United States Patent 9,487,797 (GENOMIC PLANT SEQUENCES AND USES THEREOF) - sequence listing, part 45

SEQ ID NO: 65062 - DNA, 1078 bp, Oryza sativa
aaatttagttgtaagttgatgagagagaaaatgtgtgtggggaagaaagaatatatagaaatttagttcatttgctaaacaaggttttataaaatagttgagaaggaaaactctagtgaaagttaatattaaataatagaaaacaaactaaaataaaaattaaaagaagtaaaacacattaaaattagtttaaaactttacaaatagtttttaagaattatttggtgtaatattttatgatttttgtatgaataaagatatcttataattattgtatgactgtcattattgtaagaataattatttgtgtgcggtttttttgactcatgtagatggatcggcaatggatgtacgctgatcggcggtccaaagagtttattgacggcgtgcactattttttgagagtggccgaagctaacaggcaaaggggttttatttgttgtccatgcaataagtgtaagaatcagaaggagtattctgcatccaggactattcatttccacttgtttgagtcggggttcatgccaagctataattgttggacatcccacggagagcaaggtgttgaaatggaagaagatgaagtggaagacgacaatattccggactttgctcagtatgttggatttgaaggaaatcaaacgggcgaggaggaaatagctgctgatggtaacgacgttgcggatgatcttggtcagatgttgcaggacgccagggaagactgcgaaagtgaaaaggaggcccataaattggacaagatgttggaggaccacagaacttcgttgtacccaggttgcgagcaggggcacaaaaagttggataccactctggagttgttgcaatggaaggcaaaaaatggggttagtgacaaggcatttggcgatttattgaaactcgtcaagaacattcttccggggggaaacaaattgcccgagacaacgtacgaggctaagaagatagtctgcccgttaggactggaagttcataagattcacgcatgtccgaacgattgtatcctatatcgcggtgaggagtatgagaacctagaagcatgccctgtttgcagggctgcaggaat

SEQ ID NO: 65063 - DNA, 10958 bp, Oryza sativa
ggccaatgggccttaatgatcctaatataaagtctccacaaatatattttgagttgatcaaaagacgtttttttttttcgattttgctatatctcactcgaaagattttttcttatctctcactcgattttctcactcaaatttacagtgtattttcttgtaagttacagtgtaatttatgaaacttacactgtatgtaacttttgtaagttacactgtaatttttgaatcttcacatgtaaattttaaattttgtatttgatttggtctttttcttgaggatatggtaatttaatgttcattatggtatttcttaattgcttttttctttttattatatctatcggattttaatacaaagattaaaaatctgtgtgatacgattataaaaatctttcgaaagatgtataggtactcccttttttttttgacagagaattcatcaagacgttgttgggctaaagcctggtagaaaaaaaggaataagttcacccgaggtccctcaacttaacagcgagatttttcgaagtcccttaaccacaaaaccagaaatctccacccctaaactatacaaaaccgttcactcaaggtccctaggcagtatatatgggtggtttcgctgacatggcatcctagtcagacaaaatttttttttaaaagtaagtaggacctacatgtcagccgcacgtttttttttcttgtccttctcttctcttttctcgcttccctcttcttcttcagtgaggaggccggtggcgggcggagtggcgatggcggcgtgcttccgctgcgcgcagtcggcggcggcggcgtccggccccgcggggcccaaccgccttcctcccgcgggacggcgctgtccatcgccgtggtgcacgacgccatggccgcctcgaggctccgcggcagtggcggggcggtccaagtcgtcatccggacttctggaggcggaacgtgaacactgcggcgtagtcgtggatgacggtggcgtcgttggcacgagcagcggtacggtccacggcgaggatctcctcctccgccatgcttctgggcacctggccgacgaacagccacatcctctcgccgtcatcatcctccgcatctccggtcattaccgcgatttctctctctctctctcccgtctcttttccttttctgatggctatgcaacctcctgtccgtcctctcctcgtttttgcctgcgcctttggcctttctatatcggacgagcactaaccactgattgattgattgatcagtatcagtgtcttgagtataagttaattaatcgatgagtagtaccaactaccaagtcttgatctcgagtagcagtgaatgtgatcgaatcatctgattgagcaaaaagcagcagcaacattgatgcctccgcctcgccgtccagcgcgacgacaatgtcgtgctcggcgccggactccaggaaccgcgccctcgtggaccagcacccacacccgacgaggagacactggccttccgcgtccgtcactgactcctctggtggcagcgcgggacgaggcggttccgcgccgccggcgaccgccgcatcgacctggcgtgggacctctcacccgcgcacacttcccggtctcgggttcgcctgagccttcctttgggtgtagccgacgagccgccgtcgcgccgtggtaccgccccgcagccacagcagctgtgcggctggaacagcggtggtggccccttctcctcctctttctcccccggtgagtatagatggacagactacatcggcgtcgtgcgtgcatgcatgctgcattcttggcgtattagttttgtgcatggatcttacgaaggtcgggggaggacggcgatgatggtgtgccacgacgtcgagatgccgttcctgcgggggatcaacgtgaaccggccggcaccagcggcggagacgacgacagtgaggggggcaactgtagcgaggaggaagaggagcccagcgcgacctcccccaacagcacgctctccagccggcagcgacgacgagaactgcggcggcggcggtggatctcgtgtaccgcggctggggcagggatgggagcagcagcagtagggagaagagaagagaagagaagagagaagagagaaaggagaagaaaataagatatgcagctgacatgtggaccccacatgctttgctaactaggatgtcacgtcagcgaaaccacccatatatactgcctagggaccttgagtgaacggttttgtatagtttaggggtggagatttctggttttgtggttaaggggcctaaaaaaatctcgctgttaagttgagaaacctccggtgaacttattccaaaaaaaagacaggttgaagcccatgggctggtttttctagcttgcagcgatgcacgctggttgccacatgcggatgtacaatacataggttgttgcaacgttcgcgggccgcgaacgtccacgtactagacgcccctcaaatcagtctctatcataagaaagaaaaatgaatttaggatatcgtaataagaaaaataaataaatttgactaaatataacccatggtgacgtatcgactatcaattaattaagcaaacggcttgcaacctctgattgccagctaaaaaaatccacgatatattcttgtcctaagtacagtgacttatgacctctaatcccaactacaggtctacagcgatcaaatcacttgcgccactagcaaaattgacgaactggatttactgtttataaatgaaaaccacttcgtcgctcactcgcttgtagtctccagccacacaaccgtaaaggtccacacctcttctcgcaaccacttgagccactcgcaagtctcaagccaaaatcatatcacagtcgccatggaactctcctcaacctcagcttctctcctgctcatcctcctgctcaccctcgtctacttcctctacctgcaccaggatcccaagaagaagcctcgcacccatggactcaagtcctaccccgtggtcggcacgctgccgcatttcatcaataacaaggaccgtttccttgagtggtcgaccggcgtcatgaagcgcagccccacgcacaccatgtcgttcaaggagctcggactcaccggcggcgtcatcaccgccaacccggccaacgtcgagcacattctcaaggctaactttggtaactaccccaagggcgagcttgccgtgtccttgctcgaggattttcttggccacggcatcttcaattccgacggcgaacagtggctatggcagcggaaggccgccagttacgagttcaacaagcgctcgctgaggaacttcgtggtggacaccgtccggttcgaggtcgtcgagaggctgctgccgctgctcgagtatgcggggcgccacggacggacgctggacgtgcaagacgtgcttgagcgcttcgcgttcgacaacatctgccgcgtggccttcgatgaggacccggcgtgcctcaccgaggagagcatggccgcgccccagagcgcggagttcatgcgcgcgttcaacgacgcgcagaacgccatcttggaccggttcaactcgccggccaagtcgctgtggcgcatcaagaagctcttcaacatggagcccgagaggcggatgagggattcacttgccacgatccacggctacgcggagcggatcgtccgggagcgcagggagagaagggaggcccggctggagcgccgcgacgacttcctgtcgcgcttcgccgcgagcggcgagcacagcgacgagagcctccgcgacgtggtcaccaacttcatcctcgccggccgcgacacgacgtcttcggcgctgacctggttcttctggctactctccggccggcccgacgtggaagacaagatcgtgcgcgagatccgcgcggtgagacagtcgtcggccggcagcgagggaacgcgtggcgcgacgttcagcttggacgagctgagggacatgcagtacctccacgcggccatcaccgagtccatgcgtctgtatccgccggtacccttcgacacgcacagctgcaaggaggaggagttcctgccggacggcacgttcgcggggaaagggtggctggtgacgtactgcgcatacgccatggggcgcgtggaggacatctggggcgcggactgcgaggagttcaggccggagcggtggctggacgaggcgggcgcgttccggccggagagcacgttcaagtacccggtgttccacgcggggccgaggatgtgcctaggcaaggagatggcctacatacagatgaagtccatcgtggcgtgcgtgctcgagcagttcagcctccggtacgccggcgacgccaaggggcaccctgggctcgtggtcgcgcttacgctgcggatggagggtggcttgccgatgaaagtgacaatcagggagtaatcaaacaagcgtgatgctaggctagctggacttgtcgactccatactttatgtgtgtatcattgctctcgcttgtttggagaaataaaatagaactggtgtcgtgctccggttttttacccgaatggtgaatggcccacacacagccacgcttttcgggattcacgtgagttctgcggctgtgtttggcgcaccgagcgaaatgagatgggcacgagttgtcggatataggattgcagatttgcaggagaagctatttgcacgagttgatgggctgcccatggcgcgcccacatcgagcaaatttgaatacttcgtctcagccgaaaagtatgccgtggcggagcggtgttggaactggagacaaggccgagcaactgatacaacccctggtgctcggtgttcatcggttcatcctctcgccttccccgctgatcaatgatgagtgggcaagaatctggaacgtgtccaactcggttggccgaatcggtgagcggacttgcttttttttccgaatgcgcaaaagggtgagcggacttgtcttttttgcgaacacacaaagatgagcgaacttgattttttttcttgattccactgtggcgtcaagtttgccccatcacacggactaccttttgtctttgtttgtcgctatggcctcgatagaatctgctaagagcaaggtcaataatatagcccgttgttggctttaaaaaccagccatgtcatatatagtaaacaatataactaatgtctataataaaaatactataacacgaatattttattgtttcatgggacccaccaccttctcctaccggctacctcccattctctttctctctctttctcccatcagttcatgtcttctcttctttgtttggttcttgagcaacagagatggcggcggggtggaaaatagcggcggcggacgcaggagatggcggcggccgtgcggcgggcgttggagacggcggcggctgggccgagcggcggaggcggaagagggcggcggccgtgcggtgggcgtcggagacgacggtggccgggccgcgcggcggaggcggaagagagcggtgggcgtcggagatggcgtcagccgtgcaggcgaggggtgacggggaccgtgcgacggatgtgggagaccgcggcggccgtgcgtcgacgccggcgaggctgagggcggtggtccagtggccgcaggagttggcgacgaaggcaggcagcgcaagcatctaggcgagccccacgaactcctcgaccggcacgtgcagtccggcgacaaattagtcgtcggctcactctctctctctctctctcttcccctctctcctccagatcatcacaaaatcttatgtggaagcagtaccgccggttattgtacctgctctaaggggataagatgcaggtaaagctaatgggcggcgcccgcccctcccccctatacggctatacactccttcctccttcccttcttctcttcctattacagtacactataaatttttttttaaaaaaaataaaagttggaaaaatttatgtatagaaatactatatataaaaaattgaatttaaattcaaatttgaaacaggtatgcagacttttgacttataaactttgggtctataaactaatatttgaattcaaattcaaatttgaatcgggtatgtaaacttttgacttataaactttgggtctataaactttaggtgtatagaaatactatatatagaaaatatttaaatttaaattcaaatttaaaacagatatgtaaacttttgacttataaactttgggtctataaactttagatgtatagaaatactatatataaaaatatttcaatttaaattcaaatttgaatcggatatataaacttttgacttataaactttgggtctctaaactttagatgtgtaaacttgaggtgtacaaacttttggtgcacaaatttactaaaataggaaagtaatgcggtaccaaaaaagaaaccaggtggagggaggagggaccgaaccctgatcgctaggggcgatcgatcgccccttagcaatctcgataagatgcctcccacatcacagctcttagggcaacaacaatgtatatagcaaaagtagtccatatagatagatccacttatacaaactttaactattgtaacattcacaatgtatatggatagcaaatagtagtaggaggagagaagaggtagagacaaataatatattttattctctatgggcagcccatatgcttatgagtagcttttgttatttctttgctatggactagttccacaatgttactaggtggctgaaacaaatattgtattgcttatggacacttttagactatattgtggatgcccttacagaatggtaacaacccgacagtgtccgtcacagcgtgggcctaagaccaaatagaaatttcatcaaataataaatacaccaaattatccttatttatgcatccaaattaacacagggagacccatacgtggttcgaaattctaatacacatatagtttccatgcgagaaaattgtatatctaccatcgtataaaatgggattcgctcaaataccattgtttaaatgggtttcgctggaataccatcctcaaccaaggtgtctttgttcaaataccatcccagacgaaaatgccccatagttcttcttcctctctccttccatcccatcagctgaatagttcgccggcgaccaccaccggctccactgcctcaccgccgtcgctcgtgtcatcttggacatcgtcgcgcactgcagccccgaccagactcaccagccgccatcacgtgctcgcgtggtctcggctggccaccgtcatgcgccgccgcccaaccccgacttgtcgtcctcgccggtcgtggtcgcggtcggtgctgccgccgccgcgacgagagagagagagagggggggaggagacgccccgactcgtcggccgccgtcacgcgccgcctcgcttgtgtcgtctctgccggctgccatcgcacgccgccaccctgctccgacttgccagccaatgacgacatgagcgacggaccgccggcgacctattcagccattggagggagagagggaggaagaagaatagctaaggggcattttcgtctgggatggtatttgagcaaagacatcttggttgaggatgacattccagcgaagcccatttaagcaatggtatttgagcgaatcccatcttatgcgatgatagatacacaattttctctttgcatgcaccgcaaactgctatctatttagcactgccgcattccaaagtacacactcctttcttcccttttagtagcaccttctcttttcatatgaaaagtttgagattttgaattgattttttgattcaaaataaaagtttgatgtcacagttgtatgatttgactataaagtatttgagtttttaaatgaaagtttgattttgagttgaaatttttgtaattcaaaataaaagttatggggccatggtcgaaagtttcgtatgatttgagttgaaatttatattatctgagccgaaagttttgtgaaaatgctaataaaaggaaaaggagtttataatgggaacatgcaaacaatgtgtagccacatgcaatcctatatactccttccataaaaaaaatgaatctagaattggatgtgacttatcctattacaacgaatatggtcataagtctagttataggtttattttttatgggatagagggagtagcgcaagggaggaagatatacttaaaagtttattagccgtgcaatgtagatcttgaaagaagacattaatgagatgatcaacaattgttatcttgttatacatggtgaaactattaatttgacatatgcttcatatcaaactgttatttcggtttatattcacgccctcgtgatatatgctcaatgggaagtgactggcgtgtgctttgtgtcacgcatagaaaaatcaatatttttttaagtacataagccaaacggaaaatgaatggaattgacctaagggaacattgaaaagctaagcacgttagagtagttatttacctgcaggatttttttatacttgtttgtgcccacaagttaatgaaatacatctatactttttaaacatatttttaaacatatattgccatgtgattatatgtaattgatttttggttaagatttattgtgtccacacaatatcttataattgtactttccgttaaatacatttgatgtacaacatgaattgaattaagctcaaatgcatagattgctaatataaaaatttgaaaattattaaataaaataaaattgcatgtagcgtttagcatgggtatattactagtcatccaaaagaaaaaacaaattcactcacgtgcactcctttgtaattggcgggaatatattctagttacttgaggggatgacccctcgtataccttttctcctaaatgcactgctaataggtttttaaaaaaaatctttaaaaagtaacgatgtagagtatattgacatctatgatgcatacaccaaaaaataatcttaaattcgatctacaccttgaaaaaaaaagataataatctccaatttctacagcttcagaaaataatctccaattttcatgattagcaattgttgtatatatttcttcctcttcatccgatagtttgctaggaccgtcttcttgaaaattaaattgtccattaatgatatatatataatgaattgctggacgaacaggtggtgtgaattttggtggtatggaggagaagataatcctgtatcttccatgtccaagtctcctgcagacatctttcacagcgcttcctaaatcaaattgaaggatctgatcgagggttgcatagaaggaattcacaagaccatgatctataatagtttggagagatatttcttcatggttgtatgtgggtaggttccggaatctttggagatttatctcagctttgagaaccaggaatctataggatgggtcagagattgcctgatcatctagccttaagagagggagcatatatatgattactcgtatggctgggtttctttctcttccttctaagagatcaaagaaataatcttggagtccaaggaatattttcatttgtctctccttaaacttttgccaaacaagatcgaggatgtcttgcccaaagcaagataaagtttgctccgtcttgaagcttaatctaggttggagattttcgtatgtggtactcatgggattttggcttttaagtttcttttggcaagaatctttgtaggcacaagatctacatggtgcttttggctgggtccggagtatatattgtggaaggaatgaattgggatgattatgcagtatgtatggtgtttggggaatggtatcatgcctttttgtggatgatgatggtttattatgtggaaaagattgcaataggttattgatatttatgtggaaagcaaccatgctcaaagcaagatctgttgagatcaaaatcttatctgagaataccttggtattcttatctgttgccatagattgttcaacttccatgggaagtttatcttggccatcacgggatttctcctcgcgataatctagtaacctctcctcatgatgagggatatcttgtagtttagcccttttttctgttatcttttgatctgagggcacgaaatttttgaaataatatgccaggccatttaaggcatgagctttttcttttttgttttttgcctgccacaagaggtttaataacccttgttgtagctctgttactctgaaattgtgattaagtcgttctccatggcctctgggcagttggggcagtctccatgaactcatattcgtgaaccattcagacttttgtgatgccatttccctgcatatatattcaaaatttttagtagcttttaataaatatctatcttcctatgatgtcttacctggcaagtccatagattttggaagatatgatgggaaggaattgtcatgtagatatattgtattcacaacttgttctcttttggtctgaacaagctggtcaagaatctcatctgtgttagacgaaaatcttaggctcacctgtttgcccattatctcaaattgaatatcttcgtttgtgacaaggaagggacgaatgagtgataaaaacggtgttcctaaaataacatcttgcttaagatttttaacgagtagaaaagatgttttaatgcaaacttcagatatgcaaatatagatttcagggatttgatattctactgttaaaagtcctccatctgccccacgaattctgtgggcggctttacagaaatatttatgagggataataccttctcgaatgcaattgacatcagcaccataatcaattaaagtgatatactgaaagtaggatccgtctataaaacgatacataacttctgtgtaccatttttgcttcatatatttttgaatggttccaacaacctgatcatcttcttgaattggttcgtccttttcttccatatggaatccttcttttaattctaacatgtatagacgctttcttatttcttctcaat

SEQ ID NO: 65064 - DNA, 1598 bp, Oryza sativa
aataaaaggaagcgaaaggaaaggagaatctcggcgcggcccccgccctcttaaatactacgccgccgcggccgcaaaagctccgagcacatagcacgcgcgcactcgtctcgccgcgtccacacccatcggctccaacaccgacgagtagctcggtcgccggggccgccgccgcgcgcgcgcgccaccgtgtcgcgacttcctccgtgaccgggccgatcgatcgcgaggcgcggcgcggcgaggccggcatggcggcaccgggagatggggaagagaagaaggccgggagcgggaggaacaagcacgggttcccgcgcggcttccgcttcgtgccccgggaccaggagctcctcgacatcctcgacgacaagctccgcggcgccccgctcgaccgcgcgctcgacgccgtcttccacgacacgcggatcctcgacttccaccccgccaagctctacggtagccaccgcctctcgatccctctccccctctctctctctctctccttcttcttcttctccggcgacgggctgggtgggtgctcttggggatttgattttgactcgggtggattggactggtttggggcgacgcagggatgtacgcggaggacgaggagaacggctacatctacttcttcagcacgatagagttcaaggcagccaagcccaagcagaagaagtggccgcggcgcgcggcgcagggcggacggtggaaggccgtcctcggctccagccagatggtggaggttggcggcgtccccgtcggccggaagctctccatggagttctacgtcaagggggtcaggaccaactggggcatgcacgagttcgtcaggatcatcggccccaacatcgaggtaaactccccatgttgtatctccttgtgatgatcgaattcatttggtctgatttggatgcaatttgtgcgatcttgagttcttgactcgtacaattttttctctgaactttcgtttcgccaaggttgcggatcttgccgtgtaccgcctacacaagctatggacgaacggcgaggagaagccgggagacctcgccgcggacgttgccaagagcacgaaccagagtggacaagcgtcggcggcggactactaccagacttaccagaacgcggtctctcaggcgtatgcgtatgcgccgccgtacgtcctccagccaggatggagccaagggtacccctacgatgtcgcggcggcgccaccgaccgcgccctggcctgtctgttgggcgccgccgtccgcgccgggatcctatgactgctgctacgcgtccacgttttcaaggccgccgccgccaccaccaattgctgcgagcacgctggacaaggcgccgataaccagtaccgaccacggcgcatcaacgaacacttcggcggcgacacccgtggcgaacaacaagccgccgccgccaccagttgctgcgacagcgaccacgctgggcaagaagggggagggcaagggcaaggcgccgacgaccaccagtaccgatcacgccggatcaacgaacacctcggcgccacccgccgcgaactaccagccgccgccgacgacgactacgccgccgctgcagggcacgcagcac

SEQ ID NO: 65065 - DNA, 4874 bp, Oryza sativa
gccccccatgagccgagtccgtatccgtccataggaaggcacgtcgcttcttgtcaatagctttaataacttagactggaaggccgattgccatagacacatggatcgcaatggaggagagaacaaactagaccaacacagagcggctagccagagtggtgagtcgtcccttccgtgggggagggggggggggagtcgatgggaagctttatccacaagcggttgcagggctgccttcaacaacatgcgaacagacaacgtaatgccgaggtaggtgtaaggaaagtcaaaaatcgagcaggaaagcaggactgaaccaactccaggtcctcagccgagcaacgcatcagagtaatcaagcatttggcaaagctgatgcgcaacccggacgctgcaccaaagacagaaaggatgccctggatgcacaatatacatacatacgagttgttacattagaggatgagtttccaatcgaaaatctatatatacataaggcttccgacaattttttttcgtccgtgcgttttttttcgccgttttccttttttttccgtgtctttttcggttttattcccatctgcttcttttcatgggttggcatggctgttgggcccgaggatggtggcccaagaaggaggaaaggaagagaggtggctgctgggcccaagtggagatagggatgacggccaagaggaagggatggcagcccaagagggaggagaagaagaatgggccagatttgacctagacttaggagagggcttttagtttgtttttactttaaattaattattaaaattatatttgtattattaaaattagcaattgagctttgaaaaattcaaaacaattctagatagtgtggttcattcatgaagaatttaataaaaatatatttagtattttattttaataataacatgttatttaattctaattctaatatatacctctatacctaataaaaaaatatgtaaggattttgggtgatccgtttaattgtcgggtcaaaaccgtggttgatatagtatatgtatcttccatgtaatcacctctctctcctttttacacctatattacttgcactgtgtctataggcctctcggaataagtctacctttttatgggcctctcctggaataagtctacttttcctccctcctgtcaaatcatatttgcgcgcaattttttttttctctaccactagcacggaccatgcacatccggttgatgaaaaatcaaaactatagtacctctttcttcaacaaattttttgttgattataaaatcttataatgaacccgtttttaatttaaaaattaaagttaattatattatgtgcacaaaaatcctaattgcagctcatgatcttttaaaaagtatatattcaagcaaattcccacggtgaatctcaccttaactaaaccgtataacaacaataagattaaaatacatttcatccgttacaacgtatgggtattttttctagtaatatagatatgacattgttgtccgactcctgtgtacgaccaaagcaacgttgaaagcttcacacccgatagatgattcagtctatgatgaatcttggtgtgcgcatgttagctgtgcccacgccgtaacacgatcggacagcaacgtcgtacatatagtagggttcgtttccaatatacttgatcatgaggtggaaccattaccatatttttttcaaatcctgttgcaacgcacgggacccttttgctagtactagccaaaagtcatgaccaaaatataaaaatgggtttacacttgaataagagttacgttggaagttgcccttctttttggagtcaaccaaacacatggagtttatcaagaataagaccgatagaaacgaagctagggattaacaccagaaagtatttaacttgatcatacatacaagaaacatgattaggaagagtagcaaaaaaaagcatatccaaaacagtgaggtctacgcacttattattgttttctatttgaactccaatttctagaattagaggcttcttctcgtgtaagcaacgggacaactttttgacagtagatgacaatcttttacgaaggagcttctcctcccgcttttcatgttctgaaatttctgcatctctaaaagtatcctcctccccgttcttcccgaattgccttctgtgctccaaaaactcatccattgataaaagtttctgagagatggaataaaacagtaacttgcatcagaatctggtttacaatgattaccataacctgttgctctcctttaacagaatatggttaaactaatctgtttttattacaggcatgctatcttctttctacttttcttttttgttgcaaatcaggccgtgctatatctgttgagtaattcgccatgtaaatatgttgtagctttactggttgctttagcttgctactttcgttattgaaaatacaaggtctgaaggcagtttatacttttagtctaagttgctgttcatggtaaaaaaaatgcattcaaagttctctgtagtttaactatatagaatgtagacattcaatttgaacagtacagtgaaaaatactgcatcactaaacacattaaatgttctatttatttcttattggtaaactcgacagtttgaattgctaaaactgcattgtctccaaaaaataacttgtagatggaaggttacctctgaatctctggtcacccagaatactatcagccactttgaatcaggcaaaccaaggcgtggtagaaaattgtgaagcagttggagcataaggatgccagagttgaatttttcacgttgatggttcgtgctacaattttaatcacaatatctacccttgtgtaatattttcatgtgagaacctccagtttttatttctgtgactaacatcaatttgtttgtcaatgcccatttacttatctgtcactgactcactgttgagctatcagcatatgataaggcagcgagtactccatgattatgatttttcttgttaatattggtcacgaaatattttcagctgttggaggcaatggtgaagaactgtggtgagtatgtctaatttaaagttgctgaacagaatagtttaaaaaataaatggttaaaattgtgaagaagaaggtatctacctccttaggttattgccactactctcgccactactcttatgttgtttaaattagcaaaaagaagtaaaaaggagtactgcatttttttaaaaaactaatggcctatttgaatacaagggatttggatccaaatgcttaggaatttgaactaaataagcaatttaaaagaagttgcatcacccaaacggtgggaggttttggtatgttaagaatttgtggaaaagttaatgtccgcattttgattaagatagaagaccgatgctcatataattttgtcaggacatttacagtgacactgtttttctgagtattcattttccgaatttacaaaattgtaagatttatgaaaaacatggaatccaagtttccaacaaatcatccatcacgggaaaaaaaagaacagatggattaaaacattaacttgcatcaaaacctggtgtatgacgattatgacaacctattgctatccataacagagtatagttaacatgttttctatgctaacttatttttttatttttttacaaatcaagccatgctatctctgtatacggaaggttaaatatacagtcccttcttgtagcaggctattgattgattccccccaccatatattttggaataaacttgttccgaggtgtgttctgtactccctctacccaacttctactctcttttcttccgtgcccacacttcttgaactactaaaaactttttttaaaaaaaatctagaggaaagttgctataaaaattatattaatctattttaagtgtttttgtagttaatacttagggccctcattgtttcgcttatgtttatgcttataagctaaatttgaattttagaacttagtttttattttgatttgtttggttttgtcatcgtagtttagtttattctacaacatttatttttgagtcactaataacacgtatataaaaaaaattactcgcaaacgatgatttttttttaatttgctaataagcgattcagatgagcatacgaataagcgagataatggggctctcagttaatcatgggctaatccaccgccccattttgtgtgcgggtgacgggttaccaaccattagcttctaacacagcctaattaagatgatgtgtatgccctgataagcccaaaaccaagaactcaaggccagtggaggaagaagaagaagaaaacagcaaggctgtagtatgagatttcacagatgtaacgggatcccagaggaagggggggggggaggaagagtattatcacctcagcgggctccgtcctcccgctgcaaccggaggagctgaagaggcgccgcgggtggtccgcgaccgcgagcgatggccgggcgaaggaggaggaggggaacgccgcctgcttgtagacggattgtctcctcccagccaaatcggtggcggtggggaagaagaagaggctggattgctcccgcgctccatggatcgaccgccggagcacgccgccggcggatcggagcagcggtgaggaagccattctcaagaaaggataaaaaaaaaagaagaaaaaccttggtttttgttttttgttttttttcttctcgtgggacgcggtcccgcagtaataaaagggaggagtaggagagtaaatagcgaccgtgtcggatacgcctcatatttcgtcccggccttgttctcctttacggccgaaaatcgtgctgggccttgtctgcaaccctggcctgtttatgtgttccttatctatcc

SEQ ID NO: 65066 - DNA, 5014 bp, Oryza sativa
ggtctttgttgcttaaggaagaggatagccacaaattgaatggatattgcaagatgttagaggcaagggtcatggagttgtatgcaaaatatgggtggaaccttagaaggagattggtgtagtagtgtttctcttttctcttttaagtgttgtcactttggtactttttttatccttattgtaaagaattcgggtctaagtactcttgtatgacgttgggctgtgtacatccattgtggatgtagaggccggattttaatccattttctaaaaaaaaaaattcatgcgttttcaaattcactgtttccatgcgatttcctatcctatttctaatttttttttctgttctgcattccaaaggatccctaaagttaggaatattctcaactaggtacattaaaatctttccacccaacacatgcaaaatatgttcatacatttttctttctcatattcttccttcttaaaactattgtattgctaatttttaaaaattatgatttttaaattagtcaaatttgggatgatacaatatatttttagtgcaccatgaaaatatagaaaagttgaggaacgttctgaaatggaggaggacaacgcaagtgcaaagtcatgcatttactggtgcattagctaatacttttatgcccagtttaaaacatattatttagctgattatctacttgattgtagggatatttttttatatgaatgctttgaataagttatctatgcaatacagtagaagaacggttttttaaatactagatgacaccccgcacgttgtagcgggacttctaagtgatcaacattgatttttccagtaggattgcgtgtgtaagaataacactgatacaattatagtggatcacttccaatcaaatatggaaaatctacagaggttgtaaagcaatgtgacaaaagaaatacatttttttgaagaaagacatcatataacagtattaataaaagctatttgacagtacatgaaaaattgcaatccttgtcatgggcacatgccatcctctttttcaactcaagatgcatgctagtaactgtaaatgtcatatgaaaacactaaattcactttaggttgctcccggaatagtgtattcgatgataatcgagttaaactcttatatcaatagcaattgacatgaaaggaaaggttgactaatgaaaaatcagatgaaaggtctagccttcatagacaattgcgtgaaaaatggtgcaattggacttgtgcattggaagcaatggtggtcatgcccatggttattaagaccggaccagtgactaaaccgttagggcactcggtttactggtttattggtttaaccggtcacaccaccggttgaatatggtttaaatagatgagtgttgcaatactaaacacaacatgtggcatagcctggtggttgaaagtcttcttggaaacatggaggctgtgggttcgattcttccacgtgacgctgcagcctctgctcctccacatgagcggtcgaaccacctccggttttgtccggttcaagcggttttcgccggtccgtttgattgccgatcttttagccgccggtctgtttgattgccgatcttttagccggacaggaccggccaacgcccaggttccggttttttcgggtcggactgttggtccggtccggttctaataactatggtcgtgcctagagtgcttagtttgcttgttacccgagaaaatgcaagccgatcttttagctggacaggaccggccaacgcccaggttccggttttttctggtcggatcgttggtccggtccggttctaataactatggtcgtgcctagagtgcttagtttgtttgttacccgagaaaatgcagtggcagttatttaagaattttactatggcacaaccatgatttatctcggaacatattacactcatgcgctttcctcaaagagcgtaacaggggtgactatcgtatccttgtaacagagtgaatgcatgtagatggatttgggatgagataaatatagtaaacaacctttctcgtgaaaggatgaataacaaattgtatgcttaaagaagattaaattctatttgaaaattcagtaaaacgaagactaagcatctaattaaccatttcagtatgcctgtgaacattcctagataaaatattattcagtagttttccacacatcttctgccagaaaaaatgaagatgtcagttgaaatcgcaaaaaaaaagttccatttgtaatgtggttagaaaaacgaaccagcagatatgagagtacataatgaaattgaaaactaattaatcataccgttcaattcaagttactatgtacttaaaaaaacacaaagccaaatcaaatgatactgtaaaatgatagaagataaacagaggagttaccaagatgattggatctacccaactaaatgtgtagaaaatacatggattatacactttctacgtccatccaaacgaacccatcttctacattcttgtgttttcaaattcgctgtttccacgtgatttcctattctatttctatttctttctgtcctgcattcctaaggagtgttgaatttaggaatatttttaactaggtacattaaaatctttccacccagcacatacaaaatatgttcatacatttttctttctcatattcttccttcttaaaactattgtgtattgctaactttgaaaaatagttacatttttcaaaattttcaaatttgggatgatataatatatttatagtgcatcataaaattatagagaagtagaggaacgaggtgaaacggaggagtacaatggaagtgcaaagtcacccatatatatttaccggtgcattagctaatacttttattcccggtttaaaacaaattatttagctgattatctacttgattgtagggatatttttttatatgaatgctttgaataagtggtctatgcaatacagtagaagaacaaaaaatattttagaagatgcattttcatagacatggaacaagtaatccaccacaataatccgagatgaagtaattgtaaagtattgatctttagtactagttggtgccaccaactggtacaaaagatctcccgctctgaccactgggcctgacaagagtctgacaggccacaaccgggactgtggggtacgcagtactcgggtactcatggcaaggccttgggccatggagcattgggtggaccgagtgtcttagggctatatggtttacttgtaatttaagaaagggattgaaaataaggtgatcaatcttatcccatgtaaatagattgtaggtacacaaattataaggaataccgtaccatatccgcccggccgaccttgtaactatataaggggcaccggggcaaactctaaggggtgatcacgctctgcatatgtgcctacgagcaattccaacgctgtgctgcgcaaacctacagatccaatctacactaactagactagagtattacctcatgctgagggcctgaaccaatataaatatcagtgtccccatctctccttaatatttcgcaccctataaattatattgctgatcataagaatcgacagagactaaagatcatatggctgggtgggctaaacaaccggtagtaaaaaataatctttactaccggttcattttacagccgatttttgccgatagagcaaagattggttctcaagtactgtaggaaataaataaataataaatttaatattattatagtatttttaaaactaatcttgttatatactccctctgtttcacgatatacgaattttggtctctccatctcttgtctctctttgttagggttatagataccacatacctaatagtagttgactaaatctcggcaggacccaccacataccatgtcttatatggaaacaatcttcggatatacgatgagttccgcataaggaaggatgaatagagttctacatgaaaacgataaggactacttggattgtatccatattgatttccttaattctacttggataaggagacacctatgggtataaatacaaggccccctaggaggagaggggatacgaaacaatagatcaaggcacaagatcaacatacaagtcaacatgcgccaagacaagatgccggagatcgacttcagagataagcatggctagtcccctacggtgtctacggatactgtcaggagagacatagcgctgtctctgatctcgccgggcacagattcgaggaggaagactaccctgttgtcgactacgtgatgatacttcaggtcgccaagtcgacaacagttagataggctaccccagatattgtactggtgtgattatggtgaataagagcaacgaccagtttcggccaacaggatgtagggttattacctgacaattcaggggcccgaacctgtataaaaatcctcatctctgtctcttttacctcaatctcgcatatatcctagtaccaacgatccccatactatgcaaataccagaatcgcgacatcaaacgtcaacactcttgtctagaatcatcaacacacatataaatttggatatagatatgaagcacatacatgaatacatacataaatctatttaaaatatgaaacatcttataattaatgtgaaatagtgggagtaagttgttttactccattcaaactaactatttctgaagtttaaagcttaaccttgtatgaaatattaagaattatagaatcggaggaaatatggcttcaaggcaatatagtacataattagtgcacttaggctgtggtctggaaccttgccttctgacagggaaaataaagcaagcgaatagagcgagattaactaagtattagcctaaaaacttgaaaaataaactaatatgatttttttaaaacaacattcttatagagaaattttgtaaaaaaatacacggtttagcaatttgaaaaccgagcgcgcgaaaaagtgagaggtaagttgggaaagaagggggagcacacaaccttaaatggttctgtt

SEQ ID NO: 65067 - DNA, 1208 bp, Oryza sativa
agactccgactccgatgagtcggaggaagaagagtcgttcgccggagacgacaccggaccgggtggagagtccggcagcgagagcgacacggcggaagaagcgcgcctcctcctccgctgcccggcggccaccacacccgtgctggcactgtgcaattcaagcacctacgacaacgacaacggcggcggctgcatcgcgatcgacgcgccgaagctacgctccttgcacaacctcgagtcctcgtcgccggcaaggcgagacgagagccgagcacctccgcactttccccgacctcgagcgcctcaagctagtaacggaggcgcggctgcccgctgccggcgatgaggacggcggcggcagcgatcgccaacctactcgatccgttgctgcccttctcttcgagacctcagcctcaagctcgacacgttgcctacaccatactcgatgtcatttcatgcacaattaatttcaacaagatttcgacaagtccattggtcccttcacacgccggaaatggatgccggcgacggcggtttcattatcggcacggcagcaatggtgatcgtcatgacgacatccccgcgcgttgagtgaacgatcgttcacctgctttgcacagcagtctgagaagagttagcctcaagtttcagatggattcacccgacaactttggagctcggcttgtcagattcttcgctcaaattacgctatggttctagaagaaatgtgcatcgatagtggtttgtactccctccgtttcaggttataagatgttttgacttttgtcaaagtcaaactactttaaatttgaccaagtttatagaaaaaagtagtaacatttttaacccaagacaaatttattatgaaaatatatgcaattattgatttaatgacattaatttagtattataaatattactatatttgtctataaatttagtcaaatttaaaaaaaaccaaagtcaaaatatcttataacataaaacggaggaagtaataaacagaggtctacaatgaaacaaatgtggcagcagatggctcatccaagatttctctgaaacaaaagaacttcgttgatggttcgtcattggtcttctcaagaactcatatccaggtaggagtgaccaacaagctttatggtgttaccacttgaaatggggaagagtagtatggatgatttaagtttgatctgattctgatgtggaat

SEQ ID NO: 65068 - DNA, 715 bp, Oryza sativa
attcctgcagccccacacaacatggtgcaaatgtgcaactacttgtgattcatgaacaaaaacattagaatgcagttaactcacaagaggtgtcttgatgttataatgttgaagtagctttccagaatgccttgtgtcttctgatagtatgacatcagcacatttgaggatacgcaatgccctgcagcaaggaccatccaagcttaaagctaggagcatgtttcaggaaaggagcacacgctccagttacagcctattactacatggaggtagcctcaagttcagccaaaacaactatgttttgtttttcctttttcttcttctttttttttgtgcagaacagaaagcatgccctccctgatattttcctcatggtaaaaagtaaaggggattgataaaaaataataataactgatgctaattgtgctatcaaacaattaaagtttttttttctccctgtagagattttagcagaacattgctctatttcctcttttattctaaaagaagtgctgctaatcagctgattgcctattcacaaattttgttaagagtttacaacaattgtataatcagacaagtcccaatactttcgccttttctttttaagtaaaacggcataccactgtcagttctattaccctggtatacccttatgaatcactagatattatgacatagacatcaaaattcagaagatatttcgtaggcgtca

SEQ ID NO: 65069 - DNA, 3738 bp, Oryza sativa
  unsure (1)..(3738): unsure at all n locations
gcggctgagtcaatgtgggacccacatttaggatgccacgtcaatctctctcccttcctactctctctctctcctcatctgacgccgcgaggagggcagcgccacgacggcggccggcggcggagaagcggcgcgcgggcggttggggagcagctggcgcgtgcatctgcccatgtcaaggggatagcacggcgagccgccgcccatggcgagcacgccgtcgaggttggagggcggcgcggtggatggcggagacggggtgcggaggacggcgagcaggttggagggcgccgggaagggcggggacggtgcggcgagcagcgtccccgagagggagtcgagttcggcgacttcatgcaccgccgctccttcttgccgtcacttcactccacccgccgctgctccgcctcgccgtcgctccactccgcccgtcgccgctccgctccatcccaccaacttcgtgcgccgccgctccacagcagccgcgtactcctgttcccatgtgcgactcctcctcgtcctcgtcctcgtcctcgtcgttgttgttggcgttggccatgggagaggggaggagagcgcacgcgatactgttcccgttcccgtgctcagggcacatcaacccgacgttgaagctggccgagctgctgcactcgcgcagggtgcccgtcacgttcgtcaacacggagcacaaccacgagcggctgcggcggcggcggggcgctgcgtgggcgggacgggttccggttcgaggcggtgccggacagcacggtgaggctgtacctgtcgttgcggaggagctgcgcgcgatgctggtggaggttgcgaggagggtggcgagcgacggcagcagcggtgtgctgcccgtgacatgcgtcgtgctcagtggcctcgtcagcttcgcgctcgacgtcgcggaggagctcggcgtgccggcgttcgtgctctggggcaccagcgcctgcggcttcgcgtgcacgctccggcttcgccagctacggcagagagggtacacgccgctcattcgctcaaaggtccgtttcgtccggtgagcgatcactccgtcgcacgtgtatgatcgatatcgccatggatgtgtttgttgtcacacgtgcttgcacacttggcgcgtgctatattgtatgcgatggactaaatcctttgcttttgcttcccctgccatggcagacgagagctacctgacgaacagttacctggacacgccgatagactggatcgccggcgtgccgacggtgcgtctcggcgacgtctgcagcttcgttcgcacgctcgacccgaccagcttcgcactacgcgtggacgaggacgaggcgaacagctgcgccagggcgccggggctcatcctcaacacgtacgttcgacgacctcgagtccgacgtcttcgacgtgctcagggacgagttcccgcgcgtgtacaccatcggcccgctcggcgccgaccgcgcgaacaacctagtcggcggcggcgccgctgggctgagcctgtgggaagaggacgccgcgtgcatggcttggcttgactagcagccgaccgggtcggtgctgtacgtcagctttgggagcctgacgtgatgtcgcccgtcgagctcgccgagctcgcgtggggcctcgccgacacccgcgcccattcctatcggtcatccacccaggcctcgtcgccagcggcggcggcactgatccgctcccctctgctcggctgatcctttgggagagagtggatacatacagagaagagaggggatgaggacagttnaggagaggagaggagagaggaagagaagtggagaggggagggaaaaggaggctgacacatgggtcccacgctgaatcagctgccacgttggacaaaacaggagtcaaaaccgccgagggacctagtttgcactagttttgtaagttggaggacgcgttgtatctggttttacggttgggggatgattttgtaactcgatgacaagttgagggaccttcggtgtactttttcccagtgataatagcaaagagtaaagttcatcaccggtctctaaacttgtaccgttatgtcatcccggtctctaaactcgcaaatcgaccgttcaggtcctcaaacttgttcgactgtgtcatcccggtccataaacttgcagatcactcgtttaggtcctctaacttattcagttgggtcaccccggtccctaaacttggatttgaatatcatctgggtcaaatatgacggtctaaagactttatatttaaaaaataattcataactttttcatgtgaactctaatgaagacaaactttatatcaaacttgtagccctcgacgcgatctacaactttgtagttgaatttttttttattttaagtcattttttgtcccaaaatgtaattttaaaattaaaatttcaaaatctataaacatgcaacaatattttgggaccctaaacggttttaattcaaaaacttttcaactacaaagttgtaggtcacgtcgagggctacaattttgatataaagtttattttcattagagttcacatgaacatgttatgaattattttttgatataaagtttttagaccgtcctgtttagggacctgggtgacacaactgaacaagttggaggacctaaacgagtgatctgcaagtttagggactaggatgacacagtcgaacaagtttgatgacctgaacgatcgatttacgagtttagggatcggaatgacacaacggtactagttcagggaccggtgatggactttactcaatagcaaaggtataagttcactttaggttcctcaatttgtctccgagttcgaaatatgtccctgtaccacaaaaccggatataacgcacccccaacttacaaaatcgtgcaaacgaggtaccttggtagtattgtccccggttttggctgatgtggcgcctacatggtgctcctttgactaagtcttcgtcccaacgtgacattgatgtgatgattacatgataattcgattgaaaaaataataaaacccgtgggacccatatgtaagttacacacaaataataaaaaatggcatcctcactactcccctcttctctttatcctctctctctccggcgtagcgggcggcggccagctaaagatggcgatctttagtcccggactcgtgatcccggtttgcaaccagggattaaagagggttgcaaaccgagaccattatggatttctatagcagtgcatctttttcatgagaccattcggttcgtatggctatcactggtcacacccttattattcactggtgctatttttacttattcccccatctgacattaaggactagatgaaaagacctaaatgcatctcccatttaatcctcctccccacttctccctctcatctattctctctttcatcttgtgcatccgtcaccactagccatcgcctccgattgagaaccttcctaagcaacgtcaagatacatcaagatggaggccaacagtaggccaagtggcccaaatcgacgacgagggaggccgtgcaatcaggaggcggaaggtgtcagtgaagttttcgacaaacgaggagtcaaagaagatgatgatacaatggaatggagctgccccttagcttagggaggaggaggccaaccgagtgttgcccactagtgccattggtggcttagagcaggtacaataaagattcatccgtcggcgatagtgtatccatgttggctcgcatgcatgctgtgct

SEQ ID NO: 65070 - DNA, 769 bp, Oryza sativa
  unsure (1)..(769): unsure at all n locations
ctcggacaatgaacaaggggtaaccacattggaggaggcaccaacaccatccattgaattcatagtcaattcccctaaatttcctgagaaaggtaaacttttgagaatatcagacaccaatgcacttttacccagtttaaggacaagagtagagcacctgccaaatgattaattgggtgtaaaatcaagtgccctgacccaggaaaatttagcatcctccttgcatgcatgaaagcggtcatccataaaccttgaattaactgcaggcccagaaattgcaggtgtattcttggtgcataattgagctgaaacaaaaattagaagtaaacagtatattnnttgtgcaggatataannnaattgtgattacacanatataggtagaagnaatatggntgccacttctgnannaatcgtagtccaagaggntatagtacaacaatttagccgctaatggtaatgttgtttggcataggaatgctactctttttttagattgttttactccaccatttgtaaaatctactcaaatatgtcaagtaaataaaagtttcatgattttgtaagcgtaaagaagtaaaaattaactaaatcttatattgtaaaaaagctcttgcgatcatttgggtagctaggtcacatttaataaaacgagtaagatctaaatcaacataatctttgaaaaaagttgagaactactccctccgggtgataatacttgtcgttttggacaagggcacggtctccaaaaaacaattttgaccattatt

SEQ ID NO: 65071 - DNA, 4510 bp, Oryza sativa
cctgcagcccctatttcatacgtattaagactttgaaagaccaaaccttatcatccccgtatttctaattattagttttttaaaagtcacatcaggtgctaccccttatgtcatctcttctttatttgcttgctcgatctaccactatttaacgtggtgccctccttttaaggctgtcttaataatataacaagatgggtggcccgcgcaattgcgcggttagcaccaatacaaaattatatatttttatatgattttacttaaaatttattaaatagttatcttgttgtcttaagagtttgaaagaccaaaccttatcatttccatgtttctaattttataattttaataagttacatcagttgctaatcgttacttctgtcatatccatatccttctttagttgcttgctcgatctataacggtttctattcattcattggatcttatagtatttagagtttattgtccagttaggtttcatttttataatttttagaaatctcgtcgaatgctgccattataaaaatcaaacataattatcatttttgttttttttactttctagaagttccgctaaaacgtcagcgactttgtcactatactccaatacagctcacctgctgcctcccttctttattgtcattgagattttaaaatcaaacatgattatcattcgtgtttatttttttttacttttcaaaagcccgaaccttttaaaattggatcttatagtttttataatttattgtctcgttggattttcttttttataatttttagaaatctcgtcaaacgctgccacagtactcctgccacagtactcctctacgacccgtccgccgcttattctttattgtcattgggattgtaaaaacgaatataattatcgttggaattcattttttactttctagaagtcccaccaaccataggcggctcttccattgtactcctgtacgacccgcccgctatctctcatttttattgtcattgaaattttaaaaatcaaatatgattatcattgggttttactttctataagtcccgccaaccaccttgaccggctgcttcacgacctgaccatcatcattctatttggtgctttattaatagtttttagatgtcctatcaaccgccaccactctaattatttatagacctattacttaattaatctcgtcatgtgttttagatggtcttttcttccaatagtccttatttgttatcaccaattttagttatttataaattgtattcctagttgaaatcttttttctttttctaattttagatttttttttcaaattttaattaataccgtatagtgttcttttaatatttttattttttatttctgaatttcagttgtttcaaaattgtattcctacttgaactctcttttaatttttctagttttggatattatttttattctgaattttaattaatctcgtattgggttcttatatggattcttctttcaatattgcttatttttaattcctacttgaactcttcttttcgttgtgctaattttggattttatttttatttttattctgaatgttaattaatctcgtattgggttcttatatggactcttctttcaatatttcttatttttaactccgaatttcagctattttcaaattgtattcctacttggattctccttttctttttctccgattaatgtgggaatttctagcccccatagcgaacgtggtgccttctttcaaagctgttttaataatataatagatagataaatagatagataaatagatagatgtgtatagtattagagcccagctattgtaccacatgtctcttaattcgtatgaagatgatgtggaagaagttggagccagaagcgggcggtactattaaacctgctcttataggggcatgcaagccgggaggcgacctttataagttgattctcctcttactaaactagcaatatttcacgaaacatatcatcacagttttcatgggccacgtaggtcacatcctaattggataggatgtcaaatgggggtaagctagcttgatctgctaagtgctcaacgtgagaaggaaggggcacgggagcattattgttcatacacgaatcttgatgcaatcttaaatgttaaaaaaactgcatgaaatttagggtattttcatgtgactagaaagataatatcccatgttgttgcatggatcgtagtctcacatgttcatcatggttctgcatagattatttcaaaaattgcatcattccgattcttcacttgtagtactgaagattttgattatttattgaatttagaaaaataaagatttacttttgttattcattaatttaaattctttgactgtcaaccctttttttagctccatcaatttctcaaaagtacttgaaaatcctatagcctctccctctctctctctaaaggttaaatctagtatttcaaaatttcaccatctcttctattaaaaattcttgattcaaaatgtgtattccacctcccttccattgaaataagccgagtcaaagcttcctcgggattccgcttcctacgaaacatacgttttatgaattaacggttaccaatagcaagcgatcctttcctacaaggtaaggccatggacaaaggttttttttatctaccccagcaggggcaattttaggagtcttttcaatccatcttactttgaatccgggttcgctttcactcggtcaagggttgccctttacctcgttctatggtcctttatcccctccttgctttcctagtttgtttcctttccgagacccaaaaccatgcatcacaatcagagggttaatcctccaaccagaaccaacttaacctatggatagtttctgccggcagctcctgacctcttctctcataccggcttgaagaagataagcacgtaaaaggaatgtaggcctcgctttgtagtactcgtaaaaggagctcactatcatgccgattacgagcagccgttcgcagcaatggatttggatctatatatgagaaatatcatgtggagggactattgctttttcctctaatccgatctggtaatcgaattcgcatatcccaacggtttggttcctttccttgtttagttttaaccagttccccctttgcttttgccaatcgcctgccttgttgtttttcctattcaaccaccccaacttgtgacgtataacgatgcaggtatttcagtggttttcttctgatgcttctatgaaattggattatatatggagaaaacaagaaaataagtaaaacaataactccaaaaacatgaactggtaagtaaaataatattgagcatatataaaatcaaaactcacacatacatacatgtgtaaaatacaaggggaaactattttgatctctcgagagcatgtcccgtcgtgtgcttaaaaatcatctaaacagttatgaaaaattctagaaaaaattaacgaatacgttgcctgtgactgaaagaataatcatcagcctcaaatgcaagcacctatgttaaatctaaaacttaaatcctagcggataagtttcaccactaaaattctagacaattaaactatgctcactttactcgttgtgtggggagtccaaaagggaatgagatcctctgatataagttatatggctttgagccaaaattgtctcctttgttttttgtttcacagctcaaggaaaaagcatacctacatgattttccatcacctccatcacttctgcattaattaattcctagtagaatacccccgaggttcctctagctgacttccaagaccaagcatagctcttatttccttggaaggattttaattctctatatgaaaaactctcctttttgtttcctgtatacagaccaggtctacatctctatctttgatcacctctttcaattaccttttttctggctatatttcccaaacctctaacattccagaaaaagcatttatttttttcctttgttttttggagccacctctcttcttctgcacaggacccttaattaggagagtcatcatttgtgttattcacctcttcctcatcatacacttctttctgtcccccatcatcattaccaactgcttgagtttgagacatctctatggctttgttctcctcctcttttttccatcttaattctgcaagcttagcctgggccaactctttgactttaattgtatccatgtttcatttatctctacagagttattaccaagggaaatatttgcagcaacagcaatcctatattcaactcatcatgatcaactaattggaaaatagcaaaagggttagagttacctggggcttccatgtttttcttctgcatgcgtgcgccatcatcgagggcgggaagcgtgtggccgagtgacaggcgatcgagaggattaattcgcttcgacccatcgtcgacacatcgccggcatcgtcctagctactaggagtagttttgacgacgtgttcatgccaacgtgtgtcatcgcgtc

SEQ ID NO: 65072 - DNA, 966 bp, Oryza sativa
aatgccatagtatggagtatctattttcatatattgtggcataatactttaattgcttaactgtgtaagtaatgcatggtttatcctatcatatcatatggattagccccatgatgcattctgccatatggcacatgctttctcagggcaaaagcccccgttttttttttctacaatagaagtgcagcaggacattcgattttccctcctttttcaaatacacatctttagagcactcaaattgtgttcccaaatacctcattctacagttttgagatgaccttttatcatctttttttgtggtatatccatccatccctttacctatttccagtgttgtttataattatggactagagcacacacaccatccgaaaaacaatgagatatcagatatattaaggaattgagggaatacaagctcgtggtttcaccaaagttgcacttaaatagctgactttgacatactttttgaacagctgccggactggaacattatgtggagtctctaatgaaaagagcagatgtggagtttaatgtatggattcttctcctgtgtcttatactaatttaagaagccacctctctaattttgctaaatccacaatcaccatttttatttggatgtgggggatcttggcacaatgtccaaactccaatcagccccccctcccccccacccacccaaagtacttaagactgaagtgaaactgcagcctgagtttgattgtagttgacatgaatattgtcaagctttgaatttgttatttgtggaaaaatcagtgtggtttgcttccgtgtttccttgtaggtggttgtcacccaaatgaatgggaatgattactcatcgaactctgtccatgcatttcatatcggaaaaatgagaataaagcttcgaaaaggatggtctacaaaagcaagagagtcatactcgaccacaatgaaggtacgcgtgtagtttaaata

SEQ ID NO: 65073 - DNA, 12145 bp, Oryza sativa
cagcacaggcacaagactcaagtgggcgcaacgtacgtgtaaactcgactttgacgaacgagttgatatgaacagcgacggcggcatggccctgtcggatctcggtcgagttcatcagtttccactacaaatttgtgcccattcctttgtatagcttcatggcccaccaaagaagattgacagtatagcttcgccggctagcttcagagcactgcaaaacaaatatataattaggcaatataattcatttattattattattattattattttaaatactattatctcaaatagatactaaccttgctgacatccaggacaacttgattctgtttttcgcatattccttatcctttgcttctttagctttggttctctcggcttccatagccctcctcttcgcatcttatttccttggaaggattttaattccctatatgaaaaactctcctttttgtttcctgtatacagaccaggtctacatctctatctttgatcacctctttcaatttgatactaaccttgctctttaagaatagccacatatgctaccctttttgtatcggcaagttcagccttagtctctttcagttcctcttttctctcagccataccctctttcagttcctcttttgtttcaattgtgttcttctttaccagtctcgacctatttgaacataaatgttgtaaggggatgtgaaagatataggatacatatcctttgaattctatatttgtgcaatctcgaccttaaaagcccattaaacattatacaaacacactacataaataccctataaacgctcttaaaccatcacacggcattataataaattaaagaaatcctaaaaattttgagaaaaaacaaaatattcgacctttgattttcacttaaaaagtgaacacattattttaggtcactagatctattatagataacaccgattaaatatatctcaagaaacaatctctcctcccaccctttggccgtacgtacgcatataaatacgcaacgtatgtactacctccatgcacaaatatatgacgttggttagctcaacaacatcaaacaaaaaaatatggagggagtacatgcttatccctcccctctgaccctccatactcttatatattttttaattcactataataataaaaacaattaatacttagatagcttagtaatttaagacccatataaaaataatgtaaaaatgaaaatacgttatttgaacagatctatgttttggagggcaatcaaataacatccattttttaatttatttgaactatagttttatttgtaattaaaaaagtaatttaagatttatattactcatattttgctatataaaattaaaatatataatttgaacatagtccaacaatgaaacaacaatggaacatttgaaatttagcaatatgtattgtgtcatcttaaatcattctaagtaataaagatccattaaatattctttatggtgttattaagtcaacacatgtcatattttacaaatcagagaaaaaatcttacaaatttaaagaaaaaaaataaaacatctgaccatgaatttccacttacgtcgttgacatattattttcaaacattagaaacatgtcatgtctttaaaaaatagaaacaaaatatctgagaaaaaaaaatctgatcattagcttttacttaaatagcttagaaaaaaaagctccctccacctcccttgctcacatgcacgcaacactacccaccccctcctttttggctcgagctctacgctagctattcatttgttataagctatcaaggtgaaagaggaacaactaatagttaatagttaatagaagctacgtatatgctgtctaatcttaatgctgctctattataaccaaaccaaaaatttaagatccatatgcatatactacctccgttttttaatagatgacgccgttgattttttcttacatgtttgaccattcatcttattcaaaaattttatgcaaatgtataagatataaatcacacttatagtactatgagtgataaaacaactcataacaaaataaattataattacataaatgtttgaccattcgtgcctccgccgtcgctgaccatgccgcccagtcgctgccgcgccttccgacggccagccatcgtcgccgtgagctctgccactctggcctcacctcgcgctgcgcagagccggccgcgccgcctagtcgctgccgcacctcccactagccaaccactatcctcgggggcggccacctccgccatcggccacaaccatcgcgcctatgccggctaccatcgccgcgggcttccgccacctccgcccgcctccaccaggtctccatcgcattgagcaccaccaacatcggagtcgaccactcttgatctagccgggggggggggggggggcagatccgcgttgatggggggggaccggatccgtctccagcatgaccagctccgtcgccctgccccgttgaccgcctcggccgttgcctcccacgccgaggaagagctttgccatcagcttgttctccccgccgccacctttccatccggccttgcggtttccaacggcgggctccggtggcggcgaggcggctagaggggaaggaaggtggtggcacgggcgggtagggtttccctcgagccgctcgcgtgacagcggcacgagggcatatgctttgctagctttttggttctctgaataatggattctatcttggcctatgttgttatgtgaaatggtgttatatattgattctgagcctatatgctaccattattatatttcattacaacccaaacattccaaagtttttctgccattcgatacattacaagttgatgtaattttttttctagttagcaggttcattcttactcatacctaatggaatgtaagaagcgttgtgaggacaagaagaaacactatatcgatctatcttcatggatttggaagagtttcaatgatttaatggagaaaaaatcaactatgattcaagaactcattgatcaattggaggataaaaacagatgctctatccaaaagttagtccacactaatgttgtttggatgcatacaatatattctgtcatgtttttctaaacatggctattcttttaaccgactaccgccgtgtcaagcaactaggtttgttaatttcttacacatttgtctttccccttgcccttcataatatgcatttctttggtgagtaatttcaccaagaacgagtaaatgaagagattaattggaaggcatagaattaatcatatgtattttgatgatctacatctgtcattatgtatatggtgttatgcagagtgcgatgccgacagatagatcgagttacatctgtcattatgtaacgcagacagagtaatttttttttttatgttctgaaaaaaaaagtatatctttttagttccacacacttggaattgatccaattctaagtctcctgcagattttggcagcaagttcctcatacgtcattcagtccacacgcttcaagttagtcagattgacctgaaagacaaagccaagcacgaagagtctaaatttcaaccaaatgaattcgttcggtcatcaaatgaccggtggttaaactggcacatataagtacaatctgcctgcatgcaatcttcagtcagctcttgaaagttgaataatcttcagacaccatatatacgaattctgcctgttaattaatccgtcaagaacgtcccccctgcgtaccggcattgtcgttcaggaaacttcagcttaattttcttcttctcgtttgaacagcgagagatcgatcgatcgagctgggagaaactattataagtagctcgtatcctctgaatctttggactcacaccattcctatacagcaacctagccagctcagttaagctgaaattaaacaaactgctgcaagctataactagagctaagtcacagttgtacatccgggagcagaagatgaaaagaggaggctcgtcgtcgtcgtcggcgactgcggtgacgatgacgatggtcgtgctgctgctcgtcgtcgcagcggcgtcgctgcgtgccgccgacgccgcggcggcggcgccgcgccgcctgctgggagctgacggcggcggcggcggcgggtcgccggcgctggtgtccgagagcaaggcgtcggcgggggcttccacctgcacgcacgaccccaacacgccccctagtggcactccttgcccaccgcataattgataattaaatcagctgcacgtcgtgcaattgcatgcaagattttggctgattaattctttcgtggcgttgattgaaatactacaggagtatatgtctatgtttatacatatatatgtacaacaagtatacatgttaatattgttcgtcattggttgtcgaaaataaaagtagagttaattagtttcatatatatcattgatgcacgcaacatatatagctctgaaagtagcttgtaaacattacagagtatactgtaatttattttgttcagtccatttacttgtgtgtgtatatatatacccccaggatggttacacgctgaaagagcatcagatacgaatttgtcatattcgttcaatagcgaaatacaaagctaatcttaaatttgttatggggtgtgtcatctaacaaatcatgtttaacaaatcacatttaggatataaatttaggatatccaaatacaccgctaatcatgttttattttatagaaaacatatacaacgttatcccgttggaacaggataccgttctatgagacagtacttaatacctgacacctgttgtggtactagctgcatggtagctgatacctgtgatatctgctaccagtacctgtgatacctaggacctgatacatgtgacactcgtgcaagagaatagttaatatgtctatcctgttgcaatgggatcccgttttgtagcaaccctcatctggttaagaattttgtattgagccccctcttctatagtatatccacaaatcaactcccagcactcccaaatccactctcacctagagacggcaatggaccccgttcaccgtttccctgcggtgaattcaccgtcctcctcctggtcgtcgtgtgcgtcgtcaaggcagcgatgtggcggctggcggtgatttttgcttttttttttggtttttttggttccgtgcgggtggtataacacaaccgcatgggataattgattattctgtgcggtcggcccgcccacacgcgaaaatgccgattttcccagacacccggctgcagacaggccggacaaccgcacggaaaaatcaaaatgcccgcacagaaaaatcttgtatgtagtagtgactatcgatctatcttttaaggattatgaagagttcaataatttaatggagaagaaatcaactatgactcaagacctcattgaccaattggaggagaaaaacagatgctctttccaaaagttagtccacactaatgttgtttggatgcataaactatattctgtcatgtttttctaaccatgactattcttttaaccgacagataccgtcgtgtcaagcaactaggcgtattaatttcttacacatttttgtctttgcccttgctcttcacaatatgaattttttggttaggaatttcaccaagaacgagtaaatgaagagattgattggaagacatggaattaatcttatgtattttgatgatatctgtcattatgtatatggtgatgtgcagagtgcgatgccgaagcaccagtaacacagacatagtatatcttttagttccacatagttggaattaatccagttcttaagtttcctgcagattttgtcagcaagttcctaattttttttagactttttaaattttttaattttattaatagatctttcaaagaaatattttcgagaactgaaacttttttgactatgcggccaagtggctggcgtggtaacgttgttttgccacgccagccacacggtggcgtggcaagaggctggcatggcaggacaatattgccacgtcagctgcgtgtggtgtaacaaagttattacaccagtcaggctggcgtggccaaaagattcagatttgaaaatactttttaaaaaatatattaataaattttaaaaatagaaagtctaaaaaataaaaaaaatccaagttcatcgtacgacattcattccacacgcttcaagttagtcagattgacctgaaagacaaagccaagcacggagagtctaaatttcaacaagaaaaaaaattcggtcatcaaatgaccggtggttaaactaacacatataagtacaatctgcctgcatgcaatcttcactcttcagtcagctctcgaaagttgaataatcttcgatcagacaccatgcgaattctgcctgtttaatccgtcaagaacgtcccccctgcgtaccggcattaatgtcgttcaggaaacttcagcttaattttcttcttctcctttgaacggcgagatcgatcgatcgatcgattgaactgggagaaactattataagtagctcgtatccctcctgaagctgtggactcatcaccactcttcagttaagcttacataccagctcagttaagctgaaacgatttagttcgaagccagaagcaggccggagctgaagatgaagggaggaggctcgtcgtcggctactactgccgtgatgatgatggtcgtgctgctcgtcgcggcggcgtctgacgccgccgcggcgccgcggcgcctgctgggagctgacggcggcggcggcggtgggtcgccggcgctggtgtccgagagcaaggcggcttccacctgcacttacgaccaaaacacgcactctaatggccctccttgcccaagtccaccgcataattaaaccagctgcacgtcctgcagttgcatgcaagattttggctgattaattctttcgtggcgtcgattgaaatactacaggagtatatatttatacatatatatgtacaataagtatgcatgttaatattgttcgtcattggttgtcgaaaataaaagtagagttaattagtttcatatatatcgttgatgcacgcaacatatatagtgctgaaaaagtagcttgtaaacattacagagtatactgtaattttatttgttcagtccatttgcttgtgtatatataccaccaggatgatttcacaaagagcatcagatacgaatttgtcatatttgttcaatagcaaatacatgctaatccttaaacttgtaatggggtaccatctagatccgaacttgtatttggatatcctaaatcatggtttattatatcacccgatatataaagtgcagatgtaacaacttgaacgttgttgtgggcgcgtccaggcagtttttgttttagctatctagttgagaattttgtatttagccccctcttctatagtatatatacaaatcaactcccaccgtaccactcccaagtcgactcccatcgcacccgtgggagaggaggcaaagagacggggatatattagtgttgctgcggtcatctattattgaaggatgtcggagccaagatagagggtgatcctacgagttcaatgtggtgttattgtacaatcgcgcgctgtgatcttcccgtaatatgtagtcaaacgtttggcttcaattgatggtgacaatcacgccacatcaagctcgcgagatcactctcttcatatcatacggtccatcttggtaggggagaaaatgaatcgaataatatccgatctggcctgctctgaatccgtccaaaacgaggatatgaaatgggtttatagaaattcgacaagtgtggattatccgatagtatatttgccggataatccaaaattatcaacctacataacaccatatttgttctatacaacatgagctgacttatccaataatctaactcatcaattaattctactctttagtttgaggctcctattgtctcatctcacacttacttagctgcatttttatctatactactttatgagataatctaagaaatgctgttgacaagcgtccaaatccaagaaataccatcaataagtgtgagtttcaagaaatgccatcgtacaaatgactttgtctcaaaaataccatcgtcgttagggttccgttcatctcgcgcccatccgcctctattctattaattaagatgattaattaagtataacaaatttttaatatatatttattcaatttttaaaaagcttttatatagaaagtatttgaaaaaacgtattgtttagcaattcagaaaatgtactcacggtaaataagtgagtaggcaatccaataagcgctttaattagaactcaactcatcagggagctacagggacatcttcacatcttcagttatatattcacgggctccatgttcagtcagctcttgaaagttgaatgttagactcaaaacttcgcaagaccgtcatccagataggctatcttagttcttcagacaaccatacgacgaattctgctgcctctttaatccgtcaagaacgtccccccatgcttaccggcattttcgtgcatgaaacttcagcttaattttcttcttctcgtttgaacggcgagatcgatatgatcgatcgatctatcgagctgggatctcttataagtagctctcgtatcctcctcaagctttgcactcaccattcctgcagcaacttagctaatacacttatgcacctctgcttagtaaattaattaagcaggaaactgcaaaagttacagtagtgcagaagctaagtgcagtgactagtagtgtgacatcgtcggaggcgaccggccggaactgaagaataatgaaggcgaccgcggcgatggtggtggtcgtgctgctcgtcgcggcagcgtcgttgcatgccgccgacggagccgcggcggcgccgcgccgcgtgctgggagctgacggcggcggcggtgatcagtcggagagcaaggtggaacataaatccggctgcacgaacaacgataacacacccccttctggtgtctgcccgccgaacgcgccggggccgtgattaatttgttcagctacacgtcgtcgcccgcatcgcaaaattaatactcctatataaattaattaatcagtataaattaatactcctatttggctgatgaattaattccttcttggccttgatgaactatattttttccgtaaataaaagtaagttcaggtgtgtacttgttgcatcgcgtttgatgcacgcaacacgtttaattgattcaacgaatgttgatttgttcagtatactcattgggctcttcctgtaaaagtaaatgatgaattttgttttggtgttttgttttgtgtgccccgcttgaatctgcacaatacattttggaataattatattaaggatgtcggtctgaacaaacacccatgttaaatacagtaaatacaaacgtcatctctctctatctaatctacctatctaaaaaacgagaaaaaacaaacagagacatacaaggatttgaaccgtttagacgtacacattgttatctagacatgtggccacgatcctgctttcttatatactccctccgttatgagatatatgacatttctgacagcatcgacgaaattaagtatacaacggtgaagtgaacatggcttaactagttaactagttatgttttttttaaacaacccacgtacctaggttcatgacctagactagaaatggattctcgtatttacgactaattattttttcagcgctagccgacatacccgtcaacatcgaggtgcccatggtgacttcgtcaatctcaaaatatctcaacatagtctttcggatgtgctaatagggtagggtgtatatgtgtgttcatatatatgagtgagcatgggcgtattgtgagcacttgcatttgcactgtgtgtgtttttttttaaaaaaagtatagagcgaatttactattttaccctttattcctcttcatcgatgtgtttgtccatgccgctgcgtcgccaaagccttggacgacgaggaggaccgagggggtttccgtctcccttcacgccggctcgttcgccatctctcccaagccacctcgaagctggctcactcgccgtctcccacatgccacttctcgtgaccacagtgtttagaatagaaaaatatggatctcacaatgcttagagagaaaataaatgtgggcgtgccagtgtatctaaatacacaaaatataaaacatgtacaacatatacagatacacgtgatctttattaattgaattaataagatatagttttcgtgtataatataaaaatcatgcaccattgcttgtcgttgggcagatcttgacatcagcgatgtgatcttctggttctcaggacctcgagaggctactggttattacctccataggttagaacctattggagaacctccgaataaactgcttgtgatcatctttttgtcttaacttcgtgttcttcatgcataatgataagatgggtgttgatgtagatgtgtgtgggtgccaacaacatatccacggcttcgtcggttcgtgcgccggtatcggtgacaagccttcatatagtctcgatccgcccgccattattgttcaacctcatcggtcttgaacaacgtgtaagtgtagtttgttggtgaagacatgatttgcgtagcttgaatagctcgatgtcacaatagttgcatcgagattatattagaaagggagaagccattggagaccgtccgtgttgatgatagcctaattaatcgtggcttggcacctcctacggattacgacggctctataattatgtaagaactagaggttggttgcattgaaattattacttcacgactgttaactagcattagcatatgaatctaaactgcaattttattaattatttgcatgcaatacattaatatgaacaatagcatactgaaattatgcactgccttgcaatatttgatgattatttaaaaaattaaaatatgacacactcaatttccaattgtcagttcctcattaattatttgaatagagaaaaaagtataaaatggatttaatatttacctgaaaccagcttgacctgaatacgcctgtaggtggtagctagttctggtgatcgatcagattgtgtgatccaaatggccgctagctcaggttatccgtgacgtcataggaggaaacttcatatgcattacatcatcagattaattaattgatcggtcattctatattatcccaggcaattcaacgaagtcacgattcaattcaactattcaagcagtctttgcgtcaaaaatgaaaatattcaagctgtcaatttgatcaggggctgtcagtatatttactgtacatattcttgtgacaattcagttctcaactggtatcgtacgcaaagaatgctagctggcacgtacatacatgtgcgaccgttattccaacagacatggcagtcaaccgggtcacatcatgtaaactagctgcatttaattgtatgtttagttccatgctaaaattaaaagtttgactaaaattgaaagtttgaagaaaaaagttgaaagtttatatgcgtagaaaaattttgatgtgatggaaaagttagaagtttgaagaaaaagttaggaactaaacaagggctaaaaactggatgaaagacttacaaaaaagagagagagagagaacatttgtatgtacgtagagagtctattttaaactctcaggagacttcccttggttacttgcatgttactcgaatagttatgaaaatttttttgagtagatgtattaatatgtgatattaatatcactctacaaacattcaacttttaactctataaacattcaacttttacatgtcgccacgaaaaaaacattttgattgtgaacatatcactgctagagaaaccatctttggtcggtcggccaaaatttacaatagtcctggttctaataaaaatcaggactaaaaacatattaatttagccccggtttaaaagctcaggggtactttttgacaccaacgggactaaagatcatttttagtcccggttcaaaaaaaacagcaggcggggttagacacctatattttttttagtcccggttggtgttaccaaccggaactaaagatctatttgtagtactggt

SEQ ID NO: 65074 - DNA, 733 bp, Oryza sativa
tcccaagtactaccaagtagcatcattgcgcattgcccgaaacgaaaactcgaaccaagcccaacacggtcaccaacggagaacaactcgctatagcgacgccgacgcatcaaagcatacaaacaagcaaacaaaaaaaaaatgaataaaacgaaccaaccccctttagtgccttaagaactcagagcgacacatataaccccatggattagaccaacaagccgtacacctcccagctcgatacccaagtaagtccccaaccccgccaaacccagcagaaatggggccggcgatccccgccccgcgcggcaccggagcacggccgccgccgctgctgccgcatcgcttgcatgcgcgcgagcggagaaaaggtaggagagagagagagaggaggaggaggaggagggggagagagctagggacgcggagatcaccttcgcgacgcacggcgtcggcggcggcggcggcggcggcgcaatggcgacggcgacgcggcgggggcggagcaaggagagtggggttttgtggggggaggaggaggaggaggggttttgatggccagagcgtggaacggaacggaggaatgaaacggaaaaaagaataaatgggccgtgttggaagtgggctttctagggccgaaaagaggatgtaggccttgcttggatgggccagaattctggcccatacagttcaggccttgtttggaacgggcccaatctgtctgtcatgggct

SEQ ID NO: 65075 - DNA, 26111 bp, Oryza sativa
cctggaccaggtcatttaatggtgccatagttgttaccacaagggcgtcaaaatatagactaagccattgaggcgtatgcacttcagttgagttttctacacatttggatataccagctatcactaaagaaattaggaatatgaaactttcaggaacaacaaaaatagaaaagaagtttgcagaatttatccaatcttgttctcagggctctgtttttttatggtgcatgctatgaatcacatcttttttcatgaaaagatgtgcatagccgcataggattttgttagacttgctgaagctgatagagaacaaaaacattccaatccaagcatttctgcaagtctgcattctaagagtatttttttgtaacttatgttttccatggtcaatcttcagttgtgtgggagccgtggtgggggtaatgctgcagctacggcagttttctggcaggcaaggaaaggcctgtcctacaccttagcttttgaaacggacagggataggaacgcagcaatcatgcttgctcgtaaatttgcctcaaattgcaatgtaagtgcttttgccttaaaattgcattttgtttctaacgataatgtggtcaagaatccgtttcattcacttgatgttaggaagcaagttattttatacccttttgtttgctcaatgcagattacgctcactggtccaggtgatgaagttcatgctggtagctgaatttacagtgttcacggtgtgacagcaggagtatacatgtaggctgtgaattgtgtactgtgtcagtttgtgttttcgagagtagaggttgtacactaggctttcctctttcagcatacattctcaaggcaattctttttatttgcctgccagcagctgtttgtggtgttcgtcaaacatgctgtgcaaaatgatgattattcttgagcattatatctattaacgttcgaaaagtgatagtttgcttagaaggagcttcccttgaataatcaagaaatgtacatataatcacttccatctatggtgcgtaactggtcgcacgaagtcagtggtgattgtgttgtattcaaaggatcaactattgtgttatctggcaagtgattttaatagggcgttttgccacagtaattcttctaatggagtcatttgtttgcctcatggagaattcacccctactgaaaaccttgtcctgttgaactaatgctgtatatgaggcattctgataaacccctgtaaaatcgtcctaatttccagtttgaccgttttattctgttcacccacattttcagtagtactacggcataggagtatgcactaatgtactccgtatcctccccgagacgtctgtccactgtcatagtcacatgcaagtcaattcaagtcttgagatacactaatcttcaatccaaagctagctgtactggccttttgtcagtgcacaatttggaccacatggaccacatattcacatgcctctctcaagctctcagcaaaattctcagcagtgtacagtatactcttgtatgcggtgtacttcctcgtgggtgtaaataaggcttttgcttaattccatcagaaattgctgctccactcttctcgctcaaagtgttctctcttttattttggagatgcttttcttgcccaaagttgagctcaagctcactttcatctcctgggaagtttgcacagtgccctgtatgacacatgctcgctcaaatcaacctttttctcttatgatttttcatcgtcagtaaattccaagcaggtctgtatatgttaataaaaagaaaactcgaatgaaaatgaaacttccagcctactacgtacgagtacatagtattgtgttgttaatggcaactccactaaaatggaaggcttttccagctcgatggctcaatccatacccatacctacacccaacggctagtttcgcgtggcagccgcggccaatcatagccgtccgatgctccgcttcctgaccgttgcgattcgaagccctcccgaccgttggagcggccgctccccctccgctccacgtaaaaaaggcaacgccacccgacacagaggacgcgccctgccctagctcgctatatctcgcccctcctccacgcgccgcctccaagaactgtataccaccacgcatcaatcacacgccgcacgccgacgccgattggttgatttgattgattgattgggcaagaggaggaggaggaaggggattgtttgctgctgctgctgctccagagctcgccggagccgcggtggctgcagcgctcgacggcggggaagaggggtcgcgggcggcgcggctgcactcgttcttcgcctcggtgatctccgggatcttcggccagggcgaggaggaggaggaaggggagatggcgacacgcagccagaacgtcgctgccgctccgcagccgccgcagaacagaggtgagcgaaaacagcgtgtctcagatctttggggctttggcggctgcgcggattcgagttcttgtcgtgttcctcgttagtttcctgttcggatcctgtcccaagattgggttttttttttttacacgagttgccttatctttgggtaggcttctcttccccccaaacttggtactcatcggttcattgtccagctccagcagttgatctttgttcttgttcttattatttcatttacctgctttttgattggatttctgaagaaaagattccaatttgatccctatttggtggtgttgttcagtccgacttctcaaaatcgcgaaattctcatagcgtctgtctcctgctcaatttcaggcaatgttgccgctctgggaaagcagaaggccgtcgtggccggcaggcccgacgcgaagaaccggcgagcccttggcgagatcggcaacgtcatgaacgtccgcctaccggaagggtacgtgatacgaccaatcgcttagcctcacgctgtcataatttcttctgctctttatctgaaaccttcacttgtgttcatgtaaacagcaagcctctgcagcaggcgccggccggccgcaccgccaactttggtgcccaactgctgaagaacgcgcaggcaaatgctgcggcaaacaaggtacatcggccaaccaaatccttctttcattctttgtcttgattcttgaagcatctgaatctgaaccttactgaaactattgggtctgcagcagaatgcagttgcacctgctgccgtggcgaggcctgcgcagaggcaggccaggaaggcgcctgtcaagcccgcgcctcctccgcccgagcatgtcatcgagatcagctctgattctgaccagagcatgaggcagcagtcggagggcagcgccagctctgtccgcaagtgctcgaggaagaaggtcatcaacaccctcacctccgtgctcactgcacgatcaaaggtgggttatccactgaaaatttcaaaaagaaaaaaaaaattctgcataccaatcactgacaggttatcttaagttcttaacctgtatttactccatgctaatgccaggttgcctgtggaatcactgacaaacctcgagaagtgattgaggacattgacaagctcgacggtgacaatgagctggctgtggtggactatattgaggatatctacaagttctacaaggtcgctgaggtaactgagtcgctctctctgcttgatccttcttcgatgcctacgcaaatgctgtatgtgcttggtcactgaaaggtgcaatctttcctggccttgctgcagaacgagtgccgcccgtgtgattacatcgacacccaggtggagatcaattccaagatgagggccatcctggcagactggataattgaagtgcatcacaagtttgagctcatgccagagaccctatacctctccatgtatgtcatcgaccggtacctctcgatgcagcaagtgcagcggagggagctgcagctggtaggtgtctctgccatgctgatagcttgcaagtacgaggagatttgggccccagaggtagcaacatttttagcccctttgctctgcactgcccatttctagcagggacttgttctgattggatctctgtctatgtatttgcaggtgaacgacttcatcttgatatcagatagtgcatacactagggaacagattcttgcaatggagaaggggattctgaataagcttcagtggaatctcaccgttcctacagcatatgtcttcattatgcgctatctgaaggcgggggcgtctgcagataacaaaagtgacaaggaggtaaagagccatggcttctgtttgtttctgtttaccatcggattatatttcattgctaagcaacaagtttgagcgtgtactcaaaatttcttttggtgaatgcagatggagcacatggccttcttcttcgctgaattggcactgatgcagtacgggctggtggcatccctgccttccaaggttgctgcctctgctgtctatgcagccaggctcaccctgaagaagagccctctatggactgacactctcaagcaccacactggatttaccgagtcacagctattgtaagcactacatgactcgatgacttgtttaactagcatcactgaaattctccattgagcagatatactgaactttatttttctgcgatgatttcagggactctgcaaagcttcttgttacctcgcactctactgcccctgagagcaagctgagggttgtgtacaagaagtattccagtgagcagcttggaggagtggcacttcgctcaccagcagtggaactctgcaaataaatggagattagctttgtctcgtatttcgtttgcttatttggtttagagtgcaatggaaggcgagtctgacattcattaggcgtttgcttgttttggagtcaagaaagtttggaatcttgacacgcttgctatgacttctaatggccaggatttggcctttatgtgataatacaccttggtgtatataaactgtcatctgaatcttatcaataacggttcttgataagtatgaatgatgatcgaattacatgtttgcatacaacaatctcgtgtcttgaatcgatcccatactcctcgaaatgttttaatagctctggcaacctaaaaaaactggtaatcaagtggtaccatggagatatggtttgcatctgtagtctcttgaagaaggttatagccactggtaatcaagaaacttgtgtctgtgatgtttgccaatcgaaggtttactatcatattcttggtgcctgacagtagcagttttgaaaccttagataatccatgtaattttcaactcacatataagatttataaaaatgaattaagtatagagcaagatatggttataatagagtaattcgaataaggttaaacaaatgatacattaattagactttcatcggcacattcaaaatactggcgttcatcttgatgggcatatcatctccatcagtgaagccagattacaatgcgaagatacacccttgtcgactgctctatgagaaatctctttccactcaagagcgtgcctccttattgctttcatctcagcttcttcagatgccatcagcctcttaacagcccttgcaatctcctcccttctgatcaggcgatccttgtctgtcgagtccctcaagttcactccaatcttccactcttccacaattagccggccattaattggttgatcaaagaacaatggtaaggtgagcataggtaccccagcaaagacagcttccagcgtcgagttcattccacaatgggtcaggaagcccccgactgaagggtggcacagaaccttcagctgatcacaccatggaagtatcatgcccttgttggtgttaccgacaagttctcgcactcgagtggattgttcacgaagaatccacaagaatctgacctcacttgtggcaaggcccaaggcgatctcatcaagctgagaggatgacaccgagacaaaactgccaagagaaacatatagcactgagttctcaggttgacaatccagccacgcgaagtaatctatccgtccaggagcttctccattggacttggtatgctcgttttcaagggtcatatacggaatgcagggcccaattgggtacactgggcaggtgactaatgattcaagagagtcgattacactggcctcaagctcatatatggtggtgaataggaggcactgtgcttttctgatgctagagatacatgctaggatatactccactgttctctcactgtgaattaaaggcttgagatcagataacattattgaacttgaagccaagcttgagatatagtgctcaagtctctgatcagggttatctgctgatcaaaagtagataagatcgtaagagtgaataattttgtaaactgttagcagtagatgattcagatgcacagaaacttacctctctcaaatgttagtacaaaacaaaaaaacactaagactactcaagtttggtacagaaagtggattcatcttaatagagaaattaaaaagaagcgatacctctcaagattggggtgaagtggcgatgtgttctgcgattaaaccccgactaggggatttgttgattggagagccaaaatgagaaagacaaccattttgacgacttaaaagattttgttagctgaatcacgtgagctttgttccagactcgcagtaatggatttatgtgaaagaacactaacaaattgttctcctatttgacggtgtttcatttaccacgctatattcacacctacaactgcctatattcaaccacctttttgaacgaattaaacccaaagcactcaaaacacttcggaatgtgcgtataagtaacaaacaaagctaagtgtctgcgcgagttcattccgcaccttgtatagtgtatagatttcgatgatctcacattttttccgcaccttgtcagctctgcttcagaaaccttgagaccgcccaacacctcttcaaagaatgtccctttgtgcagcagatttggactgaggttgggcgtcagatcaggccacggcgcttccaagactcatcagaggacagtacactgcttgactggtggcatagccaaacaagcaatgcagagaaaattcagaaaaaaggactacgctctgctttcctgacggtgctctgggaaatttgtacggaaagaaacaaccgcatcttccgaagcacagagtcgacacagccggcgattgcaagcaagattgtggacgagatgcagctttggggaatggcaggcgccaagggagtgcagaatgtaatatcgcgagagtagttcttttatcaccttaatgtaggcgggaagtgtttttcaagtactacaccgcaccccctgtacagtgtttttctaacctctctataatataaaaccagctccgctgggttctttcaaaaaacattttttctttacccctaggggttgtattttctcgtgctatattcaatgaaaaggcacactaatgctatttttccgttcagaaaaaaaaaacaaacaaacaaagcaagaagtaagtaacattgtattcacagcaccgagtaatagccaacatatgtctctcttggagccttatctagtaaacaggcagaaatcagattcagtaaatctcctaactcatcagttcatggatgtaacaatgtgggtaaatctctaaattgattcgtatgtgggtgattcagtaaaaaatgagattcaggagagggtaagcttgacagtaacaggcaatggaagcaatgaagagacctcacctgttgtggcaccggcgaccggctggtgcggcggtttagcgagccacgacgggaggctgtcgaagtggtagtaggcggagaagaacacggcggccatggggaagagggagcagacgggcacgcccctccggttgccgacgtccacgacccacggcacgtagaagtcggccacgaacgccgcgacgggcgccgctgtctcctcctcctcctcgagccggagccggtcgagcagtcgctcgaagggcgcctccatcctggcgccgacggcgtcgaggaagcccgcgtggtcggcggcgcggccgttctcggaggggatgacgttggggatggcgcgcagccgcacgccgggcggcgcggaggaggaggagaggaggccgagccactcctcggtgactacgaaggtgaccgtggcggcgccccgcgcggcgaggagccggctcaggttcatcatggcgttcacgtgcccgcgccccggaaacggcaccgccacgacatggcagcggcacggctcgtccccggcggcggcggcggaggtggaggcggccatcgcgctcgcaatctctcccctgttgtggctgcgtgcgtgcgtgcgtgcgtgtggttctcgctctcccctctccctttgtgtgtgccggcgccacgctgcccacacacgcatgcccacatgtgcacgtgtcgatggatattgatacgatcatgtgtgatggcatgatcataatataacattttgagtaattctcatttcggatcatatttcattactgatagtttactttaaaacatcttttaatcgacgttcttattttggacagggtagtcttgttttttctttttcacttttgactaccgaccctcgtctcaaacatatgaacgattgtttgaacaatctagaatacgtcgattcctactcatcaataaactcttaaatctcacagctatatacaagttatttctttttcatgtaacaagttagatgtagataattaaaattaaggatggtctaaaacaccatgaaaataaaaatacccaatccaaaacaaaaatattggttaaggaactattcaaagcaaaacattgataataaaatattatttcgtgaccttgggtaacagatcaacagaggataggcggaaaagtatcatttttcccgcctattctaagaacgagatgagttcgagttgtaaagcccaatatatggtatggtattttactatgagattaggactggcttatatagtccccaaacataaatgtggagttataatcttaaccccgatggtgcacaggaagttactacaatacccctatgatgctagaaacccacattgatgtggtcctccagagttcctgccgctagtttgtaagtgtggttggagcggcccagcgatatcttctcgagaaatattcctcactagcaacgtaaccttcaagcttcatttgccatgatcgaatagtacatttctcttgcagtgggctcaaatattttcttttccgaacaccggtcatttagtatttaactgtcacattaagttagccgcaagtaaaaatcaggttggtcagtaaaagggtatctgccataagtaaaagcctcttaggctggtaatctaagagagtgtttcgatagaacagggatgatgtttgcctcgtacaacagattacctaaagtaaaattttctcttccattattctccacgtggatactgatacacaacaagcattcacgctagtacatttatttacttttttggtttaattcacgctgttctctcactggaaattaagtctcccgtcggcgagatctttcacgaatccgttcaacgagcggcgcgacgagccaccgtccggtccgtcctgcacggcgccacggcaagcctcgcgcagcagcgcggccctcctcctcatctctcggctctcgccgtcgtccggatccatcagcctcgccgcggcggcacggatcgcgtccctgccgacgacgacgccgccgccgtcgtcctcctccctcctctgctccgacaggttgacgccgatcctccactcgtcggccacgacgcgggcgtccaccacctgatcccagacgacggggagcgcgagcagcggcacgccggcgaacacggcctcgagcagcgagttccacccgcagtggctgaggaagccgccgacggagcggtggcacagcacgcccagctggtcgcaccacggcaccaccaacccgttgccgccggcgatccgtcgcaggtcaccggcgctggcgctgtccctggccacccagaagaacctgaccgcgctgtcgcgcagcgccacggcgacctcctccagctgcgacggccacatggagacgacgctgccgaacgagacgtacagcacggagcgctccggctgcgcgtccagccaggcacggtgctcctcgtcgtcgatcttgccggcgccgccgtccagcggcatgtccgagattgaaggtccgactgggtacaccgggaacggaaccgcctgcgtgattctgtccatggcgcagggttcgagctcgtagaaggaagtgaagaggacacactgcgctttacgcacgttgacgaacgcctccgttgtcagcttcattgaccgttcccaagaccggaagatcttgacgtcagagagcctgactgatgagcagcctgggacatattgctccaaggacttgcggcttaggtctgcaaagaaaagaagtagagcatataataagttatgcaatgttaggccctgtttagttgcaaagtttttttttccaaacttccaactttccatcggatcaaacctttcatacacacgcaacttttcagtcacatcgttccaatttcaaccaaacttggaagtttggttgaaattggaataatgtgacagaaaagttgaaagttgtatcaaaagatgcaattgcaaatatgcatgatgataggaatgctttagcataagaattttaaaaatgcattgtgactattagttccatacttgtatctttttatgactgaaaactgaaatatgtttcatccaaaaaagggggaaaagaggaaacttctcatgtactagaatcaaatacaaatatattgtggaataaatcactcattttccattattttattgataacaagtacttgtagtcactgaaaaagcaaaggactttacttactcaggacacaccgacaaagaaatataaagtttatgagaaagggttgtgcataataagctaaggaagggctctgtgtttgtgacctcatttaatacaagtaaaaatctctgttttggcatcacggcagtagacacgtttcagcaaacattcctaaagttctttcgactgcatctaacttcaacacttatgaacctatgaaaaagttaattgatacaaaatgcattttggtttagttatatccaacttcagaacttatgaacctgtggaaaagttgactgataaaaaaaaatgcattttggtttagttgtcctagtaatcagattatctacttctttggtttctccgcaattctacattttaatagtgctgtaggggcaactaatttatcatttatggacaatgtagcagaataatgttttgacaatggtgtacttcccaaaattgaggacctcaaagtcaaatccctgtaagtttcagcccctatcttcattaaaagaaggtgcagttttcatcttaggccttgttagatccaaaaaattttggcaaaaaacgtcacatcaaatgtttggacacatacatgggatattaaatgggaaaaaaccaattgcacagtttgcatgtaaattgtgagacgaattttttgagcctaattacgccatgatttgacaatgtgatgctacagtaaacatttgttaatgacagattaattaggcttaataaattcgtctcgcagtttataggtggaatctgtaatttgtttttgttactagtctccgtttaatacttcgaatgtgtatatgcatacttcaaaaaatttacgcccaaagaactaaacacactcttaggaaagaacagtaggacactatttcaattagaattcacgaagtagcagaattcactgactgtgcatttataatttgatttcagaaacattaaaacataagatgattcagttagaaattgtctagaccaaactgaatattgaaacagtatgtttggatcatccaaagttcttggaagcatacgatatcttaatttgtttcaacaagaacatacccctatatttgaaatccccaatatttgtcattttcaagagtagaaaaggtgctacacactcgaaatttgacgtagatgtctagaaattattgtggaaatctcacatgaagtcggagacatcgtggaaactacagtagtgttgatttaaagagagaaaattcaaagcgagaaaatcggagacaaggactgaagccaaataccttgctcgccctcccggtcatccaccggcggccagaggtggatgttgtagagcgcccagaagaacgtggccgccatggtccacagcgagcacaccgggatcccgcgcgccgcgccggccggcacgccccacgccaggtaggtgtcggccacgatcgcgtcgggcctccgctccagccggtcgagcagctgctcgacggccacccccatcttggcgtccacggcctcgaagaagccggcggggtcggcgccgcggccgtgctcggaggggatgacgttggggatggtggcgaggcggacgcggcccgccggcggcagcgtggcgggcacaccggcggaggccagcagcccgtgccactcctccgtgacgacgacggtgacggtgagctcgccgtccgcggccgcgaggaggcggcacgcggccagcatcgggttgatgtggccgcggcccgggtacggcaccgcgaccacgtgccgggacacggctgtcgacgccatgctaatctctatcggactatctctgctggaatttgtgtcttcttggtggaactaatataaaggcagcacagattggagagcttttgatacactgtagtacttgataagtgatacatagacccagctgtgaattgggaggtcagagcaaacaaaggagaacaaattggcttgtcatttcttctgctcccaccgtcgtagcaaccgacgatccaatcctatatgtccaaattcgcagtggttgctacatattgagatgaagagagtacaaactagttatataaggtttactttgttgagcccaaatatcgatagttatgtgaggttcactttgtgggacccaaatattagtggggtggtgcttgtgactctgtctagcgaacatttcttgcttccatatcccaaattacatgctattccggagttgaactccattgttgctcttctagtgaacaattaacagcaaaattatagcccttaagggtttattcggtttggaggggatccggtttggaggggatcgaagagtattagaggggatgtggaataaatctccttcaatctcttctttatggggattaaccgaacaaggtctaacgatgttatatttccctacagtactgccatggtgtcaccttattaaaactgattatatttaatcttaacatagtatttaatcttatattgaaaaaataatccctgtgcgttaggtgcactgtacacttagttctcacataaacagataagctataacagtactgccatggtgtcaccttaccaattacagtactagctctctactatggtttccaagcttcacaagcaacgccgcttctcttgtaaaaatgcctctagtttacttcagataagttacccaagctcaaggctgggaagtactcatcaacaaaatcaccacaaacagatcgtactagcagacctgcagcgatcatcatactttaaatgaatccactatggtcttgagaactttctccgacgactgccactgcttgtcgctggcacttgcgacgaagagcaccaccgtgttccccttggcagtcgccttcgccagattgtgagaaccggtcagtgccaatggagtctctagcacatagctgtagtactgcacctcagaagaattgcccatgcatcagagttcagaaacatttagcactccaaagactgttgattcaaatagctgcacaagtagtgtgcaagttgttagggaagtgatcaagtgaagcttacagtttggccatcgatcttctccacggaggtatcgacgagctcgtcggagtcgaaggtgttcccggtgacaaaaggccccagagaggcgattagcctctcagggctaccgatgtcctcaatcgtggcgttcggcctgttcgtcaggcggatcaacggcgaggccaccacctgcaccttgccctgcttgtcgtcctcgaatttcacctccacccacggctcggcgcacttgggctggcagtagttgccggacagaatgttggccactcgcgtttgcttccaggtgggtggcagaatgaactcgtaaggttgcacattgcctggaattggtgaacaatcatattgagtggattcaacacatctcagtatgtcacacaactaaatcaatttctccaggcagagacgacagctaaccaaatcagaagccagaagccaagcaagcacttaccagctcgaagtgcaggagtgtccttggaagtagcccggaagaacacgaacccggggttggacgccgccggcggcaggaccgcgccgacctcgacctcacgcgcctcggccggcaaaggcgccttcaggaacgccgcgcccaatgccgcccccagcaacagctccctcctgtggctgacaaccgccgcgaggggcgccggccgcggggcagcgccaccagcggcaacgacagcggcggcgctgttgtcgtgggtggcagaagagcgccccgagcaggaggtggacggccggagtgcacggagtagcggggagaagacggaagaggaggccatgaatgaggacgcgtccgcgcgggctccgtgtcgtgtctggtccgcgcgcgcgagcgccaccggctctttatccagacgccgagcgcgatatttttctctctcgcaggaaacgagaccgcaacgacccgtagacgtacgtacgcgcggctcagccgtgtcctcttgtcaaactggttgggataagataaaggagcggagcccggcaaagccgagcggcagcagagagcacagctcggcaacaccatggcgccggcagcgctagccgctcccatcgcgtccatttcccccagctccgccgggagggtcaccgccgccgccgccggcctccgctctgccaggatggccagctcacctgtagcccagcccattggtattgattgctccttcttccttttcttgccctcgcctctcggccttcttcacggatgtcacctgtctaacctttgttgctgttcttgcaaaggcgaggcagttgtgttacggcccaaccagatgttcagatcagtgctgcgacagcggaggcgtctggtggtccgaagcagcagctcagatgaaaccaattccaccaccgaagagaaggtatatccacacgaccacacgcctgatgaattgaaaaaaaattaaagcctgaacccaactgtgacgaccatgttttgttcacagacgccattcggatacacgaggaaggacgtgctgctcatcggcgtcggcgtgacactcttaggctacggcctcaaatacgggctggaggtgacgtctgttctttctctcttctccatcactactccagttcgctgcttcttggctttgacttcatcatcaagtacacttcactgacgaacatgtatgccttccctttcacatccttgccacaactgaacacagctggtcggagtcgatcccttgcaagcaggaaacgccgtccagctgatcatcgtgctcgggatgacggtggggtggatctcgacgtacatgttcagggtggccaacaaggacatgacctacgcccagcagctcagggactatgagaagcaagtcatggaggtttgacacttgttcattctagtatgcagtgtttgttactaccaagagtatgagtgactgacctgaagtttcttgctctttgttccagaaacgattggagagcttgacagaggctgaactgcaagttctgctcgagcaagtagaggaagagaagcagcggctgactccagtgagggatcagggtgttaccttcactaggaaaacggaggatcaggcgaatgccagctagaacaccttgattctgtaattagctagctctcctgcactgttagatagcttgaattaagaactagcggtggatgtggatcgtacgtcatacgaatgaccagctaatgtcttccatgtttgtgcatcattctgaaataaaaatagttggtaattctgcttatccagatttccagacacgtttatctttggataacccaatatttgaacaaaataaacatctgaatacataaattgctttcacaacaaacatttcggcgtgctccaccactcttacactctaaacttgctaataaaacagtaatgaatagataaactacttgtgcagtagaacaatatcattatttaaatctcatcagaactgcagcgaaaatttttttgttagaaataacgagataaatgcattaacatatgaatttccatgttatacttcaattgctttggtattgtgtcgggcaaagaggaatgtgcagaaaaatccagagggttctgagcaaccgtaggaagtataacatggaaattattcatcactttatctactcccaataccagggaaaaaaaagaactagatgtaatggtatatgtatcttacgaatttgattgaatgaatctgaatctttagctgacgttgatcctcagcagggagtgatcaaatcccagcatagcatgattcactaataaaaatgcctcttatggttagtacaaggtaaaaacaactgtaggatgcatgtagtactacattaaggttaacgaaatttccttggaaacgatcttgactgaataattctttgtttaaggaaaagaaatagggtacaatacttgcactgttgcctattaagcagcacggagtatatgcacttcacctgaaggttaacaaaatttccttgcaagtggtttgtactgaatcgccatttatgttaaggaagaaaaatatctatacaatacttgtctatagaaacactgagctcatgaagattaacaaaggaaatgcgatctttactgaatcacccttctttaaggaaaagatatatacatagtgctatcaagtaacactgagctacatgtattacaactgaaggttaacaaaatttccttggaagggattttgactgaatcgcctttggtgaaggaaaagatttacacattactagtgctcttgagcagcagtgggttgcatgtgctacattgaacatcaacaaaaaaaaaaatctcctaagcaatgtttgactgaatcatctagtgatgtagagagaaaatatcagataagagtagaagattcccttggatacataccatgttcttcgacaccttaatctcagagagtagatcagacgagcacttcgaccttcttcttccccttgaggaagacctccctgtcaacaagctcacgcatgtatccatcaaactccacaggaactccaccattgagcctcttcatctccagaaaccacttgctatctctcgcccagagttcctcaaacgcatctaggtaatgcacactgctgtactttgccttcagcgcatccaacaagaccacgttgatgccctctcccgcaacatacacctgccttcctcctccattgagtctctcctcaatccttcttctgaggttcccatcattgccaccaacatgaacagagtcaaaatctacttgcatccttgatatgataccatcaacaatgtccatcaagcttggcgccgtgcgtattgctccctgcggtggacggaggacatgctcagcttcgccctcgcacacattgtaccaataattccctggctccacgtccccaaatttcctaacgatcaggggatccctcgacttggagaacttggtgggcgcaaccctgctgtcctcgatgatgcggactccaagctgaccctgtgctccccacttgtcccaatcctcccagaaccgcttgtgttcaacgatcccgaccacggattgcaggtgctcaatgtcaatatagaaggcgaggcgcttgccctcctcgggcatgcccccggcgtaggcggcggcgagacagacgctgagatcgaggacgagggtgcggttgaggtagcgggcctcggcgatggagcagaggagactacgaagataatgcggcatgggcttgcaccggtcgccgccgccaaggtaagagaggtacttgcccgcggcgaactgggagcgcgagagcgcgggtgggggcggcggggcggtggcgttggtcccgccgcggcggggcttgcgggcgagggggccggagtggtattccccgatggaggtaacggagtaggcgcaggtgacggggtcgcgggcgacggagaagcggcggtagtccttgtagttggcggaggcggtggatcgggcgcgccaggccatgtcgcaggaggacgacggcgggtcgccggggacggggcggccgaagcggttgaagtggacgtcggggaaggcgtcgatggcgcggcgcatcatgaggtggaagagctgcgggtcggcgcagtcgagcgtggaggtggtgtcgcagctggcctgatcctgctgctccaggtgggacgtggtgggcgtcaaggcggcggtgggaggggagagggagatggggaggttgcggagggtgaggaagaggaaggcgacgagcaagagggcggcggcggcgtgggcggaggaggtgatgagggcgccccgccccagcaacggccggctcgggtccatccggcgacggcgacggccgacggcgatgagatctggtggctgattgtgtaataaagccccgtctgcaggcggcggacggtggtgaacttgtttctaggaagacgacgaactgttcctcttaatgggcctaacatgagtgggcctaagacgaaggcccatgatttggcccaagaatcgcatctcgtcgtggataagacgataaagcaacattgtgtggggatagccatagccctgcaccgcacctcgactccccaaacatggcgctcgccctcgtctcgccaatggcggctctctcactccactccgggaggatctcagcggcggctatcggcggcggcctccgctctcgcagggcatccccgatgggcgccgccgccaccccgttcctccggagctccttcgtctcctcctcctccacgtcatccgcctccgcctcccccgccgcgctctctgccgcggtctcggcgtcgctgaccttcacctctgcctcctcatttgctggtgagaatgtgtactttactcgttcctgattcgcttcgttctgttgctaccatttgggttggggaactagatggaggagagagttgcctgcaaagagaaagggaggaatgaacttttgtgctgctggtttcggctttaagtactgtacaatggagtgtttatactgtcagataggtagcgtgtacagttaatcagtgcttaatgtcagaagataactaaactaaactagcgattttaatgcaattgatatatttgaaagttctgatggtattctggcaatttcctgagaaatcttaaattcaaactctgccgtacttgttagctgctgtacgcagcttgttataatctgcaatgtctgatcctaaagcccacgcattcttatagttaaccatgtgctagagaattttgcttaagatgtggattccgattaagattaaaaaaaatcacttgtttacacatccagttttttagtgtaagaacgtgtatatatattcataattcagtgattagttctagatggttccatgttaggaaacctacacggctgaaagtttcttttcttcctccatgtactgtgatactgatattgtgatttccagtagtgccagatggactgtagattgtagtacattcttgcgacagaatcatgaaaacatcacaaaaactcaggaaactccactttttggagcgagcgcatgagcttaatttagtaaactcattatgaaatatatcatctaacataattatactacgaactaacgaaatcactgaatcaagaacgtttaactggacaactcaactttttaaacagttcagttacaattaatagccttgccacctaaagcaaaaccaaaatgctcctaaaacaagccaataacgttagattaaaggaactattgcaatgatattatccttttggaaaatgaactgtactttacatactagagtttttttccaaatgatcttagagaacaaaaacacaaactaagggcaatcaaatagccggtttctgtgctgtactgttgtatttagcaaatccatgttcttatgtatcaaaccatatttgttccaacctacaaatgatttcagtatcctaatatgttacatatttcaggttcatctttgggaattgaattcagctacaacagagttacaacaggaagatcccggattctgcagattagggctggaaaggctgctctgtgcatgaccaagagaaatagatctaggaagtcgcttgcccgtacacatggttttcgcagacggatgaggactactgccggaagaaaggtcctgaagcgcagacgcgccaaaggaagaagggttctctgcacaaagacgaactcccccactgggaagaaacgaatgttctgattgaatcgcattctaagtcgctctttgtcacaattgtaagtgtatttttttatcccacgttctcggttatactcaaccataacaattggtgcaaatccttcacccggtgtccggttaatgtgtgaagtacattatcaacacaaattcaagttagcctttttgcttgtgcagtatttagtagttgtttgctgtgggaatatgttctccttgatctgcattgccatggttttcctctgatctatcttgactgcattctgagcatagattttgccaaagggcctaaatgctaacttgagcagttgctcaaataaactcatcaatttttctattctgtagtagaacgtcccttttattttctgatacagtccagtgaattttaatattcagatcatctcatcatagtcactccatgctccactgtgtaacacaatttatccacctcctctgtgccaatctctttggtacacacttatttgtaaaacaacctgattgcccatccaatcctctgtcaccttataattttgctactatcaggcgaaaaaatggataatatccagaactcaacctggaataaatgaaaggcaacaagtagcaaagagaacatttacattctaacaaactgaatccctcctcttcttcactcgcatcggcaagccgccttccatcctcaaggtcaccgagaacacaagccctggccgtccctcgccgccgacgaacctgaagctgaacctctcgaacacgcacgccgcgatggacttcatctgtatgtatgccatctccttgccgaggcacatcctcggcccgccgtggaacaccgggtacttgaacgggctctccggccggaacacgccgtcctcgtcgagccaccgctccggcctgaactcctcgcagtccgcgccccataactcctccaagcgcgccatggcgtacgcgctgtaggtgacctgccatcctttgccgacgaacgtgccgtccggcaagacgtcgtcgttctggcagcagtgcgagtccatggccacgggcgggtacagccgcatcgcctccgtgatggccgcgtgcaggtagtgcatctcgcgcagctcgtcaaagctgaacgccgccgcgtccgtgctcccgctcgacgcgcgcaccgcgcggatctcgcgcgcgatcctgtcctccacgtccggctggccggacaccagccagaagaaccaggtcagcgccgacgacgtcgtgtcgcgcccggcgaggacgaagttggtgccacgtcgcggaggctctcgtcgctgtgcttgccggtcgcggcgaagcgcgacaggaagtcgtccttgcgcgccagccccgccgcgcccctctccctccgctcgcggacgatcctgtcggcgtagccatggatcgtggcgagcgcctcccgcatccgcctctccggctccaagtcgagcagcctcttggcgcgccatgcccactcgaccggcgacatgaaccgcgccatgaggatgttctgcgcgtcgttgaaggcgcgcaggaactcggtccgcgcgttcgtccccatcccctcctcggtgaggcacgccgggtcctcgtcgaaggcgacgcagcagacgttgtcgaacgcgaagcgctcgagcacgtcctgctcgtccagcgtccggccgtcgcgctccgcccgcgtgagcagcggcagcagcctatcgacgacctcggacctgacggtgtcgaccacgaagttcctcagcgagcgcttgttgaactcgtagctggcggccttccgctgccacagccactggtcgccgtcggagttgaagatgccgtggccgaggaagtcctccatgactgacaccacgtactcccccttggagtagttctggaagttggtcttgacgatgtgttcgacgttggccgggttgccggtgatggcgccggcgatgaggccgaagcccttgaagttgaaggacatggtgtgcgtggggcagcgcgccacgacgccggccgaccactcgaggaggcggtgctggttcctgacgaagtgtggcagtatgccgacgatcgggtaggccttgaggccgtcggcgcgaggctgcttcctggtgctgccatggcgcaggcagaggaaacagagcaaaggaaacagcaagaggaggagcaggggaacggatgaagtcaacgagagctctgtgcccatgtcgaattggtgattttggattggacgatggagatgccagcctcgtgaagtccgcagaggcgcagattatggagtgatgttgcttatttgattaagttagtcgatttgttgagtgcgagaattttcagaatatgccatcgaattcgcactactttcagaatatgccatccaattcatgctactttcagaatacgccatcggagcacgaatttcctttgttccgtgccactctgtctcttccgttcgtagcaccgtcgtcttctccgcccggcaccgccgtcgtcagtccgccaccgcccgcgccgacacccgtccgtcgccggcatcgtccatcctcgttggcgtccatcgtcgtcgtccacggcatggcgtgggcgcggagggaggcgagcgcgacgcgagtactagcagcggggcgagcgcggccgcgagtgctagcagcggctgcggcggcgggcgaagctgactgtctgcgtctgcgtctactaccgcccgggactggacctcgtgtgcgcgccttgtgaattttgaggcaccgttcgttccagggtgtttggggagattgagtctcgttttccgcgcgcacgcttttcaaactactaaacggtgcgttttttgcaaaaaatttctataggaaagttgctttaaaaaaccatattaatccatttttgaaatttaaaatagttaatacttaattaatcatgagctaatggctcacctcgttttgcgtatcttctcaatctcctcaatccccttcccctcaaacacaccctgagagtagagggcggccggtaaaaactccttgtatgttgttgctgctgcacgtacttggtccagatgatgagtgtgaattggcaaggacggaagggaacggaatgggtaggtagtagttggatacttggattgttcagaggaggacgtcggacttggcggggagtcgcttgtagaagttgaaggggacggatggtgagcgcggccgcgagtgttagcagcggctgcggcggcgggcgaagcggcggctgcggctgcgggcgaagcggctgcggctgcagaatggggcggcggcggggaaggggtgggggagaagccccttgtggatggtggggcgaggcggaatgcggcagctgtgtacaatgggggggcggcgtccgtggtggtggggaggaagatgaggaggacgaggacagggcaccctcgccggcatgctccagccggaggacgcgatgcgcgggcggtggaggacgacgatggcggtgacggcgaacggacaacgccgtggctgacacgggcgcgcgcggcgcgggcggtggacaacgacgatgccgacgactgacgccggcgcgggcggtggcggactccttccctccgcgcccaccgagccgtggacgacgatgacgacgacggacgccgacgaggatggacgatgccggtgatggacggacgccggcgcggctgacacgggcaccggcggcgaacggcgccgggcggagaagacgacggagctatggacggaagagacggagtggcacggaacgaaggaaattcgtgctccgatggcgtattctgaaagtagcacgaattgggtggcatatcctgaaagtagtgcgaattcgatggcatattctgaaaattctcaactgttgatgcttaatcaacggtccaacattgaactgggttactactttggcctcaataagttagacgaaaaatgcttcgtgttcttatccaaatatctcagtcacctcctccaccacacattccctcttctcaaagtctctctcttttcaacgcctctacacagggggttgcaagccaaggcgaggcatcgtcgctggtgtcgacaccggagcaaggcggcacgtgatagggaggaggtactcgacctcgctggcggccacatgacggcagcggggcaaggctgcgcgtggtagggaggaggcgatggacctcgtcggcagccacacgacagcggcggggcaaggcgacgcatgggagggaggaggcgatggacctcgtcagcggccacatggcggggtagacaacataggattgaggaggaggtgctggacctcgccagcgatcacacggcggcagagtgcagataacgcaggattggggaagaggcgctggacctcgccgacggccacacaacaacgatggtgatgtggcagaggtgctagatttggctgtcggtgaggactggacaatgcgactggtcttgggcgaggtcgccaaccttgtgccactattcttctcccacaagcatcaatttcttgattctagcagctagccgtagaagaagacaaagatgggttcattttattggagttttagtgatgttgcagcatattgttttatcttgttgcattttattgtattaaggtgtttaattttgtttggatttggtgttgcattttactgattcttagtgttgcaagcaacctatttcagatgttgcatttgattgaaacaattttgttcaagcaatgaaacatttttcctcgattgatgaaacatctgaaacattttcatcgaaacatttttcgtggagtggtgcaacatgtgaaacactttgtgataatatagtgcaacaccgtccgatcttttgtaatagatcggacgtctaatttgtagcagcctccaagttgagagtgcttctagatctaaatttctacacacttttgtggacttctatgtttatgaactgtttttctttcttttttttttgcaaacccggctagagatgccgaccaattttattaaggattaggagatagtttcgtatggtaaagcaacaaacatagttgtgcatatcatctactatcctttacaacacaccgaagaaaagaggagaagatgaacaatgttaaatgtggcaaagaataatggtcatgaaattagtttgagctaattcaaatcccatgagaagcaacggtctacttcttatctacttcctccacctcagaataggttaatctattacgaatgtgatatattcgtcagatttacagaactagaatatgtgacatcccgtaatagattaacttattctggtacggaaaaagtatagtttcaagggaaatcccccccccaaaaaaaagaagactctttgatcacgaagggccagacgatgaacattggatgcaatcagaaacgagtttgtcctcgtccttggttcccgcgccgctctaccacgtaagagctttgattgggataatattagaattttcccaacatgggcacgccgaaagtcatgtggacttcgggagctcatgtagtcatatgtaatgatgatgagagagggtgtcatgtggggaatgcactacgtccgcaggcgcaaggatcagcgacaacagcaaaacggcaaacagtagatacgcaggatttgttttcgtttgtttcagagtctgttaaagtttgttagtttgatctttatctctaagagtttgttagatggcatt

SEQ ID NO: 65076 - DNA, 7735 bp, Oryza sativa
catgcgcacgcggtttctatctcctcttccctcccggttctatctcctcctcctctcctttatctcttctcctcactcacccttctcttcctctccttctcctccccctcccccctcctccccctcctccccacttctctggcaggcggcggcggcctcgcgtggcggcggtggccgggcggcggctggcggtggaggccggcgcgccggcgaggaggccatggcggtggccagcggtggaggcgggcgtggccctgtatgattttttcttttttcctttttgattcgatctgtgtgattcgatgtgttgatttgatctgtgagaatgaactatattgttgtgaatgattttgagaatgaactatgtgttattgtgaatgatttgagatgattatgtttttgtggatgatttgagatcgatggtgagagatgatattttttaatgatttggagatattgggtgcgagatatgaaaaaaagaaaaaaaacctgttaccaactagaattaaaaataggcatctttagtcctggttgtataaccaggactataggggattacgaaccgggagtagaaagcctttctccagtatgttaactatttgtagtttaatttgctttttttcattgcgacatgcagaaagctgaattttaagtttgtcgagtgatatatcacatataaataaatcttcttagagcttttattaactatttaaaaatgacatgcaaacaactgtaagcatcctctgttcagaatagtttccctatgtatgtacatacattacagagcttatcagttcggctttatcgtgattcatgatttcaaagtgttaaacggaatattttatatattagtaaagttttttcttaaaacgttatataattttatttttgaagaaaaaaaaccatcatatagctacacgaagatatatatagttgaagaaactttgaagctatatatactatgcaaaatgaatcgatccatgcaaccatttggattttcaacgtagaaaacggagaaaaatataaacaaatgctatcgatcaatgttggacccgcagtctcgtatgaaatgaacgattggagaaattttacaacgtttttcccacataatctattgcacgaaaaagctaaggtaatctcctgcttcgactcgagacacaggagactagctagtcaaacgtttcgcagtgaaaaacaaccgctgggaaaggagtgatgctgaacattctttgtttgactagcttgacgcgactctagctagctagctgaacgatcagtacacacgcgttttgttcatctgtgatgcgatgcttaaattaaacaggtcgtctcttagctaccctccgttttaggttataagataatttgactttggttaaagttaaattattttaagtttgactaagtttttacacaaatatagtaatatttacattaccaaattagttttattaaattaataattaaatatatttttataataaatttatcttggatcaaaaatattactattttttttataaagttagttaaatttgaagcagtttgactttgaccaaaattaaaatatcttatacgctatctcgatcagtacgttgcagaccaagcatgcacaacgtttattatattttcgcctctttttcttacgtaacatccatgtcatcatctagccttagctttcatgaattaatgatgaattcatcagtgtttttcttcatccggctggccggtggtctcatcattaattcatgcatgcagcgtacccttagctttcccagaaattctcggtttaattcctcgatatatcgatctcaaccatgcgtgcttcagaagctgttttttagatgacagattcagctttgaaaggaaagcccaagaatgaaacatatatatagtctggccgaaagcgatcgagttgatctcatcaagacatcaaccatatatagggacatcacgtgttcatcaaattaatcttcagtcagttcttgaaagttgaatcttggactcaaaacttacctccaccgttttacaatgtaagactttctagcattgcctatattcatatagatgttaatgaatctaagagaccttttgcagcacttggaaggtacccaaggtacctctcctcaacttaaacatccaccgttgattctcaaagagtagattaggaattgaattaacataaacatgggcagtttagtaattgttctttagccatcgtaatcaaccgttctttattcttttgctatatctttctgcacacctggatgtaatttttcgatccatccagccgcacacatacccctatataatggatgactcaaatttcaaaactaggttttatacatccatccatctttattgtctttagaaagtaatccatacaaagagacggaggcgcatcaatcaatttttcgtttggaaatcttcagagtcacatgcaaatctcatgcggatatatggaaagacgcgtggatcaattacttagttctaatcatcaattatgtggtcttcaattagcatctagttacacgatctgcaaacattaatcaagtactcctagacgccgtagttagtttcttcattagttatacagattaggtgcaagccgtgtgcagtggcatcaacagactgaagacgttatcatctctctgcgctccggccgccggagcagcagaaaagtttcccgtttagttcttcctctctttatgaaatatagaaaccaaattacatatctaacctttttcaagtaatgcctggcccacatatttaagtaccttttcacatgtatgtggatcgttagattggaagccatgaacagatttgacgcactccaaacacagtagaaaatctctgaatatatatatatatatatatatgtctagattcattaacatttatataaatatgaaaaatgctagaaagtgtcacattattaaatggagggagtagtacttcttcatcagaaaccatgcataccaattcttccagtttgatccgtcaagaacgctgtcgatcaatcgtgcagctaggaaacttcaccctattttttctcttgatcgcgtttgaacggcgagataatctcgatcgagcttggactgggagctactagtatatattataagtacatctcatatgctcgatcaccacacctgcagcaattaataacctagcgcatatcaacaagcttagccaagctgaagcgaactgcaagatagctagctaattaaggaagattaagccggaactaattaatcaagattgatgaaggcgaccgcggtgatgatggtgctcgtgctgctcgtcacggcggcggcgtcgctgcatgccgccgacgccgccgctcggtggcgccgccgcgccgcctgctggccggagctgatgccggcggcgccgttgagtcgccgccgccgccgccgccgctggtgtctgcgagcaagacgtcatcgggggcttccgactgcacgcacaaccctactaagccctccactggtccatgcccgccgaacgccccgtgattaattaactaattgaccagctacacatatctattaattaattccttcgtggcgttgattgatacagtagtactacattatactccaaatatttactcatatatatatgtagtatatatattatggttcattaactatagttggttgtcgtaaatactattataggttcagttcgttaattaattagttgttcttgggttgtcgtcaataataccagtaggcaaacagtgccacacatatatacaagtgtcaccgtgtcgtagcttgctgatgcgaaccttagatattgctgtagtttgatttgttctgttgatttatgtacgtatacctcacaataaagacaaacaaattagtccattaatttgttcagtatttgttgggttctgtacttctgtctgtaaattaagagcatgtacaatagtaaactataagccaactataaccatatatcgagaagaaaagagaggagagagaagaaagtgtgctatagatttatagccggctgcaacacggactccaaaacgttgtgtgtgtatgagaggtgggaccgagtattaatggtgtaatatatttttatagttaactattgtatgaatgggttattatattaattatagttgttttggagccaacagttgactatattattaaacttgctctaaatgacgatgaatattttttctttcgccaccacgaattgaattccctgatgatttttgtttggtgtcgtgtactcgtgttccccgcataaatttgcacaatagatttgggaattattaaggatgcctatcctgaacaaacacccatatgcatatatactagaatcagtataaatacagtcgccatctctcagtctccctctcggcatgcatgtggacacaacccacggctttcttgtgtgtccttttcccaacattcaaatagaatctgttttcaagttttattgtatttttatttacattcctacatttttttggttagtcaattaatttgttttatatgacccaagtcaaagcaggttgcataagcaaccactacccagaaattggactattcctgatggcaggaaaaccatcactactggagaattgataattctccggatggatggtaaaaattacattagtttcggttcaaatagaaagcaggattaatttttaggttcaaaagccaacgaaacttttttatctttagtcccggttgataacatcaatcgggactaaagatcattttaggcccggttcaataactgtcaggccgtgtcaggccatatatttaatcgaatatctctctcacacatccttatctttatttctcgtccttatctaccgggcgcgcctctctcgcctcacctctctcgatctttctctcttgctcgctctctcaagaagctagcggcagcggcggcgccctggcggcgaaagctgtagtggcggtggctgcaccctcccctccgccagatccagctggaggggaggcggcacgatgggaggccgggcggcgtccgggctgcggaagtagcggcaatgggagtttcctgtcaggagacatttgtcctgatggccacggttaacccaagcaaccataagagataaggtccgagatgatatatatacagctatatacaatactcggtggactataatcctcaaatatcctctcatttttgcaggacgagatagaaaaagataaacatgcaaattgaaattcaacatatcctcaaatatcctctcattcataaaatattaagaaaaagataagatagattattatgttatatatcattctataaacatgcaaattgaaattcaacatatacatgtaggaaaaaaataaatttaactgtgaatagtacttgtgtacactactacataaatactcatctatgcaggatgagaacccctcatcagtaccggttcctcaaccaaaactacaacgttgacactgatgagtgggtggcaccaatgctggtcttggacttggcactcattgtttgttggttttgttatacgatgaatgaatgaattactccttggtcttgatgcaaaaagaaatagggcttagacttttggacggagggagtacttgttgaatggaaaatttgaatgagattattcatgaattaatgatgaaattcatcagtgttttttttttcatccggcttggccggtcgtcttatcatgcattcatgcatgcaaccccttagctttcccagaaaatctcggtttaattcctcgatatatctcaacgatgcgtactttagaagctgttttttagattaacagattaggctttgaaaggaaaacccaagaatggaattaaacatagtctttgccgaaagcgagtcgatctctcatcagtcatcatcaaccacagggacatcacatgttcatcagcttcatattcagtcatgctcttgaaagttgaatcttggactcttaaaaaccaagtatagttcttcagaaaccatgcataccaagtcttccagtttgatccgtcaagaacgctgtcgatcaatcgtgcaggaaacttcgccctaatttaattttctctcgttttgaacggccggcgagatcgatcgatcgagcttggactgggagctattataagtagctcttcatatccagatatacctgcagcaattaacctctagcaagctgatcagttaattaagctgaaacgagctgcaagctaatcaagctctaagagagtgcgacctgcgacgtcggcgattaattaagccggaattactgatgaagatgaagccggcggccgcggtgatgatgatggtggttgtgctgctcgtcgcggcggcgtcgctgcatgccgccggcgccgctgccgtggcgccgccgcgccgcctgcttggagctgatgcatgcgccgccaccgccggcggtgtccgagagcaagccgtcctccggctgcacatatggccctaacttgccacctggtatttgcccgccgaacacgccgtagctaattaaccagctatacacgtacgtacgtcgtcgacgtcgagcatcgcatcgcatacaagcaaaagatttgggctgattaattcattccttcctttgatttgtagctagcgttgattgatatatatatagatcatatgtgcatatatgttactacctgtcatgaatatattggttgtccaaaataaaagttttagttagttattagttagttgctgcatattgttgatgcacgcaacaacgcccaagcatagtacgtggtagtgctggcagtagcttgttgaccttacagactactgtagtattttaatttcttctgtagatttatgtatgccccaggagggtggtttcacgatataaataagagggaaaatgctgatttgtttagtcttcattaattgggttctgttgtgctgtaattaaatgatgattttttttctttcgccacgaattgaattccctggtgatgtttgtctaggtgccgtgtctacatgccccgttcccgtggcatgaatcttgcacaataaagtttggaataattgggatatatgtcaagttttaatcaactattcaaaatagattattaaatacaccgtaacactggatcatggaggagcgtccatatataatttgtgtcatagggatgtcggtttcggctgaatcttgttaataatatcgtgccctagtgtgttgtcgtgtttctgttcttgttatcgatgcgctatcatatataacagggctctagtggacctactctaaaaatacactctttagggggaaaatgtttaggttaaaattacactccgagggagagtagaatttatctaacagtatctctttaaaataatagaatttatgatattcgctttaaagaagctacaaccaattattacaaatgttgtagatcgagactgtcacctataaaatcacaacttaaaacaagagaactacatataactccaacaaaaaatagataagaaaaactttcatctagagttagtgaggaatcgcataaaacaattgtttcgcagaagattacaagttatgtagcatcttcctcaaatcaggaaatcgtatccccgaaattagcgtccgatcatttttccgattgaatttcgctcacatcaccatcgatgactgaaatcgaaccgaaacggaagataccgttggagagaaactcactaatcaatatgtcattcgcatgcagttgccactgtaatagccatcaaagtcgatcca

SEQ ID NO: 65077 - DNA, 2030 bp, Oryza sativa
tgcaagcgttgcatcagtgggtgcacgcgcgtggcaggggtctggcgtccgctcacctcctccctctcattttcatcttcccattctcaactgctctcctcttccctctctcccttgccgccgccgcctccaccaaatcccctacggtcaccaccactcgttcggcgtcttctccgatggtggactggcggccgacctcgagctccctcggccgaccccggtggagaagctgcagccgctattacatcccttgccatctccatcgccggcttcctcgccattgccggcgccgcctctcttttctgtcgccacaatcgccttctccgaccgccaggccaccagatccggcgaccatggtggcgttgagcagctaggagcagctgggagcgccggtgaagcaagtcaacgatgagattgaggggatttttttttgttttctcttttctattttcaattgagagaagagcggaggagcgcgcgtggcagatccgtatgagaggccagcgacggaggagcgtggtactggccggccggcggcagaggagccgggaacggctggcagcgatgaggcaagaactcctctcctcgacgacaatgaggaggacaaacgcttctatctttcttttctttttttttccagcgctttgcagtcaaatggtggggaaattttggtgactttttttttttgagaactcaacaaatttcgctttggtgcaaagaatgctggctgatttttaataccaatattattctttgtatgtgaaaaattgtttatacctattgtctagatttgaaatttttgtatgggatattatagaggtaacctcacccaattaaatgaagaggtaaccagactcaaatctatccaaccaaccaaacaaaatattttccaaaccgcatctctcatgcactcaaccaaacaaaatctcatctcagccgggctaaaccgatgcaaacaaccaaaacagttgcatgtgtatctcttcatctgggctagactcaaccaggatgaaagagatgagccaggctaggaaaatgcaagcaaccaaacacacccaattgttgctgtggtgtggtggatgactcaggctgggccgtggttgctctcatgagtcatagcaaatgggttgatggcgtctattcttgattgtgcttttgatgcgttcttcggtagcaatgtttgttctctagcaatagcccatggatcaatatggattaagcaaacccttgggccttccggtgctaattaaggagttttgtcatgtgtggttcacattatcaatgagattttgttttaggaccttgttacagtgcaatgagtctgcgttcaggatttgtggttggttgggatgacaaattggggaaaatgtgttacaccttagtaacagatctggtttaggatagccagataaacggtacatatgcctattgaagtgtaatttatggatgtattccctatatttccccccctattttgacacaaatccatagcttacaaaacaaccactgtatgaaacttctatcaggatcatgagcaagtttgcaaggggtcttattacctggaaagatcaacttgtatttactttgtaaaggtcgtgttactgaaatatgaatttgttcttgaatatgtttactctctaaaagcctaacatgtcatcgaaaatatggctaccaaatgcttgccatttcataattatccagaaatttcttatataaaagtgttgctttattcaaaagcacatcaacactgattttcatttgtcacccagctttggggattaggtaaatgaatcaactttagttgtgatattggggtccatgaaagattgggaaaaattaaatatattggacctttgccgagcaaggttccgattctccctgaactgtggtagtcttagtcatcttcttggatttgtgcaacacatggattgactggttatgctgtattgtaatgtaatgtcatggactcgatttgtcctaatcttttgctaattacactatatgtattatgcctttttttttcttttcag

SEQ ID NO: 65078 - DNA, 1256 bp, Oryza sativa
agacatcgttacgacttgtctgaaaaaatgccccagctagcggtggtgagtcgtttgcacgtcgtccatggcgcgcttcgtcaattggtctctgtgcaaaaaatgttatacgttgatcattcttggatgagatagtactactcaaaagatattcagactgaagatcagttatgctgcctcctgtcctgagtgagtaagagtgcgacacagataaataaagttaattgttcatttataccaacaaattaacagatgaatcagcgcatagctaattaactacatatatacatacattattctgcaacttgctagctctgaaacgatcaattattctacgcgtaaaatttatactattataatttataaacatcagcaattcatcggaagtgtacgtgtagacagtgtagtgatatgtatacatatcaatcacggcatttttggtggcgcgcagggacgtccagaaatatgggggtcgttgctgcagccagaaggccctgacgacgccttgctgacggacaccagcggaggcggctgctgacggcggccgccgccatcctctccgagacggcgcgccgccgcgaccgcgacgccggcgttcagagacgccgcgacgagcagcagaaccagcagcgccgccgcaccttttcctcctccctccatgtcgcaagttcagcctgaaattaagcctcggttcttcgttgctaactaataagcagctagtagctagattgaatgcttgatcaagttggtgtttctatggatgcaaatcaaactgtaggatatgtgggtatttataggtttcagatgagtatgatcgaccaagttgatgatatttttccgcgaaattaactgtgcaatctgacgcagaagacgtttttgacggattaaactggtgtcttattcaatttatcggtgaattttacgcgcattgtgcagatctgtgatgtcctgaaatcaaagttctgctggtttctgtactggactgaagattgatcattgaaaatgaacaaagctgcgacaaaattctttacgtcgcagctttgttcaagttcacctgggtaatggacacatgatcctcttctggaaagacaattggctgcaagaaggttgcgttcgatctattgccccttccatctacgtacgatcatgttccggcccacgtgcgctggcatcggacggtggcagaagcgctgctggatcgcagatggatcagagacatatgtggggcgttgggtatccaggccatcccggactac

SEQ ID NO: 65079 - DNA, 901 bp, Oryza sativa
actatcgatgataatatcttactatcgatgtttctctcctccgttactttttttttccgaagtacatattagcctcaaccaatattcctttccttgctaaatcatttttcctatgcaaggtggcattttttccaaagaaaagaaaatcattttactcccctaaagcacttaatacttaaactatttttttcttcattttatccctaaactattagaaatggttcactcttgtattttaagctgaaactttttaagctataaatgatatcattatcaaagttctaaaatgttttcatgagtatttgcttgaaatttaaaactttcatgtttaaattagtcacagtgttttcaacctacgtaaacaatgataatttttttctaaagaatattgagaggtaaactataacgcatcttcaattctaccaaattttaatacaaaatatgacttatatagagagaagagagaaataccattaagagtaacgaaagagcctgtaacctagtggttataagagcctcagtagcaccataggtcctgggttcgactcccaatgggagtgaattttccaggatttaacggctttgtgctttcagtggtaggcgacgtaaccgtcgacagtgaggcgcctgtggtgacttcgtcaatctccaggatggatttgctggcccaatcttcgaagatgctcatagggatagggtttgcgtgcgtgtgttaagttgaaccattccaatagtttgaggtataaaatgagccaaaaaattatttaggagattaattgctcaagtgaaatagtttgggactgttttcgtttccaaataagccaagctgatcattttggtatttatggagtataattagatcgacttctctttcttccgactccctctaatcacaaataaa

SEQ ID NO: 65080 - DNA, 695 bp, Oryza sativa
tggactaggaattgcttagccatgcttagttcaactagcacacattggggatctcatttaaaacctagactataggtttatatgataatgttgctggtgttggttaaataaagtgaaccacatggtgggctgtgggtgcatggttttgctagtcgcacccatggcagttaaggaccggttcgcgggatgccctggaagaatttatcgtacttaccacaagccagcgtgggcaacggctgggcttgtagtgtagctttcctctagccgacgcatccaggcaagggtgggcgtgatggagtttggatgggccctgcgacggtctatgcggcttccggattcacctaggcacgagaggggactgcccgctgccttgcgaggagtgggggtgaaacctgaggtgtggtgtgcttggttagagggggttatgcgaagggtcctgtcacggcctctttccggtatgtcgtggtgacatgtcggcgcacggaaacgtgtcgtggggctgtgtcttgtgggtacagttgtacacctctgatcagagtaaaactattcgaatagccgtgcccgcggttatgggcggtcaaccagattcaccgtgattagtctcaccctagtgtaatctgttgaacttggatagtttaggtggatggttgggcctgtcacaacgtgggttagcgttggacagcggatgttaatac

SEQ ID NO: 65081 - DNA, 11174 bp, Oryza sativa
gatccccctcttgttgttatctagctggtagtgaaagagttgataagtctgaggttgtaggagacaggctgaaggaagcacagtacataaacaagtcactttcagcattaggagatgtgattgcatctcttgcacagaaaaattcgcatgtcccttaccgaaacagcaagcttacccagcttttgcaagattctctaggtactatctgaagttaatatgctaacttttcactcaattactacatatattcatagggtaactattttattccaatgtcaggaggacaagcaaaaacgctgatgtttgttcacgtaagcccggaactagatgctgtcggtgagacaataagcacattgaaatttgctgaaagggttgcttcagttgagcttggtgcagcaaaagcaaacaaagaaggcagtgaggttagagagctcaaagaacaggtgttcacttaactcctgattgctcatttatataaactatctagatgtggtacttctgtttagatttatataatcatcgtttttctctgctcttgtttcagattgctaccctcaaggcggcattggctaaaaaggaaggagaaccagaaaacattcaaagcacacagtcaagccctgacatgtatagaattaaaagaggcaatgcaatacctgccttccctaaaaatagacagccaatggaagaagttggaaacttagaggtattaactgctctttcacacaagatcaactctttttcttggaaatcacaaaaatatttccttttcacattgaagtttttttgtgagtgctagttatgattccaatcaatgtcaaataggaaaataacctaccaaacattctaaatggagatgggctatttatgcatttgtacataagtttagagtcattttgtcaataatctgaacaactctaaaactgaccaaagggtagttcatggtcttattgagagtacttatgtttaccttcagtagatttatgcatttgtacatcaagttcagaatcattttgtgaatgatctggacaacactaaaactgacgaaagcgtagttcatggtcttgttgagagtacttatgttaccttcagtagattattattccttttaatcttttcacaagaaaggtaatgatgttcatttaatgaatattatatttctttatgtaaaaggtccggaacaatgccactccaatgcaaaagaaggccagctttcaattttctggtgtcctcagtgagaacaactcatccgacttggctgaaaattgcaatggcattcagaagaccgatagaatggctgtcggtaataatcaatttgagaatggaaattccattctagagctggagcctggcgcaactcagcttccaacatttttctaccaaagatatgatcccgacaagcaaaggcgtagggctgaaccagtagaaactgatgactcagatagctttgatgctgctactagctcgccttccgaccaagaaatgttgttgtccaccagtggcctcaaagctgatggtattgccagcagaggtgcctttattataaagaaacctcaaacaaagaatacgaaaattacagcaacgaagtaagtccaatttaaatcctgtattttccatgaaaattgtgtgcattggattgctttaacctgttgtgctgctttgaatttactcaggattccaaatcttgcaatgaagtcgccaatgtcagagaaaaggctgcaaaccccaatcaggaacagcaagcagctacctttcagcactacgggtggaagaagaactcgaaatggcaaaattaacactccaaaataatcgactagtgcgaaggtggatcccactatgccaaggtgagatcaataggaaactgaaagaaggatgtttctaaaaccctgtataaggatcagtggattgttcagtctgatggaaaaatggttttgagacatcaaagatagagataaacagataagacctccaacaggacagagaaattgtaaacccagaaggaatttttcaaatttgagatcagtacatagctcacacgcagaagttacggttgtattgtatgtacattagcctggaatagatgcccgccatgtgccattacaacaaagagaagttcaatgacaagtttgtacgcttcatcatgttaattgtcaaatttaggccaattacaatttttttaccattgcatcatagatgtgaactttcttaaaaggaaatttctctcaaggatcattaggtgcaaaaaaggaatacattacatggtctttttgtttacatggttctaaattcagagataacaaagaggtcagaatcctctgctgggaaatactaacactaaatgaagtacaagcaggctctactatgtacagattacatacacctaactttttgacaaaatcattagtttcagttgaccagatgtctctagaacttctgcatcaacaccaagatcgatctttaatctaaattttttacaacctgttttcaccaggctcatactattgggacaagccttggccttgctggggggcgatgcgaagcctttctcgaggctctggagagcctacccacagatgccagcttcagcgctgccctgatcttgacccacttgcgtggggacaatggcaccgcaactctttcgttgctagaaaactgagaaatgaaattctgtatgagctgatcacatgagctggagtcaaagctgtttgttcttgatggctggaatggagcggcaatttgctgtgaggtttggtcattgcttgataggttgagcaggttactgaaattctcgcctgcagatgccatccttagtaattagcatcaagatgaatgaatcagatgtagccaaaaaaaaatcagcatagagtaattactgttgcttggaggcactaagtgaggttgcatcaaagccacaacttcatctgtatggaggaaattatctggagaaaagcgctgtcaacacaaatacagaatggattagttctgttgaatgaagagcacaagtaatgtcaaatttttactcttcgatttctatctagacaaaatacatagatttttacataaaaaaaggttcttaccttgtatgattcttcaggtgaatgagatcgctcattatgtgcatactggccaattcgtgtggcagcatgatcagcctggatgctgctatgagcgtttggattaaaatatgttttttcggtattaggtatacacagaggagtgattcttggtctgggtatgaatgttccttgatttgaatgatgtgggataaaattgcccatgcccaactgttggctaaactgcacgttggaggtttgaccctgcacaaatcttgacatatccactgaagcctgctagaaaattgatgaaactatcttagactaacatgcatatgtattttattatgtactgtattttgtatatttcaaaatatcttccttacattagaggcttcttggaatgaagaaaagttctccgttgattcaaatggttgaccagccagggctgaattgtattgacctgtaaacaattggaatagatgaccaaaaatccccaaaaaagtaattatcgctagtgattgaaattctcagaacaagatattaccacaagttgggatctgctgtttaggaataaagtcagtcaacatagaagttcccccacaatggaacctatgaagcggtacaggatagttgttgaccatcttatggtcatactgaataccacttatattcgcataagccaattgcttcattgtttcaactgcactctgtgaacaaaaaacaccaaattattaggaaaatagtgagaaaatctcctgttgaaggaagtgaggaaacagtacctgctctatttcgtcgagctcatttatgggcttgtaagaatcaccaaacttcaccccaacaagctgatatattgcatcgaagaaaagtcccacgttgttgcccttcacttcatacaagcaaagatcgtcaccgacttcacatgtcatggcatggcttatgatggttttccaagctgcctgtgacatcttgctaaaagtctatagacaaatatcaaagatcttctgtcagtcactttttttagggaattcggtgagtctatttttttctcttttgaaaccaacggctcatctatattatcaggtccttgtgttatggaaacatcatctgaaatttaatatttaaggaaattcatagaacctctacctgaaaaagcttcttttcgtccgtaaaatatgattgtaagaacttctgtacagtatcaactccactgtttgtcaaggcctggtggtgagctccattgcggccgatcttttccaaacgccaaacttcgtcatccaacattggcgggtagtgcttttcaaatcctgcaaaaatagtaagttgcatattattagtctcagctataaggtccaaaagacatttctgaagaaacaaacaatctgaatcttagggacaatggcataccctccaccctacgctcctttacacgaaaaggttcagtgattccttcaagaaccctatcttcagaattgttggctagcctcaaacccagcctgaacttcttagtgctagtgaagctagagttatcagtgaaggttgcattctcaagtaatgcttcccctccattgagcttcagtgtcagatttccggtgagaagttgtgcgcttttctctcgcccgcatactatctgcttgctgaagtcttcaggggtccattgttcctcatttttagcattaaagttgccgtggaggactacaacttcaaccttagcagaagcaagatgaccgaacctgacgatgcgcatctgattgttttcgagtctttcgactatagccaccttaagacccggtccatccttggcttctaatttcatcagtgtgtaaacaggctttagttcattcaggaacacgagttgataccttggacgctgctgattcaatcctgctagcagtctgcagatgaaagaaccaaattaagtatgttagagcagaaagaaactaaacatcaaattttttttattacatgtgaaatttagtaatcataataaatgaaagctagtatatgtctcaagcctcaccttggaggcgctggtgtgctgacttgtctgaaaattgctttctctacttcttctgaaacctgaaaaaagcacaaatttcaggtcagcggacagggagcacttctaaattctaatatccaagttgaaatcaacaacaatgtccgcatgtctcttcttttattgggatgaacttatcaatctaacatatctttgctctgaatgttgcacaaaatcgataatatatctcaaaattggtagatgcatgtgtaaattgcaccaatttggggtaaaaaaaaacttgcaaaagaaggaaagggaaaagggtttttaaaattggggctatttgtgttattcttgaagccgctaagccttttagagcccgtccccccccagggcgaactttgggcaacaaggggggctaaaaataaagggacgggactttttttaaagaaatttaagaaaaattgaggggtttaaagtagagtatggaatgagaaatccattgaccactattactgaagccatgcttggccaaagataggggaaggaaacatggcccatgaactcctcccccatcatctccctgaacccgaacaccccctccatgctcctcttcctcctcaccccgagccccctgcaaccaaccaaagaacaaaaaaaacacaaattcatgagcaaccaaaccatctctgaacccaaccaagaacgcagggttgactcggccgttgactcacaggacaagcgcccgccaccgcctgcgagggcgggacagctcgccgccggcgccggcgccgtcgtcgtcgtcggaggaggaccaggagaggagactcgtggaaggagccatcggtggaggaaacaatggaggagaggcatggttgcggggtgatatagaggagaagagaatgggagggaaagctcctggaacgagctgggaatgttcgcttgagctcacattttgttactgtgttcgcgagcgagtgcacaagtggagtgtttttgagtaatccatgacgtgttttgagtaatctatgactctgttggctcgtaattgtcgattggttttgggtttgatcccttcttttgtggcaatgggtttttgcacttttttttctttttcagtttgagatgttaaaagtacactttagatagcataaacttttattttgcatatttgtgctcatttaaaagaagacagttgtggtggactccgcctactcttattacagtaagtttttacaaattaccccttgaactccttaatattaaaaggatccaatctaaatggatagccacataaaattagattaagatgaatatttcgtttagaaaaagatgggtaacacattaatacattttctttaatccatagcaaagcaccgtcatttagctagtatatatatatacacgcacagatactcattcactacgataggttagatactcattcactacgataggttgtttatgaatgttactctatccgtttttaaatatatatggtgttgacttttattgtggtagcatttgattattcacaatgtgaaaacatttagtgcatgataaaagtcgtattcaaagtacatttaacaataataaaatataagtgacaataaaatgaagaaattatacttttatgtttctcttaataaaacaaatggtcaaagccatatctaaaagcaaacggcatcatatatttaaaaacataagcaatatatatatatcatttttaagaataaaaactttatattattggcgtctaacagaccatatatcgctagtagaaatgcttctcgaaatctttagctcactaaataaaccagtgttgatgtctataatttctccctctataaaaaaaatgaaattctaagaacgaatctggataaacacatttgtacattcgtttttataagttgaatttttttcttttacggagggtgtactctttataataccaccacttaccagcaactacttcgcttaaaagcttgaggtgttttgcagaagaatggttcgaatttcaaaacttttgctcttgtccgttctattgatgcatgtccacttcatctaggctgcagtctacaaaaaaggaagaagaggcgaagctgcagcctgcagaaaatggagagaacgatttacgtcgactgacgactacgacagcggtgatgatctggccggccttgtgattgactttggattttggattactgtatgtgtcgtctcgtgggcttgatttgttcctcgtttagtcccctaatttgaagttgaagttgacaaatcgcgttcacagcgctcaaaccaaccatgcacgtacgcaagcaagtgttcatatgcaactgcacttatgtcgtcaaacttttagattatattgcacttttagattaactgcactgtgctatatggttttcttttttttagattatcttgtaattcctccgtttcacaatgtaagactttctagcattatccacatttatatagatgttaatgaatctatatatataataatgtctagattcattagcatctatatgaatgtaggcaatgttagaaagtcttacattatgaaacggagagagtagttgtatgagagacatgatgtatgttttggcgaaattttgataaatgttatccttttagaaaatttatttgaagggtaaaccgtgccagaaattattttaaaaataaaccatacctcagcaccatcgggattagcgatgaggtccaacggcatagtgctaacgatcatggcgctaagcgctgccaccttggcagggccgtatgcaaggttggataggatcatttcatattatgaaaagatatagcgcaagatataaatcacatttaaagtacctttaacaattattaaaaattcaagtaacaataaaataaataagtgatagttatattttttaatatggcaaagggtcaaagtcatatctgaaaattaataatatcgtatatttaaaagcagaagtagtgtatatctatcttaaaaaaaacttgatgctaatggtgcctcagaaagcacataaatatccgtcgtagaaatgcttctcaaaatctgtagcttctcaaataaaaccaatattgatgtccaaaactgcattttataataatctctacatgccaaccaaataattcacttaaaaaggttgagatgttttactctagactagttagaatttcgaaagttctgcacttgtccgttctattgatgcatatccacttcaccttaggatgcagagcataggaagaagaggcgaagctgcagcctgcagaaagtgcagagaacgatttatacgtcgactaccgacgacgacgacggtgactacgtccttgccggcttatgatttgactttggattttggattagtgtcttgtcgtcggcttgatttgttcctcgttttaattagtcccttaatttgaagttgaagttgataaaatcgaattcacagcgcgcatagcaataaccacgtttatactgaagaaagtgttcatatgtatgtgcaattctgtcgtcaaacttttaatcttttagatcatcttgtacttgtcttgaatagttagttgtatgagagaattgggagagatgatgtgttttggtgcgctctcgtactagcattttgatagtggtagaaacaattaattccatttttaggcctttttccaaattaagactttatatagcttcggatttgtctcctctcatgatccggacagtttcctatgagcaagttaggcttggattatcgtaatttcaagttctcaagtaccctaaatgagtgttccaatattagtgcaacactagttgaagtgtcacttcttcattttatagagcattttcatctcttttcttttcttttctttttatttcttttttttttttggaaaagctcttagctctgagatcaattactcatcatatgtaatatactcatggtgggaattttcccggaagaatctaagtgtaagtattattttatcggtgaagggggatccatcttattatatatctattcggagttttcatggaagattctgttaactgtaaactgtcatggaggtgagcagggcagttgatgagatctctgtcgcctgctgattggctgtgtttagatccaaagtttggatgcaaacttcagtacttttccatcacatcaacctgtcatacacacacaacttttcagtcacatcatctccaattccaaccaaaatctaaactttggatccaactaaacacagcctgagtgaggccagttgttcggcagaaacctctgaactttcctgaatggttcttcacttcacaagcatactagttgtagttcttataacagcttaaaagtcaacgtcatgtattctatgcctttgttggaaaaaaagttaattattagcgtatgattaagaaaattagtcattcaccaatgattaattaattattaattatttaaaattaaaaaataaattaatatagttttctaaaggaacttctctaaagaaaattttttttaaaagaaacatatcgtttagcagttcgagaaacatgtgcgcggaaaacaaggaagttttcttccctttctcggaacgaacacagtctgtgttcggcataagctggtcgagaggaaaggtaccccagtttttgcatacttcccgaatggtttaattgtgtgtttttaaaaaaaattatatatgaaagtttctttaaaaatcatattactctattttttaaatttaaaataattaatactcaattaatcgtatgctaatggttcaccttattttgtgtatcttctcaatcagcttctctcaaacatttgcttaagaaagtggggaatgacaactcgcagttgcctcaaatatgacaccgctctagtacatcaatgaactctcgaagttatatataaataacattttcaatatacgatgagttgtatgtgaatggattagaaaactggggtggttcaaagtgacacaaaagataaaagatatgtttacctagtccaaagtgaaaaatgttaggtaaaggatggttcaaacggaaaaattttctgtttataaatataaatgtgtgtgtttttatttggtgcagagtctaaaacgttgtacttcaatcgttaaaataaaagataaatgagtcgtaccgtgaagccattagctgtaaccctacgccaactagtcaaccctagtggtctttagggggaaaaaaaatcgaagatccataaaaaagttggatcttggcattttgcttcgtactcctactactgttgtttcaccgtgaagtatagttggccataacgcccgaggcccaacggcccggcccaaggcaggggattttggcctggcccaggcacggcacggcctgatcgttgtcgggcccatgccggcacggttcgggtgttgggctgtgcctggacctatgcctcggcacggtgggccggcccggcacggcacgaactttagcgaggtgaaatagacttattttcaaccatatagacgtatagacgtattatatggcacgactagagagtagggacgtaaaatagacttatttagttttttatatgtcacaacccaaagagtatggaggggaaatagacttatttcaaagaaaacatgatgggctgcatgtgccttcgggccggcccagcatggcccgacccttattgggccatgcctgggccacagtggagcacgtgggccgacgtggcatggcccggcgtattggtcgggttgtgccggcccaacaaatcttggcccgagcatgatcgggcctggaccatgccatgccgggcagcccatatggccaactataccgtgaagcatatgaggagagaaaaagtcatgtatataccggagtagtttggaaagtagagtgcaaacacttctccactattataaaaattgaagatgtttttgccaggaccttggtaagtcgtccgaatccgtatgtgcttccttgcatatatctctctatctcttcccaatagctttgtctgtcgcccggtatctgacctgtaggatgtatttagttcatgctaaaattgaaagttcggttgaaattggaacgatgtgacggaaaagttggaagtttgtgtgtgtaggaaagttttgatgtgattagaaaa

SEQ ID NO: 65082 - DNA, 2125 bp, Oryza sativa
atctagaagagttcgagttcaagaaggatgcgatatgacagttatctgttaattaggcatagtttgttagtttccttttatctttaggaaagtgtgtttagtgtccgataagaactttatcttttcctttttagtttctttcttgtccgacaaggactagtatctccttatgggtataaatatgtacacccggggtcattgtaatctatcaatcttcacgatcaatacaattcagcgcatcgccaccctttttaccttttctactttattttatcgtccggcgtaacttggcacccgacggagggctgcatcggtgttcgatctccggcgaaggggtaagtccaatgttccgtcggtctaggcagttgtatcgtctacgtcggcgtcgttcaaggctgcatcagtatattcgacctcttggattgctctggtttggatgatatatttgcctacctatttatcatatgtctctgttaatctagacttagcatatcaatttagctctatcggctgcttctggttttagggtttctgccggtatcggctaaatcgtgttgctagattagattagcttagacatctaccaccttaaaaatcagtcaacggcttgattgtctagatattatgtttcttttcatacttagtgctgcatcacttaagtttgatctactaagtcgtgcttaaaaccataatctctatcctgcttattgattgccaacaagggtttcatcgcggtttcagccggtgagttatctgaacgttgcattggctcataaggattgcacatacatgtaagttggatttagccgatgacaacaaaggtttcactgtttaatctaatcttgtggatttcatgacatcggacctccagccgatgtgtgctttaaccttcggatcgatgcttatttatcatatcattgctagccgattggtttatactggattatattgttattttattgcatcatcatcagccgattgcctttatatcattatctacattggacatatagccgattgcatagaccctatcgctatcggctggtatcggcatcggctattattggctaccaggctggaactactccatcggctgtctagccgattggctgttttgatctactacttgcatatcttgtcagttgcaggatcaaactgactggcacgcccgcatctcatcatatttggacctgcactggagctaagcagatctcccaggccggtgtgttcgattttttcgtcaacagcgggcaggcagcctgcggcggcggggggcacgcggcgggccaggcggcggccggcggcggccggcgcgggtaggcggcctgcggccggcggcagcgggcgcccggcggggccatcaacgcaggcggtagccggagtcctcccgttttcttgcctgcagctggagtcctcccgttttcttttttcttttttttttgtgatttgtgattcactggatgtataatttctagaatttgtgattcattgcatagatttgttatgtgttttattttgtgtgtaatttatttaaggatttgtgatgtatttgatttgtgtgtataagtaacttaggatttgtgaggtgaatgatttaggatgttacttgatttggggatatgaatctcacctgatttgggagaaaataaagagattaatagtaaattaacaatgaaaaaaaaaacaaaagcggatcaaccgggacgtggctctatcatctttagtcccggttggtaacatgaatctttactcccgggaatctgaaccggtctttagtcccggattccttctcccggttcgctacctgggagtaaaggtagttgtgaaccgggagagatgtggggttctccagtagtgatatataagattggcatacgtgaggtgataccttgaagagaatgacactgctagtgttggcaccagtaaaaaaaatggttgcttaattttctggacatagacatacagtagaaatggaaggtattgggacaaccactacaatctaatagaatcgataaagagttaaggcattccttcatgctatgggccctaatatgagctcgacatattcaagttatgagcatggccgacaagtttatagctaggctcgatcgagcttggctcgatc

SEQ ID NO: 65083 - DNA, 13788 bp, Oryza sativa
tcttcatctgggctcagctagtagcatgtctttttcttccccaatctatcaaaaaaaatacgactcgggccaatacaacagtagagtaaaagtctgaaaccaacatcacaaccaaaccaaattgcccctctcaacccacaaaaaaggaactaatcttttcctgcaatttggaccaaacgcgagtaggtaaaaacaaggggattaattcgagaggtgaccaaccgacgacgcgacgatgcggccggcggcggagacgcgccccctggccgccctcccgccccacgcggcgctcagcgcgacgcggccgcgggaccccggggaggcggcggcggcgaaggagacggccgccgggcgccgggacaccgcgggggaggtcgcggcgaggagggtcggggcggggcgggaggtcctcgcgagcacggccatggcgtccatcccggtagctgcttctcctccaacgtccgcgcgagcgagcgagcgaccaaagcagccgcctttttttggattagggagagcggagaagaagaagatgatgagcaggagcagagcagagcagcggccatcttgtcacatttttcaagatttgtttattctcgagttgtgaagtgccgaaaatacccctgcctctcattttcctcctgcatgggggtgaaaaaatggacctgatttgtcctcatttcgagtcgctatatacctcgttcgtttatgaaaattatattaggagtagtctttttaaggttagctgaacataaaattaataatttctatgcaatgtcgaagagtcctcgtttagtgggattgttcatattgttacaacctctagcatatggtcaatgatttgttgtcataagtttgctcgattgaatttagtactaagatgtttgaattttttcaataaaagtactttttcgagataaatctatttatattgttttatgttttcaaactaaaagttatcccgattattgataggccaagcaataaaaaataaccagatttatcatagagcacaaatatttgtgatcacagggtgtacgcacccttgtttcaaacagaaatgaatgtatacgtgcttcatacaccactatcgactccttgattgatctcgcctctaccatgtacaacatgttattagtcgttttagattgtttttcctagtcccgtttctctctggttgaaatcaataaggttaatatggtatgagtttttgatatagccgtgttctatatggttttattcatcgggagataccattcttctataaattaaggtaagatgtacaccgctcttctacactatgctggtcctcgaatcatcgctaaacggtgatgcttaccttcttggcatggtacatgtatatacatgtgatgtgatgcttattttacaagtatatgcattgatacttggagcgaagaataacatacttttcttcaatgttcacttcattagaagagaaaaaagatgcctctccatccaaatgcccaataaaccatagctgcacaatgattgactttccttacaccccttatggttgcatacttaatcaacaattgccatccaaaaaagtgtgattccacaaagaaaaattgtgagcatctatcataaatgtatatctacttcatcctagtatcatatatgtacggcaagtataataaccttagtttacatgcaaacgttatcactcaagccatatcaacctacatcctacatgaatgagaaagaagtaatcatatgttcgttgagtgtgagcgcatagccaccaagtactagctgttgtgcatgagctagtccaaagtaaaagagaaagatttgagactcggtaaaagataaaataatttttaaagaaagcattgagaaatattgttgtatatgtatatggctttcaaatttaggtgattattctttagagccaacaaaaggtcatcttattggctgttgccaatttgaaagtgagtttagcttttgcaactcgttcgtttactatgagtatgtttcctaaattattagacggtgtatttttaaaataaatttttatataaaagcttattttaaaaaaaatcaaacaaatctagcttatcgatttaatacttaattaataatatgttaaatgtttttatttcacgtgcagaaaaaagctaagtcaaattgttgccactgcttcctccacactgcccacttgtccagtggttgccgaggtgcttattcctacacctaatttatggaggtcaataacaaaattattattgtaatatacttttttttatatagtactagctcatttcacccgttgttatgtaaactctttagcccatattgtatatgtggcatctgacgaccgtccagtataaaaagcatgaggcctactggcctacttaccgtaaaaagtcaaatgatacactttgtattcaaaacacatgttaccggtgtacacatgcatagaccaaacggaacacctcattttagtaaacctagtctgacgctttctatacagcaacgcggtacctcaaggtttacgccttcaggcggatcacgcacggtggagacggacgagcgcgagaaaggaacaaaccgaacaagtggacccacccacccgtgggcccatccacttcgtccaccacaccgcatcgcacaaaccacacaacaccggttccgaccaatcacatccgtccacgtaccccccaaacatcccccggccccacacaccgaatccccccgcacagcgcgtaagccgccaccgacgcgctggcactcccacgttcaagccctcctcaccaccctcacacctcacagacaggtgggaccaacaaaaaccagacccacctgtcagtgacgcggttcggacgaatcccccgtagccgtaacacgatctccaactttcctcgtgggctccacgtggcagtggggaaagcacgggtcccgatgatatcgcccacacaccacctctctctcttctctctctccccatctctctctctcctcctcgactcaccgtctctctctctcccctcccgtctccggcgatctctccggcggcgtctccggcgaccgggccaccgccgccgccgccaaggagcgctccccctcattccccagatcggtagctgtctcgtcgccgtccccgatcctcctcctcttcctttcccccagatccacaccccccccctcgcgtactcgctcttagcctccgcggcgggaggtggtggtggtgtgggcggggggtgagctcgtgagtcagatccggtgatctgtgcgctgttgcggttgccatggacgacttccagggcctcctggcccgcgactttgggctgcgcccgcaggggaaggcggcgcccatgtcggccgcccgcgccgccgcgtcctccggatccgcctggtccaactccagatccgcatcggcgtcctccgccgccgccgccaccgccccgcccgcgcccttgtacgatgacctcttcggggccgcggcgccctccgccccgccgcccaaggccgcgccctcgccctccctcgacgccatctttgactccttcaaggagccctccgccccggatgccccacccaagccgaagcactcgtccatgccggtgtttgacaagccggtctacgatgacgacatcttcgatggggttcccggggtgaagagcagctcctcggcgcggtttgacgatgtattcggtggcagccacgcgccgccgccacctgcgtacgatgatctgcttgggggatttgggagcaagccggaggtgaaggaggtgctgccggaggagaagaggaagcctgagccggccgcttcatcggctgggtttgatgatttgatcccagggtttggcgggaggatcccgatgcgtgccaggtgagcacacctttttgcatgggaatttcgggcattatgttgtctacatgtgcaatctaggagtaaatttagtagtagtttggatcaagcggaagctttgtcggtatgagccaactcggcaacgagagaaccatgtgataattcagttgagttggacaaattatggactcccatatctaatttatgttgcatttgcttagattttagcttgttaatgtgcacgtgcgattgtttgaattggtaacttataccagttgaggtaggaaattcattgatggcttatatcttcaaatctatttggtaattgaatttataggctattttccattaggtatgatctgtgttgaccattgaatatcaatggcatcttgtggataaacttatgggcatcttgtgaattttatgggctctacttcgattttactattagaaacgcctaggaacatatgctatgctttttataagcattccctactttcctaaagataccagtgcactttctcaggcaaacttgctttggcctctatattgcgttatgtggataatacagtgtatgctaggtttattatggtttatttaaattgcacatagttcatagagaatgttcagcatgcattaatgaccggatgtggtaggttcataggctgcacaactttgattgcaaattaccttaggttcaaatataacgctttatagtgatggaatatgtagtgagttatgcaagaagaatatctacgaggttctgaaattgctttgtttaaagaatgatttggatctttttaatctaaaatatgtcaatcatatacagatttgttaccataaattccctcatcctttttttttttgaatcatagggagactgttggaactaaagataagaatgtgtccatgtcaacgtctaagccagctagcatggcaagtgacccatttgatgttcttggtacaacttcaacctcaaagcatacatcttcagggatattcacggatcccttggatgaactgggcaggcctgcaaaatctcaagggaaaaaacatgataatactgctgttgacagtggcctattcgaggactcaagcacttttaatcaggtcccaaaatcagaacctctgtttacctcagagttgaatgatgacttgaaagataggaatggctccaccaaagatcgagattcaagtcctgtgcaaaatttttccagaaaaaatacaacccaaaaaccttctgtggagaacttcgaaaatatctttcctaagtcacagtctgctcgatattctgatgttcatgttgacattggtgcctctggttcagagaaatacagtgggaatggtatggatgaccagtctccaagatctgatgagtccgaagatgagatctggcttacagtttctgagattcccctcttcacacagccaactagtgccccaccaccttcaagaacaccaccacctcttgctgttaagcaaaaaccacatggatcacaagcaaaaagaaaagatgacaattatccacgccggtctaaccaaaaccacaatcatcacagaagctcgtcaaatcaagctggttcttcttcaatagatgaactggaagattttgccatgggcaagtctcaaagttctgcctatgacaatgcaaatccttttaatgaggaagaatttgagcatagttcatcagcagcagcatctgcagctgctatgaaggaagcaatggataaagctgaggcaaagttcaagcatgcgaaggttgtacgggaaagggaacgcgatgcaaaacatagaaatagagaacagcaggaacaagatgatgaagcaaggttcaacacccaggatcatgaagagagagataggcaggaaagactagaacgggagagagagatgagacaaagggaggaaaaggagagagagcaaagaagacttgaagaggagagggaacttgagaaacagagagaaagagagagggctgctaggcaagctgtggaaagggctacaaaggaagcacgggaaagagcagctgcagaagcacgtgcaaaagcagagagggaggcacgccagcgtgcagagcgggctgctgttcaaagagctcaaaaggaagcacgtgagagggctgctgtagacgctagggaacgagctgagagggcagctgctgaagcgaaggagagggctgctgctgaagccaaggagaaggttgcaactcaagccagggatagggctgcagcagaaagagctgcagtggagagagctcaacaagaagcaaggaggagagctgaaagagcagcagtagagagggctgcttctgaggctcgggaacgtcaagctgctgaggctcgagaaaggcaggctgctgctgctgctgctgcagcagctgcagcaaaagaaaaacagagtaaaccggacgatcttgagtccttctttggtatgggagctcgagccaatagtgcgccgaagcaaagggctccaacagcggtgattactctaccaaaacatgcatgctaaaattttgttcatggcaatttttgggttattgttttaccaactgtggacgtttcaggattcgatgttcaattctcaaactcaaaatagaggggcagcatcttctgcttcagcatctatgcggaaggcatcatcaacaacaaatattgcagatgacctatctgcaatatttggaggaggtacggatcaacccaaatgcagcagttctgaacatacaaggttttgcaatattattggctatcgctataactcatttggttgatttcttttcttttagctcccacatcatctgaagaatttcaagaaattgaaggagagagtgaagaaagaagacgtgctaggttcgaacggcatcaaaggacccgtgaacgagcggtaatgttgctaatgattttagtaactaaaatagatatttgtttgtaacttgctgttataatttggtactgtggacattcattttatgttcctgaattttatcatttacatgttatttttttctatttattaagagttgtgatgcatgaatttgagttgcagtgccatttattaacttcaccgtgtatgcaggcaaaagccctggctgaaaagaatgaacgggatatgcaggttcaaagggagcaggctgaaagacatgtaagtactttttatctttcaattgcccaattttacttcttttaaatacttgtcatactggttagtctccatttattttcatatacaagtttactgatgatgttgtggtgcattttatttgttgagtaaattacactcacggtacatggaacttgtgtggtgggtgcaaatagatacaaccacttgcaaattgctcactttgatacaataacttggctagttggtgtttaccgggccaaaatgatccacacaagtaaaattgctctaaattagcacacactaatgatatgacagcatacacgtatgactgtgatttggagatcttatttcgaatccaaataaaaagaggaattagatgtgcaaaagtttatttttcatgtccaggatagagtatttatttcatttattgggaaaatttgatcctctatataactcgtctaatgtttatttatctgttcaagaccaagacaatttttatctgtacatttaactcctaaaagaacactttaattttcatgttcatgttcagatactctttcatcgaaagtgtatttaatgattgggcatttttaattattttacttttttgttggtctaaatcttgaaaatatacgttgtcagtataaaattttgatgtgtaacaataattacacaccagtatgtaatgtatcatatttgatcaattttacttgtggatcggtttggcccaggtttgcacaaactggccaagttattgtactggaataagcaatttgcaagttattgtacctatttgcacccaccatacaagttagtgtaccatgaatgcactctctatcaatattttgctaatggctagttcctttgtttcgttatctgttaatccagagaatttcagaaacaatggactttgagattaagcgatgggctgctggaaaagaaggcaatttgcgtgcattgctatcaactttgcaatatgtaagtccttattcctgatgctgctaaaaattgaatcaattatccttgtcttctcaatttttctattcattctctcggtgttattcttgcaaagaaagttgcttgactcttttgcttgtcttctggaagccatacttttccctgatcagtttggtagtgcaatttttaacgtagagtgtgttcctttatcatggtcacatttcaacacatgatattttctatccaagggtagttccgaggtaattttgttaagcatgcaggttccagtaattgtattccctgctacagctttttgtaagctttgttttcacctgtggtgaccaaaaccatggtattgaggtgaataggtgatatcagatagttttggtttcttgctgatgtttgaatgtaacatagctgagtggctcaaagaccagattgctggatgggctgaatatcttttgtttttctaagtcttccagtaaaaacgtttatctggtgttattctcttggtttgccattacctgcatacagtagctccttcctcgcaagctataatacatactctgtatgtaagtaaatagaaaattgtgaaggactaataattactcctattcaacaaacattgcattttagggctagtttgaagagaattattattaattctgttctttctgacaggtactttggccagaatgtggatggcaacctgtatccctgactgacttgattactgctgctgcggttaaaaaggtatatagaaaggcaacattgtgcatacatcctgacaaggtgcagcaaaagggggcaaatctacagcagaaatatgttgccgagaaggtgtttgatctccttaaggtgtgtatgctgccaaaatatattcacaaaccataatagcagcatgctgcttcacactaacaattggtcaaccgtatgtttttatttcccttttagtttattgtggagaaattagggactgcctagctacagagcctaacaggacttattaatgtgtttttccaattttaggacattggcctctacatggaaactgactatttgtcaattatgaatatttaggatctttcactgtacattttgagatattattattcatgtgtggtccattgagccaaataaggcttcctctatgatttcacatggaaagtgccaaggtttgacagttttcatatgattgatggtacactagaataacccatattaatgcaaactttggtttgtgtccacctggaccaccacctggtgccaacgcaagtatatctggcatgccctgcctactatgcccacaaccaaattaatgcaaaccttagtaatggcctgatagtctgcctagaggaacccaaaagcaaatgcttgacatatacacgatacgataatttaatacatcagattgatcttgttgatatttagtactttggctagtatatcttacattagcttacttctttatacaatgttgcatatttaggatcttattatttatttttagcaagaaaaaagagcttgtactcaattgttttccctaaaattgtttaccaagtgccgggacttttaaagagttctattttctagtgtttcccattacatccttttggtataaactttaattaaacctcctctatgtttgcacaaaacaggaggcatggaacaaattcaactcagaggaactcttctaaacggcctgcgcaaatgaaacatattgctcaccaatcttcacctgcatgaggcaatcggggtgggacagcacctcatagaacaaccgagctggagcagtcggtcggcggacccatgaaacgatgaagtgaaagttccaccataattacaattgtattgttattaccaatattgtttgttttattatacaccctcatcttctcccttctgtatgtgttgattcaaatgacatttcacagccacatgtggtggccctgcggcagaccctcatccagtaggtgtatattagcgttctttttgctcggttgatccagggttgtgtagcagcggatttggggtggccagtgttgtggtttttggattaggcacagggtttatttaccatggagggcccaaattgcatggatcatgaatgttgccagtttgatgccatgggcttttcgtaagttcaattatcttgtttatagtgaacttctggaacacacattggggatgttcctctgattcctgtgtgattttgtataaagttgatctggaattttgatttcctcttgttctctgttaccgcttcgttatttgctcgttccttgaacgtataacgctagtatcacaaaatcctgtagagtttcctttaaagagtaaattttacggaacttcatgtattaaccaattgtgcataagtcatttgttttggcatgttgcttataatggtattatgctcctataacttcagaaaacagcagcagtaaccaaaatttcatctgagttctttaattcgatcatataaaagttatagtaatctaagttaattcttttttattttgctatagtgttaattcagattgattactagtagtgtggttttgtgaaatctaataccgatggtcactgtgcaatatgccaaaacccatatatcttgttccatttaaaaccataataaatagggttatgtgatatttaataaaacagatctgttaactcaaataaagattgaattgggaagtgttttaatagtttattaaaggttggattgggaagtgttttatagtgtagtggcttgatgaaatcatgggtctgccaccgtgttgcatcgatctcccaaattcttttctcgtttcactcgcatcctcatcatcttcatgttacttctacctacaagtatattgttttctcactattttatatcttttgctcgttaaaggacaatgatttgggtgtattcccaatttcccatcggatccagtaactcgtgtaatcaagcttaacctcatcccattttgcttcttttaactattttcttttttctaatgggtgtgttcagctgtcatttttcagcagcggctgcggctgcaactgttcaaaattgctgcagcttgcagcgactttgaactgcggccgcagcgactgtggcagccctagctgccgaacagggccaataatggaatagaataccatctcaacctttgctcaacgagttatagcccagtccagattcatagctagagatgattatattttaggacagagagagtaggcgagtagctattatgtttccaccattgtttatcaacttaaagtccggtcactggatggatttgaactatttccattgtttatcaacttaactatttccatacgtcagggtgtcctcctcgatcatatcttaaccacgtcttggtagcatgcttttctcgatcatctccatacatccgttaaggccatgatatcctccacattcatagcaacattacgagtgtgtttggttggtagcctagatgccacacctgtaacaagtctgaacaacatacaaatttgtttggttacttatctggagagttgcctgactcaggccacaaaaaatgaacaccacaaatgaatgccacacctccattcttttttcatcaacgtgactataatactaacatttgtcaccatccgactcaaataagtgtactttttatctatactattttaaaatatagtagtgatggactggtggtagcagtgagtctgctactatcacctctatcgctaacatattaggcctccttatcggtgaaactcacgtgctcactggattcaaacgtaaaaaaaaaagtatgtctaagcaaaataatgtcaatatttttttaaggtccggtaagtacgtactcccttcagtttcattttaattgacgttttggacaatgatacggtctacaaaatatatctttgaccttatttttctattataatatatataataaataattgcatatttacttttattgtagtgctttgaaagacaaatctatatatgttgttctagttcttttaaattaaatatttttaaagttattaattgtcaaagttataaaagttcgatctcaacctcatctaaaatgccaattaatatgaaaccggagggagtagggaattaatccatatagttaaaaggattagaaagagccagtttgcagaatcttcaaaaagataagtgtgcacaacgtgactttgttttttgccattgcaacatacaggcagtcttgtcccaaaatgaaactatttttttcactcttcacccaaaatgaagctattttttcactcttcccctcctctcaacaaatcataaccattctccatttaattatctcgtctactgtctgttctcagctaatcacaaccttactttaattatttctaccgattttttaaatacccatgctcactaaaaaaacctacattttgaatagaggtaatacaaagtactctctctgtttcgtattacatgtcgttttgacatttttagttaaactttttaaagtttgtccaagtttatagaaaaacatagtagcatttttaacacaaaacaaacatatatctactattataaaaatcaaagatgttttttgtcgaaattttgatacgtcatccgtttttgagttgttatatatcgtccgtatccaatttgatgtgagtatagaataactattatacatcctatcctagcccaacccctcccctccaagcccaacctaactggcccacactatcccgccgtcctatcgtgcgtttaataaaatatattcaatgctagatttaataaaaactaattcggtgttttagatattactaaatttttctttaaatttggtcaaatttaacaaagtttaactaggaaaaaaatgtcaaagtgacctataatataaaactgagagagtagaaatatagcattgcacacgtcttccgtacaaagatatactaaagtggtgtttggatccagggacttaactttagtctctgtatttagagtattaaatatagactacttacaaatctaattacataaacgaaagctaatttgcgagacaaattttttaagcctaatcaatccataattaaagaatgtttactgtagcattacataggctaattatggattaattaggctcaatagattcgtctcgtgaattagtctaagattatggatgagttttattaatagtctacgtttaatatttataattagtgcccaaacatccgatgtgatagggacttaaaagttttaatcccatctaaatagggtctaaggccctgtttaattccagggatgaaaagttttgggatgtcacgttggatataaagacacacatttgaagtattaaacgtagactaataacaaaacaaattacagattccgcctgcaaattatgagacaaatttattaaggctaattaatccgtcattaacaaatatttactgtagcactacattatcaaatcatggagcaattaggcttaaaagattcgtctcgcaatttacacgcaatctgtataattagttttgttctttgtctatatttaatactctatatctatgttcaaacattcgatgtgatagggtaaaaaaattttgcgtgggacctaaacatggcctaaggaaaaagccattatccagttcctcttagaccctctagacttctggacccacattccagtttccaacgttaaacccacccaggacccagcacaccgcaccaacctctctcctccccccccccccaactaccaaaatttcaaattcccgcactccctcctcccccctcgccgccggccatggacgccgccgacgagatggacatcgacgccgccgccgacgagacgggatccccgccctccgcctcgggatccctctccaccttcctctccgag

SEQ ID NO: 65084 - DNA, 38072 bp, Oryza sativa
tccctcgcctccctcaccttcctctcctcggcggcgtccccctcctcctccatcttcccccgcctcgccgccgcgggcctcccggcctcctccctctccgccccgctcgccgcctccctctcctccgcgcaccacccgctccccgccgccgtcgcctacctccgcctcctcctcgccccggcctcccctctcctctccctcttctcgccgctccccttcctctccctcctcctcgccctccgcaagtcggcgtcgtcgtccgccgcgtcgcacgatgcggcggcggcggccaaccctagctccggctccggctccggctccggctccggcaaggggaaccaccggaaccggaagcggaagagccaccagcagcgtcagtcgccggcggcggccccgtcgctcctccccagggcgctcgcgctcctcgccgacgccgcggggaggctgccgctcggggagcacccggacgcgcggaggtcgctcgtcgacaccgccgcggagctcgccgccttcgatgtcctcgtcgccgtcctcggatctggctactacgccgaggcgatgcccgatttggtgcgcgcgctggcccccgtggcgctctcagggtccagatcggcggcgcgggcgtccgcggtggaattcttggcgaggaaggttgtgccgttgggtgtggagggaggggaggatggggtgaggaaggcggtgggttacctaccgaggtatctggcggcgaaggcgccggagaagtcggaggctagggcgatggcggtggaggccatagtcgaggtggtgcgagcaatggggcaattggagatggagggatttgctgggtatgtggtggctatggcgaaggggaaggcgaaagggcggctgcttgctgtggatttgatcttggcgatgctgccattgctgctgccatcggaaggggatgattgtggtctacaggagggttcttgggggctgaagtttgtccgggtgcttgtggagaggtgctcggatacggtgggaggggtcagggctcgggccttgacgaacgcagcccaggcgctcgacgttttgtctgaaagaggcatggaggttgaccggttgcaggaggtgatgaggatagggaacataggccttggcgagttgctgaggctgcggtgcgctgatgataaggctgctgtgaggaaggctgcgcttgtgctcattactaagtcaatcagattgatcgggaggcctgttgacgagtcgctactcagtgctatgggggctgcgtgctctgatccgctagtcagcatacgcaaggcagctcttgcagccatctcagaggtgttcaggaacttcccggatgagagggtaacaaaagagtggcttcaggctgtgccaccactggttattgatagtgagacaagtatccaagaggaatgtgagaatttgtttcttgaattggtcctgaacagggtctgtcaagctgccaatttgaatctaaatgatgattccaatgatatggaggaagtgtttcctaaagggacactggatttgctgaaaagtatctgtgatggagaggttgcaccatgcataaaaaagatatgtgcaagccttgggaagaagaaaaagctgaaaccactgcttgcaagttcattgcagaatatcataacaatatcagagtccttgtggttgagaggttgtaaaccaattgagatgtggactgcaccagccggggcatggtggcttctttctgaggtctcatcatttgcacctaaatcagttaactggaaattcctctcacaccactggaaactccttgataatgttggccaagataaaggcaaagttcgtcctaaaggggaaccaaattctgcattatgggctgtggatcgtgtttcactcttgcaaactatttcaaatgtttccatggagctgcctgtggaacctgcagcagaacttgcacacagcttgctcacacggattgaaaattttgacatgaaccttagtgaggtaatcatttaatgtatcaattgcaaaatttagtctagtacaatagatttattacatagcaacaaatcatgtactctgtttgtggtcaggactaggctgcaatttagttgtaaaaaccactaaatcattaatcatcttgatttgtaaatccactatggcactacgctgaaatctaccatgccacattgcattccaccctagtcatgttactctattggaaatgggactagggagtatttatttttatgaagaatttgatctagccagtgcttttaatggtgtctttaatttgaatgaaggtgaacatgtcagtgatctataaggtaaagactgggtatatatacccataactataataatccacaatattttgaattagttttctgaatgaggtatccttctagcttatctgaaggttcacatcatagtcccaactcccaaaattgctctgtggaaacctacttgttatgacaagattatcccgtatctgtatgctcagattatttgttacctaccttgtttttacctgccctttttttttttctctccatagttctgcaatggtgttacttatccacttgtattatttttattcatggcattgctacctttaccttctttgttagatgaataccatttttgtgtaccacatcgctcttgatataagtaattcattgtgatatgttcaccataatgtcttattttcatacacatacaggttgatgctcatgtaaaatccctgaaaacgttatgcaaacgaaaagcaaaaacagctaaggagggcgaaacactgatcctgaagtgggtgcagcaacttatatgtaaagctgttaacattcttgatgaatacataaaggagacatcagaagctgctaagggtcctaaattttttacacctttgagtggaaaactcaagggaagaaaagatgcatctgcacaaaagtcaatgtcacatgcagttattgctgtattcaccattggatcgctgatcctagcttgccccactgctaatgtgcaaggcgtcattccttcgctgcacacaatcataacatctggaaactctcagccaagaccaaaaaatcttgctggtgggactgtttctttcaaagagctagctccatctttatatatacagtcctgggatacaatggctaaaatatgccttgtggatgacaaacttgcgaaaagatatattccactttttgttcaggtgcgtagccttgcatggttgcacttccatgtctactcttaatagaaacactcaatgctacttctttgactcaggaacttgagaggagtgatttggctaccctccggaataacatcatgattgcactggcagacttttatgtccgttataccgcaatggttgactggtgagcttacatctccattggttgacttttatatctgttatgtccttccaaaatcctgttactgtgtttctttcaagtggatttgcatttgcttgcttacacagtcacataatataaagcatagatatcactagtgtgtgcatactttgtaaaattagcacatactgtcaatattcacaaaatttgggtttatctttgttacagcttcagttgcaaaagatgtaaaactgctttactgtttgattaagatcttatcagttaaactgcacgtgggaaacagggaaaacattaaaatagttcaacttctaactgacctcccctttttattcactctgcagttatatgtcaaaaataacaaaatcgttgcgtgatccctgtgaggtagtgaggaggcaaacatttatcctactctcaaagttgctgcaggtgctaataattttcttaatatcacttccacatgtttggatcatggtttattgaaacttttcttttatttagagggactatgtaaagtggagaggtgtgctcttccttcggttcctgccatctttagttgatgagtcagagaagataaggcatttggcagacttcctttttgggaacatcttgaaaggtttaccctgcgttctgttttatcttttacttgattttttttatttgaaatttgaaaaaaattgtggccacacgttttcttttttcttgggaaagtcaagcactcaagttctttttctgaaggatttaccccctttctgtgttatctgtctaatgttgacataaattttgcagctaaagcgccactccttgcatataatagtttcatagaagctatctatgtcctaaacaattgcttgggtaatggtgcgcaaaccgaatctcagggaaggttggacggaggaccaaccctttttgcaatacggtaaaatatgtagaaattcctcatgcgtttttgagaaaaaaaaagatatccactttgcaaaaagctgtgcttcatcctctcctgagttctatcatggttatttttttctttttgctgcagaggcactgacgaaaggtcgaggtcgaaaagaatgcacatatatgtatctctgctgaagcaaatggcaccagagcaccttttagctacgtctgccaagttatgtgccgagatcttggcagctgcttgtgatggcttgctcaatgtcgatgatgccgctggaagggctgtacttcaggtacataccataccaatattgatattttggacaagtttcacgctaatgtgaagtaaattgttcatgcacatgcagccaaggaactgagattaactttcatgcttacagtttacacgtttaggtcccctttgattcaaaggaaattcataggaattttaaaggattccattcctaaaggaatttttcctatatagccctttgaatcaaaggaatgaatcctatgaaatcctatgaaattcctatggaatgtctaaagacatggaagttttggaggaaatctagcatgaggttctacctcatgaaaattttcttacgagtcttcatctctcctctaattcctacgtttttcctgcggtccaatcaaacggtcattcctgtgtttttcctgtgttttgcaatcctttgttttacacttgtactcgtatcaaaatcctacgttttttctgtttctacgttttctcaatcgtatcaaaatgtttgctcagcaatttcctccatttagcctttgcttctttcctttgtgaccatttagctacattttcacaggatgctctacaaatactggcatgcaaggagatgcgcatccaccccaacatttgcacggacaattccgagatggatgaggaatgcggcgatggcgggtcgtccaatgccactctccaggcggcgaaagggagagccgtcacccaggtggcgaagaagaacctgatccagatcgccatcccgatcttcatcgagctgaagcgccttctcgagagcaagaacagcccgctcaccggctgcctgatggagtgcctgcggaccctgctcaaggactacaagaacgagttcgacgagatactggtggcggacaagcagctgcagaaggagctcctctacgacatgcagaagctcgacgtcgccggcaagggcaaggccaaggccgcagctgctgcggaggctgggccaagcggagcctcgccggcggtgaacggtggcggcaagagggcggcggacggctcggcgagggccacggcgaggtcggtgctcaaggaggtgaaccggaacacgccgacgccgccgctgaactcgatgagcgtgcccaaggtgaggtccatgctgggcgtcggctcgcgccggcccgctgtgctggagtcggtccggcggcttgagccgtttgggtccgacgatgagaattagcgtgccatatggcagaagctttaggttggcctgatggtcagtattaggctgtgtttatgatgctaactttgaccggtttaggagaaaattacaagctcagtttctcgctgacggttttgtacatggagtatatatttaacgcattttagtgatgttcagagagatgaaacaattttactgtcgcattttctccttagtttggatgtgacatgaaagtatatatgctttacaccgaagattgcgatgtctcttgactgaatactctaacttcttatagtggaattcaggttcgcaagcaggaaatgtataaaaatcatggctacagatgggcgaacttgttaaaaaaaaaaaacaaactcaaaccacaccaggatacatacaaattgatatgtgagcaattttgacatttcatctgatggtgtgctaatgagcgaattagattatcaatatgactttctcaaaaaaaaaatcaatatggcattttagcaaagccaaccaacttcatggtatttataggatgccatcaaactatgtggcaaaggagcgataatagcgaagggttccaagtatttttctatatttgtttcgaaaaatagtggaaaatggtttagtggaagctgttgattatttgaaacgggaaatgtgcagtaaaaagggaacttctaaaataatcaaatcctagaaacttctcttatgcttttttagctagagagtagtaaaacattctcattctttacttgtaggcttatcagttggagccagaatttaaatttagaaatacaattttagagttaatttagaattattttattgtagtttatttgtagcgttggcttttaaaccacaaatagtaaagatataaaagttttaaccctaaattattttttgtttgcttggttcatatttatacggcttatagccatagcttaactaatcacagcaaattaccattaacttaagagatcgaggcagaatcccaacctaaccaacttacggcatcagggaccgaagttgcccaaaacctgacacagcttggctctaatttcacacatatctaagccaaacaattcagcaaccctatttgaattgagctatgtctacgcctaaatagagattttgtacgctagatatgattaggactgtgaaatataacgggttgtcaaaattttgtaccgacgtataggaatcgacttctacttttacttaaaccagaaccaattctcttcttgagaaacaagaaccgattctgatgagtccatataattgacgaccccccctcccccaattcgatctcttccatataaatcaaatcaatttgatttatataattcgattgatttgatttgaaagagagagaaattaagcggctactagcgcatcacacatggcgaagaagaagaaggtgttcatattcaggaaggcggcggacgtcgccatggccgtgtccgccgcctacgcgccgttcgccgccgcggtgtcctaccatgccgccgccgccgcgccggcggcgctggccttcgcgctcggccacggcgcgctcctcttcatgctccccttctccgtctacgcgctcgcgttcctccgcgcgccgcgcggcctccaccagacgccctacccgatgctcgcgtgcgccgtcgccgcccccgccgcgctcctcgccgccgtcctggccgtgcccgtgctcgccgccgacgacgtcgcgctcgcctgggccgcgaacgcctccgccgccgcggcgctgtggtggtgcctcacgaacggcggctacacggcggtggcgttctcgagggtggaccagtacgccagcttcatggacgcggtggagcggacgccggagatcgcgttccccctcgtgttcgacgtccccgccaccgccaaggccgccaggcgcgacgccgtccgcttcgccgccgccctgtccgccacatgcgcggtcgccggcggcgcggcggtcggcgtcctcggcggcctctcctcggccgccgccgccattgccgccgccctgtgcatcttcgcgctgccgatgtgcctcctgtacgtgccggagaatcacatggacccctaccccaccatcgacggcgtgctccagcgcaacccggcggcagcgtggtgcacgcttctggcgccggtggcgctcgtgctgtgcggcctcgtcagggcctcggccgccacgaacgccggagacgttggcacgttcgccacggtcatcgccggcgcgttctgggccatggacgccggcgccgccgtgctgctggggcgggtgatcgcgggggagatcaccatggcgagggagacaggcaagcattcgatctaccggtcgagctcgtcggagatcatgtcggcgttgctcatggtttgggtgcggtatttcgtgtacctccatgttttccacctgattggctgcggtggacacctcacatggttcaactcatctcactagcttagcctactaaagttcgaagtcccaaatatggacttcgtctcaaaaatatactccatccgtttcataatgtaagtcattttagtatttttcacatttatattgatattaatgaatctagatatatatatctatttagattcattaccatcgatataaatatgagaaatgttagagcaatcatatctgggagtaccgtcttacagtacagtattagactcagtttattgttgatatagcagaggatccacatcccctattcttttttttagataatgacatcccctattcttctgaagcagaggatcaaatccttcaatctaaacagttactatttttatttttatttttatagagactagaaaaaatacctgtacgttgtaacgggtgaaggctatgttaatcttattattgctatactgtttagttaatgtgaaatttactgtggaaattcgcttagagatatattttttaagaaactagcaaaaatgtccgtgcgttgcaacgggtgaaaaaattctaacgataatttatttttttcatacataaccatgtcaatgataatgtttgtatagattgtttatagctaagacaatcaaaaagttggaacatcttcaatgtaatggcccaacctcaacgatgacaaccttaccgatgcctgctttacctaaaataattggattatccacgtgacagcatatatataatctaaaatactctttcaatcttattcttgcaaccaataataggattaatcagatactacattacctcgcatggtcaagtctacacaaaatagagtcactatgcactcttctctaaataacaattaaaaatatgtttatttttcagtattatttctatatcatatgttatcagaaatattagctatacttaacaaaaatagtctaataattgcatatagagacgaaacaaaagcatggtaggagatgaaaaaaaattgatgatcctatccgacctaagagtccatcaatttagtgttttttttgagcgtccatcaatttagtgttttttctgatatttttttcagagcagcttgtttttttatatacagtgtttttttcatgcgaggtttttccaaaccattttttttagaaatggcatgttttttctaacagttttttcttcgcatgttttttttattttttagggatgacggaaacattttttagcgcttttttctgacatttttttctcacgcttttttaaccatttttattttctcgtgtatttttttatttttagttgtacgttgaaaacttttatttataattgtacgatgaaaacttctctttttagttgtactatgaaaacttctcttttcaaatagttagattagattagattagagatagagaagagatatatgcggactactaaaacgaatagaaatcgaactttttttaccgcgctttttcccgctccttttactttttttctcattcttttttattttttacgaactattttttcgccactttcttagggaatcagatggagcttttttagatgtgaattttttaagtaggggcggacgaatgaaatgttttgaattttttaagtagcagtgatagagaagcatacaaagcttatatacatgcgtataaaaaaatatacagtttacaaagtttgtatacgtgtatataaagtttgtatacatatatagtattaggaaataaaaaaccaaaaaaagaaagaaaaaaaagaaacgaaaaaaagaaggaaaacagaaaaaccatacgtgggaataggattatataggaataggattttcccccctttttaaggggaattagatctactgtttttttccggcttgcaaatcggacatgttttttttttcgccacttttttccgccttgcataggaatcggacatttttttttgttgtttttccctttttaaggggaactgaatctacgatttttttattttattcgctattttttctcaaacttttgggaattggacttctttttttttttgctattttttatttagatggacgaaggaaatgttttgtattttttaagtagtagagaataatgagatgctattaggagtccaatgtttttttaaaagaaatttcttatacaactccttttttattttaaaaaatgaacgaacttagaaaccgactcaaatacaaatatgtatttctaaaagcgaacaaacttaaaaattgactcatacacgaatggcgtaccaataaaaacatctttaatttttataatagtagggaatagatagaaagaaaatacttgtgcgatgctacggaacaaaaaataaaatagcaattaacattaaatagagaatttagttttgattatggaagcccttttgaaacctacatctattttctatacaccacctccaaacatgagctaaggctagtgtgggtggtatgcattatgcaatatctaaaacatatttttgttttcgcatgtgagaaatgagaatcactattagtattatgttctctctccgccaatctaataaaaaatatccatgcatgttttgattggtgagggcatggaatatttaaatcatcgctagagattgcagaggtttggttttgtttgcagtttgtaagaaactactctctccgtcccataatataagggattttgagtttttgattacaacgtttgaccactcgtcttattcaaatttttttttaaatgtaaaaaacgaaaagttgtgtttaaagtactgtagataataaagtaagtcacaaataaaataaacaataattttaaatttttttaaataagacgagtggtcaaacgttaaagcaaaaacttaaaatccggacggagggagtatcgagatgcagtttagctgctcaggttgaagccttggcttgcctggagggtgtccaattggctgccaattgggtacagatgccaataattttagaatccgacaacgccaaagtcgtagcaggactgaattcaacacaagactcaagagcagactggggagttataattgctgaagcaaaagcggtgatgcgatgtttggtgcaggtgcaagtgcacaagatagataaagagagattcaaataacatggctcatatgttagctcaaatggttatgagatcaggagttgaagcggagtggaggttatgcgctccgccagaaattcttgcatcgcttaaccaggaatgtaaatcctatgttctgccattaataaaatctctctttacgctaaaaaaaaaaataaaggctgagtttagttctaaactttttctttaaacttctaattttttcatcacctcaaaactttcctacacacaaactttcaacttttccatcacatcgttctaatttcaaccaaacttctaattttagcgtgaactaaacacacctaaagataggttgtcagggttacgggttaggcataccctttacccttcgataaatgttacatatcgatatgacatacccacgcgcatgcggatatttcctgtatattctaagggaacctttcatggaatctacagacgggaagaatcctactcgggcagaattgggtcgttgacgtatcgtatagggtctgatatctccgagttctacgtggagacctccagatctgcgatataaaagggaccccccggggagggtttaagggattgaatctcagagccaacacaacctacacagcctacgaggagccaagtcatcgagagctagtcgaaacaactcgactacaatcttgccggatccgacaagttcccttgttccctttgtaacctgtgttttctaccatataatcccacatcaactggattagggttattacctatcaagggacctgaaccagtataattcttgtcttttgtttgcttgatgtcgtactacgtagatccttgtaccaacgtactccaataccctctatatccggtctacgggtatcacccgtcgacagtggcgcgccaggtagggagccttggtactcaaggttctactactacgtcatccagcttcgtcgacaacaacgtcagcaccagcctcagccaagtactccctgcttcaacaatgctggtatggactcaagtcggcgaaatcgtcttcccggtttacaccacgacgctgatctcaaccggtcctccaaggactggagacgagaacgcagtggctacaaaccaaggcgattccatgtcgaaaaatcctcccgttgagacggagaacggaacatcgacgacatccaagctcgggaaggattttgatacggccaaaccttgtccttccgacatgaaccatgagccgacaaagatgacttccgaagccacaaggtcttggtgtcctatccacaaaaccaagaaacacactctgcaagattgctgggttttcctcaacgtccgtgctgaaattcgcgcctacaaagaacgtggaattcggcgtacttctccaactcgggaggtctattgtcctattcacaagacaaagaatcacgacctctcgagctgcaaagtctttctcggcgccatgaaagctccgtctcctaagttatatgtccccatcagggataacggcaaggaacaaggagcgactccaacttcagatcgattcgttggggtaatcgatcctcacgaaccatcggtcttacatctcctcgaggactatgggtcatcgacaacgagcgcgccgcgggaggtattggctatcgatgacgttggcacgtcagtgcacgccaacgcagaagcggggaatcaatcgactactccagcccagcacatcagggccgttcaagcgatactgagggaaactccttacgatcccgttctgaacgatgacctcgatcgttggacagaacgactacgggaatcggtgactaacctcagcaatacgtttgaagaagccgctaccgcagcacacaaggagcagccaccaactggcgatgccaatggtgaagatccggaacggagggaatcacctcaacgagctacccctccacctcgcggcactagcgatcttcgagatcaaatcaacggccgccgagaagcacgacgcacacgagacaacgtgaatcgctctcggcgtcatgtctcttcacagcgccatgataacggaaatcgaggagaccgctcaaacgaggaccgggaccacgacaaccaccacgatcacaatgatcgcgaacgatgggtgccagacaatactggtcatggctgccgccgtaacgacgacgacgatggagatcggtgccgagacaacagcggaagacgacgacaggattcccgagatccaggccgtcatcctcgtaatcgtacgccggaaccaagcgacccatcgtcatcgtcatcatccgcgtcctcctcatcgtcagacagacatccacgaaggacacacgaccgccgacaacccaccgcccccaacgctgggtgtagggctttcggtcgttccctacgtgatgtccgatggcctgagagattccgacccggagcaatagaaaagtatgatgggagcaccgacccagaggagttccttcaagtctactccacagtactctatgctgccggagcagacgacaacgcgttagcgaactatttaccaaccgcgttgaagggttctgcacgttcatggctgatgcatcttcctccctactcaatctcttcgtgggcagacctgtggcaacaattcatcgccaatttccaaggaacatacaagcgccacgcgatcgaagacgacctacacgtgttgacacagaactcgggtgaatcattgagggaatatgttcgacgcttcaacgagtgcagaaacacaattcctgaaatcaccgacgcttctgtaattcacgccttcaaatccggtgtcagagatcgctacactacccaagagttggcgataagacgcatcacaaccactcggagatgattcgagatcattgagcgatgcgcccacgctgatgatgcgctaagacgcaagaacgataagccgaagaccgggggagagaagaaaccagccacggacacatctgagtcaagcaagaagaaaaatcgcaaaaatgggaaaaggaaagctcaagcggaagtcctcgcagcagaatacgcgaaccctcccaaaagcccagacccacaaagcagcgacacaaagaaatcatggtgccccatacacaagacggacaaacattctctggaagattgccttgttttcaaaaagtcgctcgagaagcacatggcatttgaaaaaggcaagcgagtacgcattgtcgagaagaacgaagagacggctcctcacgaatcggattcagcatattcagactctgacctgcacgtctcacacatcttcggcggttccacaacgtactcctccaagcgagaatacaagaaagtggaacgtgaagtctgctcgacatggcagggggctgcacccaagatgaagtggtctaagcagaagatagagttctcggaagaagaccaccccaagaccgccgttatcccaggacgatatccgatcgtgatcgaacccactattcggaacatcaaggtagcgcgagttctcattgacggtggcagctcaatcaatcttcttttcgccagcactttggacgcgatgggaattccgcaaagcgagttgacaccaactgatcaacccttccatggaattactccccaatcatcgtccagacctttgggcaagattacgttgcccgtgactttcggccaagccaacaacttccgaacagaacagatcacctttgatgttgctgaattcgatacagcttacaacgccatcatcgggagaactgcacttgcgaagttcatggccgcatctcactacgcatattaagtgcttaagatgccgagaccgaagggaacattcactattcaggggaacgcaaagctggcggtgcaatgcgacaagcggagcctcgacatggtcgagcaaacgcctagcccacccgccacgactgagccacccaggaaaatgaccaagacaaacaagacgccgaaaccagacggcgccatcaagatcgttccactctccagtgccaaccccgacaagaccgtcaagatcggggcgacactaaacgagaaataggaactcgcgctcatcaccttcctccgcgacaatgccgacgtgttcgcttggcagccgtccgacatgccgggggtccccagggaggtgattgagcacaaactcatggtgcaacccgatgccaagccagtaaagcaaagactgcggagatttgcaccagaccgaaaacaagccatacgagaagagctcgacaaacttctcaaagctggtttcatcagagaagtacttcatccagagtggctagccaatccagtcatggtgcggaaggccaacggaaaatggagaatgtgcgttgacttcaccgacctcaacaaggcgtgccccaaggatcactttccactccctcgaatagaccaactggtggattcaacagtcggttgcgagctattgagcttcctcgacgcttactctggctaccaccaaatcagcatggcaaaagaggacgaagagaagacagcattcatcacgccgttcggggtattttgctttgttaagatgccgttcggactgataaccgctgggaatactttccagcgcacggtccaaggcgcacttagcaaccagcttggcaataatgtcgaggcttacgtcgacgacatcgttgtcaaaaccaagacaggcgactcattgattgacgatctgcgggaaacgttcgacaacctccgacgatatcgcctcatgctcaatcctgagaagtgcacgttcggagtaccgtcgggcaagctgctcggattccttgtctctggcagaggaatagaagcagacctcgagaagatcaaggcaatcgagaacatgaagtcgcctacaagactcaaggaggtacaaaagctaaccggatgcatggcaacactaagcagattcgttgctaggatgggaaaacgaggacaacctttcttcgctctgttgaagaaacaagacaaatttgtatggacacaggaagccgaagaggcattcattgcactcaagcgctacctatcaaacccccctgtacttgttgctccccaacctaatgaagaattattcctctatattgccgccacgccatattccgttagcactgtcattgttgtcgagagagagagagaaagtacatcgaccagtttattacgtcagcgaagctctccacgacgcaaagacaagatacccatagatccaaaagctgctttacgcagtcatcatgacatcaaggaagctacgccactactttcaagcccacagagtcacagttgtctcctctttccctcttggcgaagttgtgacaaacaaagacgttgtcggccgcattgcgaaatgggtagtcgagctgagccagtttgatgtccactttgtgccacgaacagccatcaagtcccaggtactcgccgacttcattgccgattggactatgccagataacaaatcagacaaccaaggcgacaatgaaacatggacaatggcgttcaatggcgcactcaacagccaaggagcacgggcaggatttatcttgacgtctccctccggagatcaattcaagcacgcaatccacctcaacttcagggcgaccaataacactgcagaatacgaaggactactcgccgggatacgagctgcagctacacttgaggccaagcgactaatcgtcaaaggggactccgagctagtcacgaaccaggtgcacaaagattataaatgctctaactccgagttatccaagtatctcgcagaagtcaggaagctagagaaaaggttcgatgggatcgaggtccgacatgtctaccgcaaggacaacgtcgagccagatgacctagcacgacgtgtttccagacgagaatcgctcgagcccggcacttttctcgacatcctgatgaagccatcggtgaaagaggttagcggcgaagtcagcccgaacacccccgacattagctcggaggtcaccgaggcagaacgcgccattgccgacatcgaaaccacagacgactggcgcatcccactaatcaaattcatcagcagtgaggagttgcccgaggacgatccagaggccgagaaaataacccgtaaagcaaagatctactgtatggtcgacaatgatctatataagaaagtgccaaacggggtacttctcaaatgcgtctcgaccgacgacggcagacacctcctcctcgacatacatgaaggcatatgtgggtcacacgccgccggtcggacattggtcggcaaagcttttcgacaaggctttttctggccaaccgcccttaaagattcatgcgacatggtccagcgatgtgaagcctgtcaattccacagtaaacacacaaagctacccgcgcaagcgctccagactattcctctgacttggccattctcgtgctgggggctagatatacttgggccattcccacgaggacagggcggctacagattcctattcgtggcgatcgacaaattcaccaaatggatcgaagcaatacccacgggggaaatcaaggccgacaacgcaatcaaattcatcaaagggatattttgcagatacggactaccacaccacatcataactgataacggctcccagttcatcagcgccgatttccaggactactgcatcgggctgggggtcaaaatatgcttcgcctcggtctctcaccctcaaagcaacggacaagtcgagaggggaaacgacatagtactacaagggatgaaaacccgcgtctacaacaggctcatgtcacacgacaaaaagtgggttgaagaactcccatcagtactgtgagccgtacgcaccacaccgacaacgtctaataaggaaacacccttcttcctcgtgtacggctctgaggccatgctcccaggcgagctacaacatcagagtacacgagtacagaagtactccgacgagaaccaggaggagcagcgagatatcgatgtaaatcttctcgaggagcatcgtgaacgagttgccgtccgagcagccagctatcaacagatcctccgccgttatcacgagaagcgcatccgtgcacgcatactttcgatcggcgactatgtcctccgacgagttcaaagccaagcagggcgaaacaaactctcacctaaatgggaaggaccttacacgatcacacaagtcttgcggccaggcgcattcaaaatcgcagacggcgacggtcgcgaattagcaaattcttggaacattgaccaactacgtaaattctatgtatgagtcaataccatccatacctgtaagcacccttacagtatcaataaagcctatttctaggcccatatcacaattaaagtgtttcgcccgatgatccctcactctgatgacacctagcgttgaaacctgtccttatgtccctttacgccgtctcgacaaggcctccgaggaacctaagggatcttcggctggggacacccagagccgataaggccttgtcagatcctgtagagacgaaagaccatgtaagatctggtcgtgtaagagttctcgccgtgcgtattaaccaagccgtgaaatcggaaatcaactttccaacttcatggctgggggctaggatcagagcttattcaaccaaggcagttcaaaggtccaagagccttatcctccgagaaaattcctccgacgacaaggctgggggctagggagagtgtacgactcaaacggctgactaaagtcgttaactgagaacgcactcttacacatgacatctagagtaagagacatttgtcaaagatagatttctttattcacaaaatacttcttacaattttttcaaaaatctttcgctacattacatcttttcctaagatatttgtcacagggtacgagtactaccaagaaggccaacgccagtccatagactggaagatcttctcggctgtaacattctgaaaattcgaccaacaaaatcaaagactccaaaaattcagatcttcaaaaaaaaaaactttttaaataaattgcatcatgccaattttattcgaagattttattggattttgatttcggatttcatcgatcacaaatgggaggaaattaactaggaataaaccctaaaaatcaagtgggctaaataaataattaaaatataaattaaaataaagattcggtgggtttggaaataaataaaatgttatcgcaaccatattaacaataattaaattttaatacgatggaatgagaattaactttaattaaaaattcaaatgaattatataaacaaaatatgagtgatattaaattaggtgaatcttcaattagaataatataaatatggggtaaaacttcatttatacaaaaaattaagaatttcggaatgaaattcatatgagaaacactctaaaatcggtttattggaaaagtgcattgttcattgcccgccacgtgttcgacctggtccccaacctttcccctcccctgccacgcgcgccgctccgcctcccctctgccgcgtcgctcgccgtcgcatcaccgtcgtcgtcgcgtcgagccccgtgccgagccgcgcccgtcccgctgccgcgccgctccccgtcgcgtcgccgtcccgcgtcgcgtcgccgtcccatcgccgcctgccacctcgccccgcgcgcccacgcaccccgtcccgcccgtcgcgtcgcagtcccctcccgcgccgagccgctccggagccccgcgccgcgccgcccgctcgtcgccatcgccgagcgccgtcgcccgtcgcgtcgccgtcccgtcgccgctcgtccgtcgccgtcgcgtctcgcgtcccgccgcgcgccgagccccgcgccgccccgagccccgcgcgccgccccgagcccagcgccgccatcccgtcaccacagccgcgtcgccgcccctccccctcctctctttcccctcttcttcttcccctcttcccctcttccctcttccctcctcctccttcccccttatctctctcccttcccctataaaagcctcactattcccccccttctccccgtctccaccacccactcctccacgccgtcgcgccgccatcgtagtgccgccgcgccgccatcgtagtgccgccgcaccgccgccgtcgtgctgccgcgccgaccgtttccgtgcccgcaccgctgttctcgcgccaccgtgagccgccgtcgctgccgccgtcatcgccgctgccgccgccggtgagtcgccctccgtttccctcgagtccgccgtcgccaccgctcgggtgggaaagagagagagccgagagaaagagagggagagccgagaaagagaaggagaggaagggaggaggaagccaggagagaaaagaaaagaaagggagagaaagaaaaagaaaagaaaagagaggagaggaaaaagggaaagaaaaagagaaagaaaaaaaaattaagagggaaatttaaaatatttacaaatattagaatttaattgtaggattaatgaaaatatagttagataaactcttactaattaaatacctaaaatactagcatttaaatataggattaatgaaaatataattggataaattcctatagattatagataacttttagtactctccataagaaatcaattcgcggtattaatttagatgtaattaataattaaacaaatgtatgaattctcgtaaattattgtggattatttctgggaaatctctataaataatcgatcaacggtagcgattcggatttaattactagggtgttagccgtgtattatatttaatcatagactaaattgagtcgtataatattataagataattttaggattccgtccgacatttagctcgcgataagaaatttctaacctaatatatggatataatgctagggtagattaaattaaaaacatacgacaacaaaatattgtaaccgcaaaataatttaaaccaaaattggggtttgccatagttcgcggatagtaaaattaataaaaaggaattgactttcgcatttgacttccatttggatttacttggatttttatttgaattctaaccgaattcaaatcaattttcgcacgtaactatagagaccgagggagccgcggatccaggtgaaggccaagacccgcaagacctcgagcaaggcaagtcatcactattccttgaacatgttgatcccaattgcgaaattattttgtttataaataaaattgcatgcaatgatgaatatcctacttgggattatgccatgccttgattattgtttacccttaaatctttgtaaccatgtctacgtatgagtccctagtcaattatgacaattgcttagaaatgctattctagaatcatgcatactcatatttatcaaatgctatatgcttgggcaattacctttgggaaggtaattgagatgcggcatgtggagacatgagcaccacattgccatgatgttgatgacatgatttgtgaaaggagaaataaaattaaacaaatgttttcgactggggcggctggaggacttgggtggtgtccggtaaaggctagtgccgtccctggtcagttaaggactgagccatgaagttaaacatgaaacgacctcagtacagccgtacttctcgaatgggtatagacctagcggagtagatagccgagcggaggcagtatccctgcatagtggtttcacttaggtgtgtggacgaacaagcagtctgctggcggatacccgatacggatggccaaatggcggatacccgatacggatggctagagactgacttggcaagactacaagactacaaggagatacccaaaaggggacagcgtggattgggttcaactacagaatgcgatgttaggcttgcgtgagttttccccctcgggagcgccagaactcctctcactgctagaaaccgtgtacgcctagagtgcatgagggcctaagttcatggagcggatactgccaaagtgaggttattgaaaggctttgccgtggcaagtctcattcgttgggacgtaggctcatgtgttgggcaagttgcggagtacgggtaaagtgtacatccactgcagtgtgagtaaaccaaatctattcgaatagccgtgctcacggttattgagcaccgggacatgtattacacttggctagactctaaattcttaacttgtgtgggatgggatattgcatgatgaattttatgctgttggagccacttcctgagaggcgggaaggtggacgtcctcagaaaaccatgacgaatcaatggcgggaagctatccttgggatcacaatggatggtggacagaaccgtcgttgtttaaatacaaactctggtactaaaatttgatcagtcaatgctaggtcttaggcttgtgaaaagaattacaaaacttgctttgcgcaaaagaactatggccatcctttgaactccccctttcatatgcattgttgctgtggtggcttgctgagtacggttggtactcatccttgcaaatataaaatttatcagaagcgggagatgaagcctcggaggatccctatgcctactatcaggagggagatgaagacgatggcgtccagtaggtcttagtatggtcgttgcctgtggcaatggcatgccgctgcctgaattctgctgccttatctatttctgcttttggatgtattccggacctctcggtccgatgatttaagactatgcctgcgggcctatgatgtaataattcgtattagatactcgtgtatgtgcacttgatattccagctatgaattcgtgtgtaccaaactacttgatccagggaaatggtactgtttacacgattgattcctgttataaaaacgggggtccacatcggccaacggcgacattgaccttgccagatggtctatctccgccggagtcctccgagaacgagcaaaaccctcacggagatattcgaggtccaggcgcgggcgatgatttcgtaggcaagccaacacgtgccctccggcgtatcggctcgatcgacgacactcctgcttcaaggcctcgtcgatacgcttgccgattccatcgagttgggcacaggccccattaagccacgagatgtacccggccgccgactcctcgggatctccgcggactactcgaagctccttgcatactctggccatggatgtgcagcaactcttcaagtacgagttaaaccacacctcacgacctcggagcgtttccacagcctgctctttcttcacggccagcatggttctctcgagctccgccacttcaaacttcgtcttccagtattggatatgacgatcttggctagcaagggcaccctcgagatctactaaacgtaataaccactaagtcaagctatacatctctttcgggaacatggctaacctagtcaggagggcattaaggggtgaagggactactaacctgaggaagtcgtcgccatcccctctatatcaaggggttgatccacatggtcaggcgagacgtgtggttcaaactcgagtaccggaattattgccagtgactcaggctgcccgcgctgctggacatcctcgtcatcagcatctctagaaaggacaaaagttcccgaggtcagcataccaaagtaagctgggatagtaatcgcacgcacgaaggcggtcagagttcaagttttacacattatctaggaaatacaagaagtcctactcttcaaaaagggggagaacagactcccctagatcaccgacttcttccatcacctccttacgcgtgtcgctggccgccctctggtccaagatctcgcgcagatcgagttcaggacgcgacagccttacacacgcgaggacatgacacgccccggtgtagatcctgttcgacgtctcctccgcaatcctggccgcatgcttggaggggatttcccccatcgccgtcaccagttccgcgagagaggaggtcagcgaaaactcatcgggattcaccgggatcgtggacttgacgccgcactccccggcgagctggtgaaggccagtgtaggtgaccctcaatgagccccggatctcggataggttgttcccgagttccgacattcggtcctcgagccccttccgttgtcactcgttgtcggccaccaactcgcgtactagtctgtcagcacgcgcgttcgccgtcgccgcttccgacctcgcctccgcaatctcgcggccgatgccgcgagcaccagcttcaaggaggcgccccatctcgacttggagctcctcccaggtgaggactgcaactggcagatcacgacctgccgcggggtcgctgactgggccactaggcgtcgcctcccggctcccggctgcgggcacgacatccgtcgaggccacgacgggcgacacactggaagctcatccggacttggctcgcgcagcctttgcccgcgcctccctacaggacgaccacgagtcagacaacaatcgaataagaagcgcggggattcaagaattcatctacttacttctcgctaatcgtcacaatgcgttgtcgtcgtggaggtgggggagacgcgtccgaggcttgaaagacaatcaacgcaaagtaaggaaaaatccttcttgctgcatgatttaacgacaaaataaattaccgagggggtcgacgccttgcgacgatgtccgcttacagacgagaatttcctcggctttgtcggaacattgccaccgctagtggtggcagcatcagatgcctccttgacgaccttcactttcagagatgtcgccacctgatggtccgcgagcggtccaatgatgtcagtcaaaggaagggcctacgcttaatcaagtcataaagtgatttcgaaaggagaatgcgggatgcttatcgaatatacttacgttgatggcttcatcacgttccgccgcccccttttcataaaggggcacagggatgtcactcgccgtggtcgggccactgatcatcacctggccgacgcggcgctccacgatttcgctgctcagacctgttaatcgagaaccaaccttcgataaatcaagaggaacgcgaacacaagcatgtcaagataaatgcgagaaagataccccgaggagaaacccgggtcgcgtcctctggcccggaatagtcataagctggatgggcccgagcctgaagcggctggatccgcctaccaacgaagtctgcaacaacttcatatcccgacaaaccctgtgctcggagatcgtcgatgatgtcgataaacgactgaagagagggggtcaaggggggctttgcggtccaagacggaatcttgtccggttgatcttcaggaaccacgaagacagggttcgagttcttgatctcaagataaaaccacctattccgccacttgctgcgagaagaagggcactggaagggaatgtaacgcgacttcaggccatcccgaagtcggaacccgacgcaaccagataccctgttggattccatccaacgcagttcgtagtaaaagcgaaaaagatcaagaaaaggctctaccccgatgtaggcctcacaaagatgcacaaagatgctaaagaaggcgatggaattggggttcaaatggagaagagaaagaccatagaaattcaaaaccaggagaagaaattcggaagatggagggagaaaaccgcagagaacacaatcttcgatcgcaaccatgcgacccaagatgagctgaggattagtacctcctgcttccctctccatggttccacggccaggaagagcgccatcctcctggagtttcttcaacgttgcactggtggaagccgatttgccgaggtccattgctgatcgaaggtcgccggaaaacgagcctaggttgttgaactagggtttcttgtggtggcggagaaggcaaatagtgcttgcaggtggtgtgtgtttaacaggtttggtggacttcaaaatggactctcaaaattcctttaaataggcgcactaccgacggtgcaaattccagggaatagagagagatgcccgccagaaatttctgggtccgttacgcgcggcggttttctggacttcagtataaaattcgctcgtgaccgttgggcttcaaatggcgtgctcgactatggtctatctccgcggtcctcacaccgggaatgacaacagtctcgacacccgaagtcgtaaatggttgcacgagttcattttaagcagaagtcggggggctactgtcagggttacgggttaggcataccctttacccttcgatatacgttacatatcgatatggcataccacgcgcatgcggatatttcctgtatattctaagaaaacctttcatgaaatctacagacgagaagaatcctactcgggcagaattgggtcgttgacgtatcgtatagggtctgatatctccgagttctacgtggagacctccagatctgcgatataaaagggaccccccggggagggtttaagggatcaaatctcagagccaacacaacctatacagcctacgaagccagagcctacgaggagccaagtcatcgagagctagtcgaaacaactcgactataatctcgccggatccgacaagttcccttgttccctttgtaacctgtattttctaccatataatcccacatcaactggattagggttattacctatcaaggggtctgaaccagtataattcttattttttgtttgcttgatgtcgtactacgtagatgcttgtaccaacgtaccctaataccctctatatccggtctacgggtatcacccgtcgacataggtcgtcaaagaaaaagtgtgattattacttgttcgtcagcatctgaaccaacttcatacatgtacagtccaaatcactccatgggctgctggcaatctaaattaacgtgatccaaagccattaacagtattgcaggttgcagcctatacagggcacctacaaacgtacgtgtaagcgggcagccactggcggcaggcgggatgtcggcttcggctccttggaaaggaaggcactccctccgtacctacgccgtttatctttttaaacatatttttaaacatatttgactattcattttattcaaaaaaattaagtaattattaatttttttcctatcatttgattcattgttaaatatacttttatgtatatataaagttttacatattttacaaaagtttttaataagacgaacggtcaaatatgtttaaaaaagtcaacgacgttaaatatttagggacggaaggagtattatagatcggagatggacggccgagtttacttccaaactttttcttcaaacttgcaacttttctaatcacatcaaaactttcctacacacacaaacttccaacttttccgtcacatcgttccaatttcaaccgaactttcaattttagcatgaactaaatacatcctacaggtcagataccgggcgacagacaaagctattgggaagagatagagagatatatgcaaggaagcacatacggattcggacgacttaccaaggtcctggcaaaaacatcttcaatttttataatagtggagaagtgtttgcactctactttccaaactactccggtatatacatgactttttctctcctcatatgcttcacggtatagttggccatatgggctgcccggcatggcatggtccaggcccgatcatgctcgggccaagatttgttgggccggcacaacccgaccaatacgccgggccatgccacgtcggcccacgtgctccactgtggcccaggcatggcccaataagggtcgggccatgctgggccggcccgaaggcacatgcagcccatcatgttttctttgaaataagtctatttcccctccatactctttgggttgtgacatataaaaaactaaataagtctattttacgtccctactctctagtcgtgccatataatacgtctatacgtctatatggttgaaaataagtctatttcacctcgctaaagttcgtgccgtgccgggccggcccaccgtgccgaggcataggtccaggcacagcccaacacccgaaccgtgccggcatgggcccgacaacgatcaggccgtgccgtgcctgggccaggccaaaatcccctgccttgggccgggccgttgggcctcgggcgttatggccaactatacttcacggtgaaacaacagtagtaggagtacgaagcaaaatgccaagatccaacttttttatggatcttcgattttttttccccctaaagaccactagggttgactagttggcgtagggttacagctaatggcttcacggtacgactcatttatcttttattttaacgattgaagtacaacgttttagactctgcaccaaataaaaacacacacatttatatttataaacagaaaatttttccgtttgaaccatcctttacctaacatttttcactttggactaggtaaacatatcttttatcttttgtgtcactttgaaccaccccagttttctaatccattcacatacaactcatcgtatattgaaaatgttatttatatataacttcgagagttcattgatgtactagagcggtgtcatatttgaggcaactgcgagttgtcattccccactttcttaagcaaatgtttgagagaagctgattgagaagatacacaaaataaggtgaaccattagcatacgattaattgagtattaattattttaaatttaaaaaatagagtaatatgatttttaaagaaactttcatatataattttttttaaaaacacacaattaaaccattcgggaagtatgcaaaaactggggtacctttcctctcgaccagcttatgccgaacacagactgtgttcgttccgagaaagggaagaaaacttccttgttttccgcgcacatgtttctcgaactgctaaacgatatgtttcttttaaaaaaaattttctttagagaagttcctttagaaaactatattaatttattttttaattttaaataattaataattaattaatcattggtgaatgactaattttcttaatcatacgctaataattaactttttttccaacaaaggcatagaatacatgacgttgacttttaagctgttataagaactacaactagtatgcttgtgaagtgaagaaccattcaggaaagttcagaggtttctgccgaacaactggcctcactcaggctgtgtttagttggatccaaagtttagattttggttggaattggagatgatgtgactgaaaagttgtgtgtgtatgacaggttgatgtgatggaaaagtactgaagtttgcatccaaactttggatctaaacacagccaatcagcaggcgacagagatctcatcaactgccctgctcacctccatgacagtttacagttaacagaatcttccatgaaaactccgaatagatatataataagatggatcccccttcaccgataaaataatacttacacttagattcttccgggaaaattcccaccatgagtatattacatatgatgagtaattgatctcagagctaagagcttttccaaaaaaaaaaaagaaataaaaagaaaagaaaagaaaagagatgaaaatgctctataaaatgaagaagtgacacttcaactagtgttgcactaatattggaacactcatttagggtacttgagaacttgaaattacgataatccaagcctaacttgctcataggaaactgtccggatcatgagaggagacaaatccgaagctatataaagtcttaatttggaaaaaggcctaaaaatggaattaattgtttctaccactatcaaaatgctagtacgagagcgcaccaaaacacatcatctctcccaattctctcatacaactaactattcaagacaagtacaagatgatctaaaagattaaaagtttgacgacagaattgcacatacatatgaacactttcttcagtataaacgtggttattgctatgcgcgctgtgaattcgattttatcaacttcaacttcaaattaagggactaattaaaacgaggaacaaatcaagccgacgacaagacactaatccaaaatccaaagtcaaatcataagccggcaaggacgtagtcaccgtcgtcgtcgtcggtagtcgacgtataaatcgttctctgcactttctgcaggctgcagcttcgcctcttcttcctatgctctgcatcctaaggtgaagtggatatgcatcaatagaacggacaagtgcagaactttcgaaattctaactagtctagagtaaaacatctcaacctttttaagtgaattatttggttggcatgtagagattattataaaatgcagttttggacatcaatattggttttatttgagaagctacagattttgagaagcatttctacgacggatatttatgtgctttcttaggcaccattagcatcaagtttttttttaagatagatatacactacttctgcttttaaatatacgatattattaattttcagatatgactttgaccctttgccatattaaaaaatataactatcacttatttattttattgttacttgaatttttaataattgttaaaggtactttaaatgtgatttatatcttgcgctatatcttttcataatatgaaatgatcctatccaaccttgcatacggccctgccaaggtggcagcgcttagcgccatgatcgttagcactatgccgttggacctcatcgctaatcccgatggtgctgaggtatggtttatttttaaaataatttctggcacggtttacccttcaaataaattttctaaaaggataacatttatcaaaatttcgccaaaacatacatcatgtctctcatacaactactctctccgtttcataatgtaagactttctaacattgcctacattcatatagatgctaatgaatctagacattattatatatatagattcattaacatctatataaatgtggataatgctagaaagtcttacattgtgaaacggaggaattacaagataatctaaaaaaaagaaaaccatatagcacagtgcagttaatctaaaagtgcaatataatctaaaagtttgacgacataagtgcagttgcatatgaacacttgcttgcgtacgtgcatggttggtttgagcgctgtgaacgcgatttgtcaacttcaacttcaaattaggggactaaacgaggaacaaatcaagcccacgagacgacacatacagtaatccaaaatccaaagtcaatcacaaggccggccagatcatcaccgctgtcgtagtcgtcagtcgacgtaaatcgttctctccattttctgcaggctgcagcttcgcctcttcttccttttttgtagactgcagcctagatgaagtggacatgcatcaatagaacggacaagagcaaaagttttgaaattcgaaccattcttctgcaaaacacctcaagcttttaagcgaagtagttgctggtaagtggtggtattataaagagtacaccctccgtaaaagaaaaaaattcaacttataaaaacgaatgtacaaatgtgtttatccagattcgttcttagaatttcattttttttatagagggagaaattatagacatcaacactggtttatttagtgagctaaagatttcgagaagcatttctactagcgatatatggtctgttagacgccaataatataaagtttttattcttaaaaatgatatatatatattgcttatgtttttaaatatatgatgccgtttgcttttagatatggctttgaccatttgttttattaagagaaacataaaagtataatttcttcattttattgtcacttatattttattattgttaaatgtactttgaatacgacttttatcatgcactaaatgttttcacattgtgaataatcaaatgctaccacaataaaagtcaacaccatatatatttaaaaacggatagagtaacattcataaacaacctatcgtagtgaatgagtatctaacctatcgtagtgaatgagtatctgtgcgtgtatatatatatactagctaaatgacggtgctttgctatggattaaagaaaatgtattaatgtgttacccatctttttctaaacgaaatattcatcttaatctaattttatgtggctatccatttagattggatccttttaatattaaggagttcaaggggtaatttgtaaaaacttactgtaataagagtaggcggagtccaccacaactgtcttcttttaaatgagcacaaatatgcaaaataaaagtttatgctatctaaagtgtacttttaacatctcaaactgaaaaagaaaaaaaagtgcaaaaacccattgccacaaaagaagggatcaaacccaaaaccaatcgacaattacgagccaacagagtcatagattactcaaaacacgtcatggattactcaaaaacactccacttgtgcactcgctcgcgaacacagtaacaaaatgtgagctcaagcgaacattcccagctcgttccaggagctttccctcccattctcttctcctctatatcaccccgcaaccatgcctctcctccattgtttcctccaccgatggctccttccacgagtctcctctcctggtcctcctccgacgacgacgacggcgccggcgccggcggcgagctgtcccgccctcgcaggcggtggcgggcgcttgtcctgtgagtcaacggccgagtcaaccctgcgttcttggttgggttcagagatggtttggttgctcatgaatttgtgttttttttgttctttggttggttgcagggggctcggggtgaggaggaagaggagcatggagggggtgttcgggttcagggagatgatgggggaggagttcatgggcatgttcctccccttctttggcaagatggttcagaaagtggtaatgattttcatccaacctactagtatttattacctttccttcagggagtggtaaaaaaagccatattttttgaagttttttacccaattgtgaatttacacatgcatctaccaattttgagatatattatcgattttgtgcaacattcagagcaaagatatgttagattgataagttcatcccaataaaagaagagacatgcggacattgttgttgatttcaacttggatattagaatttagaagtgctccctgtccgctgacctgaaatttgtgcttttttcaggtttcagaagaagtagagaaagcaattttcagacaagtcagcacaccagcgcctccaaggtgaggcttgagacatatactagctttcatttattatgattactaaatttcacatgtaataaaaaaaatttgatgtttagtttctttctgctctaacatacttaatttggttctttcatctgcagactgctagcaggattgaatcagcagcgtccaaggtatcaactcgtgttcctgaatgaactaaagcctgtttacacactgatgaaattagaagccaaggatggaccgggtcttaaggtggctatagtcgaaagactcgaaaacaatcagatgcgcatcgtcaggttcggtcatcttgcttctgctaaggttgaagttgtagtcctccacggcaactttaatgctaaaaatgaggaacaatggacccctgaagacttcagcaagcagatagtatgcgggcgagagaaaagcgcacaacttctcaccggaaatctgacactgaagctcaatggaggggaagcattacttgagaatgcaaccttcactgataactctagcttcactagcactaagaagttcaggctgggtttgaggctagccaacaattctgaagatagggttcttgaaggaatcactgaaccttttcgtgtaaaggagcgtagggtggagggtatgccattgtccctaagattcagattgtttgtttcttcagaaatgtcttttggaccttatagctgagactaataatatgcaacttactatttttgcaggatttgaaaagcactacccgccaatgttggatgacgaagtttggcgtttggaaaagatcggccgcaatggagctcaccaccaggccttgacaaacagtggagttgatactgtacagaagttcttacaatcatattttacggacgaaaagaagctttttcaggtagaggttctatgaatttccttaaatattaaatttcagatgatgtttccataacacaaggacctgataatatagatgagccgttggtttcaaaagagaaaaaaatagactcaccgaattccctaaaaaaagtgactgacagaagatctttgatatttgtctatagacttttagcaagatgtcacaggcagcttggaaaaccatcataagccatgccatgacatgtgaagtcggtgacgatctttgcttgtatgaagtgaagggcaacaacgtgggacttttcttcgatgcaatatatcagcttgttggggtgaagtttggtgattcttacaagcccataaatgagctcgacgaaatagagcaggtactgtttcctcacttccttcaacaggagattttctcactattttcctaataatttggtgttttttgttcacagagtgcagttgaaacaatgaagcaattggcttatgcgaatataagtggtattcagtatgaccataagatggtcaacaactatcctgtaccgcttcataggttccattgtgggggaacttctatgttgactgactttattcctaaacagcagatcccaacttgtggtaatatcttgttctgagaatttcaatcactagcgataattacttttttggggatttttggtcatctattccaattgtttacaggtcaatacaattcagccctggctggtcaaccatttgaatcaacggagaacttttcttcattccaagaagcctctaatgtaaggaagatattttgaaatatacaaaatacagtacataataaaatacatatgcatgttagtctaagatagtttcatcaattttctagcaggcttcagtggatatgtcaagatttgtgcagggtcaaacctccaacgtgcagtttagccaacagttgggcatgggcaattttatcccacatcattcaaatcaaggaacattcatacccagaccaagaatcactcctctgtgtatacctaataccgaaaaaacatattttaatccaaacgctcatagcagcatccaggctgatcatgctgccacacgaattggccagtatgcacataatgagcgatctcattcacctgaagaatcatacaaggtaagaacctttttttatgtaaaaatctatgtattttgtctagatagaaatcgaagagtaaaaatttgacattacttgtgctcttcattcaacagaactaatccattctgtatttgtgttgacagcgcttttctccagataatttcctccatacagatgaagttgtggctttgatgcaacctcacttagtgcctccaagcaacagtaattactctatgctgatttttttttggctacatctgattcattcatcttgatgctaattactaaggatggcatctgcaggcgagaatttcagtaacctgctcaacctatcaagcaatgaccaaacctcacagcaaattgccgctccattccagccatcaagaacaaacagctttgactccagctcatgtgatcagctcatacagaatttcatttctcagttttctagcaacgaaagagttgcggtgccattgtccccacgcaagtgggtcaagatcagggcagcgctgaagctggcatctgtgggtaggctctccagagcctcgagaaaggcttcgcatcgccccccagcaaggccaaggcttgtcccaatagtatgagcctggtgaaaacaggttgtaaaaaatttagattaaagatcgatcttggtgttgatgcagaagttctagagacatctggtcaactgaaactaatgattttgtcaaaaagttaggtgtatgtaatctgtacatagtagagcctgcttgtacttcatttagtgttagtatttcccagcagaggattctgacctctttgttatctctgaatttagaaccatgtaaacaaaaagaccatgtaatgtattccttttttgcacctaatgatccttgagagaaatttccttttaagaaagttcacatctatgatgcaatggtaaaaaaattgtaattggcctaaatttgacaatttaacatgatgaagcgtacaaacttgtcattgaacttctctttgttgtaatggcacatggcgggcatctattccaggctaatgtacatacaatacaaccgtaacttctgcgtgtgagctatgtactgatctcaaatttgaaaaattccttctgggtttacaatttctctgtcctgttggaggtcttatctgtttatctctatctttgatgtctcaaaaccaatttttccatcagactgaacaatccactgatccttatacagggttttagaaacatccttctttcagtttcctattgatctcaccttggcatagtgggatccaccttcgcactagtcgattattttggagtgttaattttgccatttcgagttcttcttccacccgtagtgctgaaaggtagctgcttgctgttcctgattggggtttgcagccttttctctgacattggcgacttcattgcaagatttggaatcctgagtaaattcaaagcagcacaacaggttaaagcaatccaatgcacacaattttcatggaaaatacaggatttaaattggacttacttcgttgctgtaattttcgtattctttgtttgaggtttctttataataaaggcacctctgctggcaataccatcagctttgaggccactggtggacaacaacatttcttggtcggaaggcgagctagtagcagcatcaaagctatctgagtcatcagtttctactggttcagccctacgcctttgcttgtcgggatcatatctttggtagaaaaatgttggaagctgagttgcgccaggctccagctctagaatggaatttccattctcaaattgattattaccgacagccattctatcggtcttctgaatgccattgcaattttcagccaagtcggatgagttgttctcactgaggacaccagaaaattgaaagctggccttcttttgcattggagtggcattgttccggaccttttacataaagaaatataatattcattaaatgaacatcattacctttcttgtgaaaagattaaaaggaataataatctactgaaggtaacataagtactctcaacaagaccatgaactacgctttcgtcagttttagtgttgtccagatcattcacaaaatgattctgaacttgatgtacaaatgcataaatctactgaaggtaaacataagtactctcaataagaccatgaactaccctttggtcagttttagagttgttcagattattgacaaaatgactctaaacttatgtacaaatgcataaatagcccatctccatttagaatgtttggtaggttattttcctatttgacattgattggaatcataactagcactcacaaaaaaacttcaatgtgaaaaggaaatatttttgtgatttccaagaaaaagagttgatcttgtgtgaaagagcagttaatacctctaagtttccaacttcttccattggctgtctatttttagggaaggcaggtattgcattgcctcttttaattctatacatgtcagggcttgactgtgtgctttgaatgttttctggttctccttcctttttagccaatgccgccttgagggtagcaatctgaaacaagagcagagaaaaacgatgattatataaatctaaacagaagtaccacatctagatagtttatataaatgagcaatcaggagttaagtgaacacctgttctttgagctctctaacctcactgccttctttgtttgcttttgctgcaccaagctcaactgaagc

SEQ ID NO: 65085 - DNA, 1837 bp, Oryza sativa
ctataatctttagtcccggttcttaaccctaaccgggtttaaaaagaatttcgaaatagcgggaaaagatatttactcccggttgttgagaacaaccgggagtaaagatccatgggtatatatatgcccggtgcgccctcgtcttcttcaccaacacttaacgttttcggccgatcgatctctctcggcctctctccttcgccgccactgcctagggcaaatccccgcgccgacgccgccgtatctcgccgtcgtctcgagctcgtcgtcctcgccgccgcctccgcctcctccgctgccgccgcatctctggggtgagagccgccgcatctcccttcatgcatctcgatctctccgatctcgatctctctccgtcgccttcgacgccgccgccttcgacgccgcgcaacgccgccgccgcatgccaacgccacgccgccgccgccttcgccgccgcgcgcgcaatgccgccgccgccacgccacgccgccgccgccacgccacgccacgccaccgccgccacgccacgccgccgccgccacggccccacaacgccacgccgccgccgccgtcgccacgccgccgccgccgtcgccacgccgccgcgccaaccgccgccccgatgccgccacaccgccgttaacgaacgagaacgagaacgatcgaacgaacgagagcgagaacgaacacgtcaacgtacgttgccgcgacaacgtgaacgagaacgacaacgatcgaacgaacgtgaacgagctagggaacgtgaacgagcgaacgaacgaggacgaacgttaacgtgaaatgcaatatatatatatatatacatgtatatatatatacatatatatatatgttacttcgcatttatcctaatacattttttttatcttgcagaaaagacgtgttgtcggagtcgtccgtcaagcctgagtggaagagctagccctagaaggaattggagcaggcaagtgacgtaataatataaatgattgttatatttgtaatgcaattaattaagattattagacctgtaattagacttatcatataagattgtgtagtgttctaatattatttgagttttaatataagattattttattgcaaattagacttagtatgacattattgactacggaattggtgcgctcctaggaattgactattgtagtcttaattagacttagcatatacgcacgaaacacttagcatacattactattttagtcttagcatgtaatattatttgagttttaatataatattactttatttgtaattagacttggtatgtaattattgactacggaattggtgcgacaagtagcaattgactattgtagtcttaattagacttagcatatacgcacgaaacacttagcatatacatgactattttagtattagcatgtaatattatttgagttttaatataagattattttatttgtaattagacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtttcttgtatcaacagatggctgaccgcgatgaggaacagatattgtacgatacaatcgcggagggaagcagccagtactggaatgaagaagaggggaacgaggatccaaaccagtacttgaacgaggaagggaacgtggagagggatgcggaggggaatcagcaggggcacgtggaaagggatgtggaggggaacc

SEQ ID NO: 65086 - DNA, 679 bp, Oryza sativa
ttcatttttttgagatattatagttatatgctccttctgttttgacttctttcttaatcaaacttttttaattttgattaaatttatagtaaaattaattcagtgttatagatgttgctaaatttttctacaaactttgataaacgtaaagatgtttgaaaaaaatcaaaacgacttataatatgaaacggaagaaaattatattatcataatctgggtaataatatgaaatataatgtttgtgagaattttggggttctcggagaagctactagataatccctcaaacggggccatatgtccgaccgtgcccatcagcgattaattatattgccgaatcatatcattcattcgtttctcaatcattgggattatgggcgcctaattaacgccgtcatggcaacagtgcgacgcgtgtcacagcaacagtttagaagctactacgtcgtcgcacactgattaattgagaaatttggcgttaattgtggtggagataagtcataattgacggtgatcgaaattaaatgtctctctgttcatctgacaagtactaccacggcagtaagagaaggtgttctctataaaacatgtacaactcagcaatagactagattaatagtaaaccacctcaatagtacgcctacatgggtatctatagctctctaatgcattgcatcgt

SEQ ID NO: 65087 - DNA, 751 bp, Oryza sativa
gcttccctggtcgttgtagaagcaacagcagcaaaccacccaccagcagcagcagctgcaacaaaagttggagcccaacgcacagcagccaaagaatcagcaggccacgcattagcaggagcagcagcaggaaacgcagcagcagggaaagtagcagcagctcaccaagaacagatcaaattggcagcgaaggacgacgagggctgcggcaaccggcgacggctgcaccggcagcggtggcgcagaggcggctggggcgcaggagtggtggcggctggggcgcaggacccttttttttttttctgttggttatatagagagaggttaaagaaaatcgaacagcccacattaattcgatcaccggaaataccttgggactccgattaccacaaacttagtctattttgcactattcagcgagctctatgcatccacggtccctgatcgcctattcaaacaacggtttaaaagttgaacttttgcgcgtttgttttaatatatcccgaaatacactaattcgaaactcggggtattacaaagaacatttcaaaaatcaaggaatccaacttaatgtacaaaatttaaacttatggaataaaagtgaaacgtcaacggagaaaccaagaaaatgttcgtgacaagcaatcttcgatttccgtaaaatcaataagatgcaaccaaatggagacgtctagcccgcaaccaacatatttttttcgataaacaaggagacaaatctctacaacttagt

SEQ ID NO: 65088 - DNA, 3553 bp, Oryza sativa
caatgctgcatctgaatcaataacatgctctatccctggaatgtctggcatggatggccgaccaccaactgcaatgagtatgttttttgcagtataaagctttccatcaacactgacagtatgtggatcaacaacctgcataatatgaacaggtagtatatcaacactgtcattgctgcattgatcctttcaacaaaactgtatatgcaaacttaacccaatttacaaatttgtcccaacctttccacggccttcaattatagtgaccccagaattctttagcatgtttgtctgaacccccaccaagcgctgcaactctaaattcttgttggtcatcagagtgctccagtcatgctttggctcagtgccatacctccacccaaagccatgactctcttcaaactcatgagagtatttggatgcatacaccagcagtttctttgggacacagccacgaagcacacatctgaagtatggaaaaactgaacatcttacttgcacatttttgcaattggatatgaaatggaagaaagatgctatccgcacattatagatactaagcatttcactctgcagacgctataagcaaattacagatatagaaggaagctggaaacgcgtaaggctaactggttgataacaaccagccatcgtgacagagctctctaacttttttgttacttgcgtatatggagagccattcatgtaagtatgtaaccctaatagtaaatctcatatcatcatctctacacatatattgaacaacattatagtgaataccacaaaagcctctgaaattaagcatgagctccaggaatggtgaataagaatctgttcttatagtcatagagtagactcctagtggtcgttgatcataacagagcactggatcgtgcgtgaaattgttcaatcctctcctcactactaaatcataatcctaaacaaacaatcagaagcaaaccatgcacaccatccgaattccaaacaaacattaccactgaacaatgtgtgcgacttgaactaggaagaagggtggcgaagttcactcacgttccgccgacgccgccgaggctgtcggacgcgacggtggcgaagggcatctcgcagacggcggcgcgggcgccgtagagggaggcggcgacgcgcgacgcccgcatcccgccgctcccggcgccgatggtgaagaggtcgtagtcgtagtcgcacccacccccatcgccgcccgcagcggccccgttatccccggcggaggcggaggcggagaacgggcggcgcgggccgaggcggaggagcgggccccggccccgggtggcggcagccgcagccgcgagggggtggcggcggaggtggaggaagcccccgccgccgcggcgggggaaggagaggacgcgggatatggtctggaccgcggcggcggcggaggaggaggaggaggggagggtcgccgccgtcgccatggctgctgctccgaggcttccgcggcggcgcgggggcgcgtgacgagacgagacgagacgaggcggaaatcaaatgcgttgcttcgaggcggggcgcgtggtgtggccgtgtgtggggctagccaggagacaaaaggcgaggctttgttgcttcggtgaggcatgacgtggcatcggcgggtataggtcataggtggcgctggcgcatagccgcggagccgcctgagccttgggccctcgaggtgccataagatacgctttgtaagttttaaagcgtatttttgtaactccctccgtaccaaattagatgtcattttgactctgtaaattaggtgtcgttttaactttttgctttcaattttcgatcattcgttttatttaaaaaattagtgtaaatataaagaaagtcatacttaaaatattattgataataaagtaagtcacaaataaaataaataataattatataatcttctaaacaagataattggtaataaaaactcaaaaataagtattttgggacggcggtaatgggccggatggcctgcaaacgtctactgtgtaccatcattagcttagtttagctttgtgctaggtgtgtactatgtagcctagaacggcccattcctaatagacgtggacagatggggtatcatcatttggtgacccatttcagtactccaacatgcgggaagagagggataggtggaaccgtggatgttcacttaggccattcacggtgcataactgtatacatgtaccattcaatcctaacattccacgtcatggattccataccacatctgctactcccgtaacaaagtgaagtccggagagccaaagttagccacgagttcctcgtcagatttgttagagtgttggggagggaggggaatagcttgggctatgcatccgggggaggaaccgggggaaagaggggagacaggagtggcaccgtcgtggggctcgtcgccgcccccggctccgcaggtcgccggcactaccgttgttccccgctcttccccgatgccaccatcaccaccacaggggaaagaggggagagaggagcagcgctagagaggggagaggccaccgacggagagagaggtagcgccgccacagctgcccgctaccctccagctccactcgactcgacgcctgagatggctgccgcgcttttcctcgtccttactcgatccaccgccaccagagaggagagggtaaggcaaggggggagggaagaagccgccgccggagatgggagaagccggcatggcgagaggagaggggcagcctcaaccgaggaggggtggatctagtcgcccctctctggcaccgtcgcgccgccaacgccgccgctgcttcgggggaggagaggaagggtggatctagccgccccgccgccgttgtcgccctagtgccggtgccgccccagtgccacctcgcccgccgttttctgcgcgatggggaaaggaggaagctgtgcaatggggaaaggaggaaaggagagagaaagggagataaaaagtgaaaaaaagatactagtggaacccactataggtaacttgcattgtaaagtagtatgtggctaatgcggttcttcatctaggtggcatgtgaagttcgccaaaatcacagggcgcactgctactgcccttactaggatgccacatgtggaccccacatgttttgttttactaggatgtcacgtcagtcaagacaaccatctatactaccataggatcttatttaacctggttgtaaaagatgaaggtttaatattttcagtattacgatttgaggatgtaattcaaactcgatgtcaatataagatgtaaagtgaacttattcctctatgcttggccttaaccccacccaaagaagaaagactgttacccaatttgaatttcttggtgcaaccaaggacatcatttttttttcaattttggtatatatatgttgacaaatattctggagaaaatttgtcaaattttgggacatcaatttttttcgattttgctatatatatgttgacaaatattctagagaaaaattgtcaaattttgagacattagatttactctaagattcgggta

SEQ ID NO: 65089 - DNA, 1401 bp, Oryza sativa
acaccccaaaagagaggaagataaaaaaaaaataagaaggaagaaacaaaccaatctcacaaaacacaatgctagaaaaagaaaaaaaaaaggtttctgatgagcaaaggcgaaattgtgtgacgagtgacgaccagtctgtctcaccaaacgcacataggtacagaacacagcacgaacaccgaacaagaccaccactactagagactctgctacagagcagtacaaggctaactgaaaccacaagttttttttttccttcttttttttacacggcggagcagagcagagcagagcagagaccgacaggtatgcaaaacgcagcaagctttactagacgaagcaaaggatctctcttcttttttttctttttctgttcccttctctgtcacgaaaggggagcgaggggatcgacgacgggcgaaatcagcggcctttgcaccgatctcggcgtcggcggcggaagaactctgacgcaggctttaactgcgcgcatcagatggtgtcgccatggggagtagtaaacgggagcagtaagacagtagcagtaggaggagaagaagacgacgactttgagaaaattttataatctttttttgttgctcttgccgttggcgaatggaagatgaaactctaatcaaccaaaccgctgatgtaaaaaaattccacaatccgtctcatcagttcataccgaaattcatcaaaagaatcgataagggaaaaaaacagcagagaaaaaacaggggaacacgaacacgaacaagatagccactctagcagccatcagccgccatgggcggcgaaggaaaacaaccaacaccgagaaaaccaaaaccaaaccaagaaaacgacgagacgaggaagaagaagatgaaaaaggagaaggatcaagaactgacctgagttcacttctctctctttctctccctccccggatagcaccggcaattcacttcacttcaccgcgtcgagcgaaaaaaaaaagtttccgggagaatcgccgggagcagcgggaggccaggccggcgaggagaggaggagtgggatcgcgtccgcggcgagcccgagaaccaaaaaaattctcgaaatatattaaaaaggatttcccgggcggagggtggagactttaataagcggcatgaagaggcagctcagtgcaataaattttcatggggcgtttttacagaaaggggcatgtgatttccccatatttgcagatgcatccctctaggtagcaacaaacaatgcccctttggatggagttttgtgggactattttcatcctagtgccttcgtttacaattctgagggctgttcagattgatgttatttttaattattttatttttgggtaaagttatcaaaaaaaatctacatttagtttattgctaaatttggtaa

SEQ ID NO: 65090 - DNA, 20408 bp, Oryza sativa
catgtaaaagtaaattcaatgaagcctaaaagtaatttacatatattatagaagtaacttataaaaaaagaaagtaactttaatgaatgtcttttttttaattggatgtgactacacagctagtggtagctagtttgtactccatttagtatctcctttcaacttgaaaaatacaatagtatcttcttttctcattctacatgaaaaacaaaagtgaaaggaaaaaaacaatcgatgattaaacagatttatagagagttacttttgaaccatgcaaaagttacttccaattaacattgaaggtacttttaaaaattgttaaacttatgtgtgttgatctgtgctgattaaatttaatttcttgataaagtcatatttttatctctacaacgaatttacttctaatgtcgtgacaaaattacttccgttttgttttaagttacttttataatagatgtaaattacttttagactctattaaatttacttttatatgtctaagaagtaatttagtcaactctaaaagtaacttatatatatatatatatatatataaaaatagcttacatatataataaaagtaatttacatataaatatttttcattgtaatataatcatgtaagatcttgttttgaagatttaattgtaacgaacacaatgatgtaatcgaattgtagatcggataagtaatttgagagaaaactttgtttgaagaggaaaaggacgtacatgtatattgaaaaaatgtatgcatgtagtaccacgtagtagctggagttctccacatttctccgtgttcaggcgtcatctccaaatagattttacgattttcttaataagtcgtatgtgaaaataatggttgctttttacagacgttacggtccgtctgtaatctaaaagaagtctcgtcgtttatgtagtagtgtcactatataagggcatgtttagggagcttctagctgctgcagcttctctcaaaattagaaacttcccaaacaatttagttttttatatagattctgagaaactatagttgtaaaatccaaaaaataaaacaagaacccaaagctgaaaaacctagcttttttaaattatcagaaattaactactaaccagctgcttaaacctataggatcgaactgcaagaactaaaccaaccaggggggtgaatggttgtagtacccaaaaaccaaaacttttagcggaattaaaagttaccctcatatcgatgtcgatcggtttgaccggagttgatctaccggtctgaccacgccgatgccgtcggtctgaccacgccgatgtcgtcgatctaaccggagtagatcgttcggtctaaccacctgaagatgccgcagtcgcctgatcctgctgctagtctaactgccgctgtcccaccggtctgaccgatgcgttgccgccggtatcccgccgattgaatcgctgaacctgagcaaacacaaatcgaagaactctcaaagtagatgacaactttattacttctctctgtgtttacaaagtgcaacaacaacactcctcacgaaaatctcgactaaactcgaaaccctaactattatctcaactcaatgttctctaaagcgataccaggagaccacactctccctctctatatatacccgaggtaggcagcctaaagccacgaaccaaacttgtacaagaagacctaatcccctagaaaaccttcacgtacaagaaactaactttacaaactccaattgtaccaaatttggactctttccaaatataactccgcatctgtacgcacacaacacctccatcgtatgccatatggaatcatcaccaatcacgtgcattgatctttagcctaagcatctcgcatgatatatgaccgtccagacgtcaccttatccccaagttgactcccgatccatcaccggcaacactctcccgagacatcaagatcacctacacatgaatcaaataagaaaccatattatgagcacaagctatctccaatttgactcattgctagcaaacaacagaatttcatatgcatagtatctatctagaagtcataaatataattaatccacagatattcaatgaaacaacctaaaaccgaaaccaacacagagtcggccggtcagaccgcgggctggccagtctgaccactcgaagcacgccggtctgaccgacaaccaatgcccggtctgaccggaccgacaatcagtagtccctattcatcaccaaaaccacttcgctaataatctttaaatagcgaaaccaataatctcatatgtcaattgcgtgagcgaccatagcagtgcagtgattctcttctccatctctttccccaaagtgcgtgagcgaccactttggctctgtccggcggttcgtggataggctagtgtagtgtcagtaccttcatttgacttatttttgttctcttccctaaagaatcaaatcagggacacatgtccacatgtaattaatggttctgtcaaaggcacgcaagcatgcatgcattgccagccgacttcgatcgatccacattgttttctttctgcaagctcgcatctttggatgcccatgcactgacctttccactggtattttgacatgtgtgatactgtggttacagttttttaaacaatcaatatcttcggaatgatattttcttagcatgtttacagactgataatgctaaacaaatttgaagtccgccaaaagttcaaaataccttctgaactattgcaaccctcgaaattttctcacttaactacaaaacccaaacatttaattcaacacttaaaattttgacaccgaatgaataatcccaaacactattgtgagtggtttcgaatcaagcaatccaattgaaaaaaaaaaacatgagacccaccaatcatcgctaaaaatcctctgcaatcgactgcaccgtgcttttgtcactaacatatggacacgatgtgtcgtcggacccacatgtcagtgacaaaggcacagtgcaattgactgcagaggatcctgatctaccgatcattccccaggcaatccctctccctcctctaccactttgtggaggcagttatgggcttgcgacagagactgaggcgacaacctactgtggatctgttgtatggctgtgctccttcttgaagcgcggctagccccgatcatgtctccccactacctactccttgacgtgccgaacatgagcgtggatctagggcaacactgaatatggcagtgactgcaacatggatctaggatgataccaccaacctccttcatcccgcaacattggtcactcctccgtggtgtcagaggagtcgttgggagacgaggagagggttggcatggcaagaggtccaaatctactccgtcgctcttttcctttccctatgtctcccctctcccatgaaggatgatgagcgacttatttagcctatgcaaagcacgaaggataagagaaacgtgtagcaaagcgagtgtagtacttgtagcgaatatggcaactaacgggctcacagatgacacaagtgataggggaagctcgaagttggttgcatgcgctcgtggcccttctctcccgcattctgcacatgacgagcatatctggtgggacaataggtagtggagttattaaggaggaagatgatggagctcaaggagcaagtggtggagtcaaagcttgaggagaggtggcatggggagaaggcgcggtggaggtaggtcttagcggagcagagctcgatactaggtgagctagagacgacggtagtgagctctctcaccatggtgcaaattcggaaagactgacggagagcaaggtgaagaagaggaaacactgataggtgggccctcaccggttggttgctgattagcttagactatcatgtgtgcatcatgtcagactaaaaccgttcaaattgagttatgcgtaattcatccgatgttaagagttgacagatatagaattttgagtattggagttgatggggaaaatcgaactactgtaaaagtttaataacgggtataattgacttttttctttttaaatcttggtaaataaccgttgttagatggactgaacggtaacttataatgaccaagcatatcaggatcgatccaacaacggaacacccagatctagttcatttttatgatcaccaaatactacaatcctatgttatgttcttgcatggcaccataactagttgtgtttatctttccattttagaaagaagctggctatctgaacccattttagaacgtaatctctctccagcaaaatccaatgacctcctcctcttcctcagaacaaggacacaccacaaccacgtacccaacaaaacacaaaccaaacaaacttgtattagccacgctttgttgctaatcatagccagtttagcttgttcatcgttggattcgttcgtttttccgcatgagaaatatataaaactgatgcgccgtcatcgttgtcgcatccatccatccatccatcgatcggaggagtcgcctcgcgccgccgcaccggccgtcgacgtcgtgacccgcgctagctagctcgcgcgggcggcaatgtcgtcggacgacgacgacgatgggtcggggcgcaccaagctgatcatcgccgccgtggtcatgctgctcgccatcgtgctcggcacggtggcctacgtggtggtggaccgcgccggcgacgacgacggcctgagcaagcgcggcatgaagtcgacgatgcgcagcgtggacctcttctgcgcgcccacggactaccgcgtggcgtgcaaggacaccctggagcgcgtcctggcgcggtcgtcggacccggccgaccacccgcacgccgccgccgccgcggcgatcacggcggtggagcgggagctggcgcgcgggttcgaccggtcgtcggtgctggaggcggtgcgggcgagcaacgacagccgggtcgccgaggccctccgcgactgccggacgctgctcggcgactgccgtggcgacgtgagccgggcgctcaccagcatcgcgtggcgcggcgtggacgccgtgtcgcaggacctccaggcgtggctcagcgcggtgatcacgttccagggctcctgcgtcgacatgttcccgcagggccccatcaaggaccaggtgagggaggccatggagaaggcccgcgagatctccagcaacgccatcgccatcatccagcagggcgccggcttcgccgccatgctcgacctccacgccagcgagagccacgccgccgaaggcgaggagctcgacgtcgaccacgacatccagcaccacgtggaccgccacctcgaggatcagtcgttaccaccagtcccgccgtggttgtccgacgaggaccggaggatgctcaccagcggcgaggagttcgtcgccgggctgaccccgaacgtgacggtggccaaggacggcagcggcgacttcaccaacatctcggcggcgctggacgccctgccggaggcgtacgccgggaagtacatcatctacgtgaaggaaggcgtgtacgacgagacggtgaacgtcaccagccggatggccaacatcaccatgtacggcgacggctccaagaaatccatcgtcaccggcagcaagaacatcgccgacggcgtcaggatgtggaagacagccaccttcggtacagtacgccaccgccattgacgactcacatccattcatgcattgatcgacatggacatggacattgacatggacggatggatgcagcggtggacggcgaccggttcacggcgatgaggctggggatacggaacacggcgggggaggagaagcagcaggcgctggcgctgcgggtgaaggcggacaagagcatcttcttcaactgccggatcgagggcaaccaggacacgctgttcgcgcaggcctaccgccagttctaccggagctgcgtcatctccggcaccgtcgacttcatcttcggcgacgcggccgccatgttccagcgctgcatcatcctcgtcaagccgccgctcccggggaagcccgccgtggtgaccgcgcacgggcggcgcgaccggcagcagaccacggggttcgtgctgcaccacagccaggtggtcgccgacgaggacttcgccggcgccggcggcgggagcagcaacacgtcgtcgtcgtcgggggcggcgccgaggctggcgtacctggggcggccgtggaaggagcacgcgaggacgatcgtgatggagtcggtgatcggagggttcgtgcacgcgcaggggtacatgccgtgggaggggaaggacaacctgggcgaggcgttctacggggagtacggcaacagcgggcaaggcgccaactcgacggggaggatggagatgcgggggttccacgtgctggacagggagaaggccatgcagttcacggtgggccgcttcctgcacggcgccgactggatcccggagaccggcacgcccgtcacgataggcctcttcggtggctagctcgctcatccatgcgtacgtgtgtatgttgatgcgtgctaggtggggggttgtggggttaaattcgtatgtacaaaatggttacatgtggagcaagcagaagagagagatgcatttttttttctttgagaaacatagtactatcgcaggagctcaccacgcgcggcactcaccctatctttatgagcacctctgaaaaactagcggcactcaccctatccttatgagcacctctgaaaaactaggtatacacctcaaaaagactggaccgacatatcttgagatgcacctcaaaaagattaggactgacatatcttgaaattgatgaaatcatcacagacgcatcgttgtcgagggatacacgtcgtctatcactaaaaaaataattagccgtaaatacgagtactcttgtcaagtttaggacttaaatccaggtatgttagttccaacacaaaaacctaaacagttaagctatgctcacttcgtgaagagagatacgcatttgatccaacgtgctcgtagtctgacgtcattacaaaatatacaaatataacattagtgctagtgctaattacaaaactagtgcgcgacagaacaacattacaaataaataaatatagagacgaaatatttgacaaagtgcttattgtttcgttttgcatgtcaccaatttgctcagccaaaatgctactagtaggtccaacggagaagcctcagaccggcggcagtcggtactcggcagggcaagagggctcgctggagtggaagaaacggccctgtaaactactatagtactagtgtgctgggcttctctcctggcgtggacgggcctcaggtcgatttgatggtcaaccaaccagaggacgaggaagtgaaaagtacaccgaaggtcccttaacttgttagcgagataaaaaacgtcctcgaaccgcaaaatatgcggggtcccttaactatacaaaaccggtcaccctcgacggttttgacgccggatttatcctacgtggcggctgagtcagcgtggaacccacgtgggtcccacatgtcaggatgccacgtcatctctctttcccccttctctcctttcctctctttctttcactttgctccttgtctggtggagcgatgacgggcgatgcggcgacgacgatggagaggcgggagaggagaagaggtccggcggccggcggccggcgaccggcaggggagaagaacagcggcgaggcgggagcaggctgggaagaagaatgacgacggccaggggagagtgggaggcgcatggggagtggcggcgctcggccggcaggggagatgccgcctcctgctcccgcatcgccgcgccgccatgtcctcctcccacgggacgccaccgcggatggagagtggcggcgctcggcctcgtcggcggcggcgcacccctccctcgatgaggcagcggcagcaacggacatggcggagaggtggcttgggcgcgggaggaaggcggcacggcggcgctggtggtgggaggacaggcggatgagcgccgccacgacgcgacagatgtggtcaccgccctccaccgccgcgatgcgccccagggaattcgccatcgccgacctcctcgtgtcctcgtgcagctcgccgcacgccgacgtggagggacgtgacggcgaagcagtgctccggcgagcaggccacctcgacactgccgccgccgactccccgctgctcggcctcgcccgtcggccggcggcgccagcctgcccaaagccagccgccgccatgccccgccatcgccatggctcgcctcctcctcctcctctcccactctagccgccaccacccccagccgcatcgtctcctctcgctcctccgcttctcctctaacgccagctccggctctagcccaacgccgccgcccatcaagcccttgtcctacacggggagagggggagcggatcgagatggacgccacgcgggccaggaggagcttcttcgggatgcaggtagagggacgcgatggcgaagcagcgctccggcgagcatgccaccttgacaccgccaccgccgactccccgccgctcggcctcgccccgtcggccggcagcgccgacctgcccaaagccgcagagagaagattgagagagagatagagaggaggaagggagagaagaggggaaagggagaggagggtgaggtgtacacgttgacatatggggcccacgtgggtcccacgctgactcagccgccgatgatcgtggtaaaagtgccacgtaggataaaaccgggatcaaaactgccgagaaatcttgggtgaccagttttacatagttaagagaccccgtatatctggttttgcggtttgaggacgattttgtaactcgatgacaaattgagggaccttcggtgtactttttccggacgaggaaccgtcctccgggctgccggagacagctcgcaggaacagccatagcccgctggaccatgttcaaggttcaagcacatactgctgcgttcgtttcagccacttcccaaccctctccctcgttttccgcacacacgtttttcaaattgctaaacgatactttttaaaaaaaaattctatacgaaagttactaaaacaattaaactaatacatttttttaaaaaaaaatagcaaatacttaattaatcatgcgctaatataatgccacgtttttcgtgcagaaaaaatgggttcccaaccgacttagagcaaggctaataatatagccgacctattggctataaggttatttgtagccttctatcagcctacccatataatagttagctcttcacaattaatatatagtccacttgtctctctcccagagtttattggttcttgcgttcaagccggctgtaagtttacaacccgcttctcctctctctcttctcttctctcctccacctcagcatttagccggcttatagcctactactatacttgctcttaaaggaacaaagctggaagtagatcaatactctctctctccctctcttatctagtcatctctatgagcatcagattgacgataaacaacgtgaaatctgtatcaagtctagcacttaaattcggctaagtcggtcagtgtcatcacgaggaattttaaccagtatagctaggtttcatcacttatttcacaagattcaccatgtttcttactccgtagagttcctacgaaatgtaatcctaacgactcgtgtcgctgccacttggaaagaaaaaaaaaagcgagtaaatttcacccatgcaaggatatttcgataagattattggtatatctgtctgaggcatgactgtgtaaaaatacatacgtatttgataatattgttggttatgaaattgcaaacttataaagctgaagttatgcctctaagacattaattgtacacatttgaaagtagcttttttagaaagaaaaaaaaaatccatttcactccctcataactattttgccccagcgtttaatatactacaatttacttattttatgccctaaactattttaaagcggttcacttcagctcctaacacgtagttctattttctgtttcttgctacataagtcatattttgttctaaaatttggtaggattggtatatgagttacaacttaccactaaacaatattttaaaaatttaatcattgcttggctttgaagcacttaagtttgattaaaacatcgagattttgaattaagctcaagcaaacaatcatcataaaatctgaaaatattttaaaacattgataatggtgtcatatatagttgtaaaaagtttcagcttaaaatactacctgcattttctaatatatgatgttgttatatatgatgttgttgatattttttacatcatgtttgattattcgtcttatttaaaaaatttaaataaatacttttttgtttgatttagcactaagggagctttaagcattacttctatttttaatacttgcacggttttttttaataaggcaaataatcaaatgttgtaataaaatttaacggtgtcatatattaaaaaaaataaaaatagagcgagcactaacataaaaaataaaagattaagataaatgtataaaatggtcagtggagcggttttaatagtttatcgagaaaatgtagggggaaaaaatccttaggcttaagtgatccgataaaaatagtaaaggacggatctcgtcgagagattctggtacgtcctgggctcctggcttttgtccaatggtcttctgtagcgacgattgggcacgacggacctcaccgtcagtcacccggtgaggcgtcgagcgaaagggaatgggcccaaagatagttcagcctgcgtacgtcttcctggcccatctctgctctgcggaacacaacgtaggcccgcggtcgccgtctgccgggctcacacaaccatctgtccaactcaactgctccactacgttttagaaaaggaaaaagtacatcgaaggtccctcaacttgtcatcgagttacaaaatcgtcctcgaaccatatatatgacatccctcaacttataaaaccgttccctttaggtcctctagtggttttgactccggttttatctgacgtggcggctgagtcagcatgggacccacgcaggtcccatatgtcagccccggcttcctcttccctctcctcttcctctcttccacgggcggtggcggcaaagagcagctgggcacaacaggccgatgcggcgggcgcgggtggcgcggggcatggcggcggggatgtgggcgacgggtggagctccgtgaggaggttcttcgccgcggcgacagagcggtggtgggcgacctcgtcggcgccatgacgcgctctacgcgccataccacctcaccggccattccccgccgcccgcatccagcacgcgaggtagggcttcctgcctccgggccggccgccgcgaggagccctgccctagctctccaagctcgccgctgtgttagtgacaatgcactggatcgaacacctcgcgtgcaaactgtgcacgtccggcacggcaacagacagagaaacaaagaaattcagagcgggattcagaacagagaaaagcagagtttcagagtagcgaaagtgagagaggaattgttgggcaattttctggtttctttcattgaaatgaactgtaaacttacaaaacggaaactgtagctactctcctaaatatactcaacagaaaaaaaacgaatcctatgtccaaaaatcgtgccatcccacgatccggttcttcaggactctggaacacacatgcacaccgcgcactccacgcaactctcgcaacctgcattgcgtctgttatttctgtttatttgatccgaagaaaatggcgtcctcctggcatctcgctccgctccatgtgcccatcacgacggagccaaacttctgaagcaagccaggactaacgtcaacaatctcccccttaggcctggcgttctccaagatcacgaactctaagcagaaaccttgccgtcactagctttgccgccggcaacccttttgtcagcgcatctgcacgctgttcttctgaacgaacaaattcgaccaaaatctgtcttctttcgatgcactcacgaatgaattgataccgagtatctatatgcttgctcctcccacgaaaaacaggattcttcatcaaagcaatagctgatttgttgtcaacaaacaactttaccaattttgcctcctcaccgagtagctctcccagcaatgcccttagccaaagtgcatgacaggcagctgcagtggctgccatgaattctgcttcacaagaagaaagagttactgtcttctgcttctgcgagctccatgccaccaaactgttgttgatatagaacgccatacctcctgtactccgacgatcatcaacatctccggctagatcgctgtcagtgtaccccgtgattgtgatctcaccaattcctgcggtatacacaaggccacagtcgattgtccccttcaaatacctgagaatttgcttcactgccttcaagtgcgtcatggtgggatgctccatgaatctgctcgccactccaacagcatatgacaggtccggtcttgtatgcagcaaataccgaaggcaaccgatcacacgccgatattcaatagcatcaacagggtgtccatctgcatccttttgaagctgtgtctttggatcaacaggaactgaggtcgaattgcagtccaacatcctgaactatgacagaaccttctttgcataggcagtttgtttaagtgtgattccattcacaccttgtccaacctcaattcccagataataactcaagagccctagatcattcatctcgaactcccccatcatttgtttcttgaatgcttctaccctggcaggattctcccctgtcacaattaaatcatcgacgtaaacgccaacaatcatagcttctgctcctctgcctcgagtgtatacggcttgttcttgcttgcaccgcataaacccaagttccttcagactcttgtccaagcaaatgttccaggcccgtggcgcctgcctcaagccatatagtgccttgctcaatttcagcacaaggtgctcttgtcccttcttaatgaacccctccagttgggcaacatacacctcttcttctagctccccgttgagaaaagctgacttgacatcaaggtgatgcacccgccaacctcggtccgctgcgacagcaagtatggtacgcaccgtatccaacctcgccaccggggcgaacacttcttcaaagtctacaccgtgcctctgcacatagccctttgcgaccagccatgccttgtgcttgattacttccccggtagtgtttttctttaactcgaacacccacttgagtccgattgctttgtggcccaccggcaatgtgcacagcgaccacgttgagttcttctcgatggcctccagctccttctgcattgcgtcgacccacgccggctcccctgcggcctcgcggtacgatgacggctcctccgtctctgcgagcaatgcttcaccatcctcttcatccaccaagtctacgcgtggcgcctctagcatgatgtccgccagactcctgtaccgcagcgggccgtcgtcgctgccggccgtgctcagtgacgcctccacctcggcagagtgtgttgatgttgagccaggcgtgggcgtgctgggcaatgtgggtgagaacctcaccgggcttgccggagaagttcctcgctattccgccacttctggctcattgccggctcgcctccctgccagcagcgcccggtacaacggtaccgtggtagactgttctgccagcgccggctgctgctcgccaacaggttcctctaccacaaactcggtggaattctcctctcctgcagcagcactccactgccaaggtgtgttttcatcaaatacaacgtcgcgacttacatggattccgcggcgtcatggatcaaacagccggtgagccttgctcccttcctcgacgccaaggtacacgaactgctcactccgatcatccaatttcttcagatttggagttgtcaccttggtgtgcgcagtacacccgaacacttgcaagtgtcctaagtgtggcttcttccccgtccatgcctcgaacggagtgtgttcacccatcgacttggttggcagccggttgagcaggaacacggcgtgccgcaccgcctccccccacatcctgccgggaacagacattcccttcaggagggagcgcgccatcgccatcaccgatctgttgcggtgttcaacaacgccgttctgctgcggtgagtacggcgccgtcagatgtcgctcgatgccggcctcatcgcacacccgcgcgaactcgccggacaagaactcgccactgtggtctgtccggagtgttttgatggagtgatcggccgtgttctcggccagcggcttgaattttgcgaacatctccagtgcttgatccttcgtcttgataacaaacacccacatccaacgcgaaaaatcatcaacaatcaacagaaaataacgattaacggcaaacgtcgacggtgtgattgggccacataggtccatgtgcagtagctcgagtggcgcttctgctcgataattcgccatcgcagggaatggctgcctgatctgcttcgccatgaggcaagcctggcaaagctggttgggatgatgtacttgaggaactcccgctgccatctccttgtccaccaagagtttcagcgtctggaagtttacatgtccgagccgcgcgtgccacagccacgccggatcgccgagactggtcagcaagcacacaggggacgctagttgcaactcaatccggtacaaacgattcgaggttctcctcacctttatcaccaggcgccagggatttttgtcgaacacctcaaggtcatcattatccatcacaactcggtggccagtttcagtgagttgccctaagctcaccatgttgcagcagaggctggggatgtagtagacgtcatcaagcagccactggtcaccattcttgcatgcgaaaaggattaaacccttccccataatctgtactgatgaggcgtcgccgaatctgaccacccctgtaacggtctcgtccagctcccggaacttccgtcgatccccagtcatatggttgctagcaccattatccaagtaccatagatcaccagcagctgctcccttctctgccagcatcaggcgaggccatacacgctcctcgtgcacgaccagcccacagtccatgccctgccccggcgcgttctgcaccgccttcgtcaccgcgaggagcagagctggaccggcatcgtccgtctgcacaagatgggcttcggctttctttttcttcggatgtgggcactgcgttgagtagtggccgaactcttcgtagttgaaacatttgatgtggctcttgtcgcggccaccgccgccggagccgccaccgctgctctgcgttccgccgcgtccgcgacccctgccacgactgcgcctggcctggccgcggttcgccccctcaccagagggcttgttcttttgtggcgacgaggtttctcccctgcctttcttgaagcgcgcttcccactcggccttagtaaggagcacctgaccgtcggcggtcactccgctagccgccgctttcttcttgcgcacccgctcatcgtacgccttgaggcggcccactgcctcctcgaacggcatgtcatcgacgttgtagaattgctcgatccctacgacgaggctgacgaacttctccgggacggtgtcgaacagcttcttcaccatggcggcgtcgttcaacgtcgcgccgagagcagagtgccggacccccatcatggtgatccggccagcgtactggtcaagcgactccccggcctccatcaccatgctggcgaattctcctttcagagtctgcaggcgcgcgtcgcgcaccttgtctgccccgacgaacctcgtcttgagacagtcccaaacctcctttgccgtccgcttctttgccacctgcatcaagagatcttccggcagtgactggagaagatgggatttcaccttcttgtccttcctcgggtcgacagccgctccggctgccggctcgatcgcctcccatacgccttgatcttccatcattgcctgcacccgtatcacccaactagtgtagttggttgatgtgagttgagggtaaaggaacgcgcttcccgagctccccctcgctggatccgccatcgccggaaccaacgccatagtgtcagatccgcccccccccccaacctgagaagctatgataccacttgttagtgacaatgcactggatcaaacacctcgcgtgcaaactgtgcgcgtccggcacggcaacagacaaagaaacaaagaaattcagagcgggattcagaacagagaaaagcagagtttcagagtagcgaaagtgagagaggaattgttgggcaattttctggtttctttcattgaactgatctgtaaacttacaaaacggaaactggagctactctcctaaatatactcaacagaaaaaaaacgaatcctatgcccaaaaatcgcgtcatcccacgatccggttcttcaggactctggaacacacacacaccgcgcactccacgcaactctcgcaacctgcattgcgtctgttatttctgtttatttgatccgaagaaaatggcgtcctcctggcatctcgctccgctccatgcgcccatcacgacggagccaaacttctgaagcaagccaggactaacgtcaacacgctgcttcagatgtagaaatctacaggcgcttcattctgcagtatgatatcctctcccggcgcgaagtactcggtattcatctctaaaaccttcacttaaattacaccacagaagatatcaactactcatgaacatccaacaagaattgaaaagaaacaaaaatcacatgatcacattgagatcaaatatgatcatgtgattaaaaccacgtacacacgccaagaaaccatcatgtgatgtgacttgtgagtactagagtatactgaaccaagctagaacaccaaagaattgctgctgatcaacaaatagcaagggatcaatcaaagaaagtgactactgacgaatttcctggtgcggctggtgccgtggacgacagggttggtcatgttgccgatgatgtaggcggtgaggccgaggttgaagagcatgtaggcggtggtgtagaccatctcgccggtgttctcggcgtgcatgtcgccgtagccgacggtggaaagggtggtgatgaaccagtacatggaggcgacgtagaactgcgaacatcgactaggccgcctcctgcgagcgatgagacggcccaaagtggcgacgaagaggatctacctacgcgctcaccgctggcttccttgtctcctctttctccacgcactctcgccgccggtcgccgtccttcccactccctccactcttccccttccccttccccacttccgcctccccccacctcgccggcggcgacgacgatgaccgcatcgatgcgagcacctctttccgcgtcgcccgtcgccgggtgcctctctcgcctcaccccaccggtcgcctcgccctgcggacctcctccccacctggccacccgccggccgggggttggtccacacagagaggagaggtgagagagataggaagagagagaagaggggaaagtgagaggaagggaaataacgttgttagcctgacatgtggggcccgcatggatcccacgctgactcagctgccacgtcagataaaactggtgtcaaaaccacggaaagaccaaaagtgaatggtttttgtaagttaagggatggcatatatctggttttgtggttgggggatgattttgcaactcgatgacaagttgaggaacctttagtgaaaaaggaaaaagtaacagaggagaggagtagtagcaggggcggacgcagaaaaaaaaatgactgggggcatgcatctataactcatagaacaatttgaaagccgagtgagactcacctcattgcaacttataaaaactctgagatattacattatcttaaatagtaatatatagatatgtcttccaaaatcctaaataatgttattttccaaaatcctaaataatgttattgcctgtaaaaacaacataagttattagttaacacaaaccaataaaaatattactgaaagtaatatatatatatatatatatatatatatatataaggaataaggtttagaacatacatggcatcctgtgtatccttttcacgacctatacatgattgaaccatctcttcttattcccaatcaacctataccgatattgaaaatcaccacgtggctgatatggtccccaaactaaatactttctcatcttcatgttgattgggatgataatttaccattctcttccttttactaggatcccgaggaagttgtccaaatcaattggttgcggcactgcagaattctcttggtattggtctagatgcatttgcactagaacttcctcttgtggtgttcatagctgttggatatctaataaaaaacttgtccattatctttcatataaaatcatgagaaggttgattagatagagcacatgaagagggagacctaggactagggatccatccactatatctattcacagggaagaggagtacttaccatgggaggcagagaggacagaccgagcaacagctgcagcaccgctgaggtgctgattatgaagagtgatcgcgaggaagggaggaagcagcgataggagcgaagatgaaccgatgcgggggaagcgtgatggatgggcggagtccgcagagaagaggagcggacgttcgacgacccctcgactcatgcgcgcgtgcgatggaaggaacgaaaacaagggggtgtggggtccttttttccaattggagtggggtccataggttatactactatgaatatagcgaggagcgtaaattttgactggggtccagggcccccatcgtgtgtacgctaaatccgcccctgagtagtagtagattacagttgaaacatcagctaatgctgtctcagctggcatttggcaggcgatcctcatcttctcccatatactcttttcagttccacagtctggatttcttacattctagcttatttattaaaaaaaaacttcttttacaaatatacctcctttgagaaaagcctaggggttttctgtttagctccacgaggtggtgggctaggcgacctaggttcaaagcctcactcttctaattatttgatattaggttattccctaatattcatgttttaatatacctcctgaaaaacttgtccaacaaaatttctcgggcagtaaccatggcattttcagggtgtgttcgaaccaaggtgttggaagcctctcctttcctgcatgaaaaaatgatgtaattatctagcgcataattaattaaatattagctaaaaataaattattattattttataaaataactttgctatagaatacttcatgtatctacttttgatagtcatatttcatcttggcacacagaccaaggataagtgattctacttatcacccatttaaacgtgctactagtcattcctcgtaaacaagcgattcattgatatttgcatttctcgatgctcatgtagacaatcttgtgtggaagaatgaagagtcacgcattaaatccaagaaaggcattaagatgataagttgttgtattgaaatatgcctatcaaaaataaattttttagatttggaaatatgactatcaaaagtagatggagggagtttttttttttttggaaaaaacacatcgtttactagtttgcactagtatagaaatgcacctatgtgtcgggtgggaaccaaccataagtaccgaatttcctgaccagtatcaagcaggcagcccctttgagtctcctcaaagatgtcggtttaggaaccgatacctttaaggttacttggataaaaaaaaaaagccagctccgagcacatccaccttgtgtcgcccccaaaatcaaccaagctttgccctccgaaatcaatcacaacgaactcccaacagtcaacatcaccatcacagatcctagtcatcgtcacaaaaccatactccctccgtcccattttaagtgcagccatggttttctctgcccaattttgattgtccgtcttatttgaaatttttttaaaaaaaattaaaaaataagtcccgagtaaagtactatttatgttttatcatctcataacaacaaaaatactaattataaaaaaaatttaaataagacggacgatcaaagttgagcgcggaaactcatggttgcacttaaaataggacggagggagtagattacaagtcacggtatcgacaccatggaacaataacaacaacaacaacaacaacaacaacaacaacaacaccatcttaaaaaaagatgaaagaagaacaacaacatcatca

SEQ ID NO: 65091 - DNA, 838 bp, Oryza sativa
aaaatttgacaggatatattttaaaattttggaaagggagagaccggatagtcagatagattttaaaattttgctcgtgttgccaaccgccaaacgcagctgcagaactaacttaagcccagcccccaactgcccaatagtgtggccgtgtgggctataacgcccattcgccgctcggagaaaaacaagaacatcaatcagggcaagttttataaaaaaggtgaatgttgcatctaatcttgaccacatcatcaactaataaatgtagaggtaacatgtacaatatatcacatctatactaattctaatacactagccccaatatttgtttgcccaatctactcttcctctctctccttttgtcttgaattttgtgtagtggttacctcttgcataagaggtggctcattttctctctcatctcatctctccacctatagatggccatgtgggccgcccggcacggcaaggcccagcccagccgtgcctgggccgaggattgtcaggccggcacggcccgaccgacgcaccgggccgtgccgtgccagcccacgtgccgcactcgcggcccaggcatggcccaacacgtctcgggccgtgccgggccggcccaaaggcatgatgggccatcgtgcgtttcctcagaataagtctaattttcctccctcctattgggttatgagtatatatatatatatatatatatatatatatatatatatatatatatatatatatatgtaccatatactaaaatgctattaaataccgtctaataaagtaatttaaatgttacatagaatatattctagagcacttatgtagaagatcgtttggc

SEQ ID NO: 65092 - DNA, 683 bp, Oryza sativa
aacactatgctcgttggcgaattggcattgagtacgcttagaaatcagatggactgctgatctgctatgctcaaagcacaatcgaatagatagttcatatggctactcaagtacaggattttcctacaactcaggtcccataccatctcctgcgaccttattagtagcttcagcaacttgcttcaccaggtttgcaccaacattcttagcgctgtgctcaaactcaatgcttttttgcaacagttactccatttgtgactttgggtctttgagagacctatgggatctctcaataatcacattgcgcccctacaacgcaacacacaagaacacccattcagtcgataaatcaagtggggtaccatatcacatctgtaattgagcaatagatatgatttcaatgttgaaattgagcatccttttacttctgaaatgtgccagtataatgattagatagctcttgtggaatgtacatgattagattggggggcattgggaaggcaagcaacagctccatcaatttcctactcctaactcttcaagatttaaacaaaatcaggtcaataacaacccttcattgtaaataaaactgaggggttctgtaatatcaatggactcgtgcgcttaagtattggtaacagttcaataagactaaaattgctagccacaaaaggggggcagga

SEQ ID NO: 65093 - DNA, 1749 bp, Oryza sativa
tttgcgttcctgtagtagtgtttgaaagcgcatgcgtgaaatacaatagagtagaagtttggaagagggagtaaagaacacactattttttttttgaaacctaaggcggaactttgttccactttcatatttagaagaagagaattgacccaatttataaggaaaaccgggtccgaaaaccatataattgcacgattaattacaggaaaaccggctgaaaaccaccggtacacaactaacaactacggcggagcccaaacgcaggatgtcgccgccaagctaaacacaaaagcgactaaacagctcccatatcacataagaggtgttattgttgccgagctagccgcccaagcgacccagcagcgccgacttcacaaccacagtgacactgaagccacgaaagtcaccaaagcgaaaagcagctccggcatccaacaatggacatcagcctgaccatcgaggagccacttccttcacacggccagcaccagaactccactattgggatcaaattaaaaacgggagataaaacaaatttagcaccccctccgttccataatactacctccttgcacaaatgtatgaccttggttagctcataaaaaaaatacggagggagtattatattgcattctggcaacgtatgcgtagattacagtttatacagtggtactatctagtacatgggctctgcgaatcaaagataccgttaataagcacgtcgcacgaaaagttgaggacaatgtagctttttctctgcgaaaatggtggcagatgatcatagataggataggatatgatatgatcccaaacaaacaggcatcgatcaagcattcgcgagcgaaatggcgatgattgcgagggaattctgttatcgccgtgtcaaccgctgccatcattccatctccctcgcgccgacgcccatcatttctcacacccctctccctcccctcctgccaaacctttcgatccaacaccaacatgctgcatgccatcatcttgccgccggcacagtcgccattgcctctctccctcttttattatccccatcaccagctgtagctgtaacagcacaacaccctttcttcacatctactacgtagtatgtaatcaccatgcttattgctccctccgcttcagattatattaagctgtgtttgagagagagggaattgagaagatggggaagatacgcaaaacgaggtgaaccattagcgcatgattaattgagtattaactattttaaattttaaaaatggactaatatgattttttaaagcaactttcatatagaaattttttgcacaaaatacaccgtttagtagtttgggaagcgtgcgcgcggaaaacgagtgacaatctccccaatctcctttgaaagaacgcagcctaagtcatgttgatttcgatcaaatttaaattgttccaagtttaatcaactttgtagaaaaaaagtaatattttcaatacaggataaatatattataaaaatatattcaattatagattcaataattggtgttataaatattactatatttatctacaaacttaatcaaacttagagtaatttaactttgaccaaagtcaaaatgacttataatctgaaactaagtgagtacacatttagttgagatgtatatgccggttaagttactaacgtcttatagtatgtgttgctacatccgtccttaaatatagtaacacacgtactaagtatcaaatgtgacgtatttttgtacggttaaa

SEQ ID NO: 65094 - DNA, 1374 bp, Oryza sativa
aggaaaatgtaactgcattcggctatagtgcatggcatgatatatgcacgttatacacattatgtgtaccttttcaacaagacaataatcctcttacatggggagttgggaggcaaacaaaaaatatggggaacaggcaaaggttgagaatttttgtagctcaatgtttttgtaccatattcatccccatgcaaatcaatttcaaacaacaaaataaatgatggaaccattcaaacataattcatatgagagaattacagaataaaggataatgtctgtcactaattaaaaagcaaggaggtggaatgaaaccttgtaggagcgaagaagtgtgtattcataatatctcatcttttttacatcttttgaaacctctaccgtaagctctttttctgtcaactgcctaatgcggtaactgcagcaaacagagaatgaggcatgagaaagacaccttaatatgtaatcaaaatacaaaatgaaaatcaaccatcacatacctaggaataatgtccctgaacacagcaagcaaggacatcagactaagtttaacaaccttctggtctttgtcattgcatatgtttaacatatcatttagagatctaatatgtgattcaggatcttcaagcatagacatccctatttcagccagctgggccttctttttctcaaataattcctcagctgaaagttcctccttcacctcctcctgtcaatcggagcaagtacaagacatatgtgaaaaaaaaagcattaactaacaaatagcaacatggtgattttaagatcttgaagggttgaaattgtgggcccatcatttgttttaatattgacccaacattttacaaacatgcttttttctccatggttattcttgcactgcattctataggctgtatgattaatagtttaatacccagaactcatatacatactgtgatgttcacagttccgtaccatctgacctagcgttttctcgaaaaatcttagcgtttcatgtcaacaacgaataagccagagagcactaaactaatacaggtatgacagtcaaattatatatgtggatgtatgttgatcaacaatgatgcataggatacttccatactgacaaagttgcaatcaagcaaggccaaatcatatattttttgtgctaccgttatgaagaaggcatatatatagtacatagcatatggtttttccaacaaccaaagcaaggaggtcgagacagcttgtcttcctaacaggcattaaaattatgtatcataagcaaaaggcttgttgaaaaatgaatctctgtgatgcaaaaaaagaacaaggtaataccagcacttttgattgtaattttccatttgaagcttgagtattctatagtgtcac

SEQ ID NO: 65095 - DNA, 548 bp, Oryza sativa
ggtttgcgtttggttgaagttaactttgagatgcatttagtagtacacgcgacattctcgtcggtttaatcaataatcaggagttgcatttggtcatttggtaatcgcgcaaagcatggtggaaaaagaaatgcagctcgaattcaggatccccaaaatctccgcctcttctgtttccgattgactcagaattcaaaaagtaaatctgcatcacggggggagagaccatgttcatcttctgcacgaatcgcgaggcaaactgcccctgttgccgatgtggctttccgctgactctgttgtgatctgttgccgcagccgcgcggaggtgcgaggcggcgcgatggctgcggcagatggaggcggcggcggcggagtccctgccggagaggccgtcggaggaggagttctgcgtggcgctgcgcaacgggctcgtcctctgcaacgtcctcaaccacgtcaacccgggcgccgtccccaaggtgcgttgcttaagagttcaagacccaaacaaaaaatcgatcggattggaagtcatttttttttttgaa

SEQ ID NO: 65096 - DNA, 21480 bp, Oryza sativa
  unsure (1)..(21480): unsure at all n locations
tgcaggttatactatactatacctgtgtatcacgttcaaactatgatatatcagattataacatcagatacaattgtttgaggaaagcaaaacaaaatagcaaatccaggattcaagggaatcctgatacagtagagcgcaatgatgctatttcatctggctaacaccagcatccatgacttttaacccattaacagaggcagaccagctcaaatttacagcatatcccagagtctgattacatattttggatacataaactcctgcttatatcccattcctccaagctgattttagtgcatgtgtttaaaaccatgaaaataagtatcaagtcaaataataaccatgaatataattttcaaacaatcacgaaaggatcttgagtataatacatctatgtaagtgttgttcttgctagctggccctttcaccatgacagcaaagaatcgatggcaacatagattttttttttataaagcaacaactaagagtttttttaccacaagcagtggaggcagccattcattaagttttagaagaagcacaagtacacgcccttgtttacctaagtattggggggaacaatatcaaattcatcacaaagaagaaaacaaagtgcttgcagcacccccttcactaataacgatcgacatagcaatgtatggccatgtacctcagtaataaggtagaaattttattcaaccagcttctcgttgaagttcctcacctccatccttgatcaccgagaaatcagatgcctgcaaaaagcaataaatggtcagcatggtcaacatttcttatcaaggcaaaacactataatgaacatatagtgggcagactattgtactcatgttgacctacgcctccacaccatgccgcctcatatcaaaaaatgttttcatttgtacgacaattgcgcactacatttttaggaacatcaataagatattaatattaccttcattcaattcatatccacacaaaaaataaagaatctctgcatgtccattttaacaaaatgattagctgctagctcatcttgttcttgaaaatattttatcctattctgtctgagagaggcaatagagaactgaggatatacaaaatgatatgaacatattaatttagattgcagcactaaaacacactatatctagtgttgtggctgtcaataaccacctaatatgtgccttatggaattggaagcaatgaaccaatgagatcaaatcagtggtggaacaaaattagtttatcctaaacagttataggaacaaaactatatataaattattacttctagaagcaaccaagtatactttttgaaacagagtcttgccattttgccatagaaagtgtgctttagtagcccttcaaaaatatttttttcacttgtccagtatgcatactgtcagctgaaaagagttcattactaaccttgaataatattgaaagcactattcagaaaaggttaatcttttaagtgaggatggattatagttggactaaccatcttcctttgtcattttgatacagtatagtttaattgttgttgatctaccgtgtcaaatatagtgcatgcgacatcatgtaaagaatacagccttaccctctgagttgttattcaggtcatttctcatatatttattctattaggactttcaactttacgtgatgcatcaacatatattaattgttattatgaagataaaacatggcagcatatgcattcagcagaacttacctagaactatattatattggagagatagatggcatgagggatgagtctagtcgccaacctagtcacgtccagccgggatcgatttgcagccgccggggagagagtggagaggcgatacggtgtgcgatggtggtggaggtggtcgaaggggagagagcggagcggagatgcagaggaaggcgtctactttgaagctgctcaattaatttatccctagacaattcagaggaaccaaaataatcatttgtaaactgaaatgagattaaaatgcagatggaaacacacagacatatccaaggagtggatgctatagcagaaaaagacagattttataacgatggcatcaaatgtagacaaatatccacatatgaaatgcattctccatcagttcaaattacctcaatactgtatagaactattgatagagccgcaagaaagcatgcattttttttccgtaagagacagatgaactattcagatatatagggaggatttagcactattagacagtgaaaccaaacaatgtccatcagctttaagttaggttggacaccataccaggtggaggtgtaggggaggggggaagcgggtggctcccgtcgatccggcggtggcacaggtggagcggctgcgcagccgatggaggaggtcggttggaggctccctatgacggcgcaggtggagcggctggcggctcccgtcgatccggcggtggcataggttgagcggcagcgcagccgatggaggaggtcggagtgcgtaaaatttcaggtcaacgcattctccctcatctgccaagcaaaagcataaaaacttgatgtataatataagaagtaaaactgaaacaaagatagaaagcaatatgaaccatgagtatgtctagataacagagaaacctactcagatttgctatttaaatttggttgagataaatgcatattacaaataattaagggaggcagagctgaggcaagctttagctaacaggttatttctacttgattgcaacgaaagtatcactgcgaagaaatgctcagcatcgatagtgagctgtgcagcccagcatctcagaaatcaaggtacattcgatttcatccaatggaaaatcgcatcagttgttcagtatttacagtcgaacctaagatttggaaataacagcctcaatctcctatggggaaaatcagtaactccatttgcttcaagtgactctatctagcatcggtctcactgaaatcaacaaggcaaggcacagatcgttcaagcgtaacaaaaccaaagctattgcaagaacataggttgaaactgaaagggagagaagatgaaatctagggtttgggtaacaaacacacacctcgagaacaaacgaatcgaaacttttcttgtcgttctcaatcctgctcctgtgaggaaaaaaaaattgaacacccgattaaaagaaagcaaggcaggaggcgcctcgcccactccaccctgctcggggcgagacaacactagggcaagggcatccgcgtgaggggaggagaggaagagattagggtttggggagggggttggcgacgcttgagagaggaataacagatacctgggtggggcgtcgccgtcggcggaggcggtggactcctccatccccggtgcacagccaaccctccacatccccgggagcgcgacggcggaggcggcgaagaggaggtgggcgcgtcgtcggcggttggatcgctaccacgatctggcctggccttgtgggggagaagcgattcgcgggggaggagcgcgatgggccggccgatgggctcctccctcaacaccgtccgatctcccgatcccacggttaataataggtcgtgtgtctctagtgttaagtagagaagggcggagtagtcgtcgagtatatcgcgtaaaagaaaaaagaaatctccccgtctccttctccttgcctcctccgctccttctcgcgccgccgccgccaagacgagtcgcgtcgcggctgaacaggggagggccgggcggcgatctccatctggcgagcagcggaggggagggatcctgatcctggtgcgtcctctttctgattcatctctctctctctcccaccccacccccacccccaccgggactggaatttgcttgcgttcatcaaccctactagcttctcttctagatctggaagaagctcttctcctcctcctccttaatttgatagccttaaacctctcttaattcataattcaagtaataacagtttgtttcttcacccaaacttagaacccccatttggatccgcccctgttctcttctctgttatatatattgccttctagaaaatatttttttagaaaataattcagtgtccgctcagagaccgagcaccctaataggcagaggtcgaaatctaccaacaaatgagagttgggctgtgtttagttcgtgtgccaaaattactttgaagtatacagacacacatttgaagtattaaatgtagactaataacaaaacaaattacaggttccgtatataaactgcgagacgaatttattaagcaggctcaaaagattcgtctcgcaatttacatgcaaactgtacaattggttttttttcgtccacatttaattctccatgcatgtgtccaaacatttgatgtaacggaaaagttggaagtttgaagaaaaaattttgaatctaaacacggccttggtaggaccaaacctaccaacaaaagctagcggcttgtctcacatcaagtactggtcatgcctggtatatctgcgaaaaggttggtatgaacaatctccacacaaatgttatcagcttgatcacctagtattgtgtcgaacgggtgtccaatatgcttgtaagttggttaataaggtatgtgaagttatgctgaccgcatgagatacacaactagtaaccaattcaagtgctactaaaagtggtcaaggtcctcgttcgtacctcgaccagagattgtagtgatcctcccacttttacgagtggtcgagatacgactacacctggtccttgttcgacaagagatagtagtgatcctcctacctttacgagtggtcgaggtatgactacacctggtactcgctcgaccagagtgttagcgatcctcccacctttatgagtggctgaggtaagactacagctggtcctcatttgacctataaatacaagaccccaaggaggagaaggaatgggaccaatacaagagaatccaagacaatccaacaagcctatatatacccagtacatagctacaaaagccgacaagagggatctagagctatctccaatatcgccaagttcttatttgagaaaatggactattactagccgtcgaacatatgtctccaatatcgccaatattagattaggtcgttatcaatattgtgtactcgtgtgatattgatatataatggcaacactggtttcgatcaaacctgtataaaaatccttgtctcccgtttcttttacctcaactcgcatacgctgttgcctgcgagctcagaggcgagcgagaggcatactgtgcgcgaccccggtcgagtgacgggtgctcagatggactagggctgagattacgcccccttcatgcctacagaacaagggcccacccgacccacgggaggatgggccaggttgttcttgtccaagccctccccccttaacaacatcttgtggagcggaggacgggttgcgcttgggccctcgctacctggtggcacaacgcggcctgcgttgaggggcccagatcggcacaagtcccagccctacctggccacatgttcttctcaagggtcaagactgacaacagacagatcacactgagatttccaaatccggtgccgctgtaccccgtctccgctagcgccacagggtgagcatccaagtttttcccccttccagttccaccgaggcacacaactcgaattctccctcttcctctcctcttcggctcttccctccgaagtggttagccccgaagagatccagccaagtggcttcctttggctagctaggaagtaagcctagacctggctcgcttagattatatcccaactcctgctttgccgcattcttccatgctagggcgatctccgattggggaggtactaacctcttttttcctgccatttttgtctcctgtcaggattttgggcaaaggtgggggtgaatttgcacgagggttttggttgatggcgaacattcgggctcttctcatcgggtaagatgtggatgctattctaccgatttatggtaggatagtgtttatgttaggcgatccactgcttgatgatttgcgcgtgttgacatcccgcaggttggtacgtgccaggggttccttggtggacattgggcgatgcgtttcttcttcaaggtataacgttggacgattagtcgcaagattgttttgtttgattgttctcctggatccgtgtagaattattcaattgttgctggtcttcgtgtgaacaccaaattcgatgctagggttagctgtcaatcctgtgtctaatatgttccaattcattttggtctttgaattacattattgaatattgttgaattgggatgccaagtttggggcatgtgcttggtaaaatatattgtgaaagttgcaactgctttattatgtcgttacatgtagctttgcattgcacattttttgacagaatgtttatcttccaggccttcatatctagcgtcactgggcagacattacaaggttagccaaaagatttatccccttcttatccacagtgtaacttatatgccatcttttcaggttcccatggaaattcgttggttatcctcaacaggtacatcatgttatcccatccttccaatatatggcatattgtagtatgcatattgcttctttggtgtggatgtgttgaaatagtacatcccttggataggtcgttgtattcacaggcgactatagattatacaagacagaatatttaatggcttatggaactctgtgctctcgtcatagtgcaattgttggaacttggaacttatctcctcatggcttgcatcaattgaatatgtgaaatatatatattttatcataaataacatggacatgcgaagttttacttgtttatttgcttcttgtttgttccacaacattatcaagagaaatctcacttgccgcaaagagaagttggtatgctaagcaagacatccatttgtacattatgatacgattattctaagtagcgtaggttagttgataaagtacatccatttgtagagttaagtacgcaatccgtaagccattaatgtatcattctatttcctttgcacatttgtgtggtgtctttagtgttctggaagcaaacaacacggaagcagcgttagttttaaactaatcgacttccctgcgcacctgcatggctaggtatatacatgttcttttgtatttgaaaatagagtatgtatttcatatacagctattgggcctgctcggctgctgtggcagcagcttattgggctgcagcagcaggccatgggcactgtttctgcatgtagcagctggatacgtcccacagcacgtgagcagggcccttgtacctaatgctgtaaatacaaatagtctttttattggagaaaaaaataaaggatttggatccctaaggattaattcctatgagtgtcattcggtttgtaggaatgctgtacaggaaaatcaaagaaattttcctttccttaggaatttttccatctactcaaacctcttggaaaaaatcctatggattgatgtgtacatgcattcctattcctccacttttcctattcccatgggttgaaatgcctccaaaccgaataagccctgaagatgctagtatagtttggacagatcacaattaacagtgcatacctttttccttatatcatattattatgttggtttctagaccttgagagtgaaatttgaagcctttttctactgttataatatgtaatacaaagatatcctttaaatatatccttaactctctccaacagggtttcctcctcatctggtggttgggatgcctgcattatcccctactatggtaaaaacataagcatcggcatattaatatttactgatggctcattgtgttccccctgtctacatcattggcaatctaatatattttttcattagaatcaaggtaacattgcaaaatggagaaaacaagaaggtgaaaaggttaggattttgctctgggatatttcataatagaattgaaacatcttgtttccaattcagagttctttatttcttttttatatattagtttcgatcaaaagttatctgttgtttgcagatagaagttggtgatgtgatctgtgagatagaaactgacaaagctacgcttgagtttgagagccttgaagaggggtaatgtcctttgtttgagctttgtctttggcttgaagcaagatttccatgttatttccttaaaatcagtgctccctccgtcataaaatatagcaacttatagcattcaaaatttgtcccagaaaaagggactgaactcgtttaatcgtagatctgagattatctgtatcatcttctttgtaaaaactagttaattaggtattatcatcttctataaactagttatctatggcagagattatctatatcatcttctttgtaaaaactagttaaagtcagtgctccctccatcataaaatatagcaacttatagcattctttgtcccagaaaaagggactgaactatagcagagattatctatatcatcttctttgtaaaaactagttaaaatcagtgctccctccgtcataaaatatagcaacttatagcattcaaaatttgtcccagaaaaagggactgaactcgttattattctagtagcttaagcactgaaatgactgctcttcaatggctccagtccaaatattgtgctggtgctataaacagtggcaaatgagagtagcctttggtgtttagctggagaccatgtgctcctcctacggtttcttaccctggacgcataggggctgtttagttgccaccctgatgcaaatatgcctggccagagccaagcctgagaaaacaaacttgtttggttggtgcctaaactccttcatacccagcctggcctgagctctccggcagattcattagcctgactgaggcgatgaaatttggtggcctgagctccatgcagcggcaggctgagcagagtgcttccatgagtactactgtagttgactaatctcatgctgcagctggttgctttcttttatatgtatcatgcacctagaacaatagctttttattgggaagtgtactggactggttaaaatactacagaaaaaaataatacctaattaatacttacattttccatgtacatatatggatctacgattaaacatagtttttacaaagaagatgatatagataatctgtttttacaaccaaacatatttttctcaagcatatgcctcatgcatgaatcatccaaacctacgcaacactcagccacctattttttttgggataatgctcaggttgccaacttaacaggcccttagtttgtttctgggtgatctggtcaattaacactgtggtgcgttttctagttttgagggtgtgttttttaggggccccttcttgatccccctccgcccttttgtatttttctttcttataatgaactgcggttctcctgtgttttgtaggaaaaaaaataacttctctgcttactccctcatctcaaccaataacaattatcccccatttaatttcacccctccttaatctctgtgaaactctggaagtacttatattttggaatggatacagtagtatttatccagtatgtaacaaactaaatgttgtttttcctagcttgtacatatacgttgctaagcatgagtctagtgttttttgtagctacagataagtgcttatcattagaattcccatttggtgatagaacatgttatgattctcccagaatagcattgagatattacatatttttctaatttccactttatatgtacgtcttataacccttctgcctatttttttctcgaaaaaaatcttttgcctgtttctttatgccatttggattgtgggttagaggttgggaaatgatggttctaatggatctgcacccatgtttaattggaggaatgggatatgctgaggctctgggaaacggatatggagacctaatgttagtgaaacggtgatctgacaaaagtgctcattgtttcgtccaatataccgttgcggagccattatcctatccaacagctactgcgtaatcaaattccattcccagcgtgccatttgaaagaacataatgtgtgatttactggttaactaatccaaacatgttgctgttcatccatacaagtttagccaatctatttttctatgttgaagcgaatttgagaagatatattcctttatttccctcttttgtcatatgacatggaaatgggcagaatgttcacagtgcaattttgtttaatctattccattacagcatgagaataacatgacagatgacagatcacagttatgtgtaactacctgcataccatggttggctaacatgctttacattttacaaaatgaaacattgatgttcttctcctagcctcctagatgtattgtggatttagctttgttatgagcttttcacacttgccttttttttttcttttgtgacactatcttttcttatggtgaatatttgtttaacctgtgttggaggatatgcatcttaattcctagggcatcggaaatagactagagacccatggaatgtacacaaggaatacgctagggaatatgccatggaatatacacgtaatgtaaataactacccttgttagggccatgcaagcgaggagcagaatgaggattttcccttcccccaatctctctctctatccatggatgaaccctgggggcaacacactctttacacaaaagccgttttcactcctcgatctcttccctcacttggtttcctaagactaatggtacccgtaccccgtttgttgtttatgcaaaaataatctgtgcgtaccctttaaatttctgagtgactatttgtcaatgttacaggtatctggccaagatcttagcacctgaaggttcaaaagatgttcaggttggacagcccattgctgtcacggtatagcttcatttcattgaaccgttcatttctatgtctgaatcaactgcttatttacaccattggcttgtgtgcattttcttttttaatttggccatgaactgtttactcatgccatgttcttgcaagcataatgtcatactaactatccacaatccattggaaggttgaagatcttgaggatattaaaaatatacctgctgatgcttcctttggaggtgaacagaaagagcagtcaattgcaagtgaagcacaaaaggttgaaacggatgctgcaaaagagagctcgataataacccgtataagcccggcagcaaaattgcttatcaaggagcatcgtctagatcagtctgtactgaatgcatcgggtccccgtggcactcttctgaaaggggacgttcttgctgcattgaagttgggtgcctcctcaagttcaaccaagcaaaagaatgctccagctgcaccatcatctcagccaactcatgatttccaagctcaatcagtcaccattccacaacaaaatgatgcatacgaagatatccccaacagtcagatacgcaaggtattctttgtttcattatttttatgataacagacatcatgaaatatctagtcacactttatgatatcttgtgcatgtgaagaaaagctaaaagactaaaagcatgatccaaggctgatctaatggaaattaatttcagttcattaagtctaaaacgtcaagaacaaattttcatactactaggttattaatatataatagcatagtttgtcacattttgagttgttaaaatgttgaaatggccgttaggtcattgacaggcttgcaatcaccttcgtgaggacatggttttgcccttgcccatgccaaactctgcttatcccccatctacctatagagatgtctgtagagtggtgtaaagttttttttgaacaactatgcataactggtacagccactggtcacaaaagcatgccgttttagatgtcggcattgtctgaaaatgcagctttgaccactaatttctcttgccacatatttgtaaaagttaaaaggaaataataatatttggaaattatgttttgagacaatctacatgtgatcgccatatacatatatgcaatataaatatctaagaacaaattgatgtttaaactttgaaagtttgattggaagcatatccccaaagacattattttgactatgggagtaataactagagattggctttggctttgtgctttcaggcgtcaattttatagccttttatcattaattcattttcttttctttttctcatagttgccttgttgagcctttaagaaaatgaacttgcttaagtttgtgtttatagcattacaatgcatagtgaatgatgcatcttctattcttgttctcagtgtccaacaggttcttttttatattgtaggtgattgcaaaaaggttgcttgaatcaaagcagaccactccacatttatatttatcacaaggtgtgtattcatctaatgcacattttgcaataccttggttgtgctggcataattatacgttacattgttgtcagatgttatactggatcccttgctcgctttcaggaatgaactgaaaggtgtgctatttatcttctttaatttgatatatgaagattggttagctaacctgaaaaggtttttttttctttctcatgctttctaatatttcagagcaacatggggttaaagtttcagtaaatgacattgtcataaaggctgttgcacttgccttacggaatgtaccagaagcaaatggtaattcttatctgaattcatgcaaatgtgaaacttggtggttgtgttactatatctttgattgtaatagcaagcatatcaggtgcaaatccttgttacccttcttgctgtacatttaatgtccacactgatcttgaacaagtaatgacagttttcaatctgtttgatcttggagggctcatgcaccatcatccgtagttatacttccagcattattgtttttacatatgctagtgtcgataatgtcacaagatccacaagatcaaagtcagtgaacatgaatcattctcaagttgttagatggcatgcgatggagatttgcatgttggcaccgagaaggcgcacatgatacatcaccgttggaatactatgagctatactactggcagttcacaaataacatggtggtactggtggatataggctaattttgtaacagattggcaaagggtagaaatactatcacctgactacaatcatctcaaccactattgatttgcaccgcccgaccaaacggatgaatccaacgatgtcattgcattggaatgttagaaacttagaatttttgctgcaaatggactaactgaatattcaatttacacatagtggtttaagtcaacttctttgtttggtctaatggatagctcatcattattcttttctcatgaatttccagcatactggaacaatgacaaggaacaagcccagaagtgtgtttcagttgatatatctatcgcagttgctacagagaaggtattgaaattgaaaagtactgtttataatttttattagcctatccatgcacattaacaatgacctttgcaactttagggcctgatgactcctattataagaaatgcagatcaaaagactatatcagcaatatcctcagaggtatgagagaatgtttaaaaggttcaaccttactgtcatagtttcagaagttctttagcatgaaatgtcacaggcacatgtaacgcttgtaatcaactatcttaagacatggtcttggaatgatttagaaatgtaaaatctgtggtcaacagttttcatagatacctgactgctgggactttctttggaaagttgagaaccatttctggaaagacctgggttttgtctagtggaagacaaaagtctttgtatatgaaaggcaggactataagtagatagttgcatctcgctatcagttatcatatattcctgattttcgacctttaaagtagtcttcatgtttatggttatgagatataatcagttttcctttccctatcactgtaggttaagcagttggctgaaaaggcacgtgctgggaagcttgctcctaatgaatttcagggagggactttcaggcatgtgatattttacccttttgtcattgcttttgggaaatcctgtactgctgttgatatttgaatgttttgacattgcttctgcagcatctcaaatttgggaatgtacccagtcgaccacttctgtgcaatcatcaatcctcctcaggttcctacctcctatccttcgatgaaatgggatccttgaatctgtgctgataattgttaccgtcatttttctcagtctggaattcttgctgttgggcgtggtaataagattatcgagcctgtggtggacagtgatggtacatttccttgaccatgtgtaattccttctaaaaaacaaatgcttttgtattttaactcatattgatatgtccacttgttcaggaaccgagaaggctacagtggttacaaaaatgagcttgacattgtccgctgaccatcgtgtatttgatggtcaagtaggaggtactgatatccttagacctgtagtttaaatgttcaattagccatcattgttttctccttttatttgttttaaacataagagtaaatttcacaaaactacaggttttgttgtccaagttgcaaaaaaccacacatactttgacacttggcgctcaagtacatatattttggtagtgtagtttcacaaaaccacaatatcaatgaatggattaactcgtgatatgacgtggctgttccacttaggacaaggacgtggcatcctattaccaaccatcgcacgaaattaataggatgcctcgtcctcatcctaggtagaacaaccacgtcatctcacaggtgaattcattcattgatagtgtggttctgtaattacactaccaaaatatatgtacttgaatgcgaagtgtcaaaatgtgtgtggttttctgcaacttagactataaaacatgtagttttgtgaaatttactctaaacataatcactgattccatctcttaattcgtctttcctttttgtttttcatgggaagcaggcaagtttttcacagagttgtcacagaattttggtgacattaggagactgctattgtaaatgaaagttagtactaatcgtgctttcaaatattctgttggaaaaaggttggccaagaaaaatctttcccatgcagctcggagcttggttgcttcacctccagcacgtacaaaagtaaccaattattttttatttttttaataaggttaaatctgcatttccaagttttttttcttaattaataatactgggattaatgccccaagaattttgcagatacagtgccatttcgtctttatgtggctgtgcaacatttaatcctttattagatcccgttgtttcatgagtatttctagctgacggagctcgctcaacattttttttcaatgatttctgatacacattgcagcaataagaaaatgctatatttttgaagcatcatcatcacattcttttcagtatagctccagtcttataattcttgcgttctttagctcttttatcgattaccgagcgatggttggatttgtacaatcattatttggaagttttacgcgtgccaaatgcatcacggtatttcacggggtaatgagaataatatatgttcccattttgtcttttagttggttattttattactttatccgtttcacaatgtaagactttctagcattgcacatatttatttagatgttaatgaatctagatatatatatgtgtgtttggattcattaacatctatatgtatgtgtgcaatattagaaagttttacattgtgaaacgaagggagtagcaatttccaagtggtggcggagctcgggcgatcacgcttgggaggttgctcggcctgacagttaaatctggcataaacgaatagtatgcaccatttattcatcaattagaagttgatctacatgatctctagcagatttataactaaggctatgtttggataatggcttagtttggataatgggatggggaatcttatcccaccttttagaaggataacttttaatcctagccgttcattctttatatctcgtttcatctcaacccttcactcatatcactatttcaatcccatccctcctaacctattatccaaatagcgcctaagagttcatatctatcgtctatctcaaaaggttgagctatccgtgttactgtggctcaaagcccatgcatccacatatctatcgtctatctcaagaggttgagctatccgtgtcactgtggctcaaagcccatgcatctagaaaaaaaattaaaaatttacttttttttctttcaatttacagaaatatacttgcatgacacatatttgcgaaaatatacctcatccgcatattaggttagcgggagcggtacggtaggcacggtcgcgcgaagtggggatgcgggatcgagccggtctcgcacggcagttgtgcggaagcgatgcagcccgcggaacgggtatgtgggagcggctgggatgcgggagcacctcgggagcggcacggtcccgttgaacgggcgtgcgggagcggcacggtcccgcggaacgagcgtgctggagcggctcggttccacttttttttactgtatcagtactgtttggcattgttcaaacagcggtactgcggatccaatgtgcggaaccggctcctgaacagtgtcgaaacagtgcagaacagtatcgaaacagtgtcaaaccgtgctatatgcatgcatgtgcagcttggctgctgggtcacgcgtggccggcctgcgtgaccgcgcggtgccgcgcggccggtccgcgggaccgacgcggtaccatgcgtccgtgctgcggaatcaccggtcccgtggaacggtagtgcgggaccgcctgcggattaggtatatttgtgtaaattttcgccacataggtatataaacgcaaaataataaaaaaagaggtatattttcaattttttctccatgcatctacgagtatttaaaaggaatggaacagagtgaacgagatgtgtgcagaattaacaagaaaaatcttcacctcctgatctcattctgatattcttaaaacaatcatctactccctccgttccaaaatataagcatttttagcatagtaacaagtcaaactttttaactttaactattgatagcaaaagaataaaaaagatcaatcatgtaaattaatgttactagatttatcattaaacaaactaccataatatgcaattctttttatttgaaacacctcatttttataaatattgttggtcaaagtagcatctcgaagaccgtgtcaaagtctaaaaatgcttatattttagaacggcgggaataattaaagtaatcccatgatagcacaagttgattagcaaaccctactaagagcatcttcaaaagactattcaaattggactctccaaacatccacgtagctaactatccaaatgatcttttcacgaaatactagaccatgagtgacaatgtacccaatctaggagctttatcaaccgtcaaaaacaggggagttccctagcccattatataactagatcaatgtgatgccagctatttatttaactccgttggcacaaaattatcgtaaggatcggttttttagggacacaattgacaaaaaaaaaatagcaatacaacccgagtctctctgagatagagcccaaatcgtacaccttttgtgtgnnnnnnnnnnnnnnnnnnnnnnnnnnnnnnnnnnnnnnnnnnnccgttcaatcgccgactttcctgttaccagttctttaactttcttaacttttcggtactgggcaagtatcagtttccattcatgatcttgcgactttgcagagacatatgtttttttttaggtaaacagccacccattcctcgagtctacttcacagttactctgaagagactcgaagagccgacagaaacacatggttgcaacttgcaaagaccaaatcgagtgcccatctagacagacatccaaaatccggacatggcgatttggtgaggggaactttcccagatcccaaatcttaccaagtgaaaagagaatttgaccatagaagcaggaagagccacgtcatttggtgcatgatggtcatccgattgaaaagcagacaaaacgaatcagaaccgtatgatcatgctgatcagtaaaaatatttgtataaaaacccatatattctcacatatttacattgaacaccttacatcttatttcttaatacattacattattgtctcccctatcattatttataactgtactacggagctgagaagaaaactcacatgcctatttatcctaaaataagttcaaatttaatttataggttcgtttatcccattaatttttagcatacatgctattataaatgatgcattacaacgtttcacgtaaaaagccagccacaatcatttccgttacttcttttgaaatgtccaccagacaaacatgtttctttttttttagaactacaaatatgtttcttaaaacttcttttaaaatttattatcagtagcacattataggatggttaaaatcgcgcgaatgtgtgacttcataagctagtaaattggataaaacctaaatattatgtggctcaaccaactcctgtggtcaactacacaccccatcaaaaaaaagatagatagattgactggtaaacaagtgaatgaatgattagatggcctatgggttgagccctacaacagattagcctaccattctcacaatatcggagaaaattaaagagagggtggattctgacacttttcgaggtgacgtgctcgcttccgcgtgtgtccatgtcgccccgcttcctccctgagtctgggatggttgtcggcccagctactgccattcctgcgcttttgccgcgccttctcccgcttttctcgccgtcgcactccattgtgttgccgccctcgtccgccactatcgcccgccgctggcctcgtccgtcgccgtgccaccgccactggcctcgtccgccatggctaccgtcgcactccactaagtcgccatcctcgtccgttaccgccgtcgtcgccctcatccgtcgccgcggcaccgccgctggcctcgtacgtcatggctactgtcgcactccactgagtcgccattctcgtcggtcgtcgccgccgccgccggcctagtccgccatgggcgccgtcgcactccatagggtcaccgccaccctcgtctgccacggctgtcgtcttcgtcgcgctctaccagttcgtcgccctcgtccgccatagttgtcgtcgcctacatccgtcgtggccaccaccgccctagtcccttgccattgccgtcgccctcttccacggtcgctgtgttcctcgtccaccctggtcgcctatgtccgccttgaccgcggcccctatccaccgcggccgctgccggcgcgttcttccgccacagctcatccaccgcgtgcatgcaccgctgccatcgtcctcttccgccgtagctgctgtccaccttcgcagctaccgccgttgttgtccactgcatccaatccatatcggaagagaagaagtaagaggaaggagagaggaagacatggaaagatgatgtgtccataaaagataaaatatttgtggtacagtaatttctattatatagacattaggtaaaacgtttactatagatgatatggctattttttttaagtcaatattattaaccttgctctatggtatagatggccttttggcccgcacggcccaccagccatcgggccggcacggcccgatcggcacttcgtgccgagccgtgccgacccatgggctgcgcctcccgcccaggcacggcccaccagccgtcgggccgtgccgggccggcccgaaggcgggagtggcccatcgtgccttttttatataagtctattttccttccctcctctttggactgtgacatatatatagcgaaaataagtctattttccgtccctcttctttggactgtggcatatatatatatagtgaaaataagtctattttctgtccctcctctttgggctaacatatatatatatagctaaaataagtctattttacgtccctattctttcgaccatgacatataatatgtctatttttagtccctattgtttatgtgtcgggcctagcctgcggcccatcgtgccgtgccggcccaacgtgccggtggagaggcccaggcacggcccggtggccgtgcttgggccgggccaaaacaccgtgccgtcggccgggccatcgggcctcgggcattttggccatctatactctatggtgtgtttcactctcccttgcttcaggggcagcaccacgccgtccgacctgtaccaaaatggagtaggccactgactagtgtggggcgagaaaatctcttgtgtgcccatgaaaactcacataatcccttctataccctcgaattttacccaatcccctgtgtacccctgaaatttcgctttgatcccttccatgcccctcccgttaggtttccttcattttcacgttatgtgtggttccaaatgtctaaaatacccttgtagatggaggagtggcagctagatagaaaaaattgaaaaaaatgtcaactgaacaatatgtgtattttatgagactaaataatgagcgtataacaaatttattgtggcactgaaaaaaatacaatataatgaactttttgtttggaaaaataataggatcaggaaaagctgactgtctgtacagttatcagttttctctatagaagaaattgttcctctgcataagaaattgattatggtaaaataagagcatgaataccatcatacatacaatagagatatccatacagaacacacaatatcatgcacagaacataatctttccatcatccatacataacagttcatatcatgcgcacccacaattccatttccatactcaatagtgcaggaaacaaacaactttccatttcaaacaaaatagtgcaaccaacaaaccaaattagctaggcagtatatcatgagcataatggcataaggtccataacagtgcatcaatacatcatgaggaagcaatccttacaatagcaaaatatgtcaactatgactagaccactttgtacggcatcacaataacaaaatccatcaataaagtctttgtagcacatcgcatttgagtctatcactttactgaaaataaaccgatcatattccaccctagcattttttcgatccccggctagtttgatttccaacaaatatgtagttaaggggtccatcctgtggatgaacacaatagtatgtatctatcaatgtatgtatctatcaaccaaaatgatctccacgcatacaactatgtcaaaattatgacgacggaaagttaagtcacttaccctacggggagccatgaaggaaccgtgctaagcattgaatctgccatgccaagttgatgtgttgc

SEQ ID NO: 65097 - DNA, 755 bp, Oryza sativa
aaacccgacacctgggtcggtgcttgcgaactaaatgaatttccaaaatcgcggaccgaggaacgtaccgggtgtacggtttcccgctcttgcacttaaggaccgtttccttggaatttcattcgaacataagacaagtacgaccacatgggtggaatgggacacccctggctgagtaactagcttatcgggggagccatgatgccaagagacatgtggattcgccggggtggtgtcggggaggacccctgggcttcctggcacagtatggtctgggacataatctggtgttggtctgggatccctctcgttggcatatggtgaacctgtgtcggctttcgaaatgccttgtcatgaaagccttaaggtctctagtcgtggccgttctgcacgggctggatgatccgggttagtaatgtcgtgtgggaaaagtgtaccccctctgcagaggttattaaaacttttcgaacagccgtgcccacggtcatgggcggatgtgaggtgattcctatcgtagtttttgtttgactactgccttgtgaaatttgctgttgtggaatgggtttgatgtttggaaaatctgcggctgatgggatcagccaggcccgggtggccgtttgaaagctgttggccgggtgccaatcttgatcaattcaaaagactgaatcattgcacatactccgaccggacgagacgcactgtctcatccgtgtcgtttgagaagcactcccttagttgtttcagaaaagagttta

SEQ ID NO: 65098 - DNA, 39465 bp, Oryza sativa
gatttaggatgttacttgatttggggatatgaatctcacctgatttgggagaaaataaagagattaatagtaaattaacaatgaaaaaaaaaacaaaagcggatcaaccgggacgtggctctatcatctttagtcccggttggtaacatgaatcttactcccgggaatctgaaccggtctttagtcccggattccttctcccggttcgctacctgggagtaaaggtagttgtgaaccgggagagatgtggggttctccagtagtgatatataagattggcatacgtgaggtgataccttgaagagaatgacactgctagtgttggcaccagtaaaaaaaatggttgcttaattttctggacatagacatacagtagaaatggaaggtattgggacaaccactacaatctaatagaatcgataaagagttaaggcattccttcatgctatgggccctaatatgagctcgacatattcaagttatgagcatggccgacaagtttatagctaggctcgatcgagcttggctcgatcaaaggtgggctgtacttgagctcagcttcgatcctccagccatagctagaggtggattctggcaaagatcctaccaaattgtttttctctagtttcttcaatttctcatagttcttaccatgtatttttcagctaatcatccatcttgtttttctatgtactggtcagtgacttttggatgtggctgtgttgtgctaccttacctcttcctaatgaatgatgggattaatttaacaaagggtaataataataatgtgtttagtgtgcatgtatgatggtgatctttcatgtagactgtatattccagttggtacaagccatctgtttatctatatttgatccacagatggggttttgttctgtttccagagcactggtaggtgtgtaaatcaagtttcatatagatgaaacacatttattttctgtcttaataattatcatcatgagatgtcatcagtttagcctatgtggcatctcatttaataaggttgaaactcttatgaaacttccactcggaatagccatacaggagtgcactaagacaaagaaaatattaataactctcccataccatatttacctcggtaacaaactcgaagcatgtatcatcccactacttccgagtcactaacaaccaagatattacctgttagttgtaaagtgttgtgtaaatgaatacatgcattagggtgtgttcgctggttctggttcccatccagcacagtgagcacggaaaacggagtgatctattagctattttttttaaaaatagattaatttgattttttttaagcaaccttcatataaaacttttttaaaaaaacgcaccatttagtagttcgaaaagcatgcacgtggaaacgagggagagaggttgggaaaaggggcatccgaacactctcttttttttttagataatggaatataatatcccggcctttcctcaaaaagaactacagccaattattacaaagatccactccagaagagagtgtagtttaagacaagttgaacacaccaaacaagagaagagaggacccaaactgagaaaaacaaaacaaaatgtggagctagaaggcctcgtcaaggcctaggactgaagttcgaagccaatgcatagaccaatgacaatatccttgcacgaagaggtttctccaaagtggtgcccccaaggaggatgcgacgtggatcgccgccaccgctcgttcggaaccgaagcaaggtttttacccagagaatatggtagggaaaggaaaggggtatgctaaaacaacgcctccaaggaggggaacgacgccacacggcgtcgccgttgtcagctagccaaatggctcgacaaggctttcgcccgcgattccctgtccaaacccacaccaccaatccgcacaagaaggatcgtcgtcggtcaacaacattgtcccttcagcgattcggccaaagccaccacccacagttgttgccgccgtcgacggcgcgcccgcacccggactcctccttccccgccgccagaccccttccccgcctccacataccgatgccgacgacgacgcaccatcagccggatgatggccttcaaccatcgccgccataggtaccatcgtagacagccgccaccgccactaccacagccaccaacgtcgccagccgccaccgtcagccaccatcgccaccaccaccgccaccgccacggacacccccgtccagccaccaccgtcagccaccaccgtcgctagccagcgccgccagacgccagccgtccagatccggccggggtagcgcggatcggaggtgcagcgcgaaacgcaggtcgccagcatcatggaggaaggcgtcacgggcacggcgttcacagccggagcattgacagctgccaccgtcagccaccatcgccaccgccaccgccaccgccacgaacacccctgtccagccaccaccgtccagccgccaccgtcgctatccagtgccgccagacgccagccatccagatccggccggggtggcacggatcggaggtgcagcgcgaagcgcgggtcgccggcatcatggaggaaggcgtcacgggcacggcattcacagccggagcattgacgagggcgccgcgcctccctcgtggcggcgaggttcttgacaagggccggcgtcgcggcacgcaccgcagtccgccgccattgtcgccaacttcgtcgccaccacattcgccaccatcgccgccgctagccacccccctaccaggtccgcggagcggcgccggcgacgaccgagcgcgtcaccggtcaccccggccaagcggggagaccagatctggcgacgccgtcgcccgtcgctggagccgtggagagccgacaccgtggagcgccccaccgccgcgcccaactccgcgccgtcgccgcgccgtccctgtcgccacgacctcgccgtcccgccaccatcgtcgccacgcccacgccggggcgaggtggagccgaggaggatggccccgccgccgccatcccaacgcgtcgcccggctttgccggcgacgagctccggcggcggcgaagcacggaggagggaggaggaggggcggcggcggcggctagggttttgccccctagggtttctatccctcttcataagaggctcacttgctcattttctccgaacactctcttaatgttcatttactcccatacacaggtgataaaacaaacttaaatttaaggcatgaatactaatatgatgattatttaaaaataccatagaaaattacatgatgatcaattgggaatcagagggagcagaaatatatatatggtccctcatggttttcatttgctcatgggttatccgagtggctcggctgctgatgctcccgtcctgcaggtaaacgctgacctgcagagagagttaattaaggagaactcctacctcatttagcaagttgcttgtcgtcactgctgatccatgctgatgctgacttgtactgcttcgaagccataacaaaaaaaaaagttttatactgacttcacttacaattgatcttcacactaccaaaacaaattcatgtttaatgggaggcattttaaatttttttgtcactattacatttagcacttaattatttgccacccatatattgattatatgtggatccttatttatctaggacacgtgagtttggtagaaaatagttaattgtgtactctgccatcccatatttgaaaaaattatggaaaaattttaaatataagtcatgtataaagtgtagtatttatgttctatcatgtaatataaataaaaatactaatcataaaaaatttaaaataaaacaaatagttaagttgaatatgaaaactcacaactgtatttaaaatgagacgaatcgagttaagggtaagatttataatggaggtgatagtcacctccatttttatccatatcatctatccaaaaaaattaaaagtaacttatataaatatattgcatttaatatactagtcctaaatcctaatacatttgccaccaatcaaccctctcattttctattatcacgtgaagtttgtgtagaggttaccatgaggggtggctactcctctctctcctcttctgacacttttcttctcacactaataattgcccttaaaaattaaatatttctacatgcatgcatagagccatggatttaagggcctgtttggtacagctccaatccctaaatttagctccaggagttaagtctagagtggagttttggagctgcctaaacccagctccacaactctagtatattttgtgagagagctccacccaactccactcccagttttggtggagctgaaactgtttggctgagctctagctccaggaggggtggagctggagttggacctgtaacgctccgcttgtcgtgagacgttaaaaactaattcggcaaaaatcctatatgcgaaaatttcgttctttgtgtgcgagtctaagtcgtgccgcggaatctcaattcaaatcctgttgttccctctcgtcgtcatcaaaaatcctccacctcaactttcctcttccaattcaagtctccgaaatcaaattccgaaagtcaatcccttcctttgaatcctctccaaataattgttcccactcccgaaagtatcaactcccctcaaatcttttccttgactccacccaatactcccgagaacaaatatccaagtttccgttttgaatctcttccttgatttctccttgagtcttccttgattccaccctgaaccctcgagttcgaatatcgaatttgaatccaaatccaaacttcaattctcaacaaaccagccttctctgtgaaagtctaaatcgccttcctcaagttttgtgggccgattttgtccccctcggcccatctctctctctcagccatcccctcccttctccgcacgtgcgccgcacacgcgtgtgctgagctgacgccgagccgagttctctctctctctctctcgttctctcgatctctctccccgtttcactccctcccagcgccgattcccgcctctgcctttgaaatcgcgccgccttcgcccttcccgcgcgctcgcgcgcgcgcgccatgccgcccggttgccgccgcgtcagccctgccgcgcctgcgccgcgcagccgcccgaccccgctcgcctttttgcagtcgtcgccgctgtcatcgcccggtcccgatgcccccatgctgcatgcttccaaaacacagagctagagctcgcgctctctccctcctcctttctcccaaaatggcatgggcagagctccctttctctccccatttcttctttttccatgaccggcgccattgtcacctccaccgccgttgcagcagctcgccgcccccaccttgaccgctccacgctgccagcccgcgctcgtggttcgatttccaccgctcgatccaccgccttcgtcgccccttgcatcctcgccgtccgccgctcttcggtcgcctgtgaccaccagccgagctcccttgaccgccaatgtcggttccctctcccaaaccgacttcacgtgcctataaaactgcagccgagcccctcctctcaaccctacccacttcactctccacattgccgcgccactatcgcccctgccctgcagtcgccctctccgtccatcgccgaagcaccagggagaccggtgcgtgcgaaggacacgagaaggggactccgggcacccttctccttccccttccccggcccgaggccggagagctcaccccgcgccgtcggccgcccatcactgcgcccggctcggtagtgcctcctccgttctccctccccgctctctctcgtgcccttagcttttgagctagcacccgtagcactaccgaacgcgcgtggacaccgccccgagccccactgccgccccgcatggcctcgctgccattgccgtccgctcccggaggccgccgctcgtcgccggccctcctcggtgctcctccgtcccatccggcgccggaaacgcattccttgaacgctggaggtgctccccccgccgagaatcgatccctctcccctcccggcgagtttccctcttcctctcaccggcggtgacctccgccgcgattcatcgtcgtcggcccttcctcttctaatctgtcccgttggctcgctcctcctcgctccgctcgtcgctccggtggtcccccttcctttcgccgcgcctcgccgccgttctgccgatgcgcgtcgccgtccgctgtccatctcggcatcccctcttcttcctcctcccgccggcccgcgtggctgccaggaaggcgccacgtcggcgccagctcggccggaccgggtcaagctgaccccggtcagccgctccctccgtctcccgctcgcgcgcgtggtccaccgcgagccgtgaggctgcgcgtgggcccgacgcgtctcggtccatccggcgcaccgctcgtgcaccatccccaccgaaccctagcgccgccctcgcgtgcgcccatcccaccgtgggccgtgtcaccgacaagcgggccccacccgggacccgtgaggtgctcccggtccaccggaccgctccctctctcttccgcgcaccgtaatgggccgccttccccgcgcccgcgccggcccaaatggctcggtcgagcctccttcaaacctcgggccacgcccttgccgcccgagaaagtctaatatacatccctcgtccatttccttttccataaatcaattccttattattccaaaattgcataaatcaattcctttggtcccgcacgtaagtgactgtcaataatattctggagaatattatttctataaattccataaaccatttctcctattccagaaattccatttaagcttccgaaattcatatcttctcaaccgttcgtccgatcgcccccgttcaacctccagtgatttcgtaaaattgagatctatctaatggcactattaattagtctaattaggatctttcttttagtcttttgtttaggtttttgattgtttgcgtatagttgcggttaccggatttttcgtcgatcgtggttttctcgaagattcgtgaagctccctgaagaccttgagcaaggcaagtcaccctttgatcaattgctcctataattggaaaatcattattattttgtttgtaacttgcattattagaatcacacacttaatttgcttggcctcggtttgcgtgccaaaccgacggacctacccagtagtcgaactaattcctgtaggctgtactaccctgactccttgtcgctccacctttgtggtacttcggtatccgtgctctctaagcgcgtataccaaatatcccacatacaccgttgattgtcgaaaaattgagaaatgggtttgagaagacttgaaaacccgacctgaggtgtcggtgtgtttaaaaataaaatgaattgtgaaaactcgcgatgcggcggttgtgcctgtgtggcactgtcccgtattcgcatataaggaccgattcctgtgggaaactcatcgagcataatcaaagtgcaaccacaaggtggaatgggacacactggctaagtaagtagtcggttcagggaaacctcgcatgccaatagttgggaacgccggggcggggtcggttggagccaaaccgggttcctggtaagaaggaagagtagcttgctgaattatcgatcgagtggttggagtttgatttgtgaaaactaaaatggcctatatttatgtgaggatttgatccttctatgtggcatgaggtaaccctgggtcggcttgggaaaggctttgtcgcgaatctctgacactggccagtgtctggagtaagttcgtgtcttgtgggtgaagtgtacccctttgcagaggttaactaactattcgaacagccgtgtccacggttatgggcggatgtgaggtggttcccgttgtgtagatttgttggcctgtgctttgtgaaaatttgttgtggtgtgggaatcgtaaccagaatcagcctatgtggcagatggaggacctgagtggtcagaaacgaatctgtgtgattcgggatgtctgcgggcatcatagactagacttcccgagtggaagcggattgttgtgctggtgggcagctggactctgggagtccgagaaaatgaaaaaggctctgagagccggttaatcaagtgaagtggctctgggagccgagaagtaatgatctgaccccaggaggtcggtacattaccatttgagttgttgaaaagcatctcttaaagttgaatcgagacgcaagtctcttttcgacccaaagttaaaaagaaataaatcacttagtgattccaaaatgctttcaaacaaaagatttgcaacacaatcttgcctctcttccaagcttgcattaaacaactaagttctcttgacttgctgagtacgaaagtactcatccttgctctatataaatatatataattcctgtgcctggaagtgaagatgaagtgaagattagggtttcgtcctgattctcagccgtcgcctgtggtgttaggtgttagtttgttggttccgctgctgctgctgttgttggtgtttcctcgtccgtgtcatcggttgcattcttgggctgttctgagctgcaacctaagttaagataaataagtcatctatttattttaaggattgcaatgattcatatttgtcaccgtgggtaccagcgctatgtcttaggactggtactgagatcacggtttcgtaggaagcggtccgcgccgtgtggaccgcttcctacgacacgctcctgtcagctgccgttgtacggcggtaccggattggggtgtgacaggagctgtgccaaacagaccctaagtgtgagagattttctggagattagttaaatcacttggtccttttttaccgcatgcatgcgcgcgtgtttctggagattagttaaatcatttggattcaatgccatgactaattagcacaagaagagttataaatcccctcacactttttattggtcatgtgtgcggcatgcccggcaaccgaaccggcactgctatcaacgaatcagcaattgcttgatttatctctctcgtggtaaagagtatagtagaaatatagatcacctctcatacctatcaattatatcatccttgcacctaataataactagaacctctttataagagtgaaaacttgacaaccaaaaacctctatagaatttagaatgaagctctcaaattcataataggttatatctttataatttgctgatgagaatttgtttaattccgtaacaaaataaggccctgtttagttacatgggtgaaacgttttgacgtgttacattggatatacggacacacatttgaagtattaaacatagactaataacaaaacaaattacagattacgcctataaactacaagacgaatttattaagcttaattaattcatcataagcaattagttactgtagaaccataatgtcagctcatggaacaattaggcttaaaagatttatctcacattttacacgcaatctgtataattagtttttttctatatttaatacttccatgcatgtgtccaaacattcgatgtgatagtgtgaaaagtttttacgtgagaactaaacaaggcctatatgcattttgctagaaaataaataaaaaaaataataaaaatgttggatttccacgtcagccacgaaaaaatcactcgccccttaaacttcttccttggatgccgttactaatccatcctcatttctctcgcaaatctccatcgtcggcggcggcgcggcggtcgaggtcgacgtcacgagagatggcggcggcggcggctggggtcacgtgccacctctgccgcgaacaccagatggagatggaatgctgccgcgggggcctgctgccgcgcggctccaccaccgcgctccccgacgccgccggcggtgaggcggaggaggaggaggaagaccgcctcagcgccctccccgacgacatcctcctcccgatcctcgcggccctccgctgcgcccgcgccgccgcgcacacctccgtcctcgcgcgccggtggcgcggcctctgggcccgcctccccgtcctcacgttccaccgcgtcgcccccgccccgctccacgccgcgctcgccacggtcgccgccgccggcggcgccgcccccgcgctcctcgacatcgacctcttcagccaccacgacctcgacccggcctcgctgctcgcggccgccgcggcggtggcgccgggagagctcgtcgtgaacgccagctggtccgcgcgaagcaccgagctgccatgcttcgaccgcaccgcctcgatcaagatcgacgtccacttcgccggcttcacgctgccgcccgccggagtcttcccggcgctcgaaaccctccacctcgagaactgcttcgtcgacctcggcgacatgatcccgcgctgcccgcgcctccgcaagctctccatcccgttctggaacgccaccgcggtcaccgtccgctcgccgtcgctcgaggagatggaggtgtatgccaatttcaagatcaccatcgacatcgtcgcgcccgcgctgaagaggctgtatctggatgcacgtcgcgggatcaacacggatgccggcggatttacgctctcggcgccatcggtggaggatctgacatggaactgcgagtgccaggccgtgagcgatagttttggtgtgagatggcgcatgtggagcttgagctttagctcatcatgtcttgacccccatgggattatgcagatgcagcagatggacaacaacggcgaagccgaaaccgcgcattcgctgtcattgtcgtcgtcgtcgcagcgacgccctcgtggtggcgtcctgtctctgaacttagagaccaatgtactatgtctcctctcgtgtagtactcctcaacatcttgaactcgtattgtcatattgattttcaaatcgtgctcaatctgttgtgtaggtcatgacaggtgattcaaccaggagctttgagcaagagatattccggtttcaagttacggacaacttttctgttttggagctggatctgaaggcacaagggcatgtctatggggcaatcgtcctgcacctacttggcatttgtacctctacacaaaggcttagggtgttgctagatgaatttctggtaattatttcttctgttaaatattgtattattgtctagtagatctcaaatttctatgtcaaaatactaggttgattcagtaggaagcatcactgactggccactgtatttcaattttcttttagtcgcaggactcatgctttgtaagttgccgttgcgaccagcccaataactggagaaatcaaagtatctccttgactgatcttaaagaagtagaaatcagaggcttcagaggacaaaaccatgaagttgatttgttgaaggtgctcctgagatgcgcaaccgtgctcgaaagagtgaccgtcagattttccaggaaggttacaccgagtgattgtcgatgcagggaactcagtggcattttagaggcctatccttctgtgaaatgcagtgtttattatctccaatctggcaagcaggttttcatatgcaggcagcaataggatgctagctcttggatgtaacagtggtattcgctttagcacaatattgtccaaactagaagttccaatttatcaggtaaactttgtcatgtttggtttatttttgaatggatattgctagtttgtcaatgagtgatggtgggagttatgtgcctattaccttaaatgatctgtgagtgcatatgctacacctatgttattggtgttagagtaatcaaataggtggtggtgtttccaattctccttccctaattgtgctacgaagcacatgctttagccgtcagatgcacttcgatgtgaaatagttattccacggataaactaaatggttaattcatccgaacttaggcaaggcatgatgcattgtgtgcatgtgtaccttgcagtgatacctgtacatgttttttttccatgtaataattttaaaaaaaccagcattagggatatttgtttcctaaaaaaaatttccaacatgagcaatcacttttcctataacctagttgttgttatgggcatatgaattgagaccagaattccaaaaggccggtgataaaaggccaaaaggctaaccattcaaacgtaaaactttattaatttttcactggaaactagtttttctagagaaagcggtattaatttgaagcctaaacttttactagaaaccagtttgtccagataaatataatttgttgggcaccatatattggttcaaacttttgtcatatatatatataatgaaagaaaattgaataaggaatggctcgtttagttcagctgtatcatttttctgcaactagtatacattcaattccacatgctcagactagatagcctcttattcatgaacttataattacatatatttttttattatatgtgctactagttcctcagtagataaaacgggatcaatgagaagagttcagattacggcaaccgataacttatctgtgagatgcatatataccaatgaaagacttataaggcacgtagcatatatagctacatatatatacaccacacatcggaatgggagtcatcgtgatcggaaggtgaactctgtcatttcgccgaccagtggcgaatctagaataaaaatagaggggtgctatgtataaaacttagataaaattaattaagacagctaaatatacatccatgacgtattttgctaatcaaatcgtaaaattaataaataaatagaaagagggtggcatcatataaaataaaataactctagctcgtcgtttattatttggaaaagtacttgttaaccttgcttctccactttaatgtgcagttatatccactaaattctggcaaacaaaattaatttgataggaatgatgcgcccatacactgaaagatttccaaacctaaattaccaataaagagtctcacgtttacatactagtacaacagatggattaatgtccagtccagctagctagaatatgtcgtagaggccctgacaataaagatataatgaggcagtagacagcaacgtttttattcctgaacctgactgtgaaatgcacaaccgtggagctggggctcgagccccaaaaagccccaacggtggatacgccaatgtcgccaactatctatgattcctgattggttatgtatctacaatcaacatccaggtttttatatataccaatgcgataaaaacctatctggattcactgtaacacacaaccacctcatcctatatgttttgaacaatgcaagcgttggaggcaattggagggctataggaaccagtggaaggacatcagggctagccggcctgtctctcggatatatcggaaggcaaaatgaattattgtcggagtgataatatatgacactaaaacagtactggaaatagatgctgccgcgactgcatgttgatgaagggaagaatgccgatgttgtgtgagcaccacatcaagacttcgaaaaccgtaggattgaattgttcttcaacactgtaacaagcgtcttttcaaggccattctatgacataatgcttaccatgcatggacgccaatttcagttcttttttgctagacataatactaatccctccagtattttaacgtataacttattgatttttcatataacgtttgactattaaccttattttaaaattttagtacaaatatgtaaaagtataacttaagattatacttttttataactagaaaaaatggccatgcgttgcaacaggtgaaggttatttcaatcttattattattatacggtttaattaatgtggaattcactgtgggaattcgattggatatattttttttcataaaatcatgagttgcaattaggagtccgatcatctcaagttagcatacaaggtttgttaaagatatttcttatacagcttattctgtatttccaaaaacgaacgaatttaaagtccgactcaaatacgtatatgtttccaaaagcgaacgatcttaaaaactatgacgtaccgaagtactggcaaaaacactttaaatttttataatagtagagataaaacaagtcacagcaaaataaataatatttatattttttaataagacgaaggttaaacatcacgtcaaaagttacggcgctataataaatttttttacaagagtaaagggcatggacggtccttaaacctatagggttgtgtcatataggtctctaatcactcagaatacagatttaggtcccagaacttgcaaagtgtgtgtcatctacgtcacatatcaccacaagcccctctaggatccggcggacgttgggttgggcgggtgccggatgtctactgtgcggcggtaagggagtggggccggcgacgtggggacatttcagcgtggccggaacagggattgagcggaaatggcgtcgtcggcgaggcgtgcggcgctgaacatgtcgcacggcgacgcacacaggggagcaggggagagacgcggagccatggctggcacgacaaggctcggcagctagagggtttgggcgcggctcggcgagaaacagcggcgtcgcggcgggtgccctacagtcttacaggccagggaggactttggcagaatccggcgatggaggccggcgatgatgccctctccggccattagagacggccatatgctagagctataagtttgttcagaatatttggcccagtgagagacatcatgaacacgcactactacagaaaagggattaagtgctggttggaaaacccccttcggtgctggttttcttaaccgacacaagggatgtgtcactgattgaaaataaaaaaagtgccggttagaaccagcactttttaggttcgatgaataaaaaaaagatgcctcgatgcgtcatttcgatcgagccgacgcatcgagccgtgcagttcgtcctcccgcatccacaagaatttttttggcaacattcatcacacaaagaaatttggcaatattcatctctctctccgcccgtgagccacgtcactcttgccgccgtcgggctgtcccgactctcctctcgctagatctagcggaggggagggcgtcacggccacctcccctctgggcgccgggccgccgcgggctcccctccagccaccgggcaggcatagtcgcgggctccacttcagctccccaccaccgcctcccctcccgccggatctagcagtggggagggcgcggtcactgctgccgcctccgccggcaacgcgtgggagagaagggagggagggagagagaagagagcgagacgagagagaaggaagggagagaaacagagaagagagcgagatgggagcgagacgatgagagcgagacaacgagcgaaccttatccgatgccgcgtctcgtcatggtggggcccaccggtcggctctttcgatgccggctcggctcgatttatataggcacttataagatattataggtgtcagttttttaattaaccggcacctataatatattaaaagtgtcggttttttaaaaaactgacacaaaagtataataggtgttggtttttatttagaaccgacgcctataattacttaaaggttccggttttttgtgatttcaacctgtgaaggtgggaaaaggtttataggtgccggttttagtggtgccactggtcgtgatgatacgtcgacacctatttgatattttgtagtagtgacggccttacatcatttcagctaatccaacgctgatcgtgcaatgattaagaaataacattgatcgtgcagggcaaaccaaacaaattaaggaacccataccatatattaaaaacatactttgtactttaactagacgcctagacatagagcatcgactgcattttctcccaacaactagcaggcacatgatttgtgagtgcccatattaaatataataactagtttccattgcattcttcttgtaaccacttgcaactatatactgttccagcatacccaaattaaaaagacatgtaagttacgaatttataagggtgtgtacattcgtacaaccatttttatgggttgcttcctctgcagataaaaggagagcagaaagagaaacaaaagatgagaacatggcagccgagaacttctccacgagatctacacatacatgacgggaccagtgcttcagtggtgtatgtgtattgcagcctaaatacatggaattgggaggcattaggaagccgagaagtgcatctcttatttttcaaccttccaaattcaaatgactagcaggctagcagcattttcgatgttctgatgctgcaatggaacgtccccggtttaattgcaaggctgcctcttgctatgtagtctaaacaacggagcaaacacagcacaagggctcggagaatttaactatttgccacttttaggtttggcacatatctaaatgcccctcttatgttcacatttaataatttgccactggagagaggtgattttttaactatttatctctctctagtggcaaattattaagtgcgaatctaagagagacatttggataattgcctaacctaaaagtggcaaatagttaaattcccataggctcctcctagcagatggaagaaaattggttctatcagcacaagccaaaaaaagaagtcacggcgtgtgcatctgcactggttgaagttgcagtaattgcgtgctcgctaaatgctgagacgaagaccctgtttaggataacttgagagtgagattttactggcgataatctagaatctcatgttgcttctcattttattacaattattttcttgaccaattctgtaattatagcaaaagaaaatggaatgaacaaatggttcaatatatttcaggggtgctactcaggccactacaactaatagactacatgccctttcacgggaagtcttccatatagttgtaccatataattagtagataaaataagaccagaacatgtaaacagaactgacaacttgtacgcggaaaatatacatatctatgataggtttagtgcttcacaagctagtttgtaatgtagctgtacgcctacacatataggattgggaggcatcctgaatcaaatatctcaattctagtcggccaaccatcgaaacttcaagaagcatagacattgaatttgcaaagtaatgatgtaatcgaacagctttggtttcatggtaattaacacaacggcctcatccgttgtgttccaaacaagcaagctagcagacatggttaaaaatagatgggagctctacaggtagcctattttccgagctagattgtggtttcttgttctcaatgtcaatggaaacgagcattcagaggttcaagccctttaattggttcaaaaaaagttaacgtgttctaaaatcaatggtagattgacatcctcattagagcaggtaacataagcaaacaaacacacgtattagatctatcataccaatgcttcaagatgccaaccaatgcttcagtaggatttctcgatccgtcataccagggttgtcataccaatgtgtgtgagggaagtattcggatgtgggtgcaaattgtgtgcatgtgtacgcgtttgttttccgtgtaataaaaacaagaaacaagcattagggatacttttttctaaacaatttttctagattagcaatcacttttcctacaacatagcatatgaattggaacctgaattcccaaaagcaggtggtgacaggccaaaaggctaagcattcaattcaaacctaatactttattaaaatctcactggaaattaaactagtttttctatactagataaaatggtatttggagtataattttttctaatagaaaccaggttttctagataaaacggtatttggagccctggttgagatgacgtttctatcttggtggtagccacgagtttgcttcaatttatttcaaaggaacttggcactacgaaattcagaatatcaagactagcagataagtgaaaacattgttgctttggtgggaaaagcacaagtgaaatatatttagttaggcaccatattgtcatgcattaagaaataagagccatttgcgctcaaactttatagccatagtgaaaacaaaattgaataaggaattgttttcatttgtttaaaacacaaaaaaattgtcgtggatggaaatttcgcccctcttggaacatacaaaatactacgaaggctccctctacgcagcctaggacgtgcctacacgtcacgtgtaagacttaaggcagggtggctagggtttctatttttttaacgcagtcatgaaaatccgctcctatggggagtcaaactaaggccacggggatgctgctatactaggcactataatcactaggctacatgtcaatgcgctctcctctactttagcatactatatcagttttttctaactacatactagcacatgctatgtcatatcattgcattaacagaacaacaagaaagtacacaaactcgcaccccaccaccaggacggttgcacggcatatcatttaagaactttttttccattatgtgttctacttcctcaactgataaaacaagagcaataagaagcgagttcaaattatgctgatcgagaacttttgagatgtatacacctatgaaagacgcaatagttagcaggcatgtagcgtagctacatctacatataagaatgagaggcatcatggtctaaaggaaggtattgtgatttagccagccgtcatagcttggacatgtagcgacatccaggtttccaatggggtagaaacctaggattcaatataacacaacttcctgatcactctggatgtattgaacatggaagcactatgttggagaacttgagattgagattctgctggtgagaccctatgttggagaacttgagattgagattctgctggtgagaataatctagaatcttaagttgcttctcattttattataattagtttttttagaccaattttgtaattatagctaaagaaaatggaatgacaactggttcaatatacttcagctggtcgatcttaagcattttcgtctcccacatgctttcccatcatgtccgaatcgaatatcatcaaaattatgaattttctacttttaggcagataaaagaagagcacagcgagggatgcaaagaacaaaacatgggatcccggctacaacttctccatgtaatccacgtaccaaagtggtttatgctgtggaaaaaatgcatcatacggacgtcggattgcgaggcatcaagaagcaatggagcactcagtgagatgtctaatcatcatgaattgaaaaagtatccacattgagtttatagtatcctggtgctgttagacatccatatgcatggtttctgtataacacagctgcccccctttgtgatgttttcaacaagacatggcacgcatcatggagggcagtgacgagcagtggaacaacaacaatactagctagactactccttgactaacttggtaaccgagtgactgggattgatgttgaacactgaacagtggttttgatatcagagagttatgagttttgagagctgtgtgctttgtgctatgtgtttgtgttgactcccctcaccatcgttgttgttaggctagctatctattacactccttttttcataataaaatatattccgtagtaggcatttcttcatgcaatatgaatgcaagctgactttgattatctgtatatgtgaactcagaaattaatgcgaactaaatagtacttaattgtaaccctcttgtatcttttatttttctcggtccttgtatacacatgatgttatttattactccttctctcccagaatataaagagttttagagttgggcacggttattaagaaaatagatagaattaaatacaatggagtcgtaattgtttaagaagtggaggtaggtggaaaaagtgaatggtggagggttgggattggttgagaagtgaatattggtagagaagctgttatattttgggacggagggagtacgtgtctatggacatttgctgcatctcttattcttaactttatttaaacctgaaagcttgtatttctttcccttgtctttcatccacacctcagcaaaaactctatccaatagttctttgaaacccatttaatttactgcccttggtatatatatgcacatggaaaccaagtatatatgtttcatcctagattctactaaaatacacgacacatatatcttggacacaaacaagcaagaatttaaatgctaactgaataacatcatatatatgcatggtgagcatctaccaacacatgtccatgccatccatgaacactcctttaggattggaagacatcaggaataccataggcacaatcgtatagcttagggcaagttatcctcagaagttttgcagctcacaaacaggggcagatccatggttgaggccttggtgggccgcaagacgaaagcgcagctgttggaggttggaacccaaggatccccacgtcattaccgtagcagcactttagttacatgctacacacccaccagatcaaggctatagacgaattgagcacgctagtattccgaggattttccacaccttgtaaaatccatgaatttacctcaatcgggactacaggaatggaagttgtcgggaataagaggactggactcaagcattccagttgctggtctcccatcgtctatcccgcttccatctcacattcaggttcatgttctcctcagaatcaaacctttaatctctcctctctctgcaactcggcaacatggtggagttggcggtgggcagtggcgaccagtgaagagtactttggctagtaccctccaggatcgatctagtcaggaactcaggatagatccagatccatatcagctaactattcatctgaattttttttcaaggctgcaagtttgtcaaagtatcaagaacatgaattttggtaagaagctacttcgaattggtgtcataaatgaataattagcagtacaaatcgagaactatatgcactcaaggaagaaagccattctgaattttggcaagaactatatgtattcaagaaagaaaaccattctgaattttgacaagaagaatgtggttaatgctgccaatttgttgtatttatgatgttggatgtattgaagattccttggtgtattatctctactacttaaaaaatctggattggtgatggtgaagctaaaacagacacgcgatccaaagtagaaacgtacgtcgacacgtttggagcgaaaaaaaaaagtacacgctcctccgcagcggaaaaaaaccccaagccccgcgacccgcgccccgccccgcgcgtcccgcgtcctaggcgcccctcgaccgcgccgcctcctcaccgccctcgaccacagtcgccccgcgcgccctcgaccgccgccgcctcctcgccgccccgcgccgcctcctctctgccctcaaccgccgacgccccgcgccgcctcctcgccgcacccaactccggttgcgccgtagtgtccaccgccgccgcccgccgcatcgtcgtcctccccatcacccgccaccaacgcctactccgtccacccgccaccgacaccgaatcctccgcccacccgcaaccgccgccaacgcccccgccgctgagtcagctccagatccgctgtcgggctgactcctcctcctcctccctgtcgcggacgccgccgccgccgatgcctactactccgctccgagccccatctagcgaacagagcagggatgggaggggcgccgtcgtcctactgcatccttggtgagcatccacatcctttttctcattcatctctctatgtcccacccatttttgcctggaattttattgcgttaaccatagcttctcttcgagatctggatgatgctcttctcttagttagtttaattgtttgctccccccccagtccaagttggatctgcccctgctatggataaataagattaatctgaatcacaggcccttcaatcccttctcatttgtaatcctaagcaaattaataagctacatagatgttgttcttgtaatttatttggagtaatcagtttaattgaatcacagtagcattgtgtttccccaatttggttttgtcactttcaaaaaagaaaaagacatttatgtttcacatttggtactctagcaaatttattcagttatctacccaatttattcaattgttctgctgtgtactgtagtctagccaatttattcaactattctgctttggttccgctcgttgtccatctgctcatagtcgtccactcactggtgtttccctggtatgtctctgaaagactgaagtggcatattttcttttgacgtaggacatacgaaccgagctcttgcaggccgcacaggttatcacaatgatatgtgcatgggatatgtttaattactcaataccttgtattttttttcttctggatatcgaatcaaacaaaatccgcatgaaaagctgatggagtaatggctgcaatgtgctgcataggaaattatgtttgcatgatcgtagtcttcaatattcaggatacataagagaggatgttatctcaaattagtttcaacaatatactcattattccatccctgtaacagtaatgcatgactccaaaagcttctgaaacttttaaccccatacaactattttcagtttttaataaatgaacaatgattttctgtaagaaacaggaagtaatacttacaccgggtgagctgaaatcatggttgtgtcgtcatgatataacaatccgtggacttgctcgtacagggaatacccgatcgatctagaataggggaatcaatcgatttctgcatcagatgcgctttctttttctcggttagatccgactgccggcgaacaagcctgatagttcctaagattcaagccatgaattttgttactagctaggtgttgcaacagatctcctgacatccttacccatattgcagaagtttttttcatttcagccttggaaatattcaaagtaagaccctgtactactaccacatcaaagatttagttgttcctttgtaatgacattattttttgacagcacgcatactccattcctgattcacttgatattcctaatgattttgattactcaacattatataaagaacttctgattttgattcttaagtttttttttcttatcttaggattcaaatggtatttaattcagaatttggtaaatcacctccaaattcacaatctgatctttgatttatttctttcgacattttccaaatgtacagcaacattgctatctatgacatattccaaatgcacagccatttaggagattcttttagctaattcagcaataaaataaaccatgctgtaaatttgaactggtctgcctctgttcatggggctaaaagttatggatgcttagcccagatgaaatagcatcattgcgctctactgtatcaggattctcccttgagtcgtgtatttgctattttgttttgcttctctcaaacaattgttcctgatgttatgatctgatatatcatagttttaacgtgatacacaggtatagatagtataagctgtcgtatttcatgataaatcaattttcaatgatgaaccttaaccagatttggacatcttcaggtgttggacttgataaagcttggagatcatctcagtgaacgggaggatgctgatctctataggattgggattactggtgaatcacttggaggtattgtatatataatgaattcatgattgcatccttatattagagtaacatatgcccccctgtagagcatataaaataggtgtgatagcattagaagataaggtaattttttcagtaagaaaaaaattaaatcattttttatgtgtctgaaatctaaatttacaactgaatacaagctcttaatgattctctgcacttgagcgtgtccctgaaactgactgaaatctatctattatatactaaaagtccatgaaacttcctataaacgctctcaggccgccacgtggggctcctacaaacgctcctaggccgccacgtggctctgtcaaatctaaccgtcgattttcacttaaattggtggacccgatactttacaccattagattaaatttttcattgaacctccccttccatcgatccccggtttccctcctttttctgatcctattattaagctactctttcaccaaaaaaaaagacatgcgagtacatacgtgagtatagcacgatcagataaacccgaaagaacatactcctatacgtacttaatacatgatcagagaaacaccgaaagaacacatatatatatacttacacgtacatatagaaaaagataaaacatcatactctataactttacataaataccactgtcgattttcatttaaattgggacccaattgatgttttagaacattagattagatgtctaaaagtccattaacttccaaaaatgctcctaattcgtcctacgacatcctacaaacgcttctaagttgccatgtgatgctctaataaattagtgaaatattcttaaaattctaaaataatcatattttcattaaatttggtggacccattatttacaactattagattaattttcaagaaaaaaattcctttcctaaacccgggccaaccaaagcttgtatgtataagttactttttttaaaaaaagcgaatatacgtatgtacgccttatcttcattcaattcatttctccactttttcacctattccttctcctattttcatgccttattagttagataagcaataatatcatgttaaacaattaagcttcttaatcatacaactaatttctgatccgcaaaatctttaaattatttataactaaatttacagttgaagaccatatttcactacaatttagctttgaaaaaaaaagtcattttggtttatatttctggcttttgcgtgccattcaagcaattataaaaaacatataaaataatgataataattaaattaggtctacaatcatgaaaataaaatgaatatactatgagtaatgtttacagaatatgttagttagaaagcaaaacttatgcaacaaaataagcaactataacatctaactcacactactaatatttgatgaacttatgtctttagattattttacatttaaagacccatatccactgtaatattgattttgagaagaaatatgtcactttggggctatattttctgatttttgtgtgccattcgaataattataaaattatagaaagataatgatatatatcttatcaccatatatgacttcggaataattaaactagatctatatggataacagtaaaataaacgaatgctttaaaaaagtactccccattataacattagaataagtcaaaataacattattagattattagattgtagtgttcgtatttttaatatctactacgaatatactggaaaagacaagtaaaaactatagattttaatcgaacaataaatcattttttaatttttagttaaaaaactaatagcaactaaaacactacaacccgggaattattacaattatatgcccacataatctcctcccttcaactctctcttcctctgctcactcatttaattcctttgtctcctaatttttaactaagtaaaaaaaagatcaataattagaaagccaaataattataattctaaagttaaatcataattttaacttattcgaatttttttatttataattaaatagataatttaagatccatgttacccatatttcaatctataaagatgaaaattcgtcatttaagcatagacaccgttcctttgcatagtaaccaaatagaaaaaacacaaaccataacacaaaatgaaaacaagtactatattattgtaaatcattgtacatcctttgagcacacttaaggtgtcacgtgttatgtcttaaaaataaaactttacaaattggaagaaaaatcatctgaccatcagtttccacttaaataggtagatccattattttaacccaatagatatacatttaagaaaatcttaagccgcaatgtgttatgtcttaaaaattagaaaaaataacaaaaaatgtgagaaaaaaaatatatcaacggtttcacttaaatcatttagataaaatagaaaaatccacccctccacttcgccctccccccaaacatacgcacaacacggcactactcgtcccatcccttctgaccttctccactctatcccttcctgtttatatagccaaaaataataaaaatattaaaaatgcataaatttcaagctcatctgatttctaatctaaatattattgtatttataattagaacaatgatttaaagatccataaagactatattttgaactgtataaaatataaaataaagcaggtaatagaaaatgtcaatagggactaaattaaactatttagagaaaacatgataagttcataaaaatattggttcttacatttcactaaaattggaccaaccattgcatgttccattttcgtaacaattttaaaatgcttagacattaatggccttacatctatcctatatcatagcattatgagtttctccacatattattacacatataaaccacactaaggttcacagtatatagttctttgaaaagttatatttgttactattaaatttaaaattttggattcatgttaactaggtatattcttttaaaaaagatagtatagatcacaaggaagcgaggtatatgacatgtcttaattaatttatatataagtatgtaacaacttgcatcaacttaaacctactataaggagaactacttgatggtacaaataaaacatatttattaacaatatagttctttagaatttgtttaaaaaaaggcaaataaacattctattaaaaaaggacaaaacaccttacttctaatttatgattgatttgtcaggcacgttttccaaaaaaactaaatcgaacttccttctatatattaaagagatcatagataattatttatacagatgtatcaaatatgatatattttaaaaccaaacaaatatcttggaaaaattatcaaagcaaaatgccgaaaaacagcggaggcctcacctgatgtgtcttattcaaataaaaaagtacgtttaaacatgggaggtgtcaaccaattgatattctgtttatatatatatatatatatatatatatatatatatatatatatatcaaacacaatgtacaaatcaggttggaaatttcggagtaaaatttccaaatttcagaaatttcgatcatttcggacccctcagatatgatattatttcggccgaattttttcattaattttgataatatttgtccaaattcaactaaattttgttcaaatttttggaaattttataccaaaattttggaaatttcggtatttcagtgatgcccgatcaaatcggctaaaccgaaaagtttaaccctgtgtacaatacatccccgcgtgaatgcgcgggctatctttctactttatataaagaatatcgaggacaaatctatcaggatacacaatgtgatcgttctatttgaagatttgttctatttgcagaaccctacctctatatctccaaaatatgagaactgcattattgtagatataatttagtaatgatctgacataaatctagaggaaaaacaaaaacaatttggatttttctctttgtctttgacagattgcttttgtgcatttaaaaagataagggtttgtttaactaatttctttttgctacagctttcagtatagtttattaaatctgatgtgcttctaattaatcttatacaacatatacaaaatgcttctaaagaaatcttctaattaatcctccaccaccattcagtccgccgccccgtacgctggactatatagttattattaattgctattatctttaagaggcgcttttctttccctttgtcagataatcaagaactatcatgatcttttgtgatcaaaagcccatagtccactactatgttttactacttccagattaatggagtggtattgtggtttctcagccatggcaatgtgggtatgtaaacagttctcacgtgagcagtacattttctacctcattttgtgcatatgttttatcaaagaagtaagatacacaatatttcgctagccctgtggttggtttcagaataatgttttctctgaagtgaaaattagattacaattggtctatataccttaacataattacattaatatgtcaaaaataatcgaggtatttgctatagtttatttggagttcatatcaatatcaaaacaaaaatgtactctttagttcttcatatttgatatgtacatgcttctggaggatggagtattggagtgttaattagatatggtgtcccgcattaaccacattccgtgttgaatgcctttcatggtttgaataaagtgaaattatatactactgcacaatttctgcagttgcgtgcgtacaaacaaatctttagatttctaaaattggcatggatgcttatgacagcttttggctttgttgtcgtttgcagcgagcgtcgtcgtcgtcaggtcctccactgctgttcagtccgccgccacctacgccggtcctctcgcttccaggtgacgaactctggttgatggcatcgcactgctggtaccagggtaattgctggcgcaaccgcatgccaaacttacctgctgccactcccatgaatttactaattagcgttttcttagttttcatttgttggaatgatggatcgacgaattgatgatatgctccctccgttctaaatacagggatttctcaaaagattttattttagttactaattcagttatcaatttttgaattttgaattgcttaaattcctttcctgagcatctgattggctctggaataattgaagtgatgggaatcagtgcagatgcttctattgtggtacaaagtgtgaattcttatattttggaatggagggagcatatcatatatctgtataatttaagaattccttttttgttcgaaacctgaagttggacaatcaacttttgctttggaatttctggttctattcggataccaatctcttcgtcctcactccaaaatggaagtgattttcattatttacatgattacatctcatttcttaatatttatatgcaaaatcagaagagtgagattattcccttatagcttgtctggtgacaccctcgatttgtttctagggtctttgttcaattctaattctaacatttttaaggacggattggtactgttttgcagcatcttggcttagatttatttatgtgatgttctacatattttgctctgcgcaatagtgatctggttggagtacatacatatattaaataaataagtgctctcaattttgtttccgtagatgtgagtaagcagtttttttttttcatatgtttcagtgattcattttgctgccttcaattgtgaaatgagaaatacctgtaagtgaaggcctaagctcaaggaataatttgttctttttgaaaacaaaaaggttagcgttctaattctttccaattttttaattgacaacatgttgaaccattcatcctttctgttctctatatgatgtatttcaccttcgtaaacattttacagctcataggtagaatgttcaccaccaggcaagtcaaggagcgaagtatggggacagtgtgtgctcggaagatctttgccagcttgtgttttgacttctgaaggcatgcacagatgtgaagatatgaacttctaggggagctttataaaccgagaatagttaaggcaatacttgatttactttggactgcaaattacttgatcggataatcaatatgtggcgagctttacacagattggctttgatgaatcattaaagggctatcggcggggtgaatatctagctttgaacatgatttgttttgattcctgttgcaacgcacgggcacacaactagtaagttgtaaattcatcttgcaagcagctgggagaaatgttttgaacaatgaatggaatgcaaaatctttctaatacctgtaaactgaatgaaatggcttatgaataactgaattcctgtaaacgcaatggcttctagatcccagtagtattcagagtctcagacaagaacatgatgtgagagtaatgtcagctttgcccaaggatgcgaagaactcacggagcagcaaactcaagcgatgacacacacgcacgagcaacaaattgtagtggacacacacaatagatctctggagatgaacacacagaagtgcacacacacacatagttgttaaattcagaccggtgatcgaaacagtgagtctacctgttcaaaggctccctggtccaaccgcttgttcaccggtttaaccgtcggttcaataaataactacattacattctttatgaattttttggttgactcaaaggttaaacatatttgctatacaaccaacgctagctgctttctcagttggtacagagcacgttggggcaaactgaagtcagggaatcgaacatttttgctcaaaaagtatttggctcaaattttaaagatatagcaaaataaaattagatgaggtttggtcttgtatttcaacttcttgtattttatatttctcccaactccgtggatcccgcatgcttcaattacaacatgtacaaatggaatggcattaaagttagagaaaattcaagaaatgccattaacaaccgcacaattatgatatctacaaatacgatttcatggagttccataaaatgtcatcgtacaagcgactgattctgttaagtgctatatgatgaataatatatttaacggtgtgggatacacggaaccctagataatggtgatgatatttcaaggataaatcgcttgcttgatatggaactcgcactcgcccataatatttcttggatttgaatgtttatcgatggtattttttggattttctatgctttataagggtgtgcagtagtgaattattttttccttgtattttcttccccttcagtcgaaagagtagcagagagagaagcaagatgtatacaagcataagggaacccacaacctctccatgaaatctacataccaatgagaactttagttcgcttcccaagcatgtggtttagcgacatacgcaggattgtgaggcatcgtgaatcacaggagcacacatcgagttggctagcaatcaagacctgaggacgtatccacattgagcttgcagagtccgatcgatgctataaagccacatgtttgcactgtaacacaactgcctgtctgcctcttgctccaaattttcgacaagccagcacacattgaccagtttgtaaccaagctagagatgcaaatggttccggctgccatagctaatgaaaaatcagggttagctgagcagtgagagtcgcgagactatacatataacttatcaaatggattcatagaaaaatcaagtgtgagaagaactttaacaaagccattcaaagcctccagttaattaaacatccttgttttggtcccaattgattttcttgctatcgacagctttctgtagatgacccatgcgggccgcagcgatgtgagcaaactggtcaataaggtttcaagtaattaataaggttcactaaaaataattgagctgttcaataatcaactggacaaaatgacgtatattgatctatattttctgaatttaaactaccatcaaacaattaatttttcatgtgtgtactatttgtgtgtgtgtgtggccctgtatgtattgtcctgaacatattacaagacagtatattaactagccggcaacacgtgcatatgatcagtaaactttgaaattagagctgttgaccgtcaccatagtcgtatcttgccactactaatttgtcttagaatggcgaaaaataaaatgaaatctttatggggacagtgggagctagtacggcataggaagaagataaacgttggccaggtaggcattattagtcgatcgatttcaaagtcaacacggtaggtatctaggcgtaacgacgaggaatgtggttgggtcacacttgacattcggtaacaaaacaaactctgaaacctgacattgggtggctatttggctgaacgaatcgtccgaaatcttgacccttcccaaccatatatatcagccagtcctccaaaattaacctgttggggctcctccaacatgggcctaaaaagttttatttgtatgtaaaatgagaaatgccaaccaatacttaattgttcgcctctttgacagtagataaaacgagacgggagacaaagccaagtaaccggagataaaacttctctatgagatatacgtaccactaagtagtgatttagtgcttcttatgtagcatagccatgttaggattgggaggcatggtgaagcaaatgtgtgcattatgagttggtcaaccatttatttgtgttgaagtatcagctttgaagtcgcaaaccacagatgcaaaaatacctctctggtttacatttttcagcttgctcggatgaattgccaagcaaacaatgtagagggctgggacaagcactgcaacaacaacgttgtgatcaccacgttcctagaccagaaggcacgctgaagctccatacaccacctatcgcatgaattcagaccgttgtcaatcaagaacttccctatatatgaggcctacatacccatacgagagcttctgtgctttatgtacaagttcctgttgtctacacaaataggattgggagacaaaaggaagaaaatgagcatattacgaattggcaaatcatccaagttcatacgagtcatggtgttcaggagcagtcgtgatgcagtgtaacctctctggcttaattaactgcaacacaacagctttgcagtccagaaggcaaaataagtcaccacacgagaaatcatcttgacatggtaacaagtgattgtgcctgctgttctagtgaatggaagagatgggccagccatagttggtgaatcaactatagaactgtggaagcctacctatacatgaataaactacagtaatagcagccttttcaggcatccagaatccttaccaagccatgtccataacctcacttttactgctgaaaattatagtatgataccatttcgatttgcagtgctagctgctatgcaattagtgtaggatcgaatagtaaaaaccaagccaactagaggaggggtgaatgattgtactaccaaaaatcaaaacttttagcggaattcaaagttacccttgaagtcgatggagatctcgacgtagccaatctgaccgttagatcaactccggtctaaccgcagtgccgccactagttggactgcctgcacaccgccggtctgaccaccgtcttgtcactggttggaccacctccctgccgccgatgtgaccgccaactcgcttccggttaaaccgtcaggatctagaaaaacacgtattgatgaaactcttgaaattataacaactttattgcatcaaaatgtgtttacaaagtgcaccaacaacactccttaccaacatctcgactaaactcgaaacactaacttttctcttaactcaactctctctaaatccgatacagggagaccacatgctccctctctatttatacccataacatggttgcccctagccacaaatccaactcatacaaaaagtcctaatcccctaggaaaccttcccgtacaaaaaacaaactccaaactttccagacttgaactccaatccaaatttgacttcgctttccatgcgcacacaacaccatgtgtattccatatggaaaccttcaccaccacgtgcattattctctagcctatccatcccgcatgatatccttgaccatctggacctcaacttcccccaagcctagtcccgatccatcaccggctatactcccatggcttcaagcaacacctgcacatgaacaacaaagaaactccatatccaagtacaagttcgctccaacttgactcatatcagcacacaacagtattacatacgaatagagaccatctagaagtcatatccatgaagcaatctataaatctcacgaaaacaacccgaaaccaactccaacctggaatccgccgatctgaccgtcaagcaactcagtcagaccgctccaacaccactggtctgaccgacggcacctgcccggtctgaccgcccacacagagccgacaaccaaaaacactattcaccatattttcacaaaacactcacctttgacaattgtttatcaccacaattaaatcatcacttgattctacaattagtagatctcgaggtcataaacacccgtgtaatccatggggcagtgtgtcgacgtctagctactactggctgatcatggtctaaaaaatcggttcgaaattttggtaatctcggcccacactggcttgtagaaatgtccccaaaatttttaggtttttgtcaaatatttgtatgtttggtcacaatttgttcaaattgacctctgaggtgtgatcttccttcgagcgctagcagaaggtctgtccaatcatgtatgagcacacatatttattgaatatcatgtcaaaacatattgcctttcagtttgctcttcaaatgttgtgcttccctagctagcacgtggatattgaatgttatttaaaaacatagatatatacttcgggcagacccaagaccgggccatcctatggtgtttcttttatgagatcagcaaaccacgtagaaaatttatcatggacaattggctttcaatcccaggcccatggccatgaccaaggatgcccggggctaggttgcaagctttgtgttagcatgcatagactgaataatattaaagttacgaagtttataagagggtacgatgttatatcatttatcgttctatgaattttactttgagcctttgaatgcacataaaacaagagcgcgtggaaattgagggaaaaacaagcggaatctgcaaatcggatggccgactttataaaaaagaatcgggaggtcaaatgtttcaattgatcatatgtgagacattaagttctacatggtgaaacaaaagaagatcagtgattgaaacattaaaaaatttgtgaaacacagtgaagacacaagttgacacatatcgccattacttatgaaacattgacttttaatagtctcaaacatatgcttttcttttatcaaaatataatcatacgacatcttattctaaaaattttattagaatgaatacaacgatatgatcagatcgttgatcggataagtagtttatgagaacaattattctatagattgctaagtgcatgcatatgtggacgaagtggagagagagcaagtagtgtatggcatgaaagaaagtagtggcatgtagttgcttaaattttatgaaacgaagtggaatataaattgaaacatgtaactatctcgtatgaaatatatagttttaactgtttgaaacatatatttttctttcatcaaaatataatcgtgcgatatcatggtgtaaatatttagttacaataaatatcatggtgtaatcggatcgtaaaatagttaaatcgtttaggagaaaaatcttttgcagtgagaaggaggaatggagaaagatgccagcttgatacagccaccataccgtgcatgcggcagtgagcgaccgatttttcttctttgatcggaggcccgagcataagtattctcctaaagcaaccatgaagtcgtccatgagatgagagatttgattcacacatggatatatagcacaaaatcacgtagatgtataggattaggaggcatggtgaagaaaatcaatgttttgtgagttggctaatgatctgtgattgttgaagtcacgcattgagatatcatactcctgatgcagaaaaactcaagaacatctacggttcaaacagccacactactgtctctgaaactgtgccctgaaccaccatgaaaacaggatggaggtgtccggtgggagcaatgcagaaacatcagctcgcagacaagcaagaatatgagtctcccagctgaagtttcgacacctaaccgtgtgatgaagggataggattgtcaggatcagggttcactgcacaacgagtctccaccaacaatctccacgcatccaatgggtccataaaaactctaattgtgaaacacaacgacattaagcttccaacaaccttagaggcgtccaaactgagtttaattaattatcaaacaaaatactcgtagtggaggctcgatggcatagccagacattaatacagtcataagtagatgttgcaactgaagatcatagcatattttggtttgcgaaatcaatcatagcattggcatccagctgctagcatcgttgtatgggtaatagatccaatgcaacaaatcaataaccatttacgagaatatttaaggtctaagattgttggcccaaacttcataattgtaacaaaggaaattagaataaggaccacttccttgtatataacgttttttctcccaactactcttaaccattaattcttggtcagcatacactgattgaataaattccaaattatggactttataacggtgcacaattattcattgctttatcactgcatggcagtagttataagtgaaagtgtggacaagggatgagcaactgtcaacttctccatgacctccacattccagtgagattttatttgcttcgaatgtgcttagttagccacatacgtagaattgagaggcatggtgaagcaatggagtgtggttttagctggccatccatccacaaattttgcaatatcagcacggaggtagcaacctactgatgggctaaaacctctccggtttatctgtaacattgctacctctttcacttttcgctgatgaaccgagaaaacaatgcagagacctgggaaaagtaatgtaagaacatcagtggtaccatgttccaagaccagcaggcaaatggatcgcctggtgtagaaatcatgctcaagctcctcgcgatggtcccctatggtcatacaaggatggtcggggactcggggttttgctgtgcaatgagtctccgtccactaactttctaggtttcagagaatcagtaattgttaacacatagtggcaggcagcagccagccaatggtatatacttcccactttgcaaaatctctgaaaggtttccggaggcatctgacttaaggcggccacctgtgaaaagcactactacacatgcggggttgtgaggtctcggccaccgcctataaaattcattttcatagaggaccgtcttaagcgaccacatgtgatgatcctttttaaagacggtgctttacccgcctgtgcaaataccttagcttcacatgccttttaagcggcaatcaatggacacgtctctgtaaatgctttttatctgcctatagaaaacggtttcgcagtagtgtgttcatattgaatagcatcgaagttatggactttatatatgggtgtacttatagtacatcatttatgctttgtatttgatatttgagatttgctccggtcgagcaaaaagtacctcgaggtaccgctggtacctcacggtaccaaattgtttccggtcgttgaatctagctgggcaggatgggtactgttagatccaacgatcggaaacgatttagtaccctcaggtaccggtatctcgatgtactttttaacatatataggattgggaggcgtggtgaagcggaggtgtgcgttgtggttcaactgtccatgtttgttgaagcatcagcactgaggatgccaactatgcagttaaacctctgaagaatatacagctagagaaaagaaggggagaaaagttgttctcagatgacttatataggtagagttttgtagccaaaatgatttatatttggaaggagaggaagcagcggcttctgaagcatcagatattcaacagcctcgtatataaattgaacctgagtgagtttagaagagaaattctaccattatgctattcttaacagaaccgagagaagcaggaaatctatagcacattttggttttccatgatgcaaaagcaagaggcccagcacataatatacatatacaccaaagttcactaaaaaaaattgagctgttcaataatcaaatggacaaaatgacgtatattgatatatattttgctgaatttaaactaccatcaaacaattaattttttatgtatactgtttgtgtgtgtatgtgtggccctgtatgtattgtcctgaacatattacgatacagtatatgactagccggcaacccatgcatatgatcagtaaactttgaaattagagttgttgaccgtcaccatagtcgtatctcgccactactaatttgtctccaaatggtgaaaaataaaatgaaatctttatggggcagtgggagatagtactacataagaagaagacaaacgttggccagctaggcgttagtcgattgatttcaaagtcaacatggtaggtattgaggcgtaacgataaatgtggttgggtcaaacttgacattctgtaagagcaaatacaatagggctccagaaccggcgataaaatctccacgtcggctcggacgatttgctcgaggagaaaacggaagagagagcgagagcaagcgactaaataagcgccgggctaccacgcgctccaagaaaacaggcccactaaaaggaaggaaaggggagggagaaagagggagattagagaagatggagggtccactaagataaaaaatattagtgctatagtatttctattgtacacattagctacactgtttactatagatgacatggctatttttaggagctgacagtaggctatattattgaccttgctctaacaaatcaaactctgaaacctgacatcgggtggctgtctggctgaataaatcgtccggaatcttgcccgcccttccaaaccatatcagctagcagtaaacctgttggggctcatccaacatgggcctaaaaagttttattagtgatgtaaaatgagaaatgccaacaaatacttaactgttcgcctcttcgacagtagataaaacaagagtcggagagaaagccaagcaaccagagataaaacttctctatgagatatacataccactgagtgattcagtgcttcgcaggtagcatagccatgttagggttcagaggcatggtgaagcatatgtgtgcattatgagttggccaaccatctatttgtgtttaagtatcagcatcgaagtcaaccacagatgcacgaaaacctctctgctttacgtttttctatgtgttctgatgaatcgccaagcaaacaatgtagaggactgggacaagcactgcaacaacaacgttgtgatca

SEQ ID NO: 65099 - DNA, 22118 bp, Oryza sativa
cccccccccccccccccaagtttcctccagcatcttgacgtagccacactggcagaggggagaaagaaggagagaagaagaaagaagagggagtaaaggagatagaagaaaagaaggaagagtacaggagacactgacatgtcaataccacatgacccactgtatttttttcaatttttttctaatataaattcaactgacaggtgggtcccgttggtgtttttacttttctattttccttctactgccacgtaagttgaaaaccaggtcaacagttccacataaacatcacgtcagtacaaaccaccctcaaaactactaaaggagtcatttttgaatggttttaattattgaaggggtcgatttacctagttttacggttgagggatgcgaatgagatttgacatatatttaagggagtcaaaatggacttttttcgaaaacaaattgcggcagccatggcgtcgacggaggagccagcgcatgccggagggggccgccgtatagacatgggaaggttcaacatgaaggaatgacagtagcagtgacacggccaatcatatgattttaaaaataaataaatgttaaaattacccctaactataaattagcaaaatactagtgtgccctaacaaatcaacagcccaaatcatttttactggtagaagaatactaccagtagagtaccatagcggcactcatgtgatttatagttgcagatcaagcagagttgatattcaatttaagaaaaaaaattgaaaatatatctttttcttcgttattttgcgtttatataccaatgcgatgaaattgtgaacaaatatacctttaccgtagacgggaaccgccttggtcctgcaccaccatttcgtggaaccggcggtcgcgcagaacagcattgcgggaccgatcgatcccgcagcctggaaacgcggaaccgccgcgccgtgcgctgcttccagtgaatgcatgcaacgtcaatgcatccgctgcatgtgctgcttgctttgccgcgccggtcacgcgtcgttagcgcgtgggaccgcgctggtcgcgcttatgtgtcacgcgggagcgaggcattgcgtgcgggagtgacggtgccgcgcggacgctgcacgagcgagcggcactgcctcggtcccgcatctctattctgcggtagatatatatttttacaattctttcccatgcatgtatataaaaacaaaacattaaaaataaaagtatatatttaaattttattcttcaatttaatccttgattttatttttgtgaatatataaatgctttgaaaatttagtctcgacacaggtatatatatatatatgcatgcatagggacaccccaacaaaatttattttcttgggtgaaatgagtgagaccaaaagcataattaaacattctcatgccatgaaattcggtgcgttttgaaaaaaaaaaactgagggagtacagtactctagcacacttgtatagatttgtgagttactgaaaattgagggagtgcatacctcaggatgtgctgattatatttgcatacactggtggaaaaaccatctttggtcggtcggccaaaatccataatagtcccggttgcaataaaaactgggactaaaaataatctttagtcccagttaaaaacaccacagctagtttatgatctttagtcccggttggtaacaccaaccgggactaaaaatcatctttactcctggttcatcccgtgttagtagcctgtcagagggccaaggatctttagtcccggttggtgacaccaaccggactaaagatcatctttatagtcccggttgataatactaaccgggactaaaaattattttgatctttagtctattttgatctttagtcccggttagtattaccaaccgagactaaaatttaatacgtagtatataatccctatcccttatcctctcctacacttcacagatccgtccccttcctcttcacagatctaactcctcctccccttctcccattcctcctcccctcctcacttcccatccgccccttctcctcccctcctcacttcccatccgatccggtggccggcggcggtggcccggcggccggcggggccgcggcggcggcgcttccggcgggcggccggaggtgccgcacgcggcggcggccgtgccctctcaactgccggccggtctcttttcttttcttttttttttacaatttgtgtttgattgagatgtgaaattttgtgattcattgcatggatatgagatgtataatctgtgatgtatttgatttgtatgtattttttaggatttgtgatgtatttgatttgagtgttttttttaggatttgtgatgtatttgatttatgtttataagtaacttaatattttggatgttactttgaattggggatttagggattgatttagggatatacatggcactaaattcgggagaaaatatagaaattaaatctggcaaaagaaaaaaaaaagcgctactctctttagtcctggttggtgttatcaaccgggactaaaaatagcgatatttagttctggattcgtactcccggttggaaaaccgtgactatatgggggttaccaaccgggagtaaaaaagctttctgcaccagtgatacatatacataacttggatcgggtggtatcagaaatgaaaattgtgcagggtcggcgtaagtttcagaactggacggaaggcatcagcaagtcatatactcgtatagtggatctcccgttggttatttattcaccagctttaatttgatctagcatgattgcagtatcaatgtcatcttgatcgtttgatgtgactgatgagtcgattaattatatgtacacgttttgccacttcgattttgatgtaaagatttttaaaaagtatatgctggccgttctgcacgttggtatggtcattcaattattgattatattatttgatttgtatcttctctcggtttccatgttcagatatatatttcagtgaagatgactagcagcaagacagcttctgggtggttgggaagaatgtgtatgagtcttctgcatgtcataaaaggagaaactaattatatgaagtgtatatacaccatggcatggattgcagtaaaatttgttgcataaaaggagacctgagagacgactgagagccaatatttcagaactacaaattgcgttcagagttcagacaaagagagacgcatgcagcagtgcttagtatgggattggaaggtatcggtaatcaaactagtgctttcgccttcctaacagaaccctcactaaagaaagatcttagtactagctacattattggatggcattttgtaccgatttctgctaaatagatcttgtactgatttccgctgaaacataatgtcatgtggtcagaagagatcagggggttaataaaagagatgtccaagagtttattcgactagacggggatcatatgtactatgcagtgtggcatcaaaactgctccatccgttttttaacacatgacgctgttaacttgagatacgtttgatcattcgtttcattcaaaaacatcatgtaattattatttattttattatgatttgatttgtcatcaaatattctttaagaatgatttaaatatttttatatttgttaaaaaactgtcagggttatggatatcacatacccaatagtaatcgactaagcttagcggggcccaccatataccaagtcttatacagacatacctcgtatatagaagaaattctggataaggaaagacgagtagagttctatatggaaacaacagggactactctgattgtatccatattggtcttcctggttctacttggacaaggggacatctattgtgtatctatctgttgttgtgtcctctctccctactcaagctaacacacgccgccagacatcaacatcaggcataagcctagacagacctcgtatggtgcctgcggaggccgacaagagagatctagcgccatctctgatctcgatgagctcatacttcaggaggaagactaccatatcgttgactatgtgttggttatccataccgacaagtcgatgacatttagataggttatcccaattattgtatttgtgtgattcagatgaataaagaccaacaccggcttcggtcaacaggagtagggctattacctgtcagataagggtccgaacctatataaagatccttgttccatctcttttacctcagtctcgcatataccctgataccaacgatcctcataccatgcaaataccatagtcatgacctcaaacatcgacaaaaatattttaaataagaccaatagtcaaacgttgataaaaaaaatcaacggcgtcatacattaaaaaatggaggtagtattagatatatagacttcaaattagattttctgccctttcacatccgatgggtcattaatatttatattttcctaatgtgcactgcaaggaaaaccattttcctagacaatggcaaaatatttttcaaggcaggtagaactctcagaaccaaacgtccgcctacgaaaacagaagggaggcgggcgggtagggggggatatcgaaaatgtaccttcgcagacgtacgtggtcaccaaaaataatggtagtactatatttttttttctctattgctaatagatttcataaatcggagtctcggatcacttctagcgagtggtctagaatactataccaatgcaggtcaccacaaatatatactcgctagtaaaatgaaaattctcgtttggtgaatatgatgcacactggtactgcgagtacattttaattatttgttgctacttatttggtcttataaaatgagagctgaaacgaaggagaggaaaaaggagaatagaaagggcatgagtacagagaattggtgcctttatttattaccgtgcatatagtgaacttacaagtaagattgggaggcatgggtaataaaagaagcgctcgtctgtgggatcgaacagtttttagttaagggatgaactgtgaagccgactttgtctccaagaatttactagttttcagatttgttagtgacagagttgcctcttgtactctgtcaaagagaagcctcagtccaccaagctgaactgtacggcgcctgcgagcatcaggtgaagctgcaaaccaacgtcgctttggcaaggacagcagtagattaattagctttgcgacatggggttcttcgagtgaattaggtgttcctcctcaccaaggatgatgtcaatcgatgaataaattaattaagcatctataatgctcgttatgtcatatgtggatgtgtaactgatgtgtaaacttaatctccgtgaagtttttgggtgactacgacaaagcgagcgcaaatcggagggataagttgagtcggatgaattccgcatgaaaattaattaatctgaatgaaattaatagaatgacgcatcagcataaacaaattcagcatgaacattctctattgaaatttttggacagaattatcctgagttttcaaaaacattgcccacttgtagacatgttcactactaaaaaatggccaaaggtgccggttcctaaaaggccataggtgtcggttttccaactggcacctattggtcagcattgatactagcaaccggcacctataagaaaaatagaatcggcacctttagcattgctcgagccaaaaaaaaaaagagctggctcgaatccaagccgaactcactaagtgctatcagtgtgcatgcgcccatcccaaaatcaaattcccaaaccccaaaatcatccacaaatcgtcaccaaaataaattgacatcacagaatgaacatattcaacaacaaattcacaaaaacatgttctacaaatgacatcacagaataaacatatactagcaaccgctagccgcctcccctcttgagccgccgcctgccgcctctccacctagcggaatcggcagaggggagggcgccgccacaacccgtcgcccgccgcctgccgccttccctcccgccagatccggtggaggggagggtgctgccgccgcccgtcgcccgccacctcccctcttgcaccgccacctgccgcctcccctcctgctggaatcggcggacgggagggtgccgccgcaacccgttgcccaccgcctaccgcctcccctctcgccagattcagcagaggggagggggccgccgccgtccatcgaccggcacctcccacttgcgccaccgcctgtcgctacccctcccgccggattcggcggatgagagggtgccgccaccacccgttgcccggctgccagtctcccctccagccaccgccgtgcgtgagagagaagtgagaagccgagagagagaggcaagagagagacagacgagagagacgagagaggtggagtattagataaggttgagtgcatggttgactcatatactccgtagggtataaggccaatgcgttggcctagatcagctcggaggctcggctcggtttggatagatgatttattataaattataggtgccggtttttaattaaccgacacctatgattttacccttagtagttaagtacctgtaccaatacttcaatatttttttacatcgtgcccatcactcaagagcgttggatttttacctttttagaatgcaaacaccgtagaacttctcgatcttttttcaacttttaggccccaatctgcatttccctggggaccctaaattactagagacagccctatgcttcagctggcctagaaacatgggaatgggatgctccactcgctcataatcactatgcacaaatgcatgcaagcgtccatctaaaaatggccaaagcccaccacttgccggtccgccatgaatctatcaaagcaagatttagctgcttcataaacttaataatacccaattacccatccattcgatcatctccggttaatttcatggacacaacgacgaccatggcgcctctccctctcctcaccacgacgtctctgctgctcttcttcttcctcgcgtcgtcgttcgccgccgacgtcgtcgtcgcgggcggcggcggcggcggcggcggctacgacggcggcggcgacggcgaaggcggcggcggcggcgacggcgaaggcggcggcggcggcggcggagccaagatgccgcacgtgaaccacggcaggtacaagtgcgggccgtgggtggacgggcacgcgacgttctacggcgggcgcgacgcgtcgggcacgacggagggcggcgcgtgcgggtacaaggacgccgacgggtacggcgcgatgacggcggcggtgagccccgccctgttcgacaacggcgccgggtgcggcgcgtgctacgagctcaagggggattccgggaagaccgtcgtggtgacggccaccaaccaggcgccgccgccagtgaacgggatgaagggcgagcacttcgacctcaccatgccggcgttcctctccatcgccgaggagaagctcggcgtcgtgcccgtctcctaccgaaagtaagtactcacgtgtctatatatatgtaacgtgatatcatggatgatttacgtgctgatcgatgtcatgctcacatcgtactaacatcgtcccaaaatattgctaccctagttctcgataggacatttcaaatccagtcttattataaagttataatccactaattctaatactcaacatgtaatcatgacacctcatcatccgctagcattaattaaaaataaaacttacgcaagcatgcaacattatctataattcattgaactctacaaatcaacatccaatcatcttcactcacattattcttcacaatatttttaacatatatatatatatatatatatccattatttttataatacttaacatatatttatccatataatcaatgtgcggaatatcatatttcatctacaaatctcatacagagtctactatgtattaatctcttaccatatagtttgacaaaccaattttatttgttgttaataactaatataaattttacttttagctcgattattaaaaaaaactttaaaagctctttattaattttcgcagcaaagtgcggggaaatgttccatcggaaactagcgcttagtacctagtattatatactacctccatattttaatgtatgacaccgttgattttttgtccaacgtttaaccattcgtcttattcaaaaaatttatgtaaatattatttattttattatgacttgattcatcataaaatgttctttaatcatgacatacatattttcatatttgcacaaataatttgaataaaatgaatggtcaaacgttggtcaaaaagtcaacggcatcatacattaaaatacagtgggagggagtattgaataggtctgctacctatatttcatgctcgcatactctctccggtttcattttaattaacgttttggacaatgatatggtctacaagatacatttttgaccttatttttctattataatatatataataaataaatgcatgtttacttttattatagcattttaaaagacaaatctatatatgttcttctaattcctttaaactaaatatttttaaagttattggtggccaaagttataaaaagtttgacctcaatcttgtctaaaacgtcaactaatatggaaccggagggagtaccattttctcaacgtcatcccatgcgctagcactcgtccttgcgtaataatccctttgtattactcgatgattaatttgcacatcggtgtgcgtgcatgcagggtggcgtgcgtgaggcagggcgggataaagtacacgataacggggaacccgtcgtacaacatggtgatggtgaagaacgtgggcggcgcgggggacgtggtgaagctgacggtgaaggggaccaagcgggtgaagtggacgccgctgcagcgcagctggggccagctctggaagacggaggccaacctcaccggcgagtcgctcaccttccgggtcatgaccggcgaccaccgcaaggccacctcctggcgcgtcgccccccgcgactggacctacgacaacacctaccaggccaagaagaacttctagctgatcgatttttttcaacttatttacttataatatttttacctctccctccgttctctccctacttaattgatgaatttttggaagtgaaaactaattaacactgaatttttttcttacgaattaatcctctgcgtatttactaatttgagtttgaaagaattcgttgatagtgatatttgatggatattcatgtaagctttggaatcttaaattttgatgtactggtcgaaaatgccattagcattgcatttattctgtttttattattattattttggcttcaaagaccaatttttctgacggttccaacactgtgatggttttccctaatgtgtccacgtcagaaattgaatttttacaaacccgttgtacttatttctgttgtgccgtcagtacttatttttctttgcagaaacccacaggaaaatgaattcttcgatggacctttttctgacggcagtttctgtcggttcaccacaggaatttttctgtaacggtaaaatttatttttctaatggtccagccaaacatgctagctcgagcatgtggtctatgtctcctactctctagaattaatatatgctactgtattatgttgggcgttccgacaactataaactccctatcttattaaatatgtctatagattattgtagtaataatgggcttaaatttgtaatgatgttaatcataacatctctttagacgggtgtgtagctgatagtcacattagtatatctcacacatacatatatttgctcatcactgatatatataactttgaatgttctgaaacttagtcagatcatatgaatctaaattaaaatgaggttcatttgtaaaccgtccttcattataatgtgatttgtaaaattatatgcacgacattattacattttccttattttgttcttttatttgttgttggatcttatcaaatagatgtcaatgatctatttgtaaatattttttcccaaaggaaagtcacgtagatagagtaagagggtctatttgtaaatattttgttctttaatattgaaggtatacatagtagaattatactccctccatactcataaaggaagtcgtttaggacaatgtttaagtcaaatattgggaatataaatcataaataactctcaaattgttgagtttgaaaatataaaaattatatgaatagatttgtcttgaaaaatacttttataaaagtatacatatatcacttttcaataaatatttttatagaaacaagaaatcaaagttgtgttttggagaccgtgccgctgtcctaaacgactccctttatgagtatagagggagtattcacaacttaactattttttttcttagtaggccgaggaaacttcacaaagtattactactccctctatccaatggctcacattttttctagctattttgtcttcgtgtgaacccaaaggctattattttgttgatcatgtggctcatcctagttgatttttggaattcggatgtggtgtttaatttgatccaattaggtgtgctatgaacagaagtcaccattgatgaggaagatgaaaccagaggaaaatatatattttgttgatcatgctcgtcttggatagacgttgaggcccataaggaccgttagaatttaaacggctcgtataaagttctgcctaaatcgtcgaaatataggttaatatttggcccaacaatatgggcctcttcagcctggttcacagatagaaaccaatcgatacgggaatatattatatagcaacggtatgaataatgtgcaaagttgtttttttaattagactatgatatgtacaaattataaatttgatcgatcaatcacccaaaaagatcttaagaaaattgagatgatgtgctatttaaaagcatagagataattccaaccataggttgatcatctggaagctgagaacaattgagctgacatggttttatgaaagaaaagaaataagataggtaataaatttggaccagagattaattattcgagggctagttaataaatagaaagggagttaaaccttcgtaagtaagagagaaaattaatttgtacttctctcaaagtctcaactacttccaagtgtatgcttctttcaatgcattcatatatccaagctcaacagtatacatgctactctctgctcagatcaaacaagatctgacacaggaagagagatggagtatgcaagccaaattggtgtgtgtgctagctagttttcacatttaattttcagatgtgaactcgagcttaatttagagaattcaaagagagaagtccaagtccaagcacatatagcaaagacaaatcaataaaacatgggattaggaggcaccgagaacaaaaggagtgccatggttttctaataactttctgaattcaaatcttcctcatcagtttttcctaaaggcaacgtcacaaataatgcccttctaatgtggagtcttttccccctatgccactaaaaaagttgatgcttacctgtgtaccataaaaaagtttagagtcacatgtatgctatgagaaaaactttcgttgaccagtgtgccattccgtccaccttctgttagaacttaacggttccatagctctgacatgtgggacccatgtatgaaaattactaatttgcccttaaggattttcagctctcttctcctctcctgctatctcccgtgagtgcctgctctctccccgttgcgctgcacgccgccgcaccctaaccctagccgcacactgccgccgccgcctcgcctcgccggagccgtcgccgccgccgtgcgcccagggcagcgcgcccctgcgctaggccgtcgcgcctcctcctctcctcctctagggcccgcgcgttcccgcgtcctccctcgtcgcacggcgcgtgggcggcacgcgcggcaggtggtggttggttcgggagggcggcgtcgtcgccggtcaccgggtggtgcggcgccagggcgcagattggggcggtcaacgtaagttaggctcatggcatacaagtaactccaaaattttttgtggcacacaagtaaccagtaaattttttaatggcatagggataaaagacttttagatgtgccttcttgggaagttcactgggactacggttatctgaactgttgaatcatcaacaaactaaagtttggtgaattatgctttaccatagttttcgtatcacccacgtaataaacaggttcagaaaagaaggctaaacttcagcagaagagccatttagtgccatttttacactataatggtaaatttcacatgcagaggccaatcctaatgggccaggggatctgtggataaggcccaggtgcatggctggggatggcccagtggctgaggccccctcatccgcaccgcgcagttccatctccccacttatgttttatttttgttttctccatcgcgcgcctcatttgctctgatcggccatcgcatgtatgctcttattttattgatgtgaatcaagtttgaattgatgaatttaaaccttgtttgcatttacgtgcataaatgctttggaactttactctcaagagatatatatacagacactgaggcaggtgaaatgagtgagaccaaaatcataaacatcctcacaccgatatattttcggggttctgtatgacggttttacagttcaccagcacacatgtataggattgggagctgatctggaaatgaaaatggtgcaaattatattgagatacgtatataggattggaaggtattagagcaggtacaataatcctatgtaagcaggctataacaacaaacaagttatatttatgttgagaaaaaagagtgtgtgcgtgaagagagaagctagtgtgggcacttattttgtcgccagagctaacaccggctcccatgcatgctgtggggtccactagtgctcagcttatgtgggtgaccagctaaccttcctcccgctagtgtgaaagttgctcattcaggtaaaatataattttgatagttgtgcaaagcaataataccaactgccagatactgtataactctattgctaacgtagattgttttggagccaacaatcagctacactattgaacttgttctttgagtaggtataatagtgttgattcagccggagataacaagtcaataaccaccacatcaacattgtcatacaaggaggagggagaaaacatgagagagagagagagcagaaccagcgcttctgctagcaccggacgatagcagcaaattatacaaaatgaaatattttatttgcttcatgggtttctggttcagtttacttgatcttttatgtatatgtatactgtgtggctgcatacacagcttatttttgcgctcaagcaggatagaccatagagatagagtttagtttcgatcacacgtgcgtgcaataattaaacccgttcatgcttccttaaagccaatcttttatataaacaatctgcaatgtaaactatagataatatgtactccctccgtcccaaaaaaaggcaaaccctaggtttccgtgtccaactttgattgtccatcttatataaaatttttttataattcgtattttcattgttgttagatgataaaacacgattaatattttatacgtgacttgtctttttaatttttttcataatttttttaaagaagacggacggtcaaacgttaggtacgaaaatcagggttttttttttttttttggactcggagggagtacgtacacaaccgccgactgtttgagattaaagcgatgcatacgttggtttcagaactcagtggaaggcaccatctatttatcaatcaattaattatcatggacaaccgatcgatggagcactttggcggacaccaggcctactgaccttcaatgctactgtacgaacagggtttgaaatttcggttcgaactttccggaatttcgcccccctaccggcatgccgaaatttcaaacctgactatactttggccgtacgtgccacaccaccgctttttcgtcagatatatgccgtcgtctctactgctttgctggatccggcaaacaagatctgacacaggaagagagatgcagtatgcaagccaaaggtgtgtgcgctagttttcacgtctccagatgtgagtacatcttaatttagataattcaaagagagaagaagagcattagctccagtccatgcacatagcaaagacaaatcaatcttaaacatgggattaggaggcaccgagaacaaaaggagtgccagagtttcctgctgattaattttctgaattcaaataggaggatgcattatcttggaatttacggtttgccggttctcgtcttgttttgttacacatctgcctcatcagttttcctgaaagaaacggcacacttcagaggacgtctcacgacatggttgcctttgtgaagctgctatgtgccttttttatggccgctacgctgtgatcgagaaattgcaatctagacgaactccgctgttgttcaattttgtccaaagagagatgctgagataaaaagaagtggtaaacaagatgagtgaaatagaatggtaaaaatcaacagtaacaaaagtacaaaaccaagatcgatctcctcctagccctgtctagcagtagacagagatccgtgatttggtattcagcttactaaagtatacacctcgcacaaattaaaggatatctgtttcccttgctgtttgcacacaagattacgttaatagtaaatttcaaccataataggttaatccgcaccgcaccgcagttcgatctccctcacttttgttttcctcttattttctccatcgcgcgcctgattcgtttcattgtgggtctgatcggccatcgcataaatgctcgtattttatggatgtgaaccaagtttgaattgatgaatttaaacccttgtttgcatgtgcgcgcataaacattactctcaagacatatatagatactgaggcagctgaaatgagcgagaccaaaatcataaacattctcacaccgacatatttgtagtgctctgtatgaccatagtacagacaccagcacccatacataggatgagctactggaaatgaaaatggtgcagatctcaggaaccatgcagattataattagatacatatttaggattgggaggtattagagattaaagcggtgcatacatatatttggttggtttcagaactcagtggaaggcagcatctattagacgatcatcatggtttcagaacactgctcgtctcctcactcgactccccatctcctctctccgttgccttgccgccgcccgagcaagccgccggtatgccgagcggctgcgaggacggcgaccggtggggatttcggtgcgacggaggggagcttcgggtcttgtggcgcgggagacggtgcacagggccatgggcggtggtggccgggcccgcgcctggccatgcgcggcagcggaggaggccgatagggctagtggtgtagtagtcggcggggccatgggctgcggggcgcctggccgtggctggcgagacgttggcggcagtcctatgagaggcgaaggtctagaaatccgacgaagtggaagcggatccttccggctcgcgtctagttagctatttcagactggatgacgatggatgatggtgggttaattggtggcgcacggcgtcagctcacttgaagtggatgaaaatgccttccactgagttctgaaaccaatcgcggagtatcgtagcgataacgcctatgggtggtggcgactagacgaattccactcgtcgaattcggtcgtttcaggagaggatgtcggaaagcagggatgtctcgaggtcgtagttttttcgtttattggtggtatgttcttctctttggtaagatatgagtttaagtgctcttgtattcttttggctattttcttatggatatagagatcagattaggtcctccgatggacgatgcactttggtccgattttttttcaaatgcagccccataattcatgtgagctcgcaaattcagaatttaaatatatagacatgatgctcacgtgtacactggcgtttccatccaacttctagtccaacaagctaatgggcccgtgaattgatgtacagcccaacagcccactgtcagtcaaactatgatagatggatgaaccgtaataagcaagcaaaatagggcaaatctgccgatcgctgtgctgccgttaccctcaaattttcttcgacatccatcgttcctctatttactaatccagcaaacaaatttccttgaattcagatattgttttttatgttggaaatttgatctgcataggcagtgaccggtgagtttccaaatctgaaaatcagaatatatgttggcaatcttgatttgttttgcatatagcagtggcgcatcttcacaatgggtgcatacatccccgttggtgtaaaaaccggattttataaattcccattatcttaaaaaaatcagctttacaattggtttaaaattgagctgtagaatatcgattcgattaatcccacctgggccacaacaattgctgtcaccgtcggcggtggcaccaatggcatacttctcttgccaccacagagacacaatagaatcccgatgcatatggatgcaataatgaaatgcaagattgacgattgggacatcatacacatcatcagtcatcgtaagatcggagtcaagccggtttgtagctgcagttttatcttatgataggttttttttttcattttatttggtattagaatatgttaatatttgtttaaacttgcagattggcggtcaggccaacctcattgatagaacgatccggctgttggatgtaagatagtccctagaataaaatagaaagcgggcaacaagactattcgagagcactattaatgtactgtgccttgtgtcatttctaagacctatgttatgaaggctcctatatataatggctgcaaattaataatggtcctagcttttttaggggcctgatcagattatagcttttttaggcaagatggctaaaattttagcaggatttcttatgtatttaccaaatttggcaacaaactaaacgtatatattttttagcaactttaaaaaattggtatggttgaaaatagcatcacggtgaacagacccttagtaatgaaaaatgaattggtctttctagtttctagttttgttactatgtaataataatgtgacatacttgtggtggtctctgttcagagcttgcctatttaaacacgcatggtttaaatggtgttattttgcttttgcaaataattgtaccatatttgcttcttagtgtaatatatatgtttataattaaaaaaactaaagaacttcgattggctgacgaaaaaaagagacttaatgctactgaggctgctgagtagtgtacgttatttcgttgggcattagctcacccggatttgacatgttccaacgtgcatgccgcttagaactagaaattcgaacattgttcacatcttgaattttggggctgcattaatattttagatgcaaaaatgtcggcactttggtggacgccagttctactgaccttcaattctatgtactttggccgtgccacagtctgcgagatatatatagcccgggctgacaccctgtgcctttttccttttgtttcttttgatagagtgttttttttttgttttgttatgtagcgccagacgtaaaactctgcttatctaataggcaaagcttgattgggatcctccaaagtaaattcagagtgacgtggtcactaatatgtaagcctcaccacccatgggtcaacatgtcatttgaccatatcaggtgaaaagttacgttagaggattcctctccgaaaagattatatctattttgaaagtggacctctcggttatttaccttgtgccagctacgagaaagcactactagaaaaagcattttcgctgatgttgagtatctttttttgcaggcgggtagatctctcggagccaaatggctgcctacgaaaatggcaatcagggtcaagaccttcatctgcctgcgaaaatatatttttataggcggaccacataagacgccgcctacgataatattttcatttttgcaggcggacctattaagaggcacctgcaaaaatctcattttcagaagcgcactgctaagagctccgcctgcaaaaacccgcatccaactataaaaaaattcagacttatcccactcccccaacagccactcaaatcttatcctctcctctctccctctccctctcctctcaccctccccctccctctccgagcctgcaaagaggagagctggcgatccgggcgaggaggaggtggtccggcagtggcggcggttcggcggggagggccagcaacgacggggtgacgagagatggtccggcggcgggctcggcaaggaggggtctagcggcgggggctcggcaaggcggagtgatggccgtggggtcagagcggctcggcgaggaggccgcccggcggcagctcggcgaggcaaggaaggccagaggcggctgctcggcgacgagggacggcgccgatgatgagggccggcggcagataaaccctccctccccggtgtggtcgtcccctccctcactccctcttcctctcagatctgcccggagggggacgggtggaggccggcggcctcccttccctctttcctctcagatccgcccggtggggagaggccaccggcggcagcggcatggccctcccctctgcagcagtagagggcggcagggaggaggccacagagctgtgtttttttatttgtttttattttgattgatgttgcaatgcaaatcggtgttgtggggatttgaatccgctgtatctgtgttcatgtatagattgtgttgatgaatggatgtttgtgattgtattttgttgaatggatgaagaattttttatttgtgggtgaaacgcgagggcgggctggtttggtggcgaattttctttttttgcaccaaaactatttctataggtggggccgctatcgcctgggaaaattgtgtttttgcccgtgaatgattttcgtaggcaggtgcttggtccgcctagaaaaattgatgatttttgtaggcgtttaggtacatgcggatggtttgggcgtctgaaaaatgctttttccagtgaagacatcaaatgtcatggggatcgttagatccactcaaacttcacataaagcttttaaataaatacataccatttcaattaaacaaattaggttaattggatccatgccactccaactttatgaaattaaataaaatatcactactattcgtcatatcggctacatgccactggaaatttctaaaattgaaaccatgtctctcccgtccctttttttcgtctcctcactcacgccgtctccgttgagcgttccacgcggcctcaccgcttccactgccttcctccagctccagggtggccgcgccaagcggtggcaccggcggaggcggaggtgggaactttctgtggctcgcgcaatcaagtcggcggcggacaaaagggcgacaagcaccaacgccgagccgtacgctctgctctccgcgatctcccgcgggccgcaggagctgctctccttgatctccctcatcgcggcagcgctggccaaaacacccaaggggagcagcggcgagcacaccacggtcggcgcacactgagttcgagcaggtgcagtacgagccataccggtgttttgatgattgggggaaaaatgctacttctaatcttgatgagtgattctatctatgcgtggctgggcaagccgccgtcgccgcagcggcgaggtggataggagagggagggagatggagatgaggcgccgccggggatggagacgacgatgacgagagccgcgcgattctccgcgacgtcgtccggggagcctgctgaggtgcattcgtcgtcgtcgtcgtcgaggaagcgcgcggacgccctggcgaggctgcgggcggcggcggctggggtcgagcctgacgggcaccatcttcgggcggcgccgcggccacgggcacgtcgcgctgcagatggacacccgctcgccgccggtgctgctagtggagatggccgcctactcctccggcgcgctcgtcagggagatgtcctccggcctcgtctgcctcgcgctcgagtgattaaggtgtggggggatgatacgatgtgagagagaggagacggaaaaacggacgggagtggcatggttccaattttagaaattttcagtggcatgtagccgatttgatgaatagtagtcactttttttttatttcgtaaagttgtagtggcatggatccaattaacccaaacaaatttgttctaatacctagcacgtttgaagtatttgtttgttatgttgttagcccgtgtggtccagaggtgttgtgttggttgaaaatttaagagtgagggaccgcttataaacctttatatgctagctccaatcattctacacctgaactaatccttttatattaagcgagtacaaaaattgtaagcgggaactatacgtatgtgaatccattaaaaatgtgtgtagagctaggctaatatggatagcgtgttaattatttattttcagcagtcggagaatctgagtggttggaattaatgaatgtgtatgtaccgcactttatgaaacaacgtgaacaaacaaagtgtacgccttgcatacggtacattctgcgtcgataaaatggaaaagattcagggtgttatataaggactacttcaggtgctaaatgttgtttgcaaattaatttggtatacatacatgtgctatatataagaatgcaacataaaaggagagttgagagagtgtgtagagagagccattcagaacaacagtcgcgttgaaagctgagacatgagagacacagcaatcgatagctagcatgcacatgatgcattgatatatatgtatatatatgtatgtatatgtatatctgtatatcggtaatcagattagtcttgtgttcttttccagctacttcactgcaacaagaggcagccctgaactatctagattgtgttggattactatgttcttggttggtttctaacaccactgacctaccctttctgcttgagttggcaccaagtcgaaacacaagtggttgaccttgtatcgatttccactcaaacaagtgtgtcgtatgcttagaagatcaagatcagggggtcggtatataaagagatatacattgaagatcacatcaccattcagcacaacaactctcagaaattcagaattaattaagccggaatccaacaagatacttgacatggcttgtaaaattaagataatttcaagtgttgcattgtgaactgttggctttcatataaggtcggatcttaatgatctgttatctaaaaaaaatagggctgctttgggttaatatgatgaacacaaatatatactccaattggctcattcactactagaaaaaatattttttatggcgttgccctatgattttcgctagcagccaaatggaaagccgccagcaagtacgtaacgagggctgggggctaaggaccaccagcgaaaatggatcttcgctggtggcccggttaagtcaccgctagagaatgatacatcttcactggcggactgtcaaaagatccaccaacgaagaataatcgtgcgagacgtgtgatgcagcgatatttttttctcaccgcgctccaagtcctacctctttttttttactcacctctcccacctacctctctcccagattgttctcttcaccacctctccctcaacctctcaagctcgaggcacgactactaataggcggcaaacagtggcggagctaagtttggaggagaggggggcctcagccttcttcttcctcctccagcccactctctccccccattttcttcttcctctccctcttttccccctctcctccctcaaatttccatggagtccagctgggtagcgggggctcgagccctccccccttcccccgcccccatactgg

SEQ ID NO: 65100 - DNA, 2237 bp, Oryza sativa
tcggacgacgcggcgaccaccaccgaggagtactgcttcgacgggctgcgctgcatgttggtggccaccacgtcgccggactgctgaggaagtagaccgtgtcgtcggcgccgccctgggacggcgcgtcgtcggggagcagcgcggcggcgtcgggcctccgggagagcgcgacagggccctcccacgagcccctggacgagtcgaacaccgacatggacaggtcggggagctcgtccgcgaagagcgccacgcggtagggggagccgtacatggcaatggcgtggagccgcggcgcgccgccgtgggcccccggcggcgaggggagggcacggctcgcgccggtgagcgggttcgcgacgaggagctcgcccgtgcccggcgcgcggtagaggacgaggccgccggacgacgccaccgggacggcggcgtcggcgccgccgtcgctgccgcccggcgcggcgcggcaagggatccaggagcggccggcggcgtcgaaggcgagcggcgggcgggggcgggcgccggagagcatgaggaaccacgggtcccgcgacgggacgcgggcgcaggcgcggaggaacgtgggcgacgcggcggcggcgctccagcggcggcagacggcgcggaggcggaagaaggtggccggcgggaggcgcgccaggacgcgctccagaacgtcgtcgtggaggtccccgagcccacgcggcggcgggctcctgcgcttcctgctacttctcgccgccatggacgccatggaggaggaggaggaagctgtttgtgtaggcgttgacacgcagacgcgaggagagagagagagtgtgtgtgtgtgtgtgtgtgaatctgtgaagtgaaaggcagcagcacggctggctccgctatttatatgacgacgactagtataatgatgcatgtatgcatgtcttaaaaaatatgtagtataatgatgtaaaatagtattatactatactccgtttcataatgtaacactttctagcattacttatattcatataaattttaataaacctaggtatatatatgtgtctagattcattaatatttatatgaatgtggataatgctagaaagtcttacattataaaatggagaaagtagttttttagataatgaatagtattatacttcatccgtttcataatgtaagtctttcaagtattgctcatatttatagagatattaatgaaagacttacatgaatatgagcaatgctagaaattcttatattatgaaacggagggagtagttaattattgtataatattacgttcgacgagtataagggtgcatgtatgcatgtccacccagctcaaaaaaatactactgcatttcagacagcagaaaatttaagtactccctccgtttcatattataagacggtagatttattaacttatatgtgaatataagcaatactagaaagtcttataaatatgaaacagaggaagtactccctccatatttttttttgtttgacattggttagctaaaaagaactaaccaacgtcatacatttgtacaaagaggtagtagtatttaagtatttcccggtattttagactgcaaaaaaattatgtgctcagttggatgtacaaatgtgcaatttacaggtccatattatttttagatgctttatcggattattgtcgcatattatttactgtgtaccattaaaaatattgttttttaaaaaattactgtattggttaaatcccttgttcccatgtaatcttttgttaaaaaatactgaatttcgaagaaccaaaaaggttttgaagagaaaaacaaaggtctcttttgggtattccggagttcactctttaaaaatgttgagaaaaatcactcgtcaaattaaattcaacattttttttggaacgtgagaagaaaattcaattgttcaaaccattgagttgtagacgtacggtagatcctgtttagaggggttctagcatctgtagtctaaattcttgtctacgttctacaaatacaatatacatagttatagaatctaaaaaggtaaactaaatatccatcaattgcagtcaaatacagtgacgtagatatggtcgttgtagcgcagcgtgcgcgagttttgatggaagaccgtgaaccgtttgcttaaaaatgcggggaggtgcacgcacattcgaacgcagcgtttggctcgtagcatgtctacgcatcgttccacgtggtgtgacctgccgcactgcactg

SEQ ID NO: 65101 - DNA, 596 bp, Oryza sativa
cgggccgtgcttgggccgggccaaaattgcgggctttgtgccgggccgtgggcctcgggccatatggccatctatacctctactacacctgcacaccaaccagaagggatctctcaatttctttggacttcctcacttctagcggcaaatttaataactcctcggctccacttctttcccccgttttctttcttgttttcaggcaccaaatctctgctgtttatatactcgagtggtgtttttggatgcaattaggcagcattctgcggcaaatttagcatatagttttttttttctgttctgtttttggcgattgttttctatctgtgtggagtagtaagcatgtgaaaggagctgagaggttgaagcagcagttggatttgatgttcttgccaagaccccgacattttctcttgattctttaagactttttggggatcgattcgattactgatgcacctacctcgcagctccgagctttggattcaagaaacccaaatctggtgctggaatccgagctccagattcaagccggagcaattcgggtaaaaccaggcgagagatctttgcgcaagaagatgtcgccggccaccgcc

SEQ ID NO: 65102 - DNA, 7164 bp, Oryza sativa
ttattcctggccacgaatttaagcaggtatcagtaaatacgcaaatttctaaataactattcctgaagaaataacattatattttttccgatcgatttcatcgtatatgcagaaaatatccaggaaaatatatagtgtaaacccatcacgagagtgaaaatttagaacttaccgttggataaaaatgaacgttcgagattcgtctacgttccatgagttctagtaaaatttttactcatgaatgaatccgcgagtaaaattttatccgtgatgacgtagacgaatatcaaatgtctattttttgatttaacggtagttttcagatttatagatacgtgccccgtatatttttcccatatgttgtgtgctcgtaagcacagatggatagcaacaaggaaaagatgcaggatgatggagagggggtttgacctctgctgctgcaggaatctgcacgaattccaaggtgactaaaatacaagtgtcattggcatgtgaaaggtgaaaaaaaaaagcttggagagggagggaagaggaacacacatgctcgtcgtctccccatgcatgtcgctgctctgctaggagtagataatctaattagatagacgtactactatttttttttgttgggagtactactattttataaacctaatctctccggggggctcaggctagctggaacttttgcttttggcctagacgtgcaaccagctgctggtccctgtgtagtggtactagtatacgtacgagattttcctttagttaattaattactcagatcaattcaacgcaatagatgtgtaaagtttaattactggggtttagtactactggtctactgctgctatgaaagtgtcaactgggcgcgcgtgtgacgtagtactgttttactgctacagtggtaacgtacgtggagcctataatataattgcggggacaagcatgcgtacatcttgcttttcttaggaaaaaatacataacgcaatccacgtataataaatacttgagaattatcgttggatttaaaaatagacgtatgaaatttgttcacatcattttgagtaaacattttactcgcgaattcaatcatgtgtactcttgatgtggataaatctcgtgcgtttatttttaaatcaacgatagtttcaggttttccgctacatatttttctcttttttttctgcacgtatattcatctgcgaagtgaccaaaccgaccaccgaagcctgcagtgtgttgtgtaaaaaacaatttactcactgattgatgatctctcttttcgccggggatcgcatgcaggctgtacgtactcgatccctacaccccgtaactaccactaactcaaatactcaacgggattaggaattttgagggcgggtgatttaataaaatgaattaaagcggaggagaaggtgaaagttaattgcatgtatatatgcgtgcgcgccatgtactttctccgtttcatattataaaactttctagcattgccgacatatatatatatatatatatgtatatatatatatatatatatatgtatgttaacgaatctagatatatatgtgtgcctagatttattaacatctatatgaatatgggcaatgctaaaaaatcttatagtctgaaacggaggtactatagataacataaaaggaatggttgcatgttatattttagaatgtagagagtataactagtcaattattatattaattctcacgttcttatcaattatattattaaaaccacctttttaagacaatacatttgttgtggaaactagaaattctcacattaatcggagaaaattttttaagtagaaatacaatttagaaataactgaaattcgaaaaaaggaatattgaacaaacaatccatttataacacaattacataatacgagattgattaaaattagcaataaaagataaaataaattataaaattacaatgataaaaatacagagtttaagtaggtatacaatttagttttaactgaaattcaaaataaaaataagacatattgaaagaataatccacctagaacatatatagcatgaattaattaaatctcagaataaaagtaaaataaatgctgaaaattaaaaaaaataaaaataagagttgaagtaggaatataatttggaaataataaaaaataagaaacattgaaaaaacacacaatctatctagaacaaaatacgagattaattaaaaattagaattaaaaaaataaatgctgaaattaaaaaaaatgaaaatgagagctcaactaggaatacaatttagaaatactgaaattcagaataaaagaataagaattattaaaagaactgtttacatagagttctattaattgtttatattcatagtactggtaattatcatatcacatccaattttatgttcttatattttgaaacggatggagtagataagttgttgcagagctaacagcatggagaattgggacacttccaattttgcaaataagctcgtcgtgaatggacaaattacactttttcttaacattttgtagaaaagaacttagaaagaatagaaaaaaagcaatcgaagaaatctctttctttggccttcgtcaccaatggaaaagatttgaggctcactttcacgtggagggtgaaaccaggtgagcttcatgaggtggcaccattgctcaatccctaaaggggcctcccacacatggaggttgaggtgttggcgagcaaaatgaaattcaataacaccactctagatttccaccattgttcttgagaagaatcggtacaaagaccataactattccaaagatcacaactagatgtatttcatcggtgaagaaagtagaagaagcatggcgtgttgcataagaagccaagaggtgtacttaattggggcctcaatgagtgggatgttgaggcctccttggcacaacttgaaaacttcagccacctagtgaaaatttgtcgccggaaatatagcatgaggttgtctgccttggaaagacctcatgggagatgttgatgtaggccggcataaatttgtttgcccagatctagaggcaccctgatagcacccgggagaagaagcctagcaatggagtgaatcacctccagggagaaggccagtgctcacccaaacgctaggacgagaccgaccgacgccaacgaccacctcaagaaccaaaagggtaaagaccacggtaaaaacctgaaccaacgggagaatccgactactgctactactaatactggaggaacctgacccctcttccagccttcactagtagagccattggaggggagagagaggggtaggaaggaatacattttactgtagcgaatagccgtggttgctgtttctccccttggccttggttaattttgagcggtaatggcatcgtcatctttagtggagtagggtgtgtttagttcacaccaaaattagaagtttggttgaaattaaaacgatgtgacggaaaagttgaaagtttatgtgagtagaaaagtttaatgtgatgaaaaaagttagaagttcgaagaaaaagttaggatctaaacacggtgtaagttactagtactgaagaccgccttatctagaattaccaatctaaattacgcctgctcaattgcactccatagcctccaacatggaattgatcacagagggtatagcaacaccggtgttgtaaatcctctttcttttttttttcaagattttcccacgggacccatcggtagatcttgccatatggggagcaaaagagagaaaaaaaattacgtagagtagaaagcgagagaagggggaaaaaaatgcaggtgcagggtccgggcccggggtgacagctagcgcacgtagtgtagggcggggtggtgcaggtgcaggaacatggtgattcgcgcgtgcatcggatgtcaaaggcgagagagaatagacggagtagtgtccacggctgaccatcgcctactctagtagtagtagtccagaggggagtagtatacgcaccgcaaaggcaaaaggcaaaacaaaagcagcgagagagagagagagagaggagacgacacgcgctgcctgcctcgccgtgccggtccctttctctgtctcggatcggtctcaccatggagtccgtccgtccgtccgtcctcgtaggggaatctctcctcctcaatttctctctacaaacactagcagcagtagatcaggctatttttagttcttttttatcacatcaacacattaacaactaaaatctaaactttacgttgatctaaacacagcctagagtagtctctcctctctgccattgccagttgatcagtagagtgggttgcaaacggccaagcaactgtgggttgggttgtcgtggatggatggatggatgcttttgctttacgcaagtcaaatgggggacgacatcacatcgctgcccctgccctgtccgtcctgccacccggccggggacccctccctctgcacaacaacgacgactcgctcgcgttgcactccatccaaccacccacagccaccgtctcgtctcatgcatgctggagtggagtagtagcagcagcagcagcagtagatgcgaggagtactacgagacggctactgtactacagtgtgctattgctaccgcccacatctcatgctcgttgattggagggtactgtagcaaagtcaccgtctacagtccgtacatacctagtgtaccgtgtacgcgaccccttccgtcgcaacatgcccattcttgtgtcctccctctaccagtactcgcatttgcagatttgctagtatgctgtacctctagcacaaataccactcttactaagggcatgttaagttccccaaaaagaaaatttttaggtgccacatcgcatatttgaccgaatgttggaagagttttcgaatttcataactcgcctagaaaccaggagacgaatcttttgagcctaattaatccatcattagcacatgtgggctaccgtagcacttatagctaatcatggactaattaggctaaaaaagattcgtctcgcgattttctccctaactgtgcaattagttttttttaatctatatttaatgctctatgcatgtgtctaaagattcgatgtgatgtttttgagaaaaaaaatttagggaactaaaccaagcctaccaaattcacagctactcctatctatttttcatagtaatactatctatatgccctaatatatgatgctggttatatttttgctcgccatcatgtaaaaagaatcagagagtgtatttttgctcggcgttcgtatgctttttgttacaacttacttcacatgctttgctttggtgttattccatctcgcggggagttctgtttctttttttttcttttttaaaaagggctggaagccccacatttccattaccagaaattaggtaattttacaaaacaacatgaccttacatcaaacacaactatcacatgttttttggcattaacaaggtgccatcccacaatattctgccaaaattaaccttcagctaagaaaccacacgctgcacggcaaggactcagaaccaagattggcttaaggcaaggacatagaacacccaaggatcgattggaagcagaatttccaacaaggatatacaaactcttctgatcttcatcgtcttctattccagtcttcttgcacaagtcctccatccaaacctcaagttgaagatctcatttaccacatgtttcataagacccgtcccaacgattgcaaaatacgtacctagcattaagtgaaaacgtgggttgattagctttgatttattatgcaactttggttaatatacataggctacagtgaaatccactattttgttttttatttaattttttttaatgtgaggcctcattttgtgtttcacatcggggacttgaatttttaggtatatgactgtgggaaaatatacctaccaatctctttagacaaatctatctaaataatttagccttgtcccgtttgtcttttgtcttatcagctacaaccaaaaattgaattttaaaacccaatatttaagttgattgtgagattttttttcattatagtctattaattatattaatttttaaatcactaaaaacataaatataaaagttttacttataaattactatttttggttaattcattcgattttttttcatggcttatcagctgtagaggtatcgacgagttacttaatttctaaaatcaaacaacctattacatatctacataaacacccacaagtacatgtaaaaaaacatacgaggttatgcctcggtttgttccaaaaaaagcaggaactggaagcataggggtaagctctttatcttgcaccatctatatattgctggcaagaataaatgtatatatatttttactatttattgcatagtaaaaaaataaatttatagacaccacatatgtgcatttgcatgcatgcggtggctgctgcggttcgtcttcccttttgtttttctccgtcttttccttttgcagagtttcagtgcgagcaggagatgctactagtgcctgctgctgcaggctccatctatctttcttggtctcgggtaaatcctggccggatgcgtctgtcttcttccttcaccagatcgatcttcatcgcggtatattgtggtaatattgccgcctgctgcaactccccaaccaatggcgaagcctagtcaaatattactgtatacattactccatatttatatttcagtgggatcatttctctagctaacgatgttattactatgtatagaaaaaatatgccaattagtaccactataattttcttgataagatgaaataatactgtgttattattaataaataatgcatatatgaggaaatagatatcgtaccacagcgaaattcttgccaaatacatctgcaaacattgtaaccaacaatgcagggctctgcaatccccagaagcctcatggcccaagtgtgtttttttaagaaaatgatgccccaaacccaaatacagatttccatccgctgttcaatattttgacagtcccatccaaggtacgcgggaattacccaccataaaattatgttaaacatggataaacaagagggtaaaattttttttgcaccggcaaaaatggatgttctattttcttatacattg

SEQ ID NO: 65103 - DNA, 19091 bp, Oryza sativa
agtgttaacctgtattggggatgggagaatgggagctgggagggcggccgactttggcgcacacgacgggagggaggtggccggcgacgcccgcgcggcgggaggggcggtggccggcggcccgcgcggcgggaggggcggtggccgccggcggcccgcgcggcgggagcggccgtggccggctgcccacgcggagggaggggccgtggccggcagcccgcgcggcggggcgacgcccgcgcagtgggagggcggtggccggcgccccgcgcggcgtgacggcggctggacgacggcgcgtggccggagggcggcgggaggatgcgtcgacggcgcccacggtcggacgacgccgggacgacggctcgcgtggcgggaaggcggcgggacggcggcgcagtggccggagggcggcgggacggcggcgcaggactgcagcccggcggcgcgcagaggccgctcacgtggagagatgcgggagaaggaaaggggatcgaaactagttagggttggaaggggcattttagtatttcctaaaaatactgacaatacaacacacggtttgattaacatatctaacggaaacctgacgggaggggcatgggaggaatcaaagcgaaatttcaagggtagggattgggtaaaattcgagggtatagaaaggattaggtgagttttcatgggcacacaagggattttctcgtagtcgaaagccgtgtgatgttgtttccagctgcaagtcaaatccgatactactattcacaaagctgatagttccccttcttcctccctgtgcttttcccctttcctttctctgatttctctcaaatgaattactgttaccagttggtgtgattctccagccgaaacttcaccaaccaagcaggaatggcgctcctgctgccggagttcgacccggcggacgtccgcgccggccgcgacctcatccaccgcctcaccgccgacgccgccggcatccagcggggcgtcctccgcgagatcctctcccggaactccggcaccgagtacctccgccgcttcctgggcggcgccgccggcgacgacgacgacgtgcgagacgcattcaagaggcgcgtccccgtgtccggctacgaggatgtcaagccgtacgtcgaccgcgtcgcgtccggcggcgagccctcctctgccctcctctgctccgaccccatcacctgcctcagcaggaggtaaaatttccgcaaatcgggggcggcgttgctccgagttgggataaaccctagctctttgccctcactcacggtaccatctaatttcaatgcgaacggcggcagctccggcacgtccggcgggcagcagaagctgttgccgtccaccgcggaggagctcgacaggaaggtattcttctatgctgtccaggcgctcgtgaggaacatgtaagagcatgactggtgtggtgctttgctcatcattaatcaactggcatattcttgaatttctgtagcaattaacttgctcaattaatatactatattttttgcatttctactaggagcttgcacaccgatcatggtgaagacgacgacggcggtggtggcgagggaatgtacctcatgttcgccttccacggtgaccggacattgtctggcctgcccatccagtctgctctaactacctactaccacagcagacagtttcaggaatgcgacattggcgggtttgataagtgcacaagccccctggaggcaatcctctgcccctatggcgagcagagcatgtactgccagttgctctgtggcctacttcaccgatgcagagtggaccgtgttggtgccagctttgccgctgggttggttcgggggatcaagttcttggaaaatcactgggaggagatgtgcttcaacatccggagcgggcagctcagcgactggatcacgcatactcctctgcgtgatgcggtcactggacagtatcttcaaggatctaacccagctttagccgatgagattgcatccgagtgtgcgaggaaaccttgggatgggatagtcaggaggctatggcctagggcacggtatatccggaccattgtgactggttcaatgtcacagtacattccaattcttgaggtttatggtggcgggctaccgttggtctcaccaatctatgcatctacagaatgcgctgccgggataaatctgaggccacttgatccaccatcccatgtgtcatatgcattgcttccaaacattgcttactttgagttcttggaggtcatggatgaaaatggtgaaaaggtacaaggaactaccaggcttgatgacaatttgggtgaggtaaaagttgttgaccttgtggatgtcaaagttggtcgatgctatgagttgattgtcactacctttgcaggcaagctgttgggctactttttatcccttttttttcagacatggctaggtttatcttatatctgatcattgaaagctctcatcgatttcttgtagctatgcttgcaatcataatttgtgtttcatcgcatttttcaaaatcagttctctccaatgttaggtaaatttattgatatctggataagcatctttcaagacccatgacacctatttaagtcctcaattagcttgtgaatgagaagtccgaaattttatatcctgttatatcagctactatacgtttattatattcaggacacacatttagtggaacaatgcaaatttcgaataattacttcagatcccatggaaaaggcaaaacctaccatttttttacgaaatagcataatgtctgctattaacttcattaatggaggagcatacaaaaacaaggtttaaagttacaagaaaaagatagcacttgaaagttgaaaactcaatcataagtagaatggaccaagaaaaccttagagcaagattctccattaacagtagagcaccatatgagattgtttttttttttctttgttaattgtttccccctcaagttccattacttatatgtagtcctaatggtctattaattggattttgcttgtgtcatcctggctttgttttgcttgtatgatatcctatatttgtaagacaaattttgctacaggacactcaaagtttgtgtaatttgctggtggacatcgtaaaaacgtgccaccgttgaagaacaccctaaaaaactagtaatttgttagatgacatttccagtctaattggggagaaaactcttcaagaagacgagaatgcccatacggccacaagcttctaacctgttgttggagtgaaaatttggaaattatacaactctcaatatccaatcatcccaagtatattccaagcatatctcatatttcatcttcactctagcgctaggttacaggcttgtggctccaggggcattctcatcatttttctctccaattgggctagaaatgtccttgtggcaaattaccagttttttggagtgtcgtctagctgtgacacgtttttgtgatgtccaccagcaaattacacaaacctgtcctgtagcaaaattattgaacaagggtagattccaacattttagaaaaataggattctgaatcagcccaggtaaacaacatcctgtattttgactttgtgacttgtgcatttataataggtctttacaggtaccgggtgggtgacctgtttactgtgagtggcttctacaatgcgacgccattgtttcacttctcaggacggcatgatgtcatcctaagcatagattacgagaagataagtgaggaggaccttctcaatgccattgcagaaacagataagttccacctcaggcctcttggctacatgcttgttggtagcactgcatatgcagacatatccactttgcctggccactatatccttttctgggagctgaccaatacctgtgatagcaatgttgccattgacatcgaccaaactgccatggagaagtgttgcttggcagtggaagaccacttcgatgaaatgtaccgcaaaattaggcaccgtggctcaatcagtgcgctcgagataaggattcttagccatggtgcgtttgatgctctgatggacttctttgtgtctagagggacatcagcgagtcaatacaaaactccgacagccattcggtcgaaagaggcgatgatggtattggaggaaagggttgtaggaaggtttttcagccaagcaactcccagctgtcgttcagccgaatttgagaggagataataattgtactgcctgttcggttggcgtctcggtgacaggagagggcatgttccttatgaaaagttcagtcctgatcacgaataagtggcgcagcattgcaattcgtgcactggagaaggatgatccactcatctccatcttggcacgtcctttttcagtctggaatttggtctcaggagtatcatttcgtgttttcttgtaaattcagaaagaacttctgtactgctccttccacatagcctttgggcgtaactgtagacacaacccttgctccgaggtttataagttacctccgaatttactgattgactgtgttctcaagtccaagtttccaacctcactatctcgtttatctcgtttactgtgcgcacgcttttcaaactgtttaacggtacgtgttttgcaaaaattttctatagaaaagttgctttaaaaaaccgtattaatctatttttaaagttttttaagataataattaattaatcatgtattaatctattgctccgttttggccgttaagctttgcagcaaaaatgtgttacttacgttcctgcaaattttcgtatgaacttgttttgccaacttcatattagaaagagagatccattcctttttttaaggaagaacaaaaggctgtttttttccttcgctatattactaccttttgtgatcaaaattatttatggcacgtacatttgcttcgcctcattagcatatgcaacaatccacatatacaagctttttaaacaggcatacaaagtcgtgcaaagcgcgactatttggctagtatacagttggaagtaaaagagaaaaaaaagggcatcgcttatgtgctgcggggaaaaaaatgaatattgtcctggtagagactaacttattggatcctttctgcagccaatacaccatttctgctgaacccgacataaacacgatggacgtgagaaatcaccgtctctgtcttctgtcggaccctgcccacaagctcttctgcagcacggtccagagtgagctcctcaagagtcctgacatgttcgataccgtagggcaactgcttcaggtttggacagaccaagagcttgaggtcagttaggcttgccacagctcctcttttcatctcgatttcattcaggtgtggtgcacctcgtatactgagctccctgagcctgggaaatgagttctcatggaagtatatgttcttcccatcataagcatcatagagttgtagcttcaccaaatgtggtaacctctcaagattaaggaatgtatctctgtcaagccttgatcccacaagacgcagagacccgaggttattcagattactcagtgacatgaagtgacatgaagtgaggcagtgattcctgagacaatgtacctttcaagtacagcttctgaagtaatggagggggtcgaagtgcttcaagattcaacacttcttggctgctatctgcctggatcccgagtcgggtaagatgaatcatattggtgatggccaagaacagatgttcacagtggcaacagatattgcttgaaatgacagaaggcgcccaatgcatacgatcgcaattggcaagccatggcacttgtcaacaaaattttgtgccaattggagcaattctggtggacaatccctatttccattcttccagaatgcctctttacagaacaaatcccatgcatgggactttaccaatggctgcaaattaattatgttcgtctcaggtgcaagcaatgccacatcataattccttgatgtaagaattattcgtccaataatattggcaccaccaaatgcatccttgctatcaaaccaaacattcgtactccacacatcatctagaacaaggacataccttttgttctcaaggtaagagcgaatcgtctcgactagccttctgtagcttgatgcaccttcgtcatctgggaaatctttcttccggtcgttcttgcgaaactcttgaacagttgttcttagcagatcatccgcgtcatagctctgtgacacggtgatccaagcacaggtgtcaaagtcatccttgacagcattgtaaacatttgcaaccagtgccgtcttgccgattccgcccatcccccacacactgactatcctgtgccgctgctgctgctcatcttgcacccatctcatcagcaaatctctgttcttgtcaacaccaacgaggtcatcatccctcttgaagtgcacggagtctgatctccagtttgagtttgagctgcttcccaccaccgacttcacgcctctcacgacgacgcccttcagatcatacctaatcctcctctcggcagcgcttttcaggctgaccttgatgtcctgcaggtttgcggccaagcgagaccatgtgccgatcttgcacatccgcttgaatggcatccttccacctccttcgccgagctggtaggtgaactcgtcgacggcatcctcgatgccgaaggcgagcctcctgatttgcttcacgaacgcggaggtcgtctcgtcggcgtccttgaaccgctcggccgcctgcaagaaggcacggatgctctccagctcccccttcacatcccggatctcagagaagaggcgcttcagagctgatccctccagcccgagcaacgacttcgcgagctccactgcttcactcgccagggtattcccaagtttgacgattagtgagcccacaacaccctccgccatggcttagctagcttgagctaagctatcgttgggagttgaacacacatttcttcagtgtttcttcctgcggttggtagctaactcatcttgatcccttgtgttttttttttccaagaggaacaaccgaacaagctcagttgctcactgctttataaaataatccatctctcccaaaataaatcaacctagtatgggatgtgacccattttaaaacaacgaatctgaacaacctagaataggttgagttattttgagacggagggagtaaggctgagttggacagcgctggtttcggaccgtgcaagggccggtttagtttccaaacatgatttttcacgctatcacatcgaatgttttggcacatgtctgaggtattaaatgtagaaaaaaaacaattacgcagtttgacaggaaatcgcgagacgaatcttttaggcctaattgcgccataatttaacaatgttgtggtacaataaacatttgctaatgacggattaattaggcttcataaattcatcttgcgatttcctggcagaatctgtaatttgttttgttattaaactatgtttaatattttaaatgtgtatttgtatatccgatctgacatgtattggtaaattcttttgccaaactaaacaggtcctaattgaggttggtgtcgcgtaaagaaaaaaaaggttggtgacccgtgtgcactttcatgtactgtagaatcattactgtagatgtcggacggaaggtacaccgcgcacgcatggcgccgtttggtcagcagacaatttccaaggctcacctattttataataaggtaaaacagtttattagaaaaaaaattattttattgataaaacttttatatatttattcatagcaacttaaaggttaacgttaaaaaaattatgttaaaaatatctaacgatcaactttaaaatcaaattttagctttttttttctggtttattagaccaaggtggtgtttagatccagtgacttaactttaggccctgtatttagacactaatttagagtattaaatatagactacttacaaaactaattacataaataaaagttaattcgcgagacaaactttttaagcctaattaatccataattagagaatgtttactgtagcatcacatagactaatcatggattaattaggctcaaaagattcgtctcgcaaattagtccaagattatggataggttttattaatagtctatgtttaatatttataattagtgtctaaacatccgatgtgatagggacttccatccaaatagggtccaactgatgggatctcccgtcaagatgcgaaggagccttgaagaagatggcgccattgttctaccatcgcaaagcacatggaatcagctagttacaaaaatgcctacgattactaaggctgggttcgttgaaatgggttgggaacccatctcctgtgcatggaaaacgaagcagtccattagcacgtgattaattaagtattagctatttttttaaaaaatatgatttttaagcaactttcgtatagaaacttttttataaaaaacgcatcgtttagcagtttggaaagcatgcgtgcggaaaacgagtcggagggagttgggaactactctctccgtcccaaaaaaaaactcaacttccagagtttggggctgattggtacagcactaatctcgagacgcaagccgccataacaagttttacctcttgttgaagatcgaaaccgatgcagctcaacccgaaagcaagaactcgttgaagcaaaacgaaagtaaaagggtggcgatgcgccgagattgtattgaacgtgtattagtttgattacatggggctctggtctatttatacccgagaattacaaaatatgtccatatcggatacgactcttatctctaacaaactctaagataccataagtctttgcggcagacttttacccaaacatatctctaagtaaattacataaaatatcctaatcaatagatacaattgccttcttaggactctatccatgcgtggcaatcatcatgaagcacgttaacctaacccgacaacatatgccgtgtcatattgtcggattcggctcaatcggctaaccctgtccgactcgaactatgccgatcttagtcgtagccgattcgaacttcagccgatcctcactctgtttccgggacaatctctatctcgaactccgtctcgattcctcctccacatccgattcttggattaccaaatttggtcgttaacacacatcccttgaaagttggagcaaatgtttggagatagtgttctccaaaatcagcatgacgtaaatggtcgtcgtttttatgtaacccatcatcactttgatcttctagctcgtcgtcaatgcccaacaagtcttgtgcatgtgtagacctaagtaataacaaagttcttgatttatgtagtatataattgtcgtcaatattgaaatatgtttcagctaggagcaagttcacctcttgttgtagtttatttgcacggctacatgtgattggtccttgaaatggtgtacggattgtctctcattagcggctatgtcagatgattgtcttgtgtgttcatgtgacgggggctggggcatatcataatgttataatatttttttaaataatttcacatgataaaaaggatcaacttggtaccgcttgacaaatatataacactaattcaaatctacatgcagggagaaacatgtgatcatcggttttacttattatttagaaaaagtcagaaaaataaagtccccaatacctcgcccttcccagagcatgcacacaacactgaatgaagtcccctttggctcaggatcttcacactccactcctcccctcttcctaccttttatctatcaaattaaaagacaaactatgaataatattgaaaaacccatatttttaagctatacatctaatttctaatctaattgttgctctattaaataattaaaccaacaattcatgatccataatggaacataaaataaaataagagttgtatgaagtaaattagaaaaatagaaaaatgtcaatatggattgaattaaatcaattgggcagaatacaataaatttgtaaaaaatagttattacttttcacaaattggaacaaccaaagtgtatgttccattgccataaccatgtttaagtgattagatgttaatgaccttccatctatgctatatatcatggcattatgagtttctcaatgtattattgcatatataaaacacataattggttaaaaactcatatatgatactattaactttaaatttaggactcatgttgactaggtctttttttagaaaaaacactatagatcacatataatagggaagcgagttgcacaatatgtatgtctcctacgaatttattgacaagttttttttctagaaattgaagaattactgataattgtttatagtaataaattaaatattatatagttcaaaccttacaaatatcatgtaaaataatatctgagcaatgtagatggagaaaatttataaagaaatagtactttttcaagcatgaaatgtgtcatctagtcgatattccatcttacaagttagtcaagcttatccgactttacatttcgcgtgtgctatctttctagttaatcttaacatatatatgtgcaccattcgtaagtcataattgaaatcctaaaatcacgttattgtgcttcctctcaattgtaatattaagaatcaacgtgctcgttaaagatgcaatggaaatggtttaaaatttcatgttcaaaattttcaaaccatacacgatgactttaaaacgatggcaattcatttcgacggctaggggtgcctgtgattttggtggtgtttgaatcccgagactaaattttagccccggtcgcatcggatgtttggacactaattagaagcattaaacatcgattaatgacaaaacccatttcataacctggactaattcacgagacgaatctattgagcctaattaatccatgattagcatatgtggtgctaaagtaaacatgtgctaaaaaaactaattgcacagtttgcatgtaaattgcgagacggatcttttaagcctaattacgctatgatttgataatatggtactacagtaaacatttgcttatgacggattaattaggcttaatagattcgtctcgcagttttacatgtggaatctataatttgttttgttattagtctatatttaatacttcaaatgtgtgtccttatacatgaaaacgaaatttgaaaagcaactaaacatggcctttctctgagaacagaggataagcctcctctacaactgacgagacaatacgagaggtgagtatataaagtactgaacaagtgtacggaacaatccactatatgatagaacaaagaaaggctaaggatcattttgcataaattgcattttattactacaaacttataatacgagggcagtaaaaatagaatttaaataccagaaagtaaatacataaacgaagttatgaaatttagataaaatccaacaaacccaacatattaatttatcctgcacacacagatcactcccaaaaaaaaaattcacaaatctatctctcatgtgaaatcctgagtatgtccataaccgaagacgcggctattcgaatggattgacgccctacagaggttatacaactttatctacatgatacagtttggtgccactaaacacctaagagtaaaaattccgctacctcaccctaaacactggcttctctcacggacggtccagtttttgaaacatcggtatacctcgtggtaaccgcacagttttcacaataaccgtgaaaccgtgggctggcggtaaccctcccaaaaatggtctggagaaccttgcttggcatgcgcttatgtttcgttgttgatgatcaacgaatgattaaattcatggtggatgaaaagagtaaataatatgggattaaaaggccgatgctggcattgatcgggagatgtaaagactgatgattgatttgctctcacttttttcttaactgctggtggatgggattgaagcagcaggtatggcagccgttgggtggcatgtgcgcgtgaagggaaggcgcaaggtcaaaaaaatattgttttatgtgtaaatttctaatatcacaagatttttactcatattaacatgcaacattcgtaagttataattgaaatcctaagattggaatcatgtttagattgtgctttctctcgattataatattaaaaatcgacgcgctcggtaaagatggaatgagaatggtttgaaattacacaatggctttaaaaagatcgcaattcattgcaattcatttcgacggctagggtgcctgtgatttgagatgaattttgattttcgaacaccactaatgacaaaaaaaaaaaaccaaacgaatctcattgttataccaaaagttttgcacttgcggagttgcagtgggcactgggcagtgccatcgtcctctccgataaaccctagagcgagatttttgccaaaaatccccaaatgcccctcctcgtcccctaaaccccgccccgccgccttcctctctccgccatgcttctcctatgccccctcctctccccctccgccgccgcctcctccccgacccacccctccccgccgccgcccgcctttcccgctccgaaccctttgtctcctcctcctccgatgacgacgacgacgactcccccctctccgcagatctcttcccgcgcgccggcgcgcccaccctcctcaccgtcgcgcgggggctcgccgccgccgacgacccggtcccctccgcgtccaccgtgctcgccttcctccgccgccttccccacgacgcctcgccgcacctcttcccccacctcgtcgccgccctctcccgctcccgggggggcgggggcgggggcgggggccccctcctcgcgctccgcctcttcctcgccccgctccacccggccgccgtcacccaccactccttcaactccgcgctcctccgcttcccgctcccgccgcacctcctcccgcccttcttctcccgctccctccgacgcttccccggccgcctcgcgcccacgctgctctccttcaacctcctcctcaagtgcgtctgctcctctctcgtcccgagggatcccggccgctacctcgacgtcgcgctgcggatcctccacgagatcatcccggggtgggatctcgcgccggataagttcacctactcgacggtggtgtccgcgctcgccgatgcgggccgggtggatgacgcggtggcgctggtgcacgagatggtggcggatggggtggttgcggccgaggcgtttaaccccgttctgagggcgatgctgcgcgccggggatgtcaagggagcagccaagctgtttgggtttatgcagctgaaggggtgcgtgccgaccaccgcgacatacaatgtgctggtgcatggtctgctggtgtgcgggagggccggggcggcaatgggggtgatgagaaggatggagagggagggggtggtgccaggggtgatgacgtacggggcagtggtggatggactggtgagatgcgggagagtgaaggatgcgtggaaggtcgcggaggagatggagaggaacggtcttgcatggaatgaatttgtgtactcaactgtcataacaggattttgcaagtctggggaaattgactgtgcgttgaaggtgtgggaggcgatggtggcaagtccggtaaggccaaatgttgttttatattcagcaatgattggtggccttgccaattttgggaagatgacggaggctgaattgttatttcgagagatgattcattcaaaatgtgcgccaaatatcattacttatgggtcgattattcaaggatatttcaaaattggagatacgtctcgggctctttctgtctgggaggagatgataggggctgggtgcgtgccaaatgctgttagttacagcatattgatcaatggactctgcaatgtagggagattgaaggatgctatgatggtctggaagcacatgcttgaccgtggctgtgcacctgacacaattgcttatacttcaatgatcaagggcttatgtgtttccggaatggtggatggtggtcttcgattattttatgacatgctggcaagtggtcatgctgatccagatgtcatcagttataatgtcctgctggatgggctgctcctggccaaggacctcccacgggcaatggacttgctgaacaggatgcttgaccaggggtgtgatccagacacggtgacatgcaatattttcttgagggagtttggagctggagagaggaaggggagggagttcttggaaggcctggttgtgaggctatgcgacagaagaaggaatatggcagctggagaggttttaatggtaatgctggctaagtacattgtgccagaggctcccatttgggagatggtggtcagagatgtttgtcggaggaagagggtttggagagtgattgacaaatgttgggatgagatttgggggccttgatgatttcttcctttatgatttttcattcttgataccaaaggagcatggagctcacatactggaggttcttgacactccatttgttgtaagttgtaatttgtaacactgactcatttatttctaacaagattttgactaaataaattgatttctatacaccattgtgcttgtcgttgagcatcgaacttcccttttgtcctgatctaaatggtgtaaagtgtatacattgctgtatgggaatgcctttggtggaactttatgagtctgtcacttttttctctctctgattggcctcgccgcctactttatgatttatatcccttcttcatagaagaaacgggttgcttgggagttataacaaaaatatcatgttaaaaaattcagcgcaactattatttgttttgtctaccaaataaatttgtaaaatataagttagttctatgtgtaacaactttgtaatgtccatgcttttgttatagtaggctttgtaattttcttgtcaattctctactgcaagatatggtgccttcagcttattttgacatgccaattgattggaatgggtaaacaaaggtggcaaatatattatcattattcatatgttttttcaggagttgcactttggcagtatgggttttatcatattctggatttcatcctacaagtaagttatctatttttgtttattctgcctcattcaatcagcataagtaatgccctgtagtttggattcaaacgtttcgccttaatccatgcgtttctttcctcagacctgtgcactgtttctcaccttttttgacagttactacattccaaagaaagacatgtgggtgcttcagttgcattgccctggattccatcttgctgatggtcgaaaatcatacaagtgaagtgtttttagagcttgctgttttacctatttgaaattctgaaaggttttatcccttagttacttatgtaattcctatcaatggtaaatttcttactcatggtttacaggattttacattggactggttgcagacagtgactcagtgagccagtgatgcgaggagcattcctgaaccttctagttgctctttttgccttggaacgtgacaatgtgtcagaacctgaaatatataactgaatttcttagttcatagtactataaaagaactacaccttgtgctttgtatggccaattcattatgacagcattttaggagtatagctatggcttctccagcattcttggtttcagagataactatacagtgtctctttttcattgacatgggtcttcatacatttgtttttggataccagagacatgggtcttcatgatcagatcctcatatttttacttaatatttcaaaatgttagtggaagaactgctcatgtgcaagaattattctgaatatctatatggatgtaactagttattgtaagatgtaagtacttacctgaggaatagtgttattggagataaattgttcattattacagatcctagctgcaatatagatttcgcacggaaacacagtgtggtacaaagatttattttgtatgcttcagtacttcctaaatatcaaatgattttggattgcagtgatttcgaacttgcttgcctctgttatttgtttcgttgttaacaacatgcttgaaatttgttttgtggttcttataatattcccaatatattgaaatttgtgctaccctgacatgcccttttgtggtaattcatcaactttttacagagaattctcatctttaaataagaggataatttctgtttgtgaaactttttgcatccatagattattaatttctgcttgatatatatgagaacagcatcagataaaacaacaaagtcggtagtatctgctgaattttgatatctgaagtagatcaaatttatctactgctgtattgcgtgcttgcctagattagtttaaagcaccatttggtgcgtgcagatctctattctcgctaatcgctatctttcattgctttagcagaacatttattttactataaataggctgctctggcagttttgcatatatgctagaattaccaagacattgctgtgatccagtactagttctaacatactacttaattagagcctgatccttctgcatcactagccttcattgagaaatcatcttttgtgctatgccaaactattgaccgttaatgagattgtagtttcttgttttcacatagtagatattctttctgaaaacttgaaaatgtaccaattatttataggtatttattgagttgtttgtgcagggtgaaaataacatgaactgctttattgtgtgtatatgattctttcctttaatcatgtgctcgtgatttgatgtggtcgacactgattgtagaatggctcaaaaagatggcctgagcgatcttagaaatttgtctcctcatgttcttgtgagaggcagttttccttctgtgcaaaacatgattgcttcatatttccaacacgctgctctgtctttgcaggccatacttaacatgtgtgacaatattggcggtaccttaatcgacatgaatggacctctgcctatggcatactaaatggtaacttgccaatgcccttccattttttaagctgataaaatcacagaacttctcttttttgcttttctccgagatggatttcttgatttgagatatggtgctgcattcactaatgtccagatcatggtggcactgcacataatgaactgccacggtttgccttcagcggcgtcgtctactcatctgtgtgcttcttgtgagttgtgaagcatccatcctgacattgcgccatatttcgcattgtggttattagtaatatagaagaaaaaaggtaagtgaatcgatgaggatacggattgtttctggaaaaattttacactgtagcatgttcagccattcaggatcattccgagttatatcatcttccaaatgtacccacatctgttgtaggaattttacaggattatgttcaattcctccaaaaatcattttgagtgtccctttgattcgtaggaaaagtgtaggaattttagaagattccaatcctatggaaataattcttatgaaggcctttgaaacaaatgattgaatcatatcctatcatttaaaatttctatggaaatatggaatgagtaatcctatagagattttggaagaaagttagcaagaggtttaatttcttggaaaaaaaatcattcgagtttatctctctcatccgattcttatatttttcctgtggtctaatcgaacggtcattcttgtgttttctctgttactctattttaccaatcgtgcatgaattcaaagggtccctaaggttccaccatccaaaggaagtccttaattgattctcttttatcgtaacctttctgttaaacctcttaaaagttttatcctcattttcattcgttctgctgcaggggtcgcagctcgtgcatacagcattcggaggagcaaggttaaaccgttcgatggaatcatcatggaaattaccagctttctgtatcatcatggaaattaccagctttctgaataagcagaacatgaagtctacagttgtacggtgtacttcataaagtcagaagctgcgtatcgtttgttaggtacagtgccatgtcgaggcatttactaagaagtggcccaggtcaacactgatgagagctttcttgaaaagtggaaacgcgatggttactccttggccaaaggaccgttcttccatttccatcacaagaacggcgccaaccatggagatttagctctcgagtcatgtggactgccgtccattttacaatggacggcgagcccttcgtcgatgccttctgtggtctgaaatacttcatgccctgtcaggttccccaaattatctgaattttggctgtgtacgatccgttttggatgtagagaccggtttaacccatttctttaaaaaaactgaattttgattactttcttttgggttcaaattatggtttatatcatctagcttttctttattgcttttgagttaatactgattggcttagatttttttttttcttattactcatgacacgtgattgatgtaacaaaagaaagccaacgctaaagaattagaaaacgattaaagaaacacctagacaaattttaaaatgagttatagaattcaaatatgattctggcttataggttggcgagctgacaataatggagagcgtatttcaggtcacatttttggatggccattatattctttccatgtcgaaggtgaagataaaagctcctgaccattccaaacaaatccagcgaggcatccaaatccaaccagtcaatcgattgtcccccactgcaagtactcataccagtacactacaagctgacctaatgaccatgacttgctccttcacttgtgcttgagtcaaaccatcctgcacctgcaatgcaatttccacggcagttacacgatggagacaggccaaaccgaacatgccagcctaggcacgtagtagaagaacaacggttctttggccgtgtttagtttcccccatattcccaacttttcatcacatcatatcacatcaaaaacttttctacacacataaacttttaactttttttttctaaactctcaacttttttcaaacttctaactttttttcaagga

SEQ ID NO: 65104 - DNA, 1862 bp, Oryza sativa
  unsure (1)..(1862): unsure at all n locations
atgcgcccaagtgtccttctcaaattaatccgttaattaattgactaaccttttctctcttttttttttccaaaaaaagaagagtattgcattctacaaagtacaaacattctctttttttaacttctaaacgatgtattgcatgtagaaccttttcttatatagaagttatttctaaaaaaaagttaatttaaatctgttttttaagtttatataaatcaattgagtagattttcagtaaaccgttcaacctatataacaggtattatgactggtgttatataaaactcatttattatggttttataaaaccccgctcctatatatatatgtgtgtgtgtgtttagcacacatttacttaagtttttaaaatataatctatatggaatttttaattgttgattttaactacgatttaactcttcactactttcaatatttttcacatatgataaaattaattacagtttgaataaatgtgagatttaatggaatacttagaccatgaaacatgtggttatatgtcacaagttataacaatatggctttctaccattttttaccatgaaagtaatgatttctaaaatttattactttaattaatactcagttaattatgtattaatgaattttcttgtttcgcgtgccgcttaaaatcccaaccaaaccttacgaacgaacgcagccttaattaactaattgaaggatcaatctaacatatgatttgatcatgattttgttaatcggtattatgatcatctggttacatctagatataaactttagcatttaaatcaactaagacatgtacattctaaatattgaagagtgttccaaagcgtctaaatcgaacatgtatataatattaaaatccagccacacaaatacacagataccgtgccagtggttatatttaaaaggagagaataattgttctgaacctgaactatatattctaatctggaaatgagacagtggcttacaagctattntagagaacatattctctaaatctttgtaaattcaactaanagatggaaagtatccatacctgttaacatgaaaaaatcatgtcaatattttcacaaactgaattacatattttggcatcattttacggggcattgtagtataaaagaattgcactggccatggagtatcaagaagtcatttcaacttctggccggttctttctctaaatctcgaaaaccgcacaatgaacctcttgagggctcnntgaagctcttctacgcaatcatcacattacatgctagtagatgtttatgcacgatctatttctaggatgctctcaaattcttgcataagattcagaagcagctactagcatttatctttgaaatggaggtaccaatcgtgctctttcaaaaaagatacttcctcagttcctcttgcttgattcatcgatcaccagccgtagcatctaattaatctagctttcttcagttgacttgcagtaccaatgccattcctcaaaggatcaacgtgtcgcctccatgaagaacacatctacctctgaacccaaggctggatgatgacgagtcgacgcagctgctcttgcctcgcagcctcgccggattgtgtgtcaccgaaccatttcctatctatccgtgccatctcctcctgcaccgagggcagcatgaaggcttgctatatatatgtcgtgcacaatcggcgatcctatcggaaatgcctgaaagaaacacatcacaaaattgatcaaatcttgttcactaacccagtaaaattaactggagtagatgatgaagtattttaacagacgagagagacttacaaatccgaagcctcccaacctgtaggtcgggccaaccatgctgtaacct

SEQ ID NO: 65105 - DNA, 27850 bp, Oryza sativa
caaatgtgccatacctcatctcaataatcttttgtttggctctccaggcctttgcatagcttatggtgtacttgaatttgttctcgatgtgcctaataattgattttggttcaaagccaatgttaccaacaacactgttgtacatctcacttgccacaaaagctgaagtgatgtttcggtgatacttctccaccccttgtaagtagcacttgtgctcggtcacaatgctaactttccaataatcatttcatttacccttatatgcatggacacgccacggacaatcttccttcatgcacctcacttcatacacataatttgttgacttgaccaccctaaactctctctgcaaggaaactgcccaatgcttcaccgcctccttcatctcatccttatgagcataccttgcaccgtcaattacctcgttctccttatactcccagggtacatgatcaccctctgatataacaagtccagagaagtcctcatttgcccaatcagtggccattacatcacctttctcatcggatgatgcgtcgtcgtccgcttcctcattatccgaatcttccctctccatttcatcaacaattataccgactctctccccctcatccgccatgcccatggcctgctcctcccttggttgattttcctcattttgcatcgatggtccaacaacatcccctgcattaataggaccctctacatcttcggtttgcattgaaacatttatatctttctcttgtaccgacacaaatataacgaggggccatgaccgttcaaaagccatttccacataccgtctccaagcagcagtgctgtccatcggcattagttcccaaaaataaccttctgttgcacgactcactacaactgatactgacattgtgtagacttcttggtctattctaaatcctctcaacaaccaactataaattgactgaaatgttctctccgcaggcctatcgatgcccttagatgtcattacaaaatctgacagatcaacaccatctggaccaaatctaatatttccttcaccgtgaactatctgaaatgtgaccttatttgacattgtgcttgatgaaaacaataactgcgttaacctcgcatttctgtactacgccctaagttacattctctacaatattgttctccaaaattctaaaagtaggttacattctccagatcaaactaaactacatcttacaattaacactactgtctatgtctcaattcatactattatattctatgctctagatctacacatatgtgctgtgtgctacagatatgctaaaatatatggaactaaaactaaaacgcaacatatatactcaaacataacatattagtacaaatgcaaaagatgtatgggagcaaacctgtgatgaagtgagcgaaccagcagggcttcgccgctccccttctgctgccctcccctctctctctttcgttttttttggatttttagtgaatataatgaaatttcagagaggggggactgggctttatagggggaggcaaaaatcgccctcccccagggcggcaagggggccgcctgcaaatttcgttgacggccgtcgcccgagagcgaacggccgtctgccacgtcattttcgccgccctctgggatggcgatttttaaaaatcgccctcccagagggcggtaggcgaccacttccgtcaattttcaaaatggaaaattatttttgtaaaacttttaataaaaaaaattaaaaataaaaaaaattccgctctccgtgcccaagccacgccggtgacagccttcactcctacctcatcctcctccaatcaggcatgccaacgctctcaacttctccttcatggcagctagctaggcttcaagctggccactctagtcaccatggcgtcactcaccgagctcccctcctggccactgttcctcgaccccgagctcacggcctcaatggcgtcctgccatgctttgttcctgcacagttcttgtgggtccaatagctgctcactagcttcccattcgctcggccttggagcgcgtgtgtagtcggcgacaaattagtcgccggctcacactctctctcctctaatctttcttccagctcaccaaagaaatccaccgtggatgcattatcaccagtcagaatagcttattgtacctgctctaaagattcccacgaccagtccccacgatagttgaggcccaactgctccttctactgactctcacgcactaattactactccacttacatggttttctcctataccgaccgcaacgtacacaaacctccatgatgccgacgccgacgacgatcatctgcctcctcgccttcctcgccgtcctcgccgccgccacgggcgacggcacgacgacgacgacgcacctccacttctacatccacgagacgttcgcgggcgacaacgccaccacggcctccctggcgccgtccccgctcgccgtcgccggcagcaactcgtcgttcgggagcgtgggcgccctggacgacgagctccgggagggctcggacgcggcgtcgcggtacctgggccgggtggagggcctcgtcgtgcaggccgacctggggaacccggcggcggcgtggacgctgctgaccctcgccttcgccggcggggactacaacgggagcacgctggtgctggacggccgcgtcgacttcggcgccgccggcgacatggagcgcgccgtggtgggcggcacggggaggttccggcgggcgagggggtacagcctcatgaccaagttcggcaaccccacgcccaacaccggcgtcttcgagatggacgtctacgtcaccaccatggcctagctagctagcttagctgcattgcagcttaattactttattactcatcttgattgtaattaagtcgtcgttaagctcggccattctggcccgtcgatgctttcaactagttcgcaattgcattgcatgcgggctgtgaatttgtgatgtgttctgaggaaaaaataaaaattcgggattttgttttttgcgtccagtactcgtcttcgtcgaaagaataacgagaatgttgaagcaaaagtgtgtgaccatgcatggaaatttctttacatgatttcacctggttagtgtttgccgttggtggtcggaagcattttaagggcaacaggatatcgctagttagtgtttacatggaaatttctttacatgatttcacctggttaattagtgtggacgcctctcctcttatgtgaactgccactaaaatgtgggttcaagagctgtggagtccacatgtcagtcaccacgtccctctgactttacgtcaagggatcccaatccctctaacgtatacttcctcttcctctggttcgataattcttttaagttttaaatacggttgaagttaaagacactataacacggcaaaaaattatattataagactggctctgaaatcgatatcggtagctgaacacaaaataacaccatagaagatttaaacttgatgacgacaccagagtataatactaccatagtatttgttaatgaggttaagccaaatcttacgtccttgggaactgtttatgggtgttccttctcacctatctagcacagtgtattcaaatatcagacacacgacaaaaccattggccagctgtacccacacctatgctactatcaccatgctactacagtaggtgtgtctctctaagcaatggaaaatacagaataaaaattgagggtatgctagactgaaagtctaagtcggtaatgctaaaataagacacataacattatcaaatcaaatgtaacactttcatgattagatagaaaaacatatttaattataaaagacgtacgtaccttgactaaccagtagtcaagtacttcctccatctacttttgataggcatatttctaaatctgaaaaatttatttttgatagacatttcaatccaacaatctagatcttaatgactttctcggatttaatgtgtgactctctattcttccacacaaaattgtctacatgggcattgagaaatataaatattaatgaatcgcttgtttacgaggaataactagtaggatgtttaaatggatgataagtagaattgcttattcttagtctgtgtgccaagatgaaatattactatcaaaagtagatggagggagtaagatgctaattttcttagatctttggtaaagagcaaagtgaacagccacctggatatattaatgagcacatttagtaacgcatgaatggtagaagtaaacacacattaactaaaagaagcaacgtgtcattgcaatttattcttcaggtcgacaaagatactttgcgggttttcaaggcttagaattgcttcatgattgcatcataatcgatacttttgaatatctctagctcagtactcactcattcctaaattgatcatcatataataaaattttaaatttctcaaattgattatcatataaccacatgtacatggatttcattataatacaactaatgcagcacgtgagaatatgtgcatgctaacgtgtgattgatatggtgttttaatcgatacatatattgtgggagaatgtgtacatggtgtcttaattgatgtaatttaaattattcttagtcttggtatataaacatatatgatgatcaatttgggaaggagggagtatattatactttcaaactattaagccaattatctgatatcttatttgcgcagatctgcagtcttgataattttcattgctgaaaatatgcactcaacagagatacaccaatgggcaatggaagctcaatgaaacgatgcaccaatggaaattaatgttctatgcttagtggtcttaagtcttaaccgtcagctgagcaaggcttgagatattagtacattcattaaattcatcagttctcctaacattaataagaatgaaggtttgaagctgacttcttagcaataatcagtcagatgttgtgaaatctccagaatatatctttgcaagtggaacaagcttattaacattgaattttgaggaggagtttcttggatcaaggcaagacatgcataccacaagctcggaggagacttcattgaagtgatgattcatttcatgcaaagttgcatctaagcctgctaatggactgggtttaagtggatatagtgggttggatttcagtgtgggttagctttgggcgggtggaaatgggttgctgcacctgatggactggactggtttggatggagatgggaaatggtttggattggtttagttttggctgcaaaagtttggtcccagattggattcaacccatgggtatccactggattggccccaatcccatcgtctccttgagaagtcgacaaccacatcgccgccatcgctagctcgacttcgtcgccggtggcttgctaccttcctctccctcctctggcaaaccttctcccttcacaaagtccccaaaaaatcaaccctggctccggatcttctggctgcccgcggcaacagcgacggcatcgaaggccgtggccgcggccgccatcatgggggagaagggcggggcaacgtggggcttgtggcggacaatggtggtgcggtggtgcggacttgggggagaagtcctacggcggtgcagccgcggtggtcgcggctgtagtgctcacgagcctcgcgacggtgagtcggtgaacgcgctcgcggtggtcgcggcatcccagcgctggtgaggctccttccctgcggcggcgacgacgacgtggcgcacgggagcgccagatgctcccacgaccctgtacgagctctgcaagctgctcatcctccattgatgccctctgcaagctgctcatcctcccggagctgaccgaaggagggaggaggaagaagatgacgatgcctgttggtgttcagagtaatattgtgcatttcctttgggttggaaatgggttgagaatgggttgaatccatttgtctgcacttggtttggattggtttgggcttgctctgtgagtggattggattggtttggtttctgcaaactatgaattgaattggattggtttagaagtgtactatagatacaagtgaactggggcggttttggtctggatctcagtccattagcaggcttagttgcatcaataacgacatagaaaatgttaacattgtaataatgatattgagtcacttactcaccttgtactttctctgaacagagattaacccataactcaataagatcatccatgcatatttggcacatcaatcccatatcttgcaaacgctctttcacatccaagttcaaacccatagcttcaacggtatcatgatccttccgttgcatagcttttgatatagctcatttgtgatgctgaggtcttgttagggaaaaatttttagatttggttgtcacatagaacatacggacacacatttaaaataataaatatagtttaataaaaaaacaaactatagattttgctaggaaactacaagataaatttactaagcttaattaatccctcattagcaaatgtttactgtagcaccatattgtcaaatcatgacgcaattaggcttaaaagatccgtctcgcaatttacacgcaatatgtgtaattggttttttttactacatttaatacttcatatatgtgtccaaacattcgatatgatagcatgaaaatttttcttctggaagctaaacatgacctgagtaaagatattaagaaatgcatgatgaatataatacaaattcaaagcgctccatcttctttaccaaacctgcagctccaccatgatttgagtgctcacgagcatatccacttacagttaccagaacatccaccattgcctcccacaacattgttaaatttaactcgatgagttgtaccgtatgtccctaaaataccgatcaggtataatctgtctgtacatccctctttcttattgtcttgacagttttttttcataactcttctatttaataatcaatcctattttaaaaaataaaacaaatatattttgacgaggataccttgaaatattttaattggagagcactttatatgctaaaaataaatattctctcccttccaaactaaaactatttgtaccactcaagctttgtttcaaataagtggagctaactctctacacacctaccatttgatctcaccaattacaactatattcttcatttaatttcttaacatacatttctctctcaactaatcacaacttctcataattatttttacctactttgttaataaatacatccacatactctagctagtattttaggatggttggagtatatcaggccaatcccaacccaatgactagaatggtatccatagcattaaataagccgtcacttagaatgaaaaatgatgtggcaaatgaatgaatgaggaaagggaaggaaaccggttcttgcgtgagacatggtttcaacacaacatccaaaacattacgtgagataagtagtattaaatttaagtatggaacaagggtgtttgcattgaaagagtagtgtctaatacttcctcggtttcacgatgtaagactttctagcattgtccacattcatttagatgttaatgaatctagacatatgtatatttttagattcattaacatctatatgtacgtgggcaatgctaaaaagtcttacattgtgaaacagagggagtactagtttcttcgtgacatggagtttatgaaaactatgtatagtgtcttggcttgggactggcctgagaataattgtagcttgtgttgactctgtatgattggcatttgactggtaccgaggttggtacatattccaaagtttccaacaatccaacaactacaaccacaattcaacccaacaaaatatatactggctggctgacggtgtgcagagtacagagactaacaagacgatgaccacggcgacgccgaagatgaccctctgcctcctcgccatcctcgccgccatggtgacggaggcggtggcggcggccgcgggcgatggcaccacgacgacgcacctccatttctacatccacgagactgtcagaaaaaactcacgcgaattggctctcagtctctctgaaacacacacactgacgcttgtaggtgcagctacagctaactgaagaagttcagaaaaacagagtcgaacagaacaactgacgaacagagttggcgctgcgtaatacagtgcagcttttccggttttatcttctatttattcatctccacacggagtttgttgcatgtataacggaaaaaatcacgacaatctcggatcaaccatactgaccgcgccatccctcgatccgagccgagtcatcgcagctaattaaagaaggaagcaaatatgctagaacagaaaatgctattctaccggccagaattcagactccaacggaactctaaatgcaacaaaacaaaagagaatataaatgctccgggagggctccagcgcggagtcccagtacctcggccgcgcggagggcctcctcgtgcaggccgacctcgggaacctggcggcgctgtggaccatgctgaccctcgccttctctctcggtctctccgacgacggggactacaaggggagcacgctggtgttggacggccgcgtcgatttcggcggcggcggcgcggcggagcgcgccgtggtgggcggcacggggaggttccggcgggcgagggggtacagcctgatgaccaagtttggcaaccccacgcccagcaccggcgtcttcgagatggacacgtctacgtcaccgccatggcctagagctagcttaattagtttaggtctgtttgattcagcttagaattattataatctatattattagaagtaagctgaaaaaaacaagtataaattattatgctagattattataatctacaaaccagattactataatccaataatctcctctagagaagctttttctagattattgagtggctaaagacctactacccttaaatgcctcaaataatccagagaaacaaacaactcgtagattattttatgtcagtttattataattcagtttagagtaatctgatttaataatctagattataataattttaaactgaaacaaatagagcctatcttattgaatgaattgcactcgggttgtgaatttgtgatccgttcatcgtaggggggaaaatgaatgtcaactagaggtgaacacgcgcttcgcgcactgcaccagtggtgccaggagagggaaatcattgattacatctgttggttctggtaggtaactgaaacaaatgctatttgcaaggtctgtgaaggtcaagtataagctaacgacatggtgtgagatttaggtttagtgtagtgcaaaaaatgaagttctgtgacgtgagcatttatattgatagttgtcatagaggctaaaagctaatcacaacatatatgcagattgtggacagtcctaaatagcaaaatgtgccacatgttcgatggcaggatagacagtacatagtagttttatagtggtagcattgaaatagttctgctagatgagcacataggagtataggactataaaactatattacacatggctaaattctactaatatggtttggatgccttcaccgaattcacacaggggcccttttgttgatgtgcaaatggaagtggcacaaaaaggtaccaaccaaaagcaaagtaatgatcatccatactaaaaaaacaaacaggtaaacaatccaaactgttttcagtaattttctaataatcaggtatgtgaaccaaataatgcacacagcagcatatttattcaacaaagaaagttggaatggacggtattgtaggattgtaaaggtcaatctgtcaagttaacctattggtttctggttgtacatcttttacatagattataaaaggtatgtgattttaatacctaaatcatagcaagcacaataattttatgagcagatactatcagtatgtttaaaggaagagggtgaaagtgcaagctagtcaaataatacataacttagttaaaatgggattttaacctacagggcaacgctcatcgtcctaaactgaagctttatcatcccaaaccaatagttatattatcaagagtcctgaaaaaccacttctatggcaagagcaaataataacattagtcgtttcaaagaaaacttcaattttagaaccctaatcaagccaatcttttatatgctagtctaagcattacctaatcatcacatattaaataaaaaagggcataaatattagaagcattaggtagaagattcaaagtgagctgcaataaaaactggatgcatccaatgtagaacatgagaagcatctgaaggacaagtcagttacatttgtaaaatatcataggcattactgaatgcaaattagaaaacaatgtaacatcatatattttttatatcaagttaaattctgttgcacatcgtggggatgtcatgataatttaatatgttcagagttaatgtctattatgtcatgataattaattttttttatagagttaccaatcttcagctataacttgcaacagaattcttgttcacaaacaaccaaattatagaactaatatatgcctatttggtaaacaaataatcaactaaattttcacttccgtaaagaacatgtcaaatataatttaaacagtgaactcaaggtaggcaacaaacaacgatcagccaaactggttgccagtggtgccatttctcctcctggaggatggcaccaatgcaggcatcctttgttctgatctactatgttgtgtgcacctggagtcttggcgtgttaaggcaggcatcagcctatcatagcctagttttgctactgaaaccattgcaccagctaaagcctacaagaataagagaagtggacagctatgccagtcctttgatcttgcaccaatccatcatgttttctttggttcttctaatattattcgcaaagcaataatgtaatccattgtaatgcagcagctgattggcgttgggaagattagatagcttagaatagaattgaagctatagatggattgtgcaacaaattgagataaattgattttctatagtgcaaaagagcagacacatagcgagctttagtaatcacatccaaaaataatacagagaaaattacagttcattaatttatttttggtgcaacagtaatatacagttctgattcagacctgtacaacctttatcaaatgcacttgtatatttttggtacaacagtaatatatagcagcagtagtagtgattagtgtgattagtgtataagtttagtctcagattctgcatgtaaaaggtcatctaatgtcaagttacaaacatgctcgttataaattaattttatagaagtcactaccttcaaggggcataattagtaatgaacaaactaaaaatgcaaagccacaatctattttgatgaagatgcatgactacgtttggatggagcattatcaaattatccacaaaaaatattgtacattgctatattttgctggaacaaatcagcatactcatacttcaacaaaagatatatcaatttcttatacttggaaacaaagaatcttatgcattaactaatttgtaatttaaagtcatcagcatgctacaatggatcgtagatgaaccccttaaagaaatgcacagccaaattgacagcaacactaccaaagcaaagctcgccgccatcaaagtggggccacattcggtggagatgcaacctggttgtggtggcagatgaccttagatgctgtgccagaggaccagcagggcagcacggccgtgacgcaaggggatggaggtggcagcatcctctaggaaccccgcaccgatgcccttcactgctttgcgtaagctcaacaaagcttcactacaagctgcattcacacgctcacattcatagtgttacactgatttaaacttgcaaagaaaaattcaatacacatatcttcatcggtccaaattaatcacagtatcacactaagaccaccaacttggcaaagatataacatgcagtatgaaattccagaggaaactttcctctcctcacctccttccaaaaaggcagaagaagaggtaggatggagctgacgaggagccctccatgcggcagatccagcagcacccgccgtactggagaccgccgctgtccggaacgggacaccaatgccacagatcatgcagctccctctccaaatcggttcaccgacctcctggatccagtgattccccgtctcctcgacgtcccacacgcacgtccgtggccgcctaatcgcaggcatccgctgatccggaaatgaacaggatggagagggagagggagagggagagaggggcagtgccgggcatagaggtagaagagtagaaggcggctcctggcttcccctcgcttcagggcggccggatctgccggcgaggaggccggagtcaccggatccgacagtcccggcctcctcgatggcggatgcggcgcgggagcgagaggatggcgatggcaggacgacggcgcggcgacagcaacagctcgcagtagggagtgcgcgggggaggtcgccaactgcgggaagaagaggatgaggggacggcacgcggcggcggcggcggccgtcgctagggcaggagagagagcggagcgagaggagaggaggcagaggaatggtggcggctagggtttggggaaaggggtgagggttgtttttgttttgcaaaaacacccctaaacttctagttttcagagcgcggttcaattttccgttttttcgcttcttcatatagaatattgttttcttaagaggtcctctaagtaagaacgcacaacattagaactaaggaccagggatctataattatcaagtaaatgaagggtgtttttgcaaaatcactaacgacgacacgggtgtgcgagagctcacgaaaaccacccgccatccagcgcctcgctgacgcgtcggcacgcgcaggtggccacgccagctcaaaaatctccaggagtcgcaaatctcggcaggtttgtatataagcgatatttcaagtggtaaataagaaaaccgtcctggttacagtggtatatatataaagaattctctcctaatattaataatagtaggcctgatcatattttctcttttgaataccccggtacttggtttagcattggattctttgctagcagtcgtgctaatttgtgtatacaacgtactctaaagtctaaacatgaggaattcgactcatgcagttactagtgtgaccgtaagttaagcagtgctagtatattcttcttggcactataactgtatcattgtagcagccgatttgaacctttgactgagaaatggatggtgtaaattgtgcgcagttacaatagtaactgaaagggattgaaagaagatcgatggaaatggagatttctctgaaccaaatgactgtggtctagagaaaaactatcagtttacgtactgtatttcagttcccgctgttattattggagtatgatcccatcagttcaggatgcaaatgatgtaatgtagagtttattttttctaatcaagcctttggtactgctctttaagttcacttggcacgggcagcctggattggtctggtctccagccacatttgtacgccagtgtgggctgggcaaggattgtaacggggcaacgggcctctatgttcacctgcgatgggttttaacattaacaccactctcgggcccatcgaagcatttccacagacatgcggatgttgttacgcgaacaatatatatggagataagattcttttatgtggtccaatccgaatcagttttagagataaatccgttttaagtatctctctacctataaataaagcaacagaaatatccattgtacaaaaaatcattgataataaagataaaacttcactcctacatctgagttcattgtctcatgtgatgtgattgttcgagaagagatacgggtttctacatcctctcagcgccttattttttgcaagagagaagggagcggatcttcacagggcctcatgttttttaaggctatgtttggttaatccccaatagggagggggattggaggggatttattcaacaactattgtagtatgaaattattccccctagaacccctccaatccccttcaaccccctctaaactgaataaggcctaagagagaagagagcggatcttctcgacgccttattttctacaagagagaagggagcggatctgaggatctatcgatgtagctattctacaacatgttatcaacatgattctagttctactactggtactatgaaagtcctactgaaattgccggagtatctcggcaggatggtgagggttgcattcattgtagctcaaagaagcattggacatgcgactgcgtacatagaacctcacctcatcgagatgtaccaggagaaatatcataagacttctacttttagattcaccttaagaaatatctcataacatataattcacatgttattaatttacatgattttttagaaattatatatatctatataaaaactttggacaaatctaaacggcgggagtataatgagaagaggggaggtaataaaatgaaaacaatatttaagaaaaaaagacttaaaatacatattcatatatttatgctaataaaatttataaaaacaataaataatgaccgtttgaataaaacttactagaattaaatattcacaatatatgaaagtaatagatgcccacaagttataacacagatggcccccgaatagtgctagacaaagatgaaaaccaggaaaacgaaatcttgagacatgtacaataacttataaattatatattcgacacttactgtaatagtgtaagtaaaatagtgctaacaagaaaaataggcttcaaatattagaactggtacgctgtacgtttctaacctacccttagaatattatatagtgtgcctaaatatgtgattacttgtaggggtaaacttggaaaacttacttgcaatgcaccccaattcccttaattatcgatattcttgcatttcagatgacaaattaatagacggcaaaagaatacaatcgatcgaagaagtcccttccatgaatcataatcgaaagcaataatataaattaaaaaggaaaaccacagatccacagctactgaaattgggatgccgcggaccgatcgattggaatttggaaatcgaatcgaaagatggatatgatgctgcgtgttcgtcctggatcagaactcaaaatggatggacgtagatgccgatggactcgaggtagggccccgcgcgggcgaagaagccgacgacgctgccgttgttgaggacggggacggcgaagggcgtgccggcgccgttgccgaacggcccgatggtgcgttggctggtgacgagcttgagcgaggtgacgacgtgggtgtagtccccgatgggccccacgagccgtgcacctccttcacgtactccgatggctcgaacgtgatctgcgtcacgttaatcgagttaaggttgctatattttaaaacggatctgcagatactcttttcgttaaaaaaagaatcttaggttccatattgattcttttttgaacctagagtgtagttacgtacggtctactcggagaggccgccttggccgccccaggggccgatggtgtggaggttcttgtccttgtcgaggtaggagaagagatgcagtcgatgaccttgccgtagcggagccagaagccctccagccgctgcggcgccaccgtcacgtcgtactccttcccgccgtggtcgccgccccacgcacccagcttcaccagcgagccggcctgcgcatgcaaagatatatacaaatcgatcagacagtacagatcagctacaactgtacaaatagctgtgtattatttggccatggatgcaaatgcagaagagatcaggatcatgctgagcaagcatggaccgaccatttctcgtttgcagctgcaacccaacccccaaccacgacacaaagatggatatatagatcgattggcggctggtttaattagcttggttgctttgggtcgtcgtgtccaactgcgaggtggagagagctatatagcctccaatttatacaacactctagagctagtatgtttaactgctagcttcaaattatttatttaaattatttatagttaatctaatagctaattcatataataagttaactataaatatatactacattattaataataaaacctttagcgttttagagtacgtactgctggctataaatatgtagcacgtttctcttctctcttctcttttatctcctccacatatgtttatggctgatttatagtatattcttgtacctgctcttcttggttgcagtgggccgtgcaaacaaaagtgagatttgtgtgcaaactattggttgcatatccgtgcaaatttatctagactcgatcgtgtgcgaggaccgacggcctaacctttgcatcaggggtagctgcgttccgtggccagcgtgacgccacgccggtgcggcacgccgtgactcgtccatcaatgcctgcacggccgtactgcaggccccggctactgatttttattttctttcttttcttttcttttcttgctacaagtagtgaacatattttgatgctttggtcgactggagtggatgaaaacggtaggaaatggtcggaaacagtattatattattttattattttttcgaaaacaaatggaaatagtcagaaaatttctatatttatgaatttatctatttagtatcaacttcaatgccacgccgacagaaattaaaaaaactaaattttaaaaacggtaaccatcggtaaaaatattattattatattagttttgtggaaacggtatcggtacggttgggaaatttccataccgttttcacccctagactggacactgtcgattctgtggagtaaatttcagaaaatacaaatgatcgaatctatcactttgtgctacagtttttactaggttcataaaactgcttcatatcaaaaaaaaatacgggttggttcactttatcatcactttcaaccttattaaattttggtggtacttttggtagttccgaaacttccacccatgcatactaccaaattttataaagacgtcaactaaatatatctaacaatataaaaaatttgataatatcaaaacttaaaaaaaatagatcaaattggcaacaaagtgaacaagcactacaactccatcactattggttctaaccaaaccgacagtaatgagctgagagtggttgctctttgtgggttagtgaagggagctagagtatgggcgtacgatttggaggataaaaggtcgaaaaacgtagaaacatgattcccataaaaatgaacactattcatccatgtaatttgtaggattttagcataagaaattttcatatgtctatgattcctaagaaatttcataggacaatttacatccactcaggctatgttcttttggggatgttgagaacctttccttcctatacataaaacggagtagtggattagtgtttgattaaaaaagaattaactatataaatagattaatattttataaaaaacaacattcaaagttctgcataaaatggaccgtttagcaattcagtaagcatgcatgcatgcgaaaaatgaaggaggagaagttgagaaaagtgaagtataaaacacaactttaaagctcttttttctattcctacacttaggttcgagacaaagcctcacgaggtcataaaaatacttcctccgttttattataatattgagtaaatttcacaaaaccacatatactttggtcaaattatcacaaaactacaaatttaagatgatgtaaaaaaaccacatatttaataataaaattattataaaacaacagattttagggttgaagtctttagcactgatattatgtttgagttataatatttatgttttgtgattaaattgatctaaaacatgtagttctgtgataactttgttactaaatttatagttttgcgatagtgcaccctatatgtgtagttctatggtaaatttactgttaaatatgttgttttgtgatacatcatgttaaatatatagttttgtgataatttgactaaagtacatgtagttttgtggaatttactctataatattactcaagtcactttgtttttttaattaaatttttttaagcttggccaagcttatataataatataacaatacttttaatacaaaacaaacatattatcaaaatatattaaatattagttttagtaaaatattataaatgttgctaaatttttctttagaattagtcgaacttaaaaaaattgacgatgaaaaaaaatcaaagccacctatgatatgaaaataaagggagtatgaaacagttcagaacattcaagcatggcgaagcggctggctagccgtgtgcgtgtagcaattgatttgtaatactagcatatgtcacatcatatgctaagttggtttatctcaagatagtgggagtataatcctacctccatcgtaaaatgttgctacctagtacatagtagaacatcatctaatactgcgaatctgaaaagtctagattcgtaatactataatatatcacattcgattaaaattttctatactttagaacggaagaaacaataatttagaacggatatagtactctctctatttaaagatgcgaaggtaggagctcccgtgccactattttcatggcagcatccacaggttatatatgtactagccatcagcccatcatttccttgtttctccgtactagccataatgagtacagcacttggtggttgatccagatgacactcaacctaccgttattccaaactactccatccatccaagaaataaataaatttagtttaagataggttaggatattatattacgtagatcaacaaatcttaacataagataatactccctcgtctcataatataagaagtttaatttagagttggacacgattattaagaaagtgggtaaaagtgaatggtggagagttgtaattgaatgagcagtggagcaatgtgggaaaagtgaatggtagagggttatgattagttgagaagagaatgttggtggagaagttgttatattttaggacaaatcttgagggctaaaagttgttatattttaggacggaggaagtgtcttattttattttagatttatttattttgaaacagaaggagcttggatcaatgaatacttaatttatttgttgaagcatggtgaacagatgaagtgatgacacctagctagttaaatgtaaaaccaaattgctgagaacatatgccgtggtttttctttcgtgtggttttcatttgtggacaagaacttagtgcatcgtgctagattgattcatcggcttaattccttcgttaccacgcaccggcaaggagagtgagcgcgccctgggcagtatacaagccacattgcttatgattatgattataaatcaaactttaaattttaaaattaattttgtgtttttattattttataatacttgcttctaaactgttattccataaactatttttattgttaataaatcgtacacataagcatgaggataattaaaatgagtctttgtcaccacactattgctgttgtggaaacttgcatggcgcagtaataatgtttttgggagagtgtttgtgcggccgcttatacggctgcgtttagaaattcttccctccacacgtaaaacgggatgactcattagcacataattaattaaaatattagctctaaaaacttaaaaactgaattaatatgattttttaaataactttcatatagacttttttaaagaaaaaacacacaccgtctagcaattcagaaggcatgggtgcggaaaaagagggaatagaagttgagaaactaggggggaagaacacaaccatctatcgtttctcaattatgtgttttgcaatgaatctacaacatttttaaggctacatatttgtcaccaagcctaaagtaggatatgttaaaaatggatttcatgttaatttgctgctgctaatacattgatctgctatttcctagtaataaaaggaagaaccggtgatgtggtagggtccgcccaccataatttaaattacgatgcctataaatatttcacacatgctgatttgtttttaatagaaaattagtgagacttgtaagttgccgctatttttcaccatctctttggattatatgttagggagggtacattcgcgaatcgccactgtatgtatgcttgggtgtcttcctaaaatcttacggaattactccattagtcatccaaattaataatatttaagtaaaatatggtgattactactagaaaagaaactattgtcaatgacaaggggatgcagcaaaagagccctttaattctgtgagcacataatactgcactgttattattcttgaatgcaccatagtttgagaaacattaggccataaatcaaaaaaaatatgaaacagttgagaacacattcaaattaagcacggccgggtggtaactggatggatcatatcatatcggtggtgttgatcaaattcaattcaattcatttctcggaggggatgcacgggttgacgtagacgccgatggcctccaggtaggcgccggcgcggacgaagaagccgacgacgccgccgtcgccgcgcacggggacgctgaagggcgtcccggcgccgtagccgaagggcccgatggtgcggcggtcggtgacgagcttgagcgaggtgacgaggctgtcccggtcgccgaacggccccaccgtgccgtgcacctccgtgacgcgctcgccggcgtcgaacgtgaactccgccaccgtggcgccggggggccgctccccggcggcgagcttcctcgccaccgcctcggggagctcggcgccgtcgccgccccacggcccgacggagtggagctcgccgtcgccgtcgccgccgtcgtaggtgaaggcgatggagtcgatgatcttgccgtggcggagggacacgctccgcagccgccgcggcgccaccgtcacgtcgtggtcgcggccgccgtagtcgccgccccacggcccgatcttcgccaccgtcgacccggcctgcagttgcacccacacaaattgtaattcattagttgctgccgccattgacgccgatcgatcgagcaaacattgcattgcttgtgtaatcacagaccatttcgtcgatgaagctagctagcagaacgagaaaaaccaagaagagggcgagatgagatgggatgggctcgcggagtacacgcacgaaatcgggctcgatttatagggtgcaaaatctgaaaattatctcgtgctcgtcacctgcgcagctgcacctaacggaatcgagagaccatcgcgtagcatacacgggagtacgggacaggacaaggggcaggggtagatgagttccatggctagttttggtgccacgttatgtggttctgcgtcacctcctgccataacatactgcaatcatcacgtcgtacattcggtatactctaacaatgggccattagtgctgggaagaacgatattgccttcatccttagaacgtaaaatggttttaagctggaatatggatattaagaaaaatcgtgaaattaaatataagaatgttataattggttgcgaatagtgtagaatttaaatggtacaagttttgtgggtgattgggaatagaaatgtaggtaaagaaattgttatatctatctcttatatactatctcttatatactataagtccataaaactttctacaaatgctcctataccgccacgtggacttttaaaagtactccaaaacagccatgtggcactctaattaaccagtggacctactattttagattttcatctattagatttacacttatatggtggacccgacattatatgtcattagatccatttttcaaaaaaaaaaaaatcacatcccctcccgtgtcgcttatgtacgtctccgtgtacgccctccccccttttttttttgaccgggtgtacgccctcccctttgttcattttctctcctatttttatgctattttagttagatggaaatcacaattatttataatatgtttttagaaaataaaactaaatcattgtcctatacacgtacatatagtacgtcctcttccccatgttccttggccggtgtccaccctccttttttaattatattatttaaattcaaattagaccaaacatttttgaccattaaattattagttttcactattagttcttatcttcgagaaaagaaatatgtatgtttccctctccctgtgcacgtatttctatacctaattaaaaaataagcaaagcttccggtaaaaaaaatttcatccgtcctttcctttttcaccgttttcctctttttttccgatccgtttgcttttcgttttccccttttttttttggttttccgttttttcctttccttccgtctactttttttcccatttgttctcgccccttttttccttttttttctctgcctgcttttttttccgtttctctccgtccgtctattttttccttccattttttttacattttccctcttttttcgtttttttatccgttattttatttttactttttttttggtaggatttttttatctgccatattttttcgtcattggatcaaaccctagcgctgtcgtcacgtcgacaaaaatcaattagtttcccatgctttccctcattcaattagttgcaaaaatcaattccccactactctctcatcattttctcatgattttccacattcaattctactttaattcaccgaatttaatctctaattgaaagtcattttttatcaagttttgcggattcactccgattttgataaaaacaaaaagaggagatcgagtgtatcaaaagtcctcaaccaattttagaagatcgagacagattcgaccgaatttgatggggaggatcggttttggcatcgtatggacacaagactgtcttctagaggttgaagacggcagttgactatgtgagctggaattgcagctacacttgtgggttaggtcttagagaggcaggagaggtaggcccagcagagggaggtagaggactgggctaggactataaaggaaataaggaatgagtatttgtccaaaaccaaagaaaaatgtacagcgatccaaaaataattttacccgttgcaacgcacgggtattttttctagtaagtttcaaaaagacaaaaaaaaaaaaagcatcccttccgtctgaggggggatcccatctccctgctgtctctcctatttctcttctattctttagctatcaaccaaatatataaaaaaaatactccctccatattatgacgccgttgtctttttatcaatgtttgactattcgtcttattcaaaatttttgtacaaatataaaattatttatgtcatgcttaaagaacatttgatgataaatcaaatcacaataaaataaatgataattacataaactttttgaataagacgaatggtcaaacgttggtcaaagagttaacggctttatacattaaaatacagagggagtaataattagatagataaacaatcataactctcgagtacatatccaatttttaatttgtttaaactattatttatttaaatgttatcatatgtttctcttaaaaaattataatacgtcacctggatacggcgaacccaagaaagaattattagggcatcgcatagatatataccctttctttcagtggcgaggctagcaaaaaattatcagggtactacacatataaattatgcaattgttgattgatatatattgattaatatgaaatgaatatagctagaatcgaataatctacgcaggaaggtgaatgtagttaggccgatgtatcttttgcatatcaatcaaacaaaaacaagctattataaaaaaatgtacatatattttgtcatcttaaaccatttaacgaacatacgccgtgaataaattttcaaataaaagaaacattaaaaataaaataaacatgtattatgtgatcttaagttattccacaaaattgcatagctatatcagattgacggtgttaaaataaaaattataaatgcaaccatgaaaataaatttatgcataaatttaatttatctagggaccacactcctacactttgaatgtcatccaaattgtcataaaaaattgtaaaataatttaacaacatatattacatcatcatacattactttgcaagcatgcatagaaaaaatagatatataatatgtaagtgaaaagaacaaatttaactatgaataacataaaaattataaaaaaaaattgtacctttagttggatgcaataatatctaattaattatgtcttttgaaatatgctcaaccgacgagataaattaaatcggctgatttgtacgtaagtgttctaaaatatagtatacattaccatttaatggacttagaggtaaaaaacaaaagaatattactatggcttccatatcttttagatataaagataaattagtctattttatatgcatagaccattaaaaatgtgaatactcctatatatgaatattaataggctacgagcatgtccgttgtttgtacgcacgcataaccaactttaaaattcatttcgattttctgatatattttactatgtatgaatattaatattatttagattgactatagtttttcttttaactattatacgggtctcacgtatcatagagaaacaatgtttacggtaagtatatttcttccatatttactaattcacatgcaagcatataacaaattatatgcatatgaaccaattaaagtgatgacgatggtacaaataatatacatttgtcagtagtaaatgtttcgcgaggtttcttaagaaaatagaaacaatggatcgaacatccattattatatattaaaagcacattaaatttcctacaaacgctctcaaaccgccacatgtgactcctataaacgttcctaagtcaccacgtggcgctctaataaattagaggaatttctaataattcttagaaaaagaaaaacatctaaccattgattttactttaaactcagttgtcggtgatatgggcccgggggtatcacgttgagagggaggaggccgcccccaatcccacgtggcaccccccgaggggggtcgagcccggggtggagcggcagctgccccctcccagcttggggttgggccgccccgaaccccatgtggctcccctcgagggggtcgagcctgggccgcagcggcagctgccccctcatagcttggggtcgggccgttcccgaacccacgtggctccccccgaggggggtcgagcctggggtggagcggcggctgccccctcccagcttggggtcgggctgccccgaccccctccacgtatcagcccacgtgtacagggttaggtgggcgtgcctaacgcccaccttgctacatttaaagcggtccatgcagccgcgccaagctgcatttaatgcggcgtgctgcgcatcagaccggtctgtgactggtcgaatgaccgatgggactacgactgtatacccctgccctgtcagtgtgtcaagcggcgtgcggcgtgctccgtcccatcccatcataatgatgaggggcttcacagcctcttatcccggtcagagctggtccaaccactctgaactgatccgggttcccgtttcctggtacgaacgggaacccggaagtcctcatccattaaacggtgaatgacaagggcgccccgcatgatttgatgggccccgcgcagcagccgacgtgcagatagcttctgggctaaggcacaagacatgtaattaatatagagaatattttttcttctccctaggtagcactcacagcacatgtggtatccccttagaatataaaaggaggaccatgcctagcgggaaagggggatcgaactctggatccctaagccaaagcttgtctagccctagcttgtacaccaaggattcagagactttctaagcacagaagaatcatgatacacacaggagtagggtgttacgcttcatagcggcccgaacctgtataatccctctctcactttctctctgatctccatcttgtgggcctagctcccgcaaattcaccgcagttgcgtcgaaagagacttcttaggatttcacccgctcccccggtcgaactcacaaaggggggcctcacagcctcccgctagagaggatcacccctcgacattagtagacccactattttcgaccattaaatttgctaacaaaaagtaaaagcccctaaggcccataggggctgtccatatcgtttacgcgtatggtgcacgtacatacgctacatcatcccctcttatatattcaagctcccctccactgtatagaaaatatattttgtgataatctaaatcatagagctaatattttatgtacatcattagattatttattacaaaatttataattcaagacccaaaccattggatttatctcaaaggaaactgaattcctcccctcctcatgtcgcacgtacatgtgcatgtctcccggaagaaaaatcaggatatatctactctatattcattgatgcatatgtaaatatgtataacaaattaatatgaacccattaaaaggagggctagcttgatggtacattattaacaataatagtttttcgagatttattaaaaaaaagccccaaaacattcaattaaaaaagaaaaaacatattaccttttaatttgaacttaatttgttacacatgttttctaaacgaactaagtctatctccattttaaatggtgaagaagaaaatgataattacgtatacggatgcattaaatattacatagtagaaagttaacagatacctaacaaaagttatttaagcaaagtcggcaaataaatttatgaagaaaacatatttctgaagtttggcaagtatggttgatattcattcctggtaagtttttcaaatatagcctacgatatacatgcccgcgcaaatacgcgggctaccatcctagttttgaaataaattttgaaggttagaaattgttatatatttgaacgtctccgtctcgcagtttttaaaaacctgacagcgactactagttacttttaaatttgatcatttagctcttttttttaaaaaaaaatgcaaacgtcaaaaatatttttttgttattaaattactagaaaaaatgctcatgcgttgcaacgggtaaagacatttttttcgtgatgcctcaactattggaagccgaacaataaattgaaatattgggatcactatacattataattgaaaaaagccgaaacgttattttcgatacctccctacgctcggcttgaatctctacagcccagcacacaaaagggcccaagccacgagcacaagtagagttgcaggcccaactcacatagcctgcttcccttcattttcagccctagtctagttcaatacctccctacgctcggcctgtatctctgcagcacagcacacaaacgggcccaatccataagcacaagtggataaaaaaagcctaatcgaacataaaaaaacggtgaaaaaaaatagacgggccaaaaaatcatattcagttaaaactgattcttcaattaaaaccgaaaactgattcaaatatggatgacgtaccaaaataccagcaaaaacatgagaagtctggtgcctctgaagctagaataagatttggatgctttaaaggagtcaatgca

SEQ ID NO: 65106 - DNA, 2693 bp, Oryza sativa
agtaggataggctggtaaagtttggcaaatgagggaaagagtttggccatccgtatggcttggagagtaagatgaagaggctgttggagtcggtcatttaaagttgctaaattttggcttgaagagtgggatggagagactgttggagatgctctaagcacatgaatcttttccttttgtctccctcctattagcgatgtgaggccacaagtgaggtaacctcgcctcctccaacacaactgcctccactacccaacacgctgctcctcagccccattggttgtcctcctccccaagccgtgcggctgtcgaagacgccacgccaccttcgtctcctaactactccgtatctaatgcaccacaatcctccaccgccctactatagccccgcggcttgaatggcgacacaaccgcccaccaccattcgtccaacattaggaaacctcaaatcctaatccataggttctttgcgagagttggggtgtcgccaacatcgaagaagacagggagtttaccggggacagaggagaaggagtccgaacatgaatcttgctgtgcggatacaaatggtggagaaatcataagaaatctccctctgtccacaaatataatggagtttgagggtacaggtttatctgcaattttaaggaattttgagtactacttgcatcactcaaccacccttcatttgatttttatttaattatattcctaattgtttctcatttattgagagacattatatccatttcccttaaccttaatctcctaaaaaaactaaaatgcattatatttgtggttgtaggagtacatttaatatatatccgtaccttttaaattatttgtaacttaattgaaacctatatatagagactgtctttcaaaattaaaattcggctcataaaaatcaacagagctagctagtaagttctaaaaaaaaaactagtgcgtccttactaattagtacttctagttaataaaatggtacggcgcttgattttcgttagtagaacgtctgcttccagaacatgctaggcataattcgatggggatgcgcaccatcactcgacgcagtatcaaaaaactctaattgagaatcgacttgtcaactaaaaccaaaaaggtttctgctttcctccctttcaagacatccatgccatttctttttccttatgagaatatatatatacactttagttaattattagcttctcctgattgaacctgttagcttggatagagtgactagtgaatccaacttgctaagtcaacacagcactatatgcttgacttatttaattaattgatttgtcatatgtgttcacatgatatcatgatagccgttaagcaaaccatgcatatgaatctagctacccggtcccaagtaattaacgaaaaggataaggtaaggcaaaatgtgctcactagctagatttgatctgagcaatcatttaggtatggatgagatgataatgttaattagtatattggtcctttgatcctttaattttttgtgaaaggtgtattaattagcactaatcttgttaagcagaagatgtcagtacgaccttaatttaaacctttctaaaaagagaagatatcacagagctgatctgaaatgttggcaactattactactagtttttattcttttctctctaagtagagtgtttcctatccactttccaaatccaatctggctccacgcactactacatacccattttccagtggtgtctgggaaaatcgcgattttcgcatacgggtgcttatatcacccgcacgtgaaaaacaaaaatccaagaggatggaatagaatttcacaaaaaatgaaaaccctagattggcgcggcgatgccgcggctcccggccgccgccacctcgtcgtcgacgcccgcctcccaccggcctccacgcccgcctcgtcgtcatcaccgcccgccggatcccgcgcctccaccgtcgcgctgtcgtcgctgtcgccgcgccgccgcggtatccgtgcggggacggccgccgcccgccagatcccgtgcctccaccgccgcaccgtcgttgctgtcgccacgccgccaccaccgcaccaccatcgccgtgggccgccgccgccgctgagaggcagtgagtgcagagagaatcggctgagaggagagagagagaaagagagagaagactttgggagctgaagagacttttgggctgagagaatcagccagataaaagagagagaggaccgaggcgcgcggaaaaacggtaaattttgaagtgggtaggaggaaaaagagagagtactatttttaggtgcggctcttttaatagatccgcatgggaaaatcggtttattttcccgtgcggttcatttaagaggaccgcacggaaattttcccgtgcgggcgatagcccggcgccggtccgcctatttttccgtacggttccacttacgaatcacatggaaacaaaagagggtagcgtccaggaaaatcaatccagtagtagtgacggttgaacagtacgatacatactccactaggaccgtactccactggttccaaaatggaaccaacttagtacggataaaacatattctagaaatacaaatctagacatgccacacatatccagattaatagtattagatattctcatttcgtaccagtgttatattttgggacgggatagatatagattgaagc

SEQ ID NO: 65107 - DNA, 4485 bp, Oryza sativa
tgcagcgcatctaaaggtaaaatgggtttcataacgtcaaaagatatcgggtatggaaatatttcacccaaacattctgatgaaatgaggatctacctttgtcatccatattggcacaaagaaaaatgttactgtatcaagcattttacagaagtaagcaatggccaagaagtagatgcctcacctctagctgccctctacctgcaacagcatacagcacggtggatccacggaagtcgagatactccgacacgtcggagcgacgctcgatgagctccctcagcatctccacgctgccgccccccgcggcggcgtggactgccctactcatcatttccagccagaacaccgaggagcagccaccaccgctcctgcgccttccccgttgggacaattcgtcgagcacctcggcgacatggcgtggtccagcagcagcttgaacacctcggcgttcccgcccctcgcggcggcgtagaacatgtccatcacgccatgctcgccctcgccaaacaccagcaagggatccctgtccataagctcctgcacgaacgccatgtcccccgccgacgccgccgagtagagcagccacccaccgtagcccgcccggagcagcgtgttctcggcggcggcgctgttcttgcactcacactccagcagagccgcgcaagggttaaactcgtcgggagcagtgcagatcgagggggatcgggggcggcgccgccgatgatggggaccggcgatgcgggctgaccgggggcggcaccgccgatgatggggaccggcgatacgggctgaccgggggcggcgcgaatgcagaccggcgacgcggaagcgagggatccgggtggagggggcggtgatttgccagggggaggggaagcgatccggtctggatcggatcggatcgggaggtgctcgagagaggcgcgcggtcgcgcgaatgcggaggaggcgcggtgattgcggcagagaggggggtgtgggacgcgcgctgatctgggacgttggatccaaaatcttcagatgggtttcgaccgttggatatgtgatatgatgaatgagtaaaactatttgttcaactatagggtagatacataccgagcatctcacaagctactattattgatatgaacacgaaattgtaatcacatgcgaaatacgttggtttttttaagttacagaaaattgctaatcgttattttagtattttgaagttaaattaaaaaaaaataaattgagagtagtttttatagatctccaggatttgccggcccatccttcgaagatgctcataggggtagggtttgcgtgcacgcattcataggggtgagtgtgcatgcgttgtgagtgtctgtgttgtaccgtgtaattcttaaaaaaaaaatcgtgttaagaacttaagagcaaaaagttttgcaatcatataaagatgacatcattctagacaataaggttaaactattgaattgtatcatatgtgaaatacgttggtttttttaagttatagaaagttgctaatcgttattttagtattctgaagttaaattaaaaataaaattgagagtaggtcttataacctgtagctaaattttatcgtgttaagaacttaacaacaaaagtttcccaatcgtaataagatagcatcattttagacaataaggttaaattattgaattgtgtgaactatagttataactaatataatttgaagacgtctagcaatatttgagaagaaaaagacgaataagtaaaatgcaggcttacattaatatactcgctcaatctttacaaatacttttaatcactatatctactacatataaaattattacattctccatttattgaatcaaataatactattagcaaatcaaaccagctcaggctttggtcgttggtaaaaaacgtttttttactagtctggcttcggcttcctgaccagcggtagcgctagcttggtgagtatctgtcccttcaattgaggacaaatttaactattaggtggcaaccctctaaacgcccgattagtgcctctctctccctcttcatctcaccatactacccccttcatgctggtcgtctcaatcttatagccacctcgctagccgttgtagattggtagccaccctaccaattgccggaagcctccctgttaccatgcctgctcattgttggaggagctctagcacaaggtaagcgttgaggccaaataactcgccaggcgataagaggaagtttggtgcaggaggagtccccacttagaagtggaggtatttttttaataacaatgggtctccaaggacaacagttgtgaagagagacctagcggcagaggaactagagggcgtagggttccccaggttaggatgtgacgtcaagctcgtcgccacccaagttccaagatgcacaccttgtctttgtcgagctcaagcggtcacctcatcgtcagggttgacgccctccttcatgttagagctagtttgacaactagcgggtacaacgatagggactttgctatgattaaggtggctgttaggctttaacagctagcgaagaaatgaaatataaagaaattgctaaccttgctatgctagcgggccatgtagataaaagtataacaaaccacctttattggatgataattttgtgaagacaaaattaaaaggaggcatttagctccctctatcaaaatcctcttgcttaagatcggagagacgtggtcgctgacacgtgggcccgatggcaatgggctccacgtgtcagtgagacaaatgactactctcccaaccccgtccccgtccctcccctactctctcgccttctgttcctccccctctcccttccaacttcccaagcgcgcgcggggagacgatcggcgacggcgacggcgaggcggaatggacagcgggaacgtggtggtgtgcgacaacggcaccggggtaagcccgccctccccccctcctcccgcagcctgatccctgatccagcgtggcgacctccctccctccctctctacctccacgctcctgcccctagatctgcaccccctccgtcccggttcttcttcttggacggtttcttggatttcttctgaaatttcctgaatatatacgataggattgtttctctctctttggttggggagtaattagcatctgtgctctagattcatttgtgccgaataagttttgctgcttactactgagctgtaattaatctaggatgaaatgatacgtgtgcacattgcaagaaattgaagggggaaattgctctagtatggtggaattattgttctccacataggcaggaaaaattgctgtaatacgatgagattattgttctctgttgaatctttagataatgtccttccaaatgcggaactggaatagataatgttcattcatataaaccacattagtttgatattttgcggtccaaaagaaattatgctgttgtctttggcttagtttctgttaagtattttccacatcattcctgtggcttgatgttcgatatgcttaaagccttaaacaacagcagaacatatcatattcataggtgatcttgttaatttctaattcggtacctaatggctaatgttgcagtatgtaaagtgtggctttgcgggagagaacttccctacatctgtgttcccttgtgttgttgggcgaccattgctccgttatgaggagtcactccaggagcaggaattgacggtctgaaatcaatgtctatctttgtgtttctggcattccctcattctgtctctctctcagtacaccttataattgtgattgtgttccacgcaggatattgtggttggagcggcttgtgctgacttgaggcatcaacttgacgtatcatatcctgttacaaatgggattgttcaaagttgggatgatatgggccatatatgggatcatgcattttacagtgagctgaaagtatgacttttcatatgatttatattactttaacatcagacccttttaaatttatatgctcataattcatcaacattctccgttatgtgtcttgaaatctcttagctctaggtaaatcaatgtatttctattttgtttctttaggttgatccttctgagtgtaaaattctactgacagatccaccactcaatcctgtgaaaaatcgtgaaaaaatggtaggttgttttctcccatctggctgttctgtactatgaaatttgttttttaagatatcactaactagcaaattgaatcctacgataaatagattgagacaatgtttgagaaatacaactttgctggggtattcatccaggtccaagctgttctttcgctatatgctcaaggtactctctctctctctctccccttccccccctctcagtatacagacacatgtatgagcttgcacacctacaaacacaaaatgtactggttcttttcttaacatgtattatgtttgtatcctttccaggtttgctgactggacttgtcatagac

SEQ ID NO: 65108 - DNA, 4871 bp, Oryza sativa
ggttgggctctgttttttttctccttttttagcagaagtagatgttggtggttatgactgaagattcaacgagtatgtacttaaaaaaaatcatattcttgcaaagcaccacctcctagatgcagcaattatctgtttgtttgcatcccaagccataaaatattttccaaatagaatttctcagaggcagtgatgagaaaaaagaaaccatttcttccatgaagcaggggatctgccctaatttgatattgccatcaaagtaacttgccatgttcctgaagatgatctcctacaaaagatggcaatggaatctttgttggtaggtagggctccttttttttttccttagcagaagtagaatttggtggtggtgactgaagaagattcagagagcgtgtgatcctaactcctaagcatgcaatgatgcacgtgtttggtgagatacataattagtaaagagatgttggttatcacctaactgaagcgggtaatgaccgtcgtgttttgtaattgactgccttgactaggaaatcctgagattatgcgtgatgctcccagctgctgaattttggcttgaaatgttgagacaacctactctgatggatggagcattttgtttgtcttttcagtgcatccattcaacggatttcatcctgactgaaatagttggaccaactaattcaacagcaagcataagtatgaaagtaagggaatggacttcgcaatttatgaggtttatgtctatagatgtctcacaaacaagacacatcttgttttcttggacaaaatggcttgaaacaaatacacatcttgtttcatgcagaagcagaaactacctaagcataccctgaactgagaaataattttccttacaagcaaatcatcaatttacatactaactctcatactaactctcagttacattagatccttgcattgctaatgaattcataattttgtaaccaatcaattttcagaattattatcaggttgaaaaccttagattcatttggatcgggcgatgtcgtcgttctgtcggtgtgtacttcttgaaggctttgtttttaagagtttttcccttgttgaactgctgttctttagttcagtgtgtccggttttcctttaattaaccgtgccgttttgaggtttttggattcggtttttcttataaactagatcaactctcttcttctatagtgaaatagcatgagctccctgcctgttcctcgatttttttttcagaattaacacatgacatttttgtgggttttcagttcaccagcagacaggcctgcatcacttgcgagctaactgaagttcaggttggtaggatacttcattaagattcaaagatatcaacttgacagataaaatggaactccaaacttatctggagcaatacatatcgcacgatttcttacctgaaccccgtgtccaacaactcatagatttggtcaggtctctgatgtgcacagaattgaaaatcaactctcccaaatgtcaaatgacatcactgatcaagactgttcctggttaagcctgatgcacgccgcaaaccaaaatgccatatcctaattaggagttccattggtccaagcaataccagaaagcgacagaaatgtaagccgactagttaatttctatcgagacaatcgaggtaagcataagatatgatttcatctagcaaagtttaaaatcatgatgataataagtattatcatagttttactaggattttaataaggttagagatttggctctggcatttatccctcggagtttatgtttgttgaacgtactaatgagtatatatatggtttcgtttggtggaaaacttttatagtagctgcagttttttttcagaattttaagctctctcaaataattaacaatccagattcttattcatattctgacagtacgtagttatagaagtcaaaagaagttagaaaatccagcttcttaccatctctcttttgtcccctaatcttgagctctcgaaacagggcctaacatactcatgtgatgcatgtaacggcgaaaactgttctcaagcaggccggacgttcacctagctctctgtcattgtgcctccaatgtaccgtcgatgtctgaaaaaagtggtcgactgctagctccgtcaagagacgcgtgcatgtattaattccatgtactcgaaaaaatgaaaacgaaggacgaagaagcgaagcatgttcagatttcttatgggttttaggccttcaccgttttgttgacggcttcttgctcttcaaaagggtcgtatttacgcgcgtcagaactgcataaaaacgcagctgacgtatatatatctggccattcatggccatgcgtggccgattgcccatcgacacgagagatatggatcgatgtaatatatttatcggatcataaataaacactaatatctcgagaggacgttaactcattattatatgccatctaaatgttataaaatataatatacgatatatcgttcttcaaattcgatctttacaagtttaataataataatagatttaactgaaacactttatatttaaatttgttgttttaattgtgaaatataaatttaaacttgcatgttgtgaagtgatatatcatatattaatttatcttgctaaaaaaattttaaggacacgaggaaaaatgaagggaaaccctatctctaggattaaaaagtctctcattagagatgttatcaaaatattggtcgtgattcaatgacgggctaaaaatggccgccacaggtcagccgccatgggggccgtacatcgaggaattaataaacagcaacgtgatcaataattcgttagtcaattaacttgatggtattttccgagtgacagtgcattaatttgtttgtacagttatcgccgtgcagagtcttagtacggactccctccgtcaacaaatggatgtcatgttaaggtccgtgcgtccagtagatcgatcatctaaagctatttatattttggtgctccgtatatggaaaaatgagtgctggtttaatatatttgaaattatcatgagatttaaatttgtcgtagagaaaaacattggatataatataaactttatgagtgaattttcacaaaactgcatatatttgataaagctgttatgtgcattaaagctttgttttgcgaaactatagatttaacacggaacatgaaaaattttgaatttagttacaaggttgatccttgtcttatgttcagttttttttttttagttttgtagtatataaaactgccactaaatttagttttgccataacatggttataggatctgcattggtgcagagtatatcatagagtaaatttggcaaactacatatccttatcaaactattccataactacgtatttaagtcggtgtgtcataaatcaatatttttataataaatttaatattaaatttatagttttgtgatacaacgtattaaatcagtagtatcatgattgtttggtcaaaatatctataatattattctattctatcttcgttattaagtttcatgaagaaaattgactaaaagagcaaaatattttaatcattcctctgaggctctcaccatgtaggctccccgaggccaaagcattttgagccgcaacaaaccaacagttaagttttaatagtggaaaaggcaagtccttgactccttgtgcttatgatctcttctggacctttgttcagtttatgtggcttccggttcacccaaaagcccattttttaggttaaactccaagaagcaaaagatgtctttattaatgatattttacttcgacactatattgatcgagcttggcttagatacagtaaaaaaattgctccacctccatatatgctccgtccatgcctagagacatgaaatcgacatggaccacattttttaaagttgtatgagtataaacaaaatgagcatacgtctagtacgtcgacacatgcatggttttatatataaaaacagttgactccaattaaatcacataattatatataaaatggtgttctttcattacaagtaaaatcctcaaaagttgtttccaaatttcatgtttcattactacctacttcctccgtttcacaatgtaagccattctatcatttcccacatttatattaatgttaatgaatttagatagatatatatgtctagattcattaacatcaatatgaatatgtaaaatgttagaatgacttacattgtgaaacgaagggagtaatttgaaaagaaaatcgaaatgtcgctaccacaaatgaaagacttatcaccaccgccactgctataacgatgttcatgatccaattagactctcctaccgctatctctatcatcttatttacgtcaatttaccgcgtggatacacttgagccaacttttagaggtaaaaaagacccatttgcattagattacaattacattagatcagactttaatttgcagtgctaattaatcaggcaaatctttccatgaccccacaaattaagtctgactttccccccatccacggctatatatggcgcgaaatcaatcaaacccgccgcctccaaagcagaaaggaaaccccgcgaaaggaaaagcctcacaaattaagctggaagccaacaaggagaaggcgacgacggcggcggcgagcgatcgcaaggttatggccggcggcgcgagcctcctgcacgcggtggcggcgctgatgagcacgtgcacgcgccggctgcagcgcgcggcgaggcgggtgtcgtccgccgccgcgggggcggggaagcagggggcgtcgtcccgcgccgtggtgccgtggaggaaggcgctgtcgctgcccgccgcggcgacggcgaaggtgaaggcgg

SEQ ID NO: 65109 - DNA, 563 bp, Oryza sativa
gtggcttgcctcgctcgagatcttgagcttgatcctcgaaatcctcgtactacggtcttcgggctccgaaactacacgcgaaacgggacaactcagcaaacggcgaaaataaagccttattattgacctctaagcgtgccattagatagatctcgagatttgaggaattttggaagttgaacggagtcaaacggacttacggttggggagatattgaatttctaagattattggatttttggtctaaaggaaaaggatttatttaaatcctttttgaaaaagaaaagaaaagaaaagaaggagggagggaaattagacttccctcgggcggctagggcacggcccgagagaatggggcggctcggccgaccttaatgggctggctggcctatgaaggcggcccaaggcgcgcgcgcgagcggggaggggagagagagagccggtgggccgggtccatccctcgtggtcccgggtgggacccgcttgtcggcgactcggctcaccgtgagccaagtgcacgcggggcgtgctagggtttggggagggaggcgcggcgcatgcgc

SEQ ID NO: 65110 - DNA, 42852 bp, Oryza sativa
gaatcttgcccgcccttccaaaccatatcagctagcagtaaacttgttggggctcatccaacatgggcctaaaaagttttattagtgatgtaaaatgagaaatgccaacaaatacttaactgttcgcctcttcgacagtagataaaacaagagtcggagagaaagccaagcaaccagagataaaacttctctatgagatatacataccactgagtgattcagtgcttcgcaggtagcatagccatgttagggttcagaggcatggtgaagcatatgtgtgcattatgagttggccaaccatctatttgtgtttaagtatcagcatcgaagtcaaccacagatgcacgaaaacctctctgctttacgtttttctatgtgttctgatgaatcgccaagcaaacaatgtagaggactgggacaagcactgcaacaacaacgttgtgatcaccacattactagaccagaagacatgctgaagctccatacaccacctatcgcataaagccgtagatggtcagggtgagatcgttcagaccgttgtcagtcaagaacttccctatgaggccgatacctgtatgcgagcttctgtgcttcacaggtgtacacattactgtagcatacacacatataggattgggagacaaaaggaagaaaataagcatattacgagttggccaatcatccaagttcatacaagtcacggtgttcaggagcaatcgtgatgcagtgtaacctctccggtttaacaaactgcaacacacaacagcttctgtctgtgcagatgcaagaacatcatatcagctatgcagacaagaaggcaaaacaagtcaccggacgagaaatcatcttgacgcggtaaaaagtgattgtgcctactgttctagtcaatgaaagaggcatgccagcgtagttagtcaagcaactatagaatagaacagtggaaacctaactatacatgaataaactactgcaatagcagccttttcaggcatccagaatccttaccaaggcatgtccataacctcacttttactgctgaatagtattatagtactataccacttcaatttgcagagctagctgctatgcaattagtagatcttgaggtcataaacacccgtataatcagtggggcagtgtgccggcatctagctactactggctgatcatggtttaaaatttcggccccaccggcaagcacaaatctccccgaaattttcacgtttttgtcaaatatttgtaaatttggtcacaatttgttcaaattcagtcaaaatatgttaaaaattcaaaaaaaattggccaaaaattctgaaattaccgaattttggttctttcggtcccactggctaaaacccttgtttcgaaattgcccctgtggcttatcgagacgatgaacaagacggcggcaggtggagttgcatatgatcgtggttgcgctgggacaggatctgaggatctcatggggcagttgctccatgttagtggctcaaccaaaacaggctgtaggagtgtaggtatgtcataattaacctctatcccaaccaaacggtatagctctgaggttgagcattgagctctgaggtctgatcttccttcgagtgctagcagaagacatgtccaatcatgtatgagtacacatagctatattgaatatcatgtcaaaacatattgcttttcatttaatttgctcttcaaattttgtgctagtctctaaaacatagatatacttggggcaaacatagcctaaagccaataccagaatttatcatggaaaatgggctttcaatgctaggcccctggccatggccgagggtgcccgttgctaggttgcaagctttatgttgtcatgcatagactgaataatatttaagctagggagtttataagggggtatagtagtgatatagtatcatttatcattctatatagattttactttgagcttttgaaagcacataaaacgagagcggaaattgagggaaaggttagcaaccatgaagttgtccatgagacgagagatttatagcacacaatcacgcacataggattaggaggcctggtgaacaaaatcagtgctttgtgagtctcagctttgcgggcgtgccagataagctacagaactctgatcatcaggaggaggttggacagactttaaggagtagaccagtaagaaggagtaactgtaatcctagagtgtttgggccggaatggacctaacttctttgtaagattttgttttgcttgaaaaagaaggcacagtggcgccgccgatcctgtcggattggtgaaactatctcgtgttctcgagcgattattcatttccatctagttctctagttagtgtagctaacagtgagttggctaaccatgtatggttgttgaagtgccgcattgagaggatagatatatatcatactcctgatgcagagaaacatcagttcaaacagcaacacacactacactgtctctacaactgtgacaagaaccaccgcgagcaaacaggatggagggggtccagacggagcaatgaagaaacatcacagctcacagaccagcaggaaaatgaatctcccagctaaagtttccacaccaacagtgtgatgaagggattgtcaggattagggttcattgcaccaacaacatatccatccaatgggttcatagaaagactaatttgaaacagaacgacattaagctttccaacatcctcagagttgccaaatctaagcttaattaattatcaaacaaaatacgtactggtagtcgatgctcgatgacatagccagacaatacagtcatgaatagatgctgcaactgaagatcatagcatattttcagtttgcaaaatcgtagcattcgcatccagctagcatccttaatgtgcgagtaatagatccaacagatcttcatgatcaggaataattgtctaacagcagcatatagggtcaaggaagaatgaaaaacacagtggcggcggtgagcaaaggcacagagtcattgctggaacagaactcatgagtgttcaaccagtgtattgctctctccctcttcagagggtagcatttatatatttatactgagttacatgtaaaggaaattacaaccctacccctatctctctagctataccggggtggctgacaggtgggcccgccaacggttcgggagcccattcaccagaccaagagtcagtggcgcccattaaggagggcggtatggcgccatcatgatgctagtgtttacttgggtaatagcgggctccaggtaatgactagcatcggctttcacatcgccagtcgtgacgtgacgacggtgatggttggaggaagagtagtgcgcttttatagtgccccatagttattcccggtgtcctctgtaggcttcggctttggagccatggcaagagctctggagcctttgagccggctcatgggcctccagatcccttgaaccagctctagggccttcagaggcccttgactgggctttgggatcccccgggccttccggttgactccgaactcctgggagcgaactgccctcttcgggctcagctggcttcctaggccttcggattgggttctccctgcggagacgggctccatatggcactggtggcgggcctcccgacggggccctatctcctccgaagctaccagggagtgaatggtgcaatgtcgctctccttgccccaacagtcatcctccatggagtaccgcaactatgaaactaaatttaggccatcaggcaatttggaaatgtgttattttactcttagttaatcacacttaacaaactaatgaatcaataaccatttaccagaataagccaataaggtctaagattgttggcccaaacttcataattgcagcaaaggaaattagaataaggaccacttgattgtatataacgttttgctccgaagtactcttagccattttcttggtcagaataaactgattgaataagggtgtgcatttattcattgctttatcactgtatggcagtagttataaacgggagtgtggagaagggatgaacaactgggaacttctacatgaactccacattccagtgagaattttttttatttgctttgaacgtgtttagttagccacacacgtagaattgggaggcatggtgaagcaatggagtgcgattttagttggccagccatccacaaatttggaaatatcagcacggtggtagcaatctactgatgggctaaaacctctccggtttatctgcaacactgctacctctttcacttttcgctgatgaactaagaaaacaatgcagagacctaggaaaagtaatgtaaaaacatcagtagtatcatattccaagaccagcaggcaaatggatcgcctggtgtagaaatcatgctcaagctccttgcgacgatcacctatggtcatacaaggatggtcggggactcggggttttgctatgcaatgagtctccgtccactaactttctaggtttcagagaatcagtaattgttaaaacacagtggcaggcagcagccacctctagcatcgttacaggtgtcaatattcagttctataattcaacagaaaatatacagtgatcatgcctaggtgaagcaagttaacttgtaaatattattacttgattccgaagctagagccaatggtatatacatcccactttacaaaatcttggaaaggtttccggaggcgtctgacttaaggcggccacctgtgaaatgcactaccacacaggcggggttgtgaggtcatcttaattacgcagatcaccgcctgtaaaattcattttcatagaggaccgccttaagatgaccgcctgcgatgatcctttttaaagacggtgctttacccgcctatgcaaataccttagcttcacatgccttttaagcggcaatcagtggacccatctctgtaaatgcgttttagccacctatagaaagggttttctcagtagtgtgtccatattgagtaacatcgaagtcatggactttatatacgggtgtacttatagtacatcatttatgctttatattttctacttcgtaagatataaaatacaacagcggagagagtagcaaggtcaaaacaggggaatccataaccactccacgaaatctagataccagagtgagagagtaagtgctttgagcgcaagcatgcaagatggctacatatatatgttggattctgaggcgttgcgaatcaagggagcacagcaagttatgtcatatcacaacctgaaaataagcttatggaatcctgatgctacaaaacctccactgtttgtaacacaactgcttcctgctcttaattcacggtacaaattaatagtgtagatagcaacccaagaactgtagtcatagcctactccttgacaatagttggtaatcgacttaccggactgagatacattagctagctagagatgcagatgggcgctgctgccatggctaattagtggaagactagctagggctagctgagaaatgagaatcgcaagacaatataactaacaaaatacgttccatataaaagtcaagtgtgaaaaagcatagtagcatatataatagctattcgaagatctaggattgggacgaagagagtactacttcgtaacatatataggattgggagacgtggtgaagcagaggagtgcgttgtgttttgaccgtccatgtttgttgaagcatcagcgctgaggatgcaaactatgcagatacagttaaacctctcaagaatatatagctagagaaaaaaaggggagaaaagttgttctcagatgacttatataggtagtgttttgacgccaaaatgatttatatttggaaggagaggaagcagtggcttctgaaggcgacagatatttataagcgaaattctaccattatgctattcttaacagaaccgagagaattaagcaggagattataacacattttggttttccatgatgcaaatgcaagaggcccatcacataatatacaaatacatgttgttgcatacaagggattgagaggtataggaaataaaacgggagctttaggtatctgaatgtccaagaacgctttgatgcattcaattcgacgaagcatattaacatcataagcggatgttataaaaccagccccgaaattgacatcggtagctaaaacgcggaagaaaacgccataggagatctaaaacgatgacgacaccgagacacgatatttggtaacggagttcagccgtagcctacatctccggggcactgattacgggcgctcctccccgatccagcatatacagcatatcagagttacaacgactcacggccggtcgatgccggcagccgctccctcttgctatgctaagtcgccatgcggttacaacaggcacgcccctctatttatgagagaacctaggatagagtccgactcatactctagtcctaatacccattataactccaagtcctaaactgtaaccgactacgtacacatattcgacacaaactctaacaaactccaccttgacgaatatgccacgccaacctgaatttgttacttgctcgaacctccgtgtaccaggacttgagttggttctgccacagttcacgccgagccacccgacgagcctacgccaggctcaccgccttcaggatcgtgcacagcaacaccagcatgcctatcttccatgactccacctgcaacagcacttccttgtaacttgtacaaacatgagcttgtcctctcaccagtcataacagtcttgccgtccttcatgatattcatggtcttcctatcaaaatccacctgatacaaccaacttgtctcatgtaggctcccaagcgaaatcaaactcttccttagtcccggcatgtgtctcacatctgaaagtagcacctcgtttccatcatacatctcgaacttgacatcacccactccaacaacacgataactcgtgtcatcgcccaagtaaacaacaccaaaatcaccagatttgtatgaagagaaccactcccgcttcgatgtcacgtgataggaactagctgagtccaacatccacgcttctccagacttctcattagacactgtgagagtctcatgactgctgctatctgaatcatcaccacgagctgctaaacttgcaatgccacctttcctcttcttcagtaacgggcaattcctccttatatgtccaaactcatgacacttatagcaccgtgcccccttatccttgctcttcgacacccccgcttcatgatcatgctttgccttgaccagcaaactctcagcctgagaagcctccattgcctcgtttttgtttgatcttctcaagtctcgtgcaagcaacgatgaaattttctcctcagttttgacagtatccttgccgtgcatcagggtagtcaccacatgttcatatgacggtggaagcgagcacagaagaattatggccatgtcttcatcatcaagtttcacatctaacttacttagatccacaaccaactgattgaagacgtccacgtgcttcctaagatctgactcctcttgcatctgcaaaccatacagctgttgtttgagatacaacttactcgtcagcgacttggacatatacaggcttgccaacttgtcccaaatttccttcggcgttttttcatccatgaccgggtacatgacagaatccgagagactcaagcgtattgttgcagctgcctgcgccttcatctcctcccacttgccagcatccatcttttccggcatcgtctcctcaagagccttggatatcccttgttgagccaatagatccttcagcctcatctgccagagaatgaaattcccggtgccatcgaacttcaccacctcaaatttggaaaccaccatcgccgccatcgacgataatcaactcaacagctgttgccctgttaaattgatctgccctgattaattgacccaccgactaaacttgcacagtcaccagtcggacaaaaccaaccccttttctttttctccaaaaaaccggttcggtttttttttcggtcaaaaaaccaatcaaaccgagcggtcaaaggaatcagatcgattcctctccttccttcggccttttctcgctccccttcctcctgcgcacgcgttctcccgatgcgccgccgcctcctgctcctcacgccaccgttctgtgccgccggccccgcaagggaccaccgcgccgccccgcctcggaaaccgcctgggcgccgccacctcctgccgccgtcacctgcgccgacttcgcgaggagccgccgcgtcgcctgccttgggaagccgccgcctgccacctgggagcacccgccgtcgaagtccggcgccggttcctcgccgggaaccgccgccgccgccgcaagctcctgcccgagctacgacgaacgccgcgccgagcaccacgccgctgcacgccgcctgcaatgacgcctccagccgcccgtgaactcgccgccccaaaccacgctgcccacgaaatcagaggtaagatctcgcccttgccttgtggtttgtttcgattgcgttgttgcaatcccgtggtcctccgctgcttttatttgggaaaaatcgagtcccattcatggacagatcgtaatcctcgtccgattccccttccgtgcttgactaggtctctccctcaatctgtttctctattgtgctatgcatccgagttggaaacatatccgactccttccatgtcacaacctctccagatcgagtcctgtgcaatccgacttcctgctactcaggctctggccacgttccatggtcccggcttcaacaccaacacgtgcacaccgccatctccgtgacctcctcagcctccacgcacccgtacgacctctagcgtagccacctagcctcccgctgaacctcgccagtgacgaataccgccggtcagttgcaaccaatgcttattgctgtgctaacacaattgatcagcgcattgacggtctgaaattgactgcccttctgcttgattccgtcgcttttcatatgtgcgctttctccgtagcagtctgtcacgcaaatacctcgtcaacacctccaaaacagcctataggatccacacgctccgacttttgattgaacgccatcaatctaatcgcgagccgaagccgataagtcgcatgccgtcttcccagccaccgaacgatccgagcgctacgtctagccgtctccctgtcgaacgtagcttatcgaaaggcccgggccaccccgcccagagtgttcgaatccaccgatcgagaacgccgatcgcctccagcttcaatcaacccgagcatgcggccgcacgtctccctgtcgagagtagctcaccggaaagtccgagccacccgcccgaagtgtccgacccaccgattggatcgccaatcgcttccgccgccatcaacccgagcaccacgtctagtcatctccctgttgaaagcagccatcgacggttccggccgccgccagaagtgttcgatccaccgatcaagactccattgatcgccgccgtgctccaccttgcaccaatgcccctccctgggcattacagcaggctatgcggtgtggagcacctccattgcgcctctaccatggaccttctgcaggctctgataccacttgttataaaaccagccctgaaatcaacatcggtagctaaaacgcggaagaaaacgccattggagatccaaaacaatgacgacaccgagacacaatatttggtaacggagttcagccgtagcctacatctccgaggcactgattacgggctctcctccccgatccagcatatacagcgtatcagagttacaacgactcatggccggtcgatgccggcagccgctccctctcgctatgctaagtcgctatgcggttacaacaggcacgcccctctatttatgagagaacctaggatagagtccgactcatactctagtcctaatacctattacaactccaagtcctaaactgtaaccgactacgtacacatattcgacacaaactctaacagtggctatggttggaaaacaattatataacaagatcagattacctacggttggaagaaaaagaaattgaaagtgttggaccgataaaataatttgtttttccaaaattggtcggttcagtgaaataagcgtgtggagagtcatattgtccattcgttttattcaaaaacttttgtaaaatatgtaaaacataaaaatatatttaacaataaatcaaatgataggaaaataattaataattacttaaatttttcgaataagatgaacggtcaaacatgttaaaaaaaatcaacggcgtcaaatatttaggaacggagggagtactttataagaaaaattccatatatacctctaattttttattgaaaaagaccgtctcatgccctgccattgtcattgctcacagctccgccaccttgtgccccgccatcgccgtcgctcgctcgctcgctcatgagctgttgcttgttttgccgctgcgactcgccgttcctagcctcgccgccgacatatccactcacgagctcgcacccgccaccgtcgtcgccatcgcctgttctcggccagggttaggattggagcagcatagagaacaagcgacgactacataacctagtatatatagtagtatttttctttcaactacttgcaagcgtgagcttcttcagttgacccaaattgaacaacatattatggaatttatcaggatgtacgatccttcattatttctacatcctccatttcaaaatgagttaacctattgttcagatttgcagtactagcatattcaatattagattaacttattttggtacgaagagagtacattaattgttcatgttgcttcctaaccgataaaaggagaacaaagagaagagtaaccatcgtcaatggagaaatcctttgtcatatcttacatacccatgaaaggttcaatgcatcacaagtgtatttgtgcagtgtacgtagcctacgcaaaaataggattgggagtcaaaaggaagaaacgaagcatatcgtgaattggtcagccagccacattaccaattttctccggcagcattgaggtatagaaatcataatagacattagagtctagctctcggctggttgatcttccacacactgtaactgttggtgtagtttaacaaaccgatgaagcaatgtagtggagatgctctagttgtccagacgagaaatggcggcactgaagctggtcagatcaggatgaagcagcaaaggcctgccgttgttggccaagaaattctgaaactatcaagtacaccttcaggatcaatatatggtagcatcatccttttgaagcgtcgtctaaaatccttacgtaccaagccctgttagctcagtttttctactgaacatgaacacatttacttgtctatagctagctagtatttgtcgatccggaggttagaaacacaaacaaaaatgatatcgtggtccgaccaaaatgggacggacataccccacaatggcgccgtgtggacccaactgaaacattgggtagttggcgacagctcttttgggctgaaacttctaagttttcaagtgatgaggtatattctattaagtctgggctatattgcatacttatggagcataatgctgggatatagctagtcttgttgattttcattttctaataatctaatatagttgcatgcttcgccagactccaacacatgcatatattgaaagccatcttaaaactgacatcactaagtacttgccatactacactatatatgcactaatgtgaaatatataagttacttagacttctggtatcctactatccttcatgtttacaccctagcagcaaagatgagaattttttttatcttttagacttttttattttctaattttattaatagaactttccaaaacgtatttccaaatctaaagcttttggccgcgctagcccgcctagcgtggccaaataactttgttacgccacgtgcagatgtcgtggcagtgttgttctgccacaccagcctcttgcctctcggctagcatggctaaaagattcagtttttgaaaatatttatttggaaagatttattaataaaattaaaaaaagtctaaaaaataaaaaaaatcgaaagatgactcatttatttgaaatctataacacttaatatacatgttgttgcatacatgggattgagaggtatatataggaaataaaacgaaattaagctttacgtatctgggtgtccaagaacgcttcgatgtattctattggacgaagcattaacatcataagcggctacggttggaagaaaaaaattatataacaatatcatagctcctatggttggaagaaaaagaattgaaagtctacgaccaataaattaatttgttttttttaaattggtcagttcggtaaaataaactaaccgtgtggagagtcacattgttcgcttggaatgctactttactgtgttgtgctccctcatcatgaaaattgtttcacgatgaaaagcagttgtttcaccatgaaaggaaattatatgaaaattgtcatgggatgaaaacctgattggaacttggaaacagcgaaatggcacaagcaaagcgcacgtacgcgatgcgaggagacatactctgcctttgtcaataggatggttcgcatgaatcggactaccagcaatgactgaagcggaaaaaacgaaaatactcacgctcgggcgatcggcgcagggggagccggatcgggcgctcccccgcgcgcctctcccctcacgtgcgtacctgttgggcccaacacttctccctcccctttttttaaaaaagatgtttcattataatgttttactttttatagatctaatgttttaccaatgagagggagggagagagcggcggcatcttggctacagccaacattgcccaagtacaacgcatcctccgctggtgccgcgctcgtcgtcgccaccatctcctcctcaatgctgcgcggccttcgcgcgccgcttgccgtccaccaccacgccccgaccactgctcgccatggccactgcgtcccgccatgcggaggcaaagaaagggcgtggcagagcggatccggtgccgacgaggtggatggcgacaagcggcggggaagacagggagagattggcggcgggagagagaggcgccgtgtggagggagagagagagagagggagagagtggcgatgagagtgagggaggagaccgtcgctgggaaaaaaaagaggagggtgtcgtagagagggagaagagaggggtagtacagaaaaatacccactgtgggctttttgggttgggacacccattgtgggtttgtgtatcttcaccgagttgcttcaaattttgaaaaccccacctaggcgtagcctccattgagagatgtgtgcccctgggagtgccctcagttagtgagggcactctagtatggttttgattgtagatgcccttagcatatcatggtcactaccaagcagaagttcagcactaccttgcgtggtgtgaagtgcgccaatttcaaaccaaatgtgagtagactttgaaattagaggtgatggtaaatctatttgaccattcccagcttcaaaatcgtagcaattgtgtattagtttccacataagatgaaatataaacattggatctagcgattggtcgattgtgaggtcagcacgtagtatgaggagagacaagaggaagccggccagcggttacacttgttgtttagtaatgaaaacgactccaccaaacccaacatccggtggcttgcaaaaaggcccagcccagttatatgggtgatacaatgacatgtcctttgaaatctaatttgggcccaaccaagatgggccgcatggaaatcctacatgtgcgtagatgcattgcatatttctatacgccccatcttgtatgggtcataactgagccactcctaggctcacccaactggaattttttgggcttaaattgttgagatcttcttccaggtacccattttgggttcagactgtgttagtgtttaactttaaagcttttttctatttctcatctcttccatccacctcatcaaaaagataatgctttaaacccatttaatgttattgcttcgataaattcttatatatatatatatatatatatcatcctgatcaaattctaacagagaacgcagaacaaatctttgaaaaggcaagcaagaagtaggtgtacgtgaactatcaggtaattaggaaaacacatatggggagcattgatcaatgatctcctcgtcacccacaaatacctttaggcttggaagacatcaagaatacagtagggacacttgtatccaagggcggagacaagagtagagcagctagagcttgggaatttgatgaaactactactggctcagtataacggtgtttaggcatgtgtcttagggtttttaatggaacttcatgggttgttagatggcacgaacattgagtttctaattgttctatttgtatcagaagctacaacatgtaaagttgagttacattgtttgtcttcaaagtaaaagagacagaaaactgccccaaatcccccccaagtcctttgtttcttcctttgctctgaattttgtcggaacagctacagagtgcgcccaaagtgttcgtccatggttcttcccaacaaaactaattctaatgaataaataatcttttattttgcaaaatataatttaagaactgctgctccaaatttcataatagggaaaagagtaaaaaaattcatgacatttagaggcccagcactagcctaggaatttgcttcccatatatcttgtccagtgctcatgccatgttgaaatacttttcatttttctttcatcaaattgcatgcttcaccagcacgtccatattgaatgccatctaaacactaaaaatacatcccacaaatcctttagcatttttaacccgaaaacttgctaccacaagctttcccaggatgcacatactgaatctctctatgttgacgttttttttttggcaaacaaaaactcaactaacaatttgagtataatttgtggacaacataaatgctactcaatggacatatgaaagaaaagcagagacatagatgagcaacatgagaacttcagcttgagatatacataccaactagagattcagttgctactgctttacaagactatttcatagcacctacatataggagtgggaggcatggtgaagcaaagaagtgcattgtttgtctaccatccatcaagagtaaaatttttatcaacacgcagttcagatactctagatgcagtataacttctcgggtctatctataacggagccgccgcttcaattttcctattgcctaaccaatggagcaaacaatgtatagtgtctagatggctttggaaagcaatccaagaacatcagtggtagcttgctcctagtccagaaggaaaatgtgtcgcttgacgaggtaccactgaatcttcaccagctatcgtgaatgggatgatctgagttggatgtgcaaccaagacttcgccacaaaaatgggaaatagtcataccaagatgaagcaagctaagatgcatatattaccaattatatatgtatcccaatttacaaatcaattagcattactgtgcgatgttagagaaatatttcagatgattttcctactcagaaagaacctggtacatttgcacggtgcattaacaaggcagaagaaacataggctctgcttgtagaggcagagatgactattgccgggcacacacctgatgcgggagagcgagcatggctggaggtaagggtgtaaatgaataaaccgcgaaactcacttataggtctgacctataagtgggttttgcagattaaatacttattcccctggcttgaggtcgtcacgtacagaaacatgtcactcgtagccgtcctagctgagatacggtagcacgcgaaccagactttgtgaggcctaatgtctagcccagactatccaggccacatttaagccacatgcctagcccagcccagttggcaaggtaagtagctgaccgggacatgttggtgtgtaatgcacaaaatcgaacgaggaatggctctttgtaattcagatgttcctatagcattttcgctcaacaacataattggaatctacaaccagcggcgcgcggattcaccgccggaccagcacgcgggggaattgcccgggtttcgtctgcacgatccattgaagtctactgatttcgttgtgtacaagtctacagatttgctgatttctgacaaagttagcaggctaaactcttaattagaagccgtggaacaagcatgcttcactgtggctgaagtgattgagttgagtactagccatatgaatcatccttttttattacaaatcatcttgttgttcaactagtgaaaatttacatgcatgttaaactatgcttttattagaaaagctgctgtgtgttcaatttggtagtaaaatcggcatataaacatttgataagtcggtagtggttttatagagtttttattgatttgctcaggctgcttaaaatttctagttccgccattgtctgcaaccatgttttttcagcattcttttttttttaaacagtagatggtaggagttctaccggatatattagaagaagagaattgaccctatttataatgaaaaccgggcccaaaaaccatataactgcacagtttactaaagggaaaccgctaaaaccttgcacagaagacacaaaaagcctatgacaaaactacaaaccacagtagacatcgagagaagagcaaaaccttcaaggcgaagcctccaaggaggtgaacaacgacagaagccgttatcaacgcccacccaactgggctgggttttcacgcaaaaggggagagagtccacaaggcaacaccttcaacgaggaaacggcacccgtaggcgtcgatgtcgacgatcctaggagaccagactaggcttttgcctaagactccctcaaaaggtgtagagcctctaggaaaccagagccggagtgttgagtattatcgttgccccggcccatcggctaaacccgatgcagcagctccgactcagcctaaacacaaagactctagtatcgtagaggacaagcatcccgctcaacactcggcactacaacaggttcgcaccgacacagggcacttgaagcaacggcgtggccaaagagccctgactacagacaaactgaacctccaacacagacaaacagaacacctcaaccaccgaaaggctccacggccaggtctggaagcagacggccaaaaagaagggaggatcaccaaggagtgaaggaggcttggccggcttgaaaaggaactaagagctgagtcaggggcaacaaagacatcagtgtcttctatgaatccggcgaggatctccgggctttgcgagacacaccaaacaactgagcaaccacctcaaactaaaccaccaacgcagagagaggcgcgctggggcgaggagaagagcaactaagaagaaatgctagtgaggaagggatggggggaagggcaccggcgcagagagacggcagacgccccttttgctaggagacgacacagagaccaaaggaggaaggaggaagggaggaagagaataagaagtgggttgttgagggggtggcctcagcaaccgccaaagatgaagaagaggcaggagaccagagatgccgacgccctagaaggccgactcaccccgccgaccaccgaaaccggcaggcgccgcaacgccgccacgcgagcgcgacggtgaactccgccgcccacgtgccaatattcgcaccgccgcgcatgcctgtcgccactcgagcgccttgcgctgccgtgaccccgtcgcctgatgccacagcggccgccgccagccgcaccgtccaacaacaccgccacagacgctccatccagatccagcgacggcggtgccggatctgtccccgacaagccggaaacctcgccgctgccacccccgccacgggcgaaaaaaagccacctcccccatgcctgagagggggcaacagcgtggagaagccccgccgctgccatcctactcaccattcggctttgccagtagtgagctccagtggcggcgaggtagggggagggggtgacatggggtcagcaccggcggtagggtttcgcccaggtgtcacctgcgcgtgggagagggggggggagagggttgagtctaattctattatgtctaattctaattgtattatgtcttgtaatttttcagctttcacaaattgaataatattaaagtttcagcttttattttacattccgactctctggcatataaaaggagaggagatagagaagcaatactaagttgcgaaccgtattgtcaatcgagaactcccatgagatctacactaaatttagtggatcacgagtatcgtacgtgtagtgtagcctaccataggattgggaggccacaggaagaaaagtagtgtattgcaaattggccatccatccatatatgtcttgaggacgctattcattggggtagcaaactcagtagcttattaatgtagtccgaattaccaagcaaacatagtacaccgtagaggcctttggctagcaaagcaagattgacgacacatataatgctacacatgaaagcaagtaaagcatgtcgcagcgtttgaataagtgaaattgataaaatgtaattacggcggctgcaagctgattgagatgagagcaggaggagaacgctggtcatagtaagaagcaattgtgacaatcattgcgatattttacatgtatgcaaggaatatataataagagcagtcttttcaacgtcctttgcacttacaagttacaactcattttactagtaataatactagccttttaaattcaggcaacgcggtagctccacgttactaattagcaaaactaacacgaccaacaaacgaaaactaaataggtactttctccatttcacaatgtaagttattctagcattttgcacatttataacaatgttaatgaatctagataaatatatatgtattaatatctagattcattaacatcaatataaatgtgggaaatactagaatgacttacattgtgaaacggagggagtacatcattgctcagatgacttgcctattatattttctcacttcatatggaagtccatataaactctctaaattgttactccctccttccctaaatatttgacaccgttaactttttaaatatgtttgaccgttcgttttattcaaaaacttttgtgatatgtgtaaaactatatgtatacataaaagtatatttaacaataaatcaaatgatagaaaaagaattaacaattacttaaattttttgaataagacgaacggtcaaacatttttaaaaaagtcaacggcatcaaacattttgggatggaggtagtatgtacttgtgttttttctccaaaaactttacgtgccagcatattgcttagatgacttgtctattctattcttttacgttataggagaaagtccatatgtatatatacctccaaattttgattgaaagtctgtctagcaacctaaatcttaaaaccggacattcaaaccccaaaatcatatttttaacccaaattctcatactaaataacaacggaagttatatggagtggagtttacaagggtgtagcacgtactacgtgctacttcaaccgtagataaaacaagggtagcgcaagtgacaaaagcaaccgggaaaaacttcgcgagatctgagagagtcgatcgctactactgctttcgcacgaataatgtcgcacacagcttcacacacatatgattgggaggcatggtgaattaaaggtgcacatgacgacttcaccaaccatccatagctaagggtgtaggagcagcgaggtcgcaaacactctagatgcagtagaacctatctagtttagctgtaacacaagtgcctctctctctgttagtacgtccttgtagcttcgacgaccgagtaagcagtttagagcgttggatggaagcaaagcgataacatcagttctgcatgctcatacaccagcaggcaaatgaataacacggctgagagatggactttagcaggagttggttgaagcttcgacacctactgtgatatgaagtgatggctggggttggctgcactgcgtgtatgcaacacgttctacgtacagtactggggtctgatagaaacacttattgtgaaccacagtaattttaagccagcacactgcaccatggcacagatttgcccacagatgtttgtttgcaaaaatagagaatcaaccaataaccatcaatggggaaaaaatttatatatgacataggatctatcggcgcgcagtactttggcatgatgcagatcatatgttgggagttttacagattttgatggttaaactatctcttaacaattgcgagggcctgtttgcaagtgcttttggcatgtgcaacttttcctaaaatcagaagcaccccaaacaatttagatattcattcaaatgctaaaatgttgtagttatagaatccgggaaatgaactagaaaccaaaaactgggttttctaaatttttagaatctagctaccaatcagttatttcttaaaattctgagtcagcggtgtgtctgcaaagcttacctacgcaccatttgtcgccgaagattgatccattggatctcgatcaagcaacacaaaattactctcgctgcaacatatattttctcggctcaccacccgaaccctagatctagccgccagaccctcatccctcctcattcttcttgcctccgtcgttccccgctgccttttctccgccaacccctagacaacaaccctgccggcggccacctcccgccactagacaacaaaaccgccatcgctagttctctgggggcctttcgagggcaaggcggcaaggtggcgcgcagccgcacgaatcgattcaagctctagctagatgcagcactgaggtaaacatcctcacacataaaacttccctagttaaaatgcaacacaattgccccagcagcagcaggtagtgcatgaacaaccacgcaaacagtattctggagggctagggttagtacgacaaaggttgtgggtggcaatgcaagaacgctggaacaaattcacgggagtgagattgcgtgcagcatcacaacagagtgagattgcaatataacttgcctgtaactttttagagaaacactaggataaggtcacgggatataataccctcacctatgcatgcactgtgactttttttccttcctcgcttgcgtgaatcttggattgagtctaatgatctaaaattacgtgaaaagttacatacaagttacactgtatagtatgtatgttacaatataattacactacaattatgatactgtagttacatttgatattttttcgagaaattttgtcaagaaatgtaaataatggttcggaggtggctaggcgatgaagctaaagacctgaggtccggcccaaccacctgatgtacagcacaattctttccagcttaaccaaactgggctgcacttgtgttacaactatgccataataaatttaatagttttgagaaacacgattataattcaccttattgtaaggatgccattgcatccctttcaaaattggactcatgcttgatatctatttggaatccttttttggttattgtattttttatggaccaaaatacccctgcatacactttagatccatatgaacatgcttcattttagatcaaaacccaaactgcaacgaatcattgcgatgatatatctatcacacaaagagagaaaaaaaaagggagaatctaggataagaagaatttacgaaggaaaaaagggaagaaaaagagccagtcgaccccgagccggccatcccctccatgccgtgacctgccgtccccaagctcgcactgccgtcaaactcgatcaccggccccgacatagctcgccaccgccagatatgctcttcaggtctagctcgtgcctcgtacaggatggcatgaaaccaattttgaaagagttgaattagcatgatgaattatattagcattctttgaaattagcaaatttataatggtttggatccaatgaaccctaaataaaattggccaaatatacctgcaatcccattgaagcccaattaactggatatgtgagcctccctctatcctgcttgggcccaactgaaatgatcacggctcacttgggctgaaatttctgagcttttaagggctattttggtttgaagccaaaatgtgccttaccaatgcaaattgtttcgcactttgaatagtattttattagtgtttggtttgataccaaaatataccaataacatacaaaaagttactaaaattttagcacaccaaaacttgcctacgttttggtagtaccaatatttttggcatggtagcaaaccagacacatgctaagtgacaaattgttctttcgatgcccagcactagctaggccatggcaattgcttgactgtcccttgtatagtacacacgcttaattattgagcattcttccccacaaaaaaaaatattattgagcattcttcactagcacatgcacatgtacacattggatgccatccaaaggcttatgttaccatgtatcatatatataggagttttacccccaaaaacttgcaacatatgctacttgctacttctgtactagataaaatgagagtggagagaggcaggaaatttgaaacttctccatggcatcaaccgtccacgttattccaatgagagatttccacaattcgcatgcgtgtaccttagctatggaataacataggattaggagatatcgtgaagcacatgagtgcattgtgacccagacaagtatctagtcgtaaacctgttggagcgatgaggtctctagctcttgattcagtaaaacatctccagtttgactgcaacacagctgcctctacacttgtgtcctgaactaaacagccaagcaaacagcgtggagggatggagagaagcagtgcaactgcatcgaattctactctgctcgtagacgggaaggcaaacaagtctcccagatgataacttctttggtggagggatgaacgagacgtcgagacactgagctgggaggcaaccaacttgtgctttctcttacttaactaaatattgaaagtagctagcttgttgatggcatagcatttgaacatttgttttttctgcgtagatatatatgcagcagggtaacatgcagacatattagaacattttgaagctagaaccatccgtatatcccaattagcaagttcgtatgcctctcatatacggcatcatcgatccttcgttagaaaaaaatatagattacttgtacgaggaatcaaaatgcagaggcagcagccactaataaaaaaccctcataggtatcggctcataggtgtcggttcatttaaaaccggcacctattaatattttcccacttttgtgggatgaaaaaaatatagaactggcacatatgagtaaactatatgtggtagttcagagaacaaccggcacttattaatattatatgtgccatttaaattaaaaattgatacctataatatattataggtatcggttcttaaacaaaatacacccaatgaattaaactgagacgagccaaagacctggtgggaacttttatttgactccaccaacgcacctaacaatcttaaccactcataatgtctctccaccgacaccaaactcatctctctcacactcttctccgccgtccctctcctatgacgcctcctctccctcctctcctatggcgcctccttcccatcatctcaccgagcaactgcagccgcggtcatggtggcgtggaggccaagtcgggggattcggatcgtctaacttcgccctgtgaaggtacgaacgtacgtgtgcagtcacacttatccaccatccatgcaatccaccatccgctactgccttcaccctcgtattgattgttgaagctttgccattccatcttcctgctaggactggatgcatcaatcggcagtcatgcaccatgcttgctgcgtggaatatggaacacaactaaaatgagcggagcaaagtatgcattattgcattggattctatattgagcatacaaagcacgcattccatcaggcaattcataagtttcaaacaacaccactcattactaagcacaaatttacactggagagtcgagcgacaccgcaaatcaaagagattgtgaatagagtataggttgacaagaacaaaagcagcgccctagaatacaatctccatagctaaagtatgtattcagtgccatcagcagttggaaaaacagacaaaattaacttagcaaatttggtacttgggcccggcaacaacaaaaaatacttcagaggcggctggtgacagccccgtactggcagacgagctccggccgtgctagtggccactggtggcggcaatgacagcgctgagacatcgtcggactgacacttgagtgcgtcttgttgggttaccatcggcttcaaatagactttatcagcagttaattaagtgcatgcgtcacacgagccgttggattgcatggatggtggataagtgcgacatcacactcgtgccttcacgggtgaagttagacgatccgaatcccaagtcagggcagtttgcactgtcccacccactgcagtccgggctcttcctccaccgccggcgccgcaagatgcaaggcggccgtcggggtctctggagatctcctactcaagaccccttgctgtgcaaggtatgggatttttcccctttttgtgcctgtgattggtttcttgcatggtttcctcaagggactgatttcattgagatgggattgggtgtagttggcaaattggaacgtggtgcatcgcggatggcgaatacatgatgtgcgtgttctgcagtgaggattttttttttcatgttgaagttaaggatttaggggattattcgtgtggggttgatcttgatttgttgatttgggtgattgttgattctgcatgttcttaatctgatgttgggattagggcaatggatgttcattcttggtctgattttgggaaattggtttgggctggtcgaagcattggctcatagagccaatgctacgagccaacttctcctctttttctaatcgtggggagaataaaggtgccggttctaccaccagctccaatgactcaagggtattagtgccggctgcaaatcgacacctatgttgggtttgcaacaggcatctaagaggggttctgcagcagtgagcagcgggcacgaggaggcagggagattggtggcatggatgctaaggtagaggatctagcaagtaacaagtcatgatgtctagcccatctggcccaacctaactgagccgcatgtcatccgcaatcccgttcaggaccaaatattatgggccacatatcagccacaagtgcattccatcccacctgacaatggtgacagctagctaaactctcttttggggtgaaatatttgaggtacatgagggtgtacatagccaacaagataaaacaaggaatggttccttgtaattcagatgttcctatgccctttttcgctagctacttgcaacagaatgtttcttcagtgtgcccaagttcaataacatccaagttattatggactttatgaggtgtatgatcatacattatatctgcattgtatgtgttgcttcctcagtggataaaagctagagtataaagtgaagcaatacccaaacattgtaaatttagacatcctatgtgggatttacataccaacgataggttcaatacttcattggtgtaagtctagtgtagcctacacacattggattgggagacgaaaggaagaaaaatagcatatgttgacttgaccaatcaaccaaatcagatcaggactgcattgatgtcttaggccttcttctttacttcaactttttcgttttctgttagcacgtttttcaaaatgttaaatagtgcgctttttaaaaaaatctatataaaagttgtttaaaaacaaacaaatcaattatttatgtttataatagttaatattaattaattacttcctctgtttcaggttataagatgttttgactttggtcaaagttaaactgctttaagtttgaccaaagttaaactgctttaagtttgaccaagtttgtagaaaaaagtagtaatatttttaacccaagataaatttattatgaaaatatattcaattattgatttgatgaaactaatttagtattataaatattattatatttatctataaacttggtcaaacttgaaatattttgaatttgaccaaagtcaaaacatcttataacctgaaacggagggagtatgtgttaatgagctttcccatttcgcgtgtatgagaaaattttcctccaaacgtttgcaaagaacacacttgcaattttataacccatacacaatgtttaatgagtcattcggtttatcctaatgttataatacttaaaattggcggatgggtcagatgattttagaacaaaattagttggatattgactatttgtggaaggaatttttttacgagccacaagcaatttgggacccgaatgacaactgcaacaagttgtaggacctatatatatctgcgagcatgtggaccatcatttaaaacataggaccatcacaatcctcatggcaaatggacagatggaagtggaaccatctcatcttaaaacaggggtgagtccaacccatatcttgtttctgaaccaaacacatgcctagatgacatagacgagagaattttagggacttcgtgaccacatgctttgtcaagatccataaaaagaataacatttatgttaaaggactttataaaaggttctaccaaataaaaaggacagcggaaaaaaagtgggaagtgggcagctgacaacttctcgactagaccagtgcttcacaagcgaaccatgtagttacattacatacatagaaatgggatgcattgggagccaaaagagtgcgtcggcagcttgtcgtccatccaagatctcctgactaccagtgctttggttgcaaagtgttgatgcagataaccctctttggtttaactgtaacagaaatgcccgaacaaatcgatctcggtcaaccatgtaaacagtgttgaggacgaccggaaacgatgaaatggaaggggtagataaaaagctgattggctgctttcagaccaggtggaagttgtatggctgttatagaactcattgaattcttggtagcgggctcccaatattgtcgaacaaaaagtttccatagaaacagcactccctccatactcgtaaaggaagtcgtttaggacaatgtttaagtcaaacattggaaatataaatcatgatcgaataactctcaagttgttgagtttgaaaatataaaaattatatgtatagatttgtcttgaaaatactttcagaaaagtatacatatatcacttttcaataaatatttttatagaaataagaaatcaaagttgtgttttggtgaccgtgtcgctgtcctaaacgacttcctttacgagtatggagggagtatttcagaaacacagtaatatataggagtattttgatgtccattgatctacaacacgcttactgcaggcatacaaataaattcaatttcctcaagtactgaaattcagtggcagcagttcatcccaactgcacaatcgtagtgattgcgtcaaacacgagagatatatagtatgcacattggagagctaaccattagtcgatttcaagaatcattcaatgacacaaagtagatgatagacgtcaacaaaagcgagattttcagaagctgataaaggttttcaaaaggagatcattagcagttacccattcactcacaaaaacgactaggcttgaaagagatcaggaacgacagtacaacagccacaattgcgcagctgctggtcagtggttattacacttggagttcatacgaatcaaccagaagcaagcacataataggtgtttttcttcaagcatgcataatagtttttgcatcgaataataacttttccaaccacaagcagatttggtcctcagacaaaacaaatcgacactatatatcatgtgttcagattctcaatgatacacttcatgagagttttcgatctcgggtggtctccagggattctgttgaattgactggacattttgataccattcgaatttattcctttaactcagatctaaatggcttccattggatcattcattattttttttcgaattgcaccaaagtcatagaatttattcacaattagcatttctctcaacgaaattttgcttgagatatatcgaactcactatcccttgacccagtggagacttttcttcggggtgagaaccaccagggtatgaatgaaaattttattaatattggcaaaaagtgagaacaaaatctaatgagataaatgtcattttttatataaatacaaatcaatatccatattggctcaagccaaagttttcaataccagtcccaagctcaaacattatgtaggttgtaaggaacatattgttggaattaatagatgggccttagcccactcgaagtttaattctttgaaaaatcagaaaagtccaccacatgcgatggcatgcatagcgagtttagtaccaccttacttattctaggagagagggatctccttagggaggatgccctcctagccacttgaagtatgtgagatggagagaagagggggaacacacgcgcttgctcgcttgccgggccgggcaggcggcgcgcgacgtacgcatcgaatagatgcagcctgcttttgcagttatgttttgctgtgtgaaattcggatttgttttattttggaaatattctgaaaaatccgagaaaattcggatttgttttgttttggaaatattccgaaaaatccggtgcgtgaaaacagacttaaaattggttcctcacccttacgcagatgcagcctgcttttgcagttatgttttgctgtgggaaattcggatgtgttttgttttggaaatattccgaataatccggtgcgtgaaaacggacttgacaagggtgtgtaatcacctattatttatgcatagtatctcctccggtgcgtgaaaccggtcttgacaaggatgtgtaatcacctattatttatgcatagtggcttctagttctcggaaatattaaaaagagatagagaagcaataggcgagaataggctagctgggaacttcacagtaagataaataacaatactactctgagattcatggcttgctacttgcctatttggcatgcatgtaccgtggctacatacataggattcggaagtattgggaatcaacagagtgcgctatgagttggacaaccatctaatcccaaactagtgtccactgcgaggtagagaagtcctgatagagtaaaatctatctgttttcactgtaacacaactagctgttgatgcgaaaaacacacattgatctgtgagatctgcttagctccagtcaaattttggcgttaacatcagctcttcccacaggctcttatcaagcgagcacaaagtgcggaggaaagacttaggccttcttttcttcaactccaacattttagttttccgttagcacgttttttggttaaatagtgcgcttttaaaaaaatttctatagcaaagttatttaaaaaacaaaaaaaatccatttttaatgtttataatagttaatattaaattaatcatctcttaacgagctttctcgtttcgcgtttatgaaaaaaatttcctccaaacgtttgcaaagaacatgcttgcaattttataacccatacacaatttatttatgactcatattgggtttattctaatgttataatgtttaacattgattgacaaaattggttggatgttgactatttgtggaaggaattttttttaacgagccacaagtaattaatttgggactagaatgacacattgtaacaagttgtaggacttatatccatgagcatgtgggctatcccttaaaaaataggatcatcctattcctcatagcaaatggatatagatgaaacgtaccatctcatccaaaaataggggtgagtccaacaaatctcattttgttactgaaccaaacatatgtctagataacatagacgagcaaattttggggtttgccatgcactttactctgctttgtcaggattcataaaaagaataacatataacttaaggactatataaaaggttctaccaaataaaaaggatagctgaaaaaagggtgggaagtgggaagccgacaacttctcgacgaggccatgtagttacattacatacatggaaatgggatgcatcgtgaaccacaagagtgcactggcagcgtgtccatcatccaagatctcccgtgtaccagtgctttcgttgcgaagtgttaactgtaacagaaatgcctcaacgaatccctggagatcaacaatgtaaacagtgttagaggacgacctgaaaaaaaggatgctctcagatctctgcacgttggaagctgcatggctgttatagcactcactgaattgttagtagtgggagaacaaaacgttgccatagaaacagtatttgagaggtacagtaaataggactatttgatgtccatcaatctacaacacccttcttactacatgcatccaaataattagattcagttttcttatgacctgaacatggtattacactggcactggcttgacgcctgacgcaagagccagacagtaccgtggtgcatattgatgcagcaagacagggatggagactgctacaaaccctgaacctgaactttcgaaattgtgggttcctagatgttggttgtcccaggcatgcatcatatgcatagagtatatttttgcatggaagggatctcctgtaaaggggacttatttggagaactgtggatggtacaactatttttagataatggaagttctattggtctcagtcaattacatcaaagtgacccaattatcctaagaacactctcagcctctgcatagctaagatgcacacagctaaaacacactaaaagaaagacatcaacagtagtattaaggaccatcaattctgagactagatcgccactcatgtttccgggtaaaacaatccttgaggatggtacaactattgatgtaaagaatgataattggatccctaggattggagtggactgcttaaaccactgggtttaaggcaaaataatggtgtaatcaaagttaacgatctctttcccccagtaacaaaagacaatggagtatggaaagttaaccactggttccttttacttcagctgtacccgtagcatctaatttttgcaactactacttacaaccacaagttttgccagcatgcgcatattaaatgacattcaagttatggacttgacaagggtgtgtaatcatccattatttatacatggtatgtcctagttcctggaaagattaaagagagaaccaagaggcgagaattggctggctgagaacttcacaataagataaagttactataccgtgagattcatggattactacttgccaatttggcctgcatgtacctcagctacaaacataggaatgggaagaattgggaatcaaaggaacacaccgtgagtttgagaatctcatctaagcctaaactagtatccatgtagatttagagaagtcgtgatagagtaaaatctatctgatttcactgtttagggcatgtactaagggagagtcaggtgtgagctctatatcatcaaaggctattatcttaccgcagttgagacaaccattaatgtaccaaaataatcttatctttctcttctttcctttctttcaaaccacatccaacaaaatattttctaataaatgttaagagtcgactctgaactagtgttatgcgtaatgatcatgtttctctttccatccctctctttgttccatgtcatcaaatttatttgcacgataatagcgagagcccactagtaaagaccatcgtacataccctaacgcaaccagctctttccatgggctcttagcaagtgagcacaaagttccgaggaaagccaatggaagttaaaagatttcgatcgactgtagcctcctgtatgccagctagcgggcggacgagttgatcggttagatctgcactcatatggaaaggtgcctgtcgtcccttttttcgttccttattttttgttcacgttaattttttgttttccctcctatattttgtattttgtgtatataaatgccttggaaattttgttccgcatatatgaacttttgacacatctatatatatacatatatgcatatataggcacacccaatgaaatttccgtaagtatattacatctgagtagttttgaaggcaatcaagtatattcatccacaggtattttaaaactttatacccttcaattgaaagctgctcccagcatatggtgcacatctgaggtgaattattgctctgcaggaagccaagcatacactacaattatgtgcatgaatacattttttagataatgatgtgtaatacgtactggcagataaaaggggacttgacagaggacagaaaacattcagaactacaaacgggtttggagctcagacatgagagacacaaacaacacttttagtatacacatgcataaggcatacaaattaaggattggatcattggaaggtatcggcaatcaagctagttgctttgcaatttctaacagcttccccactacaaaaagaggcagtatttaggtagctaaatcttgctggtttactacattttaggctggtttctatctcaactggctagtgtgttttatgttcaagcgaatgcactatggagggtgcgtgcatgatgctgtcaggcgccttgcaactatattaccctggcatctgcttgagtaagctccattacaagaatctatcatcaacggtagcaccgatttccgataaattgatctgtcttgtacagatccgctgatcaagaaactttcatgtgcgaagaagatcagggggtacaaaagagatatctgaaaagtttattcaagacaaatgagatcgtgcaggatacaaccattagaaatttagaatttagccaggatataattaacttgatagttgacatggccataataccaagtatgcttgtagaaacaattttttcagtgttctccactgatgatataatcaatttagaccttccatcttttctcatccaatagacattatatatttgataaattttaccaccgaaactactagtagaatccattgaaaaaattgttggtagttggaacattttcttcagtagctaatagatatcataaagcaattgttcatataacttctggtagtcataatacttgtactatttatcgtaaaacattaccattagagataaccctaaaaatactcgcttgcaaaatgagaattcgttgggtgctgaatatgaaggacattgatactccaattgccccaatattagtctagtgaaatattttaaaccgttgacaaaaaatagagcgaaatttgattttgtttattggagtaatctaatactattttagctccgtcaactagtagcaagtgcatgcttgataaataaaggcatctaagctcaacgtacgaatgagtttactaggggagtacatttttgacagatttattgttactttggtcagataaaaagagagcgagagggcattgtgtcgtccctccacatagctgcagtcactacgccagatcagtcaatctttgatggtccatctctgatgcacagatttatattgttaatttaaagttttctttatactcttccacatataaactctagctgaagatcaaaattcagaacgtattggtgggagacgttaaaaagcgcttgtcatgcatatagtgaatttccaaataggattgggaggcattggtaatgaaagaactccgagagcgatggatccagcatccaagactttttagctgtagcagaaagtgtgaagcaaactctctctccatcgatttgccagttttcagatgttttggaagctaagttgcctctcgcgctctggggcaagtgtcagttgctgttcagaactgtgcacagtacgactgcctcaggtgaagctagctgtgttgtgcatgtagcttcgacgattggaaggagagatctagcagctgtacgactttccaggatggggttattcgagtgatcgattagggctctgtttagttccacatcaaaattagaagtttggttgaaattggaatgatgtgacggaaaagtttgaagtttgtgtatgtaggaaatttttgatgtgatgaaaaagttggaaatttgaagaaaaattttacaactaaacacagcgtaggtgttctaaacaaggataatcgctaaatgaatagagcatgcacccataatgctcttactccttaatggaaaaatctttcgaaatgagcttccctcgtttagtttttagagggctttatttaaagctgatgttcttctgcatatgtgcagaatgaagaaacctctaaaagagatagttttttattggttaccaacagtgtaatcttttttctagtctcttgtaatttgtaaatatctttttttctataaaatcacactgcgaggcaaagtcatgcagtatttccggtaaaaaaaatattcgtcatgtagataagtaaccgtcgtaagcgtaatctgcataaaatctcgatcttaatttgctttctacatatagtagtataatgcggcatagcatatatatctcctacttcctcttccaataaagctatgacaaagaaagccaatcaggggaggagtcgagtccgaacatcatgagaaggaattaatctgaaagaagtatataacgaggcatcaacagaaacaaaatcatgcggatcttccattgtaagaaggcacgatgtaatttggcaatgcactcaaagcaatatgggtaaaaatctaacaaaaagtactagtaccatacttcgtcttaacggtccaacgaaagatcgaagacgatacgaaacacctttcaatacgtgaaaattctagataatgtgtatacaagggaaacaatatataataatgactcgatggaaaattaatctgtacttttacttatgtgcataacttatgtttaattgtcgaaacaagattttggcaatacgaaaagggggtggctatcaagctagaaaagtggatgggttttgagacacagagttttatacaggtttaggccctctcaatgagaagtaataccctactcctgtgcggagattgatccaccgagtgtattattgatcgtatgatctggaaaaaaagttatgctccaagagacacccggacccctccttatatagggggaggagtccatattacaaggtacaacccagtcggatacgaaactgactaagaggtgagtaaagataaaatataatcgtaactgactaagactcagggtatttccttgatacacaagtttggaatttaacccgagtcccttaaagatattctatctacatacagtacccctatacctagtcggatatacatgccatgtgggtatggggtatccataatctccacattaattttcttaacaaagttagtgatcaccagtcattgtttataactaatttatacttgtaccataagttgagtgaaagttggggattttctataaagtagtgaacattgatgcaattcaacaacaatgtactgaatattttctgttgaaacattcgaccaaaaaatctatacctatactaattgggcactttctacgaactctcacgttaattagaaaaatccatccgttaatcgagtagacagtgtaatcttaaccgtagattatcaatctccttttaatcgttttaacgtgatgggcctggcaaagcccattcaatctgtcctactgtcacccacctacgtataccttttcttttttttctaatattcttttaatcctttttaacgtgatgatggaccagtcaccagggaaacatctgtctggctgtctcccacataagaattttaattctttttctgtttttttcaatacgcgagtactactattttctttcagtaatctgttgtcgtaagtattcttttccacagctgtacgtccaaaattggtagaacggcataattgcattattcggtagatggcaaggattaacgcgtcgacggtagtccttcttcatatgcagatggctatggcgtacgtcctgcaaactctccagctctgatgattttctcaccaagagacatcgttcgaattgatctctctgcctccggttgatattttcttaacaaagatttggttcaatttcttttgtttaattcataactcagctatgccatcatttgatcttataaattcaggtgttatttgcatgtcgatctagaattaaacaagttcacttgcacccaataagatcgggagtggccagtacatctgcacagcattataaggaagaagcatatgcacacacaccccttaatacgcacctaacaaatgcatactcaaataaacggagattagctgtaaaaccaaaaaccatagccttcatatggatggtaagtgaatccttacataactttcaaatatgactaatttaatattttttatgttacttggcatcatatcctacaaatatgaagaactgaagaaaacaacacacacatgagacataagattaatcctatttcgaattacatatatagatatatattttatattatactccatgtggttaggtgaatcttattaccagctgatcaacttcaagttgagaatttgtttttaaagtaaacattccaattgcaatatgtaatctctttagcttttcaacattgtctaaaagcaagattccaaagtccaaaccaaattaaaagtacaacacgaacaaacatgcatgattaattcttaatttcgaaattattctatcaagtaaaattctcgatcgttactgaatactaaatctaggatcattaaatcatggaaaaacagtaactaacacttgaaacaaagaacatttcaatacttattaaatagtattaacttcacaactattaaatcatgaaaaacctataatcaaggtcccaaaccgagtacaactctttaatagttaaattttggagctattaaataacaatattctataatcaacacttaatgtccatactgggtatagtcgtactaactaattttaaaatttcaaattaaataatgaaaatgataaaccatgactccatagatgcgtgcaaatcaacagttattaattcttatttttaatattattaaatatagaaaataaaaaataactagcagagaaaatattaagatggatgactcaatatttgtgtatttttcatttttcaacaatcaatcattctgctgtgtttagaacattaatataaagtctacatgtaaatttaataactaccgtattggacatatgataaaatttcaatattaataataatatcccgtgcaacgcacggatagacggctagttatctgaatttaaagacattgttcgattataccagttagctagctgacattcagtatgtgcgcaacacactatcgccagttccctttgcttgatttcatcgcatttaataagtttggactttataaggatgtgcaatcacacagtgtgttttcaactgtatctctccttaatttcctagaagataaaaatgaggagaaatagggtgagaacagggcaactcacagctagcatctcggcaaagaccagtgcttcacatgcttacaatgcagttacgttacaaacgtagaactaggatgcatcgggaatcaaacgagtgcattagcagttagccaactatccaatagttcttatccaagttttgatgctcttgtttagctgtaacacaactacctctgccaatagcttgtggccttccggtcaaccgagcaaagcattttattgcttttagtttttcagtctctgccgtctccatattttctagacacccaagagtcaaaatgtctcatagaaatagcatggttgtgcttcagaggtgctcattgggaacttttttcatccacacacaaaacgaggtagctcattagcatatcattatttaagtattagcttaaaagcttcaaaatggattaatataattttttagaagtttttctatattcattttttggaaaaaaaattgtaccatttatctgtttgagaagcgtgctaacgtgaaacgatggggtagaatttgggaaacatgagttacaaaggcagctaagtatgaaacacagtaacagcagtatcgtaattccgaagccaatctctacagaattaattcttacgcatgccgtcaaaataaattcagttttctaattgaacatactaggtaactaagatgcacacattaatagattttcaattcagaggcagtagtttatcccaatgcaaaatcatagagttgtatccaatataagatgaaatatacacattggagatctggccagtactagttgatttgacaatttctctcaatgtcaccaaggagatcatagaacacgaggcagctcatacacatgaacaaaagcgagaatatctgatccagattaagggtgtgtttaattcacgctaaaattggaagtttggttgaaattgaaacgatgtgatggaaaaattggaaatttatatgtgtaggaaagttttaatgtgatgaaaaagttagaggtttgaaaaaaaagtttgcaactaaacacggtgaaagaatctcatatagagagccctatagcacatacccattcacacacaaaaacgacgactatgacttggaggataccggaaatacagcaggcacagttgtgaaagctacaggccagtggttaattcactttttggccgtgtttagttcccctattcccaacttcctatcacatcgtatcacatcaaaaacttttctacacacataaacttctaactttttctccaaactaccaactttcttccaactttctaacttttccacatctaaacatagccttttttttgaagcataaaccgatcaggcaacagcctcagcagtacatttattcgatagcaaccgagagtacaactgattttgcaaagaagcccccgaaagtagggaagattacacttaaaacacaagggatgcaaagaaggacctgaaaagataatgaaaaagcaattggagccgtggcccggctgcagaagatgacgcctaggctcgaacccaaatggggcctccaagagtaggaggttgaagaagccttgacaagcaaagataatatcactcgcactttatgaatcctttcgccggagacgaagaagatggccaacaccaatgcaagaagctcgccagagaagaactgggcggccggcgcaaccttcttcttcttgggctagaggacaagtctccaaacccgagcaaatcagcggaactcctagttgtaggcgttgaaggggaacccagcaagtacaagagaccccgatcgatgagaatgccggtgaagtcctccatggccgcaagccgggacaagaagagcgaaaatgccggtggccttcttgagccgcacaacgaacgtgattaacccgactatgggagagacccaactaagctaaagctatacctattaaaggagaagccggacaccctcccctcttactggcgaccggagagccgccggattccgaaaggaagaggacatgaagaagcactagtatgaaatcgtccatctatgacgttttgctcgtgacgctgtataatttcgtattgaacagagcatatctatgacgaaatttcatgttttgtcagggatcactcatggtgggggtagacattgaaactccatgacgaaatttaaaatggcgtcaaaaaaacaatagataatttcgtcacaatggtgtgcacgattcatgctcctttattagtacaatttatgctgtaatagcaaatcaggttgtcactggacccacatataattaaagataaagtaggtcgctacattcgttttagttatagcccatgtgaactattttttctaaaaaatatgctgcacacctaggggtcgaaccaacgacctgtggaatggcataagtcaagcttaaccactacactgcgaagatctttcatgctattggtgtctcaattctagttttttttttcacaattcttgaacgcatgaatgattgaatgttttatgcggacgacctaggacctgcatcacctgctcgtggggttcatcataaagtgtggtttatctttttaatctctggctaaaacttgtaggtagtttttctccctatactaacttcaaatttgattattcctttttctaaatttttctaaattcatgatctatcaatttattgtgttattacaactattatttttgtcataccttaagggacttttttttcaccctgggagacgctccagttaattcacttggagttcatatgaatcagccagaagcaagcatatggtagtatgttttcaaatatgatattcctgcatcttcagacgccatgaaatatgcataaatataatattcgaaaacatacgcaggaatatgatgtgtcgttctttatactttgttagaagttgttatatttggttttcagccaagagttgtagcttatgttgaagtaaatgctatctccgtattttaatatataacgccgttgactctttttataaatgtttgactattcgtcttattcagaaaaaacttatgttattattatttattttattgtgacttgatttatcataaatatttttatatttgcacaaaaattttgaatatacgaatggtgaaacattggtaaaaagtcaacagcgttatacattaaaatatggaggtagtagatattatcaattatcttaaaaaaaggtgtgatcacttctcttaccacgaagggggccttgctcttcaaacagaacaaaaaacgggcaatttcatgtagttcatattctcatatttcgtgagattttgttatcttggatggctgggagattttattgaacaggccaaaaattttgaatacattcaaatttcttaagttaaattatcttttttcaaactgcgccaaactcatagaatttattcactattagggcgacgatcagcaacagacggcaacctccagatatagataccctcggtcgcctcatcgagctcgtcgtcctcgggcaccgactgtgactccatgccactgccgcccccactagtcaacgagccgcgggagatgccacgacgatgacgacctcatgctcaatgggatttgtcggccagacagccttgaggccgttccgccatcattctaccgaagatgagatctaggcggaggcaaggtggcggcgacctcgatggcggccctccgtcttcctcccgatggcccaacctcccacaggcaggctgtctgcttcgtcggcgccatcatcgattcgggaagcgtggagcaggagccgggaacatgaggaagtgcggactcgtcatctagatctatccatatccacagcagctgccactagtggagaaaccatctttggtcggtccaccagatttcacaatagtcccggttggtgttaccaaccggggaaaagatcaatataagctttactcccggttgatgttaccaaccgggaaaaaaaagtcaacataagcggggtggttgcacgcgatcggatcaatacaatctcctcctctccttttttaactcatctcctcatatattcacccttatctcctcctctccctcctcctttcctctcctctccctcctccccacctccctctgcaacggcgggacgcagaggcccggccggcccgcgcggtggcccggcgcgcggagggccgaccggccggtgcgcggcggctgccagccagcgcggcggcgcggcgtgcgaagggtcgggcgaggcagcgcgcgggcggctggcggcctcgcggcggcgcggcgtgtggagggtcgggcgaggcagcgcgctggcagttggcggcctcgtggcggcgggcggcgcggcggcgggcggcgacgcggcgggcggcgcggcaagcggcgcgccggcggccggcgaggcagcggccgttcatcttctttcttttttttctttctttttttataaatctgtgattcggatatgagacgatttgtgtgtgatgtgaatatgtgatgtatttgatttgtgtgtgatgtgaatatgtgatgtatttgtgatgaattttgtagaagttgtgatgtaattttttttaagattttgttatgtatttagagattgatttgagaatttggagactattcggggatgattgatttgggattttgggatgggatagggtgaatcaatatattaaaaataatgaagaaaagaatagaataaagtagcaacctgagctctatctttagtcccggttggtaacaccaaccaggactaaaaatggattttactcccggttttttcacccgggaataaagatagcgatctttagtcccggattcgtagtcccggttgaaaaaccgggactacaggggggttacgaaccgggagtaaagcccctttctccaccagtgtgccttcccaatgcacctagtcatcatcaaatcatccaagagatgtgcggggcggtggcgccgagaggcttgcacgagcgccacctcgagcttgcttgatggcagcggtgggcggcggcgccgccggccttcacggtagtct

SEQ ID NO: 65111 - DNA, 2665 bp, Oryza sativa
ttacaatttggaagttcaaaatacctgagagcatgctacgttttttcaccaagaaactgaaatgaaactggcaccctcaagttttgagacttagttggtgtcctaaactctcacagttaacgatgcagatattattttccagggactgaaattcatacattgttatgtcattagacaaagtttcatgtctacaagtcagttagatgttgtttccttggattctatttttgaatattctttgaggttcagagcaacagcgacacaaaatgcattgtaatggtcatctagaacttacaggtcttttccattgctagaaattaatttattgtcatgatattattaccactttattttgtttttcttggtacttttcctatgattcaatcagattggctaagtttgagtgcagtcatattttagcagttaaccagtcattgggtgcaaaaagcccatgtcaagatttaaggcaaagtttctcatatgaagaaccaatgagatgttcagctgcgtacttgtataacatatgcttccatgatgtgtatgaaactcattctatctttcaattccagagcaaagcagcagagggtgatattgtgggtaaacatacaaaggggtgtaaatgcaagagaacagagtgtctgaagaaatactgtgaatgcttcaaagctagtgttttctgttcagagaactgcagatgtacgggttgcaagaattacaagagtaatgcagatagaatttcccagaagaacactgttcatgcgcatcatgtgcagaatcctgcttcaagtgggatggttggacaatctgtgataattttccatgcagcagaaaatgactccagtctttcattggctgcatctgtgagcgatcattccattaacaacaacacttcacatgtaattcttttgcagcatacttttcaaatttgtcacgggccctgcttcctgataggctgatacttaatgtacaacacaatttaaggctatctactgcagcaatctggataagtgatgatagttgattagagaataatgcttttgtgtataaaacaaaataatccttctgagcaatcaaatggctttttactaaacctcaatccattcaattagcaagggtgcataaacagaatctgaaactctgtttgttgacatgcctccttgttagctccatttcaggctctttcgtgttcactcacttcttctgttactagagaagatgctaaaagtctcgtaaaatatgtaccacatgaagttacttacaggtgaaaattttctcatggtcataatggttttctctgttgtacttctttcattctactgtataacatatatttcattttttaaggccaagtttagcagacatcatccagatagaagatgtaaatgagctctgtaatcttttaattctagtgtcaagacaagctggcgcaacacttttaggtatttttctctctaaaaaacaatactagcgatgagttattcatattacagttgctacaatatactcttctatgacaatggaattcaacctctggctatattttacatgcatttttatttaccactgaatgttgggaacaaaacaatatgttggatcttctcagatgggaattgctttgttgctcctttagagaatttaataagagtgtcaactggagtgtaggggtgaagaaattgccaagccatcaattgacaactggccatctctcttgtgtaggcattaaaagagcacaaatcaagtatgatagagcaaatattattgaataaaatactgggactggtccatctggttatattacaatatagccatcagagattgagattatctagccatgtttgtatatctggtataacagaatttttccctatgcataaccatggaaaattcatgtttgaaccttcaaaagatgaaaattatatcattacaggtcatcgaaatcccccagaaagaaatgataatgactttcatgtagaaggcaatatagcctttatttgtaaccacatataatatgtttaatcatttagtgttttttattttttggggtaaaatcatctagtgttcttgtcattatgatctactagataacctgttgagcatattggtgaaatgcctccagctatccccttactatccacaaggcttgggtggataatgtactcttctctaaccgagcaaaggagccagaatagtcttgctctaagttgggagtttacaccagatggatttcttttcttgtgggaaataaatatcaaactataagttattttttcttgtgtggaatacctaagcatttctcaattggatattgaaactgtgcttatattctctcttttttctcaagaaaaaaaatatgtttatatctgaaaatatcaaaattacaatttcttcactggaactccttatctttttatggtcttggatgttgacttggtgataaattgcacgtccacaaccctcatgtccacatatttgacatatatcaatgcatatatcatgttaagtatgacacatgtgcttgttctttttccttgtttctctaccaaatggcatcatgtagccatacgatttgacgtggttgtggtatccagctaatgtagtaattaacaattacatcagcatcagttgtcatgcttagttgaatatatatgtggggaataatgcttcc

SEQ ID NO: 65112 - DNA, 5530 bp, Oryza sativa
acctagctatgaacaataatactccatatgtagggttgtttagctgacaatttaactttagcacaatagttttcacaagatgtaacaagccattatcacccttaagacaagttgtagcaagaaaatgtaccaatcatgaatggtcttgatttcttaaaagtggtactataccatagctacacctatccctgtgtgtaagatgatcgaccacttatggccatgaaatttaggccctaaaatcgtatatttcaatctacaccgatgcattttaatatgcttagttctcttcatttcaccttttttttcaaagtcctttcttggcactggtaagtgttcgatgacaaccatggctacttcgaatggttgtatctcgtgacaacaatgtgagtgtgtgttccaaacaataagaattccattgttccacttaataagaaaaattaagtgcctcttcagaaaaactaaattggtaatattgtcaaatttttgtaggataaactaaatatgttgtaaccaaaattatttatacgttatcaatgttaaacgcatccacatgtttatcgacctttaaaaaaggtatagtttaaaatggcaccaatctaaataggctctaaattggtgtagccattcttcttcattagatcaccactacttaaataggtggatatgcttatttagtatagctttttgttgttagcattaaatataaggcctagggtcccaaatttctacaaatagcgtgatcaagttatggcaggaaccaaacactaggcttatcctatattatacatatatagttcatcgatcaccactaagtatagttaatgctatttctatcttctctcattaagtcgtatcacccagattatttctagcctttagataatagatctatagttcaaactgtgtcttctttcttctctcataataccatgcaatctcaattatttttaggcttaaaattcataagtatcaatttgttttagttttaataatcatattgcatcttatttgtgcatattatgcaacttaatttcctgcagcaacgaggctgaatattcatctagttaggttaaaagtagatgccacaccttcatgcctggtgcaagatcaaacgtgatgagtgcgacaatgcttataaggggatgtagatccttgcatcagcctgaatcgcctaagttgcgtttgagaagaaggaaggatcacgagcgattggcattggaactgcatgcgacctcgtgggggcacacggcatgatttgcggaggtgcgtgcatttgttggggggaggggtgcaggagattatgcggccgctgaccgccgtgcgtccgagcacgattaagagtcggagaagtgttcgggcaacgatcagtgttacgcattcgataagattttttttaggggggtggaatgtgagtgggattaggcctcatttgcgcgaagaatcatgcatcgtgatcttgagcgcagaatgcaatgtaccgtaggtaaaagaaaacgatccacgaagaggaaagagatcaatcgaactttctagaaaactgtgatcgatgatgcaagcggcagatagagatagtgttgtttcgatgttggtcatccacatgtccacatgtgacatgaattgtctgttttggatctaaaaatcttttaacggtcgttatcttttctttgtttatctccgttagtactttgttcaaagactaatttatcctctcaaaagaaaagaaaaggtaaattttcctttgaccaccttttattacggatattctgcttcggattacccattaaccaatatttttaattgaaccgggtattttacctttgcaccactttaaaccattctcaacttttttttattcatttacatacaacttgttgaatgaaaaaaatgtctcatacataactgtgagaattttattgttaaataggagccgaggtatctgacattgttcattgcttaagaaaaaagttgggtggtccaatccaaagcgaaaacacgagttgaatggtgatccaaataaaacatgggcaataaaatgtaggacacaactacaccgagagtgctagctggatagtgctaaagagagacacccttctttcaaaaaaaaaaagctactagtacactcaatatctatgtatttttttcttagagaattttctcttaaattactcatccgatttataatccgattacaccgttgtattcataacaattaaatctttacaacaagatctcacatgattatattttgatgaaaaatcataaattacttttatgatatatctaaattacttctaaatttcactaagttacttcttagacatataaaaagtaaattcagtaaagcttaaaagtaatttacatatattatagaaatatattatagaagtaacttataacaaaagaaaagtaactttaatttacaactatatctagattcattaacatctatatgaatatgggtaatgctaaaatgacttacattatgaaaaggggggagtaactctctgtagtagaaataattatattgtgagtgagctgaaataagaaactatgtagagtaaattcgcaagtaaagtgtagagaagatttataaagtccacagaatatagaattaactaaaaacaataataaaaataatcaacttagagcattatgaattatgaatgtataggagtaatttagtcaaatctaaaagtaacttatatatatatatgataaaagtaacttacgtatataataaaagtaatttataaatataaatattttttcatcgtaatataatcatgtaagatcttgttgtaaagatttaattgcaacaaacgtaacggtgtaatcagattgtagatcggataagtaatttgagagaaaattctataaaaagaaaaaaaaatagaatgcattgtgtgtacttgtaacaacgggaccttttctcacgtaactgtactagtagcacaggaccttctctcatgtactagtagcactagaccttctctcacgaatgagtgcgttgctctttaacactaaatctagagcgctatcggtttagattttgcgtaaaatgtagcaaaaaaaaagaatatttgtgtttaaaaaaagaaaaaaaggaaatagtcgtgcggcggtgtttccccttcttcctctcggcggcgacgccgactcctcgtgagttcgtccgccgccgccgccgccaccacctgcaccgatccccatccatcccgcgagcgagtaggggcgcgcgtcggttgtccggctgcttccgcggtatcctggtgagaatccatccatggctacgcacgtccactttctcagctctctctctccgcgtacccttttttcttctcgaatttgcgttaaccctagctgctgttctacaaatttgccttaagtttgttctcaaaatgttcgggggagttcaactgaacctccattttcccatgttagatccgccactgtttcgtagtgatcaaaatgacggtgaaaccgatgtgcatcctggcttcttcttttgttttatttacatgtgagttttgattgattttgctcagcctggaggtccaaatatttagtactgatcaatcccaaattcccaattgattttatctgtaatgtgctagatgatctcggagaagaggattgattttgtctgatcaggtgtttaatttggcaccagagtgggatctaggaagtggtgggaaatggagaagccgttacagctttgtccagggtcagtgaagatagattttgcctctgcctcgtatgctggcaaggcagatatcgctgctaccgcggcagcgctcttgcatgcgcttgggccgccccgaacacctccctgctatcagctcccactggcaaaagtaaattcatcactgccactatggcctccagtgatatgcccttcaacatttgcccagaagcgtcctatgtcattgcctagcccacctccggccaagaagctgcaagtgcagcagtcttcatccatgctgccacaagattttccaaagttagaggtattgccagttgaaaagcccacaaagttgcaggtgcggcggtcaccgcaacatgtatccccagcgctgaagcaagattcaccgaagatggagaggccattgttgccaaggcctgcaacctttattgacgtgtgagttctccatttcttggaatagtgagatggaatgctttgttgaagaaattgaaattgataacttcatatttgtgatagtatgatgcatacctttaaagttttataattcactgtttgccattgtttgcactaatgcatatatgagtttcttggattaattgagaaaattaggagaacagataatgaatatgtttcacatggtacgtaactgagttttccatttgctagtttaccttttcttagagcaagaattggatggagcactttactaaaggaggtaaattgtcttcttttctgtctcttcaggatgctgagttctcaaaagccatctagcgaaatgtggtctgaaacaaaagatgtgacactgacaaggaaaacaaactgcagctgcaagtattcgaaatgcctgaagctgtaggttccataataaatttcctccaattgctgcgtaagaattgtttttccatataatttttttcctatttgataaatataaaacaagttgttactatttttttagaactttggcgctgcttttattgctttgtagaatttttgttagaaatattatgtcagtagacactcttcaaccacaaagtttagaatacatgttcttgtgtgaaattaataaccgttagttggatttcatgttggttgaaagttgttttttgcaagctatctcttcttttcccttcctacctgtttctctgaacgcttgttgcaacctatttctctgaaggtttgttgcaattatgagatgctgcatttaacttttgcatgcttccatcattgatcaatttccttcctacctgcaaagcctttttttttttgttgcgaggaatttacacttgcaaggttaatggccctaggcttttttagtaataacagagccaatgacctggtttcgtttgtaaccataatcacacattcacacatactagtcttttggtttgcctgaatttgtaggtattgtgagtgctttgaaaaaggcagatactgcattggttgcaattgcacaaactgttgcaacaatgttaatcatgagaatgcaagacaggatgctatcaatgttgcattggaacggaatcctgcagcttttatgccaaaagttttgaatagcacagcccacaactgtgaggtagggcatgatgtatcttattgcaagatggcatgttttctctgttcagattctaattctctagtagctagcctataagccttagttatccatatcatttttgggttaattgtttgcctgttcagtttgttcatgagcaaaaggtataataaaggacgatttcacactaggttgtgaacagtataaacaccggcttttaaccaaacctggtgggtaccaccataccaaaataaatgtataatgtgtatata

SEQ ID NO: 65113 - DNA, 30014 bp, Oryza sativa
aacgtgtgtagtaagtagtaagcacaaaaagttaagcaattgaatactgactattgtcaatttgcaatggaaagaaagttttatctagatttacttttgcccgtcatgtttattatgatccaggtgccggtagttgatggattctcttacccacatattacaaaaagaatgaatgtagctggaaggcacataacatcttatcttgttgatctactctcaagaagagggtaatactctttatcatttttatatgtttgtagataaaagatgctctgaaaacacaggcttatgcaattgtttgcttcagtgtttttcttatcaacttaatttcgtgctttaaaggtatgctatgaacaaatctgccgactttgaaacagtccgggaaataaaagagaaactatgttatttaaggtcagttgctttattgttcttaattgttttcgctatagcttgctgtcacatttcatagaattgaaaagggaaaatatgtacagctatgattacaagcgtgaataccagctaggacttgaaaccactatccttgtcaaaagctacactgtaagtatgttaacctgctttgtttctatttggtccctttttgtattattggctgaacttttgtcatcagcttccagatggaagggtaatcaaagtgggcactgaacggtttcaagctcctgaggctctttttactcctgtaagcttgtactcatactattctttcatagcttgctgatatacattaaggcatgcatttctctgttaggatcagtaccaacataacattgataaaacatttgttgagcaggaactcatagatgttgagggtgatggaatggcagatatggcgttccgttgcattcaagaaatggacatcgacaaccggatgacagtatacagcttacccatacaatatgctatattttgttgctccaatcttttcacttgcttttgtttatcttcaagtatttatttgtaacattgttgatgaattgatgagttagatatagaacctctgtagtcttcaattgaaatttcgaaggcacactttgaattcaactacacatggcttgtctagtgaatttgtgcataagataatctttgataatttaggattactttgttttgttatttggtagcaacttgataagaccatggttttgcataaaaaatccacttacatatatacatgatttttatgttgttgtcttaaattagaacttgcacaggtaaacaccataagttgaattactgtcaaatgctgaacacacttccaaatgttgataatttttcatatttagtacatgtgtatgtgttaatgtaaattaagtcaagaagggacaaataaatgccagttatgttagtctctatacttgattaattgtattttaagttgttatgaagtacttctagataagcattggatcatgtgttcttctctcattggatgtctggataacatcttgcagctttatcaacatattgtcctgagtgggggaagtaccatgtatcctggtctgccaagtcggtaagatttgacaaacatatcccgctctgtcttcttttgtttactacagtacatattaacgattagtttcaaacaacactatttttacactgaagctcacatcatttttggtggtctatgccactctgattttttgcctgttctatttcttaccaatgtatgtgtttagctgtttttataagcttcaatattgggtatgacttaacacattacaacatttttgaagactagagaaggaaatgcttgatcgctatcttgatgtggttctgaagggaaacaaagatggactgaaggtaatatttttttgtggttattttgtagctgacaacagttgaaaatttcataagcttattgaaatcaaacacaaggaaattcccaagttttttttccagtgcaacacattttcttattcaataatggatgttgtcttttcagtaaggaatgtgaccattttcacttctgtctatgtgcagaaattgcgtttgcggatagaggatccgccacggagaaaacacatggtttacctgggtggtgcagtactcgctggaatcatgaaggtaatatacttttcccacagcgttatatatctatcggttattataagcaaagccttgggacaaagtagagaggtgaacagaaaaggagcccaaaagatgaaatcatgcattactgtgtgtgcattgtcgcatgggaatctgctcattttgctttattactttgctgacggctgttcacctagcaggattcacctgaattctggattacaaggcaggaataccaggaagaaggccttgcgtgcctaaggaagtgtggacaagcatagccgtcgagtatgttcctatgatcctacctagattctcatcaacagcagatgtgaaaggctctctcattctgtttgcaggagacaaaaaggaaacctatgtttagatgatggatgcacattacttgtagaaagatgagcacatagtgttgtttgttgtccctattgttcaggatacttgttggtgcatgttgtagcctagaagccactatgaacacaaactcaccatataaccatgatgagcaaacattagatatatttcattttctattggtaatatacctatgaacacaacacatatttctacttactatattatgtactggtgagctgatgctcttcatttggtccctgtactgctagggcaaatcaatttactgatagggaaagtcaatttacaacgaagcccttaacattagaattgctttgagatttgtgcggatggcatatatttcaatggatcgcaatattgtattcttctttttagtatatcgtgaatcttaacaaaacatctaattgttcagcatagcacttatattgtaaaaatcatcttctctactgttgtatgaaactttttgctgcctatatttatcttcatccaagaaatctgtgagtttcttaatcagctgcaaacttttagcaagttctgtgctttaactcagcccatttaggaaaggtcatgttccattttccaaaattgtactctttgctcaaatatattttctgaaattgtttcttttccgtgtttggtagaatttgaattattttccgcattttaacacaagatgtttggcagaatttgaattgttcaccgcatttaacacgaagatattgtgctaaatcaatagttaaatgccttgcatacgatgttgctcttggtgaacaacaatccattgtccaatgatgtgcaagcggggaattctgaatttatgagacgcaaccaagccagggtagtggctccaatgattcaaaaatgtaaggattgcggaaaccagaattgaataaccaaaggaatcccaaaattacagagttctagtccaatctgaaacgaacggtaccatcaaattcctctgaatatgcgtgccaggatacctcttttgcctttcttctttttttcttttcgatcttttgccttcctttttttttttgataggaaaagcttttattaacttaacggcctggctaaattgccatccaccatactctccatgcccgtaggcgtgccgtcccaggaaaggccagcattcagagagcacttacaacccaactccgcaagggcatgcgccacacgattacaagatctagggcaatacaaagaagcaaaggaagcagcaatcactcttttaatctcaacgatgacgccttccttccttgatgatagggtggtgatggcagattattagagtcttttaaaatggtatagcttattgaggacacatataaatgaattaaatattacaaagttgataagtttacttattaagacaagttcttaaaaaatactaatgaagtttctgcaaaaaccacacccaagcatattcgtggtattttggtggacataatcaaaacttgctccctccatgttttttttaaataatagtcggtcttgacttcaaaaattttgattcggttttgatttatagttgctctttgaacaactatgtttttaaataatctaattatttagcaacaaagttgtatatattcgaataaaaagcattttactaatatcttacatttgtacctgttcattttgatgttgcttaaacctatttgtaataaaaaaaacttgatctcgtaggaagaaaccaacactactttctgtgaaatcacatactcgcttcaaaaattttaattcggtttttatttatagttgctctgctttgaacagcaatatttttaaataatctaattatttaccaacaaagttgtataattagattcgaatcaaaagcattttactaatatcttacatttaaacatattcattttgatgttgcttaaacctatttgtaataaaaaaaaaacttggatcttgtaggaacaaacctacactagtttctgtgaaataaagtactgacagtcaagagatatcgctgttctacaaagacagactcaaacctgaaccctatcagatgccctgtgctgggacaatataacaagagatatcgctgttctacgaagacagactcaaacttaaccctatcagatgccctgtgctgggacaatataaacaaagtcttgagcatcatcatgcaaatgaagccaacaaccatatccatctccagaagctcgattggttcgcgagaaatttcagccgtgcagtttctccaagtagccaatgcaagcctttgaacctgggacatagccatacctcgactggtaaaaaaggagagtaaaagagatgcagaaattattcacaactggcttcatagaatctttttcactcatgtgaacttcaaagtgaatatctgaactgcagtaggaagaagtagcttaccttcaacttcaagtttctccaaacacaccaaagaattacaatttactcatgttaaattgatgtacctagtattatggcccacatctttaagcgatcgtgcctttacaaaatctggcaacaatgcgacttagttcttcaaccttttctcgcgtgtccttctggtaagacgcactcttttcaattgctcaattaccaggatggatattccattcgagctctactcaagggaaagtcaaatggaatatcttgccaatggtggcggatcaacataatttggaggctatggtacaacttgaaccaatcaaaagaatgaacatatcatatcttgccaatggtggcggatcacctcttgtaaggcttaatgtgatatggtttgaattcttcaccaaattttgctgcttcttcatcaacccttttcttcagccttctccaggtcctcaacatgtctgcttgtattaaaccacgatatagtgtctcaaaggtgatcttctggggaagaaaacctctctctatcatttccatgaaaaactggcatgcttccctccatttcttattgtcacataaaccatgaaccaacaaggtatacgaattgagatcaggaccaacagtgctctcacacatatcattccaaacttgcataacggtgtcatgttggttcaacttgataaacattccaagcagtatgttgtaagtgtgaatatcaggtgtggctggtgaaccaggggccttcatcttattgtacagctgtagggcaccattcacatcttttctccctcgatactctttgaagaaacaattgtatgtggccggcgaggggcatactccctcacttgccatctcatcaagcaagctctcagcatcatccaatctcccacaggaagcaaggcacttgatcacagaagtgtaggttgccaccgtgggacaaatgcctctctctttcattgagcggaacatacagagacatagttcaggtttatgcgcacgactgtaaacatgcaggatgacagagtagcttgtaacattgggttcgattcccctttgatgcatttctttcaagagatcctcagctgcacgaactgttctatcaaaccggtaatcagggtgcaagcttgcatgcctacagataccattgaggagaatgttgtatgtaactatgttgggttctatcccatgataaatcatatcttttaggaacttctgagccatgtcatttcggtttaccttgcaccaaccataaattagaacagtgtacatcttttcgtttggttcatacttgtattttcttttgttgaatacttccgctgcaacctgcagtggtgacagatgagtaaatgacaatgattagcagaagaaaccatggagctgtcccctttaacaaggaatgttcacaaagcagccaaaaaatgagttacaggcagacagttgatcaatgtaattcaaacactagcacgcataaagtatgtgtgactgtctagctaacattgattggctatcaactcagcagcagcaaattctagaatagtgaaaagcatcagaagttcaaaacgcatgaagtagcaaagacgaacaattctgttgtaaaaaaaggtctaacatgtgcaagaaatggttattaggaaaactgaaactttcaacagacaatgaaggttcaaaatcataactccatattcatcctaatattcagagataagcaattgcagcacacttcaatgaaattttgataaacatacgacctaatattgtaccggcatgagtctggtactctggtacctgtcattctagtgttgctctctataggtttctcaacagataacacaattagtggtcaaatccaatcctacactaataacatattactcaaatcagagttgctcggttaatgttgcttggcagcacaataaaaagtttacaaaaatgtacagaaaaaaaatattcacaagaagctaaatgcctaaacatgaagctcatgtactaacgtcatccattaattaagaaaactcctaagaaggaactattcaatataagatgtgaatctacccataaatccttgtgcacaatgaagtgtaacaaaaggcaaacagttctaggatgaatcaacctaacaggcaatatcagacacaaaatattcatcagcgatactagtgcacatcccatgaaactgcaactacaaatgttttcttcactctacaaaccacgtacatgacaaggccttaagctatacaaacagattcatactacgcgaacagtagaaaacacagctcatactcgttacacaaagtacattggtaatttggtatgcttatctgaagctcgatcgatactcaacgaattaatcaaaaccacactttcacaaacggctactcaatgggctaaaattttacagcgtgcagagaacaaaagaatcgaaatgtgtgaagctaaggcatttacactgaactcaatccagccaaaaataatctcagggctgaacagtgaaaacctacgaattcattcagaacatcctctgaaactaactagtgaccaatctttatcaagccaagaaagttagctatgagcaaataacctttggatacttgtacttgcagagggtgtcgagcagcgtggtgaactcggcggcgtcgggctccctcccgacgaacgcctccatgtcgtcgaacgcgcgcaccgcctgccgcgtcatcccggcggcgacgtacctcctcgcgagcaccgcgaacgtgcggggcgtggcggcgccgtccgccgcggcctcgacgacgagcctccacgcggcgtcgaactggcgcgcgcggccgagcgcgtccacgacggcgtcgtaggcgtcggcggcgcgggaagaggcggcggggggagggtggaggcgcgcggcgtggaggagcgacagcgcgagcttggaggcgccgcggaggcggaggaggagctggacgaggaggtcccccgtgagggagacccccccgccggagaggagctggagcggcgactcggccgggtggaaggggttgtggtgcgcaaggaggaggcgggcgagctcgtcggcggccggggacggctcgacgggcggcagggcgaggaggtgggtcgtggtacagaggaggcggcggctggcggcggcggcggggagatggcgcggcatggcaggcggcggcggcgtggccggagttggtggatggaggagcgtggtgaagcggtttggggtttgggctacgaaaatctgtaccgttggttttggttggttggacggctgagattggaggaagccgcgcagttagttctgctgccactgcagaatcgcagatctccaaaagaaaaggaaatgtaaattaagtaaagctgtaaatacttttgccaaactatctcaaaattacgtatttaaatcgctgtgtcacgaaaccatatataaccaaatttatcacagagctacaatgtttaagatggaattgtggagtatcaaaactacattttcttaatattctttaagtaacattttagtaaaacaaaattatagaactaatgatattgcaccaatttgatcagacaactataacgtttatagcttccacagaacaatttggattagggatttaaactctaaacttgcagttttgtaacagcttcaataataaatccttagttttatgataatttatcttaaatatgtagtttaatttgtgataaatttgatactctatagtgacatgatatcttatatttttagttatgtgactatttgctcgaagtatatgtagttttctgaaattcgctaaaaggaaattcagctacaggagcataaatcaaggttgttttttttgtggggataaatcaaggttgttgttaggtgttgttcggttaatccctttcgtaacgtgttccacatctattaaggtgagtaactagttggtaaaattttgaaccagctgatttcctattccatgattatctttataagcttgcgaaatgtggaagattacaaagtgaatacatgactatctttgtgagcttgtgaaatgtagaagattacaaaggtgagtcatagtatacgcttgttacataacagaagccatcttttggtgtctaacaaattgcattgagcaaactgtcgacaataaccgtaacaattttgaccgtggtcgcagtctcgtagagaatgacatttatacaaagtgaggttagcttaattatatgttgatatctccggtctgttgcaattattatatgaggtttggccaaataatttttagagaaatattataaagacccccctaatagtaagggttgaatatgaacctttagtatcaccttactatttgtagagtgacaccttactattattaatggactctctccgttaccatgcaagtaaatttggtaacgtgaaagagaaaagggggaggaaaggagaacattgttgctacacataacaacgactctaaattttgttacatgatggtgaggtaaagaaaaaagggtaataataaattattttttgcagtaatcgttaagaggttttgttgtctcaattattataggaggatagcctttaagtcatatgtattaactaacaacccgtatcaaactctacctttgtacatgccttgaaagggtgagttctccgacacatgcatagatggcgcgcgcgcacgacgtgcatgtgaatgtccgctaaaattggatccttatgcttgcacagacgcatcttagtatttgtggtgtttgaaaactcatcgtattcttgggtacacatgacttaactagtttagttagatcacacgttctgatatctctataaaatactaagtcaccatcttcatgcaacacatatgaaaataatctaggatttgcctcattctctgtactgcactgtcattcatggtctactctgtcccaccaatccgtgtgcatgtgtgatcatgagagcaggtcctcggatccatcatcttcgatgtcctgcatcgcgagaggattttgggaagcgttcaacacgtgtctgcttgttgttcatccacaatggcacatcttcttttacgcttgggcactgcgcatcgttgtcaccattcatagcatgcatcatacgtgcaatacgtgttgcttccttccacaacataatcagaaccgtcgggtatgtatcaattatattttgtatgtttgtatctgtcgtatacatgcctatattgtgtggtttacatatttaatatcgtgatttatttaatccatgtctctatatttccaacaatatcatgacttgatcgaacaactctagtttatattgatctggccctttgttgggttgcatacctgctgtattttctctcccattttttgttcattcatgagttgcgtagcccactgcaaatcctcaattcctcaccaaaacatgaaatctttctgttctacctctcatgtcatcaagttcatgattcatgattcatggatatccatgggatgggttgtcttgacaggaattgacaaggaaaggattgctttatctttctatgggctttgtataattccatgtaggtgagaacgtagtttcccaaaactttgtggatcacctgtcgaaccttttgctttcttcataaagtatcaaaaggttggagcatctctctggggagatgaaactggtgcagataggctagtgattgcttatcgtttgatttttttaagttaaatttctttatgattgactagatttatagaaaaaactagcaacatctataacactaaattactctcactaaatttaacattaaatatatttgataatactttttccaaaaatttgggcaaatataaaaaaaatgatttagaaagcagccaaacgacttagaatatgtaacggagagagtatgttttagcactttgtataccatgctttactgcttttttttttgtttccgtgtatgtaaaaggtttccaaacattctgctgtaacaggaatgtttacatgtgcgaactgtcaactgtttgacgtgcgatgggagaagtgtgtgtgttgccttttcatgacatgaacagtatgcatctccgtgcaaatgaatcaagcaatttaccttcgaaaagccgcatctgcaaaactgttttgcgatcatcttttaaagaaataataattggatcaatctggaatacaaaccgaccttagctcagttggtagagcggaggactgtagtcgttgcagatcaatccttaggtcgctggttcgaatccggcaggtcggaatatgattttaatttttccttttttaaatctcctcatctttgtgcagcaccgggggaattgatgaagccaaatagccaatgtattgctcaagatcttttttttaacaaaaaatcatgacataccgtaaatgcaagtaatgctggttcgaatccggcaggtcggaatctaattttaatttttccttttttaaatctcctcatctatgtgcagcaccgggggaattgatgaagccaaatatccaatgtattgctcaagatcttttcttttttttaacaaaaaatcatgacataccgtaaatgcaagtaatgtttgtatcatgctttgccaggaatcacatggagtaaacgaagttcagcagaagtctagaactccagatccacatagaaattcttttagtctgagaatcccttttttttctttgaaacagatcaagtcaatctcattgctcatcactaaccatgaactcaaaatgcatgtacaatgaatccaggcaagcattccatcaaacccaaccaatttccatccttttttttgttcttgctggtaaagactggagtttctagccattcccagcatttcttttgctctacttcttctacatctacctctctactcttagtttcactatggagaacacaaccacaattacaaccatggtggggatggttagattcactcaatggccggcttccattcctaatgctttagctctccttgcctccaagagcttgtctttaagatggagggaagaaccggttgaggttgaagggcagggtgtagaactcctcattccggctgtcgcctctgaacgtcctgaacctcgcccaccatggcatcccccggtccctcgccgcatccctcacctccagggtgttgtcgaggatcaccgcgacgatcagaccgacggtcgggggcgaggagaagacggtgttgatgtagtcattgaactgccacacaccacacagagaaaagagaaaaaaaaaagatcatgaggtttataagtttcagaacacaacttcagaaaaaaaattcagtttcagtggacatacccatcctgccctggtgtgtgcagggccgtgcagagcgctcatggtgtagcggaagaagtactccgggatggaaatgccgaggaacagcgagacgccgatgatgaagaggctgcgcatcgagttcatgttggtgaactgcatgaaggagagccccactgcacctgagaaaagatccagcaagacatgtgttgtagagggttgaaatcttggtgataaaatgaatagatataagaaagaaagatatgtgagaagaacatcggtaattttgatacctaagacacttaccaacatatccaaacatgacgcagtatatggcggcaaacattgtgaatggaatcgaagcaaacagagccccaaatctccctgaaatcatgagacgtgttgagaaccaggaaaggtgattcaggatcataatctttttgtgcagaaaatgtgctacctagaatggagaagaagatcatgaaaccagcggagatctgtatcactcttctgctgccaatcctggttgatccaagaagaccaatgttctctctgcgttggcgaaatcgtatgcattatgttaggaatacatgatagtgctagaggatatcggagagtaaatagttttcgataaagaaggaaaacacttacacagagaccgtggagccagttccagtaccaaatagcccatcaaacagcagcccaattccctgattgttcacataaagggcaaaagcattatactcctgatcaacagcagaatacagatttttgtagagctactcagatcctaatgctactcagatgattaaattcattctaagaaaggtcttgcattcatgtggccaagattctactaatctgatcacaactaggattttaagaatggccttgcattgtgtaatctttgaatatttgcagaaatgaagaaacaaacctgccatccaatgcctctgctgaggacatatggtggtgggggtgttgcactcgccaaccgcgcagcagccttgaatgctccagctgactgaatcactcaaaaaattgtcaccaaatcagatcagtataatgacatatgctaacaagatacttatcttaaacagcttggtatagatttcacagtaatgaaatgttacctctatcaaggacaccacaacagcagccatcataccaaatgcatgatctgcgctgaatgttggcggaccccattgcagtgggtatgggatgtcaatcctgaaaaaaaaatatattttttttaaaaaaggatgaacattagaaatctactagtaccaaagatcacatgaaaattgaagaaaaatccacaaagtacaaaccagtctgcagaagtgatgagattggcacggtctgttcggcagtttatctgggtgagcagagaggtatgtttgtatgtcccacttgctgtgaggatgtgagcataaacccagacaagcgcgatcgaaatgagcactgagaacctctccaatatcggaaaatggcgcacttgtacatgcttcagatattgggaaagagcaacaaacaggacaagcattggaagcccaatctccacgcacctcccaatctaaaaacacaatgtccatatgttagcttaacaaccaagtaagcagacatagagcatacttattctagtttgtacaatttgataatcctcctaagtgtaaatatgtgtttgatgctactcaaaatatcctgatttattgtaaatgccactgtgtataattcaatcatagaaatgaaacacttcaactttcagttccaactatatgaaatgatcccaaatggtcctgttgaaagctcccaactaggaagcatatgttcgcatagtgccaataaccagttaagataaagatagagagtaagcgggtttagcaaagaaacagcactagagactttaccactgggaatcctctctcgaaaaggccaagccccaccagcgcaaccaccggaaccatcccaagtggactgaagaacctgcaacatgacaccgggaaattttaagattcttatcgtcaatccgaagggtcgcagccatgtcctattacttttggataattggcatttggcactctttgattttagtatattagcatgatgcactttgtctctaaagtgatgcccacttctcacactgagagaaaacaaagtggatgtcttaagggcccagggcaaccagggctattataaagaataaccagggcataatctactgattgatcatgtgctcctaatgtcaacacgcatgatgccaaaagttacacaaacacacaaaaaaggctttggtagaagacaacccttacttgcaatataagtaaaccaaaacactgctcagtctcatgttcacttgtccatacaagttaagaagaggaaaaatacgtctagtatggacaaagcaagaatttggatatttggactatacgatcaaattggacacgaggaagttgtatgtacctggagcatatcccccacaactggctgtagccaagaattatttggatgcaggaggatattattaaagccccctgtatggctctcatagtcatgataaacctctgcaataggataaaggacatttaatcattattatctaagaaaaggaaacttttaataaataaatgaaacttgtgatgctgaaatgaccactaatgatattgactatctagaagggggaaaaaaccatggcatgcttacagtatggtcatcagttatttgtgccagtgatgggtcttttattatcgatataaccgggatcacgaacgcatacgagcctccgatgatggtcggaagccgagttccaaacaaagtttggagcattgtgtttatcccagtcacaaacagcatggtttgcaccacctttgccttgtcatgctggaaacaaaacagacaaacatgtacctatcagcatgcactccatcacaaaagcagtgactaaaaacatcattatctggaaagagagttgctggacacatgcaagtgaagtgaccaactaattcgagggtactatactatcattcatagagccctctccctacgagcatcttatggaacaggaggtaggtaccaaaattcatttatctgatctgcagagtacaacttttgtttcatactattaaattccacaagcttaattacaacggtacataaatccaatgcatttaaccagaagattcatcttgaaagtagtagcatttattattacaggatacacactacaatgatttcaataactagatatgagtatatagctgaatggataaaatggcatggtaaaacagtgaaaagattcttacagcatttccacccatgagtggaaccagtaaggtggggatcatcacagccgtccccaggcaaaggatgtaatgctggaaccccagggcaattgcctcccctgtaccatgaaaattaaatcacacaaaattaaataccagacaaggaacagacagatgaaccctacaatcctagtcacttcagtgaaatcattatctgtacataaaaaaaaaggagcttgagtgaaatgacaaacttaccccaggatgggttggagtctatgcagtactccagcccctgcagctgatccattggtggatggctgatctcctcttgcttcatgtcagccatctctacagaagcaggaacttctcccccttgttcttctgcttgttcagggtgatctaacaattgccacaatgagcaatcaataagagaaatcaggcttaataaatgtgattgagtgggtagttaaataagataggataggaaaggaaagcagtaaagaaggaagctttaagcaactttattggcctataggctatgagaatcagatgccacaggaagaattccccagagaaacaaagcaaaccccttttaagccctgaacaaaaaagaaaaaaaatgtgcctttcaggcctgcaacaatctggcagctggcttgcaaagattgacgcccttaatctcccaaaacatggagcaaacatcgcaaagacaagattttgtttttcatcactgatcaagaaccattccaggacacacccactctacttgcaaaaccctcaaacaaacatcaagaaagccaagaaaaccaacaaaagaaaaagatcaccatgagcaaatgctctcacctgtcaagaatgctcaccctcacaaaaatttcccaaccaacgctagcaaaacacagcgcaaaagaaactaagcacgagtaggaagagcaacccagcaaggcgccgatttatagccccagaatcgaaacggctagctgcaggaatgaatgaatgaatgcctaaaatgaacaagatcagtttcttgcgaatattcagattttcttttccagctgagcaagcggagggaagcaagcaagcaagcagtaacagcagcagcaagagcagtgtctgtagcgcgaggaagaaagagagaatgagagagagagaaagagaagtgctccgggaaacgtcaaaaaggctgtggtggccaaaagaagccacagggatcgatcacacacacaacacaggcagcagcagcctatcagaagttgcaagtaaagatgagagagaaagagtagtagtagaaatggatgaactgaagctgctgtacatgactactcgagtgagtacacgccattactacccccctagcaataagctttctctctcctacacgccattacagcccctttctctctctagacttattttttttttctaggtgagaaataaatccggcagatactttccttgtcataggagtagagagagaccgatagtccattgtttagtttatatttatgcttaggcctgtttagttccaatttttttttctaaaaacgtcacctcgaatctttggacaagcattaaatatagataaaaacaaaaactaattgcacagtttgcatgaaaatagcgagattaatcttttgagactaattagtctatgattagctataagtgctatagtaactcatatgtgctaatgacggcttaattaggctcaaaagattcgtctcgcggtttccaggtgagttatgaaattagtttttttcattcgtatacgaaaaccccttccaacatctggtcaaacatctgatgtgacattcaaaaattttcttttcacgaactaaacataccctcgtactgctagttggtaataaaaaataattcatgggtatttttttacaatgtcctaagcggttcaaaagaaaatactgtgaaataaattatgactgaaccatatataaaatcaacttcacaattaagtttaaaatttttttttttcttacaagcataaaagtaaatgaaaagatgggttctgagatgagaaaggatgcaaaatgtacccctgaaaggtggggtccacgttggtttaaccaatgcactgttggcattcacattttcacagagcaaagaagctgaatttttctctctctgggagagtttttgtctggcacagtgccaccgcaggcagtggagttatcctcctgcgagcatctgaattggcccgttgggatttccctctgaccaaattgccctccccctgcctgacaggtggggacccattgatcgggtgctttgagattcgtgcggtggaattctgcttctggctggctagtggctggaacaggtgtagatgtttggttggttatgcttaaattagtgttttaattaagcaccttgaatgtgctagtactggtttgagtgattccttctttggaagtgctttggtcatattcaattgatttcatgaatgggtgcagggtatgtaccaggaaaaggacaaaaaaaaggttggtgaaacggctgagataatgttgctgaaatgtttttagttttatatagaataataataaatattttttactgattagtcttaagaaaatttacagctgtctgatttttttttcatgaaatagactcttgtgaaatctaagccatccgatctagatccaattgagtaaggttttgtaaaaagaaacttggtagtgaaacatgacactatttatgtaaaatacaattacgctttagaaagaagaaacaaatggaaacaacaactcactatggctcttggcacagacaccgtcctaggcataggggagatcaaaataagaagtcgtacctagatgacgacgcccgtcctgggctacgggaagtagatagataggtcgttcaactcttgtccccgaagataggtaatatgttctcatataatgttgctccaactttttttctcgagggcctaactggtgagattttatttaattgtcatgaactctagtggattcactgtgtaaaccaatgaaatatgtctataaagtgaaactttcatgtagtaatactatttctttattgcaaaagttaaacagatcatatagatgatgatttcaatactactctactagatctccatgtactttttgagaaagaaatgaacatcttgtacgccctcatatccaaatctaccatgataaaagttatgtgtgcagcacaaaacaaaaaaaaaacaatacaactattcaaaagtttggatctttagatctaaactttttgagtcctcatgaataacctaagagatcaaactcaagttttttaatatcatgaacttccatttaaaactaatgaagattgaaaatatgggttgattacacataggtctttgacttattcttcagactggaaatactacgtatctcaaactcagatctagatctgtcaacatgaactgtgcaaaaagaacaactgcaagcttaaaaaacaatcaaatatcatcacaagtatcaaatagtttacccgttgacggttcatggttacgcgcaaaaatgatagcatctttaccataactctcaataggcatgagatggcagctacctgcagtaatagcggtgagagtagggcttgagcaccattccttccaatatagctaatcttcctcatcatgttgtagatctgggatatccgaccacaatttttggccgaacgacacgacgtgctccatgagacctgccattaggaattctaagagagactagtagcaacgaaggagttggtgatgatgaatagctagagtatggtggagatgtgtgctttcctttctgctgaggtacctttaaatagaggggaaaagttgccctgcatactgctggcaacgtaacgcttgaaatgtctgtagtgcgacacaccattttcttttaaaaataatatcgcttgaacttatatcttaaaattattgaataatgctggagataaaatgcctaaagtgtttatggtgcgtacacagtttcctcttcatttttctttgaaaaatttacaattgagccatatgtcctgaattttaccttgtttctttattattattacttcccttttactatgccttccaatatatctcatcttcctcatcatattgtggatctgggatatctaaccacaattcttggctgaacaacacgacgtgcccaatgagacctaccattaggaacactaaaagagactattagcagtggagggtttggtgtctatgaatactgtggagatgtgcgctttcctttccgctaaagtacttctatatattgggggaaagttgcccagtttactgccggcgatgtaacgcttgacgaagaataacgtgcagatgtgcactttcctttccgttgaagtacctctatatattgggggaagtaacctagtatattgtcggcgatgtaacgcttgagcctatatcttaaaattattgaataatactagtgatgcaatgcctaaagtgttcgtggtgtggtacaccgtttcctctttattttttttaaataatttgcaattgagccatatgtcatgacctttgccttgtttctttagtattattacttcccttttactacctgcagcaacagcggtgggagtagggcttgtgcaccataccttccaatatagctcatcttcctcatcatgttgcggacgacgtgctcaatgagatctgccattaggaacactaagagagactattagtagtggagggtttggtgacgatgaataccgtggagacgtgcactttcctttccactgaggtcgtacctctatagattgggggaaagttgcctcgtatactgccggcgatgtaatgcttgaagtgtctgtggcgcaacatgtcatttgcttttaaaaacaatatcactcaagccctatatcttaaaattattgaataatgttggcgatgtaatgcctaaagtgtatgtagtggcacataatttcctcttagttctttttgaaatagtttgcagtcgagctctctatcttgaaattttcaaatgcacccttctttgttctttagtattatgcttccaccctttttttttttactattctgaagtagtagtgagcgcagggttagtcgattatatttgcattgaggcaaaaaagggacaaagattgtgatccacattatatgaaatggtatagtacatgtgcaattaggggcattaatttagtgtgtgttgtataattttgttctacacccatcaaacaaaaggaggaaaaatttgcttccagtttcattatattagaaagtaatgtttaacatgttagtataacaaaaataccttacggagacatctttttattactatagaggcattttcaaaaatatctcattggggccttacggtgaattgcctatacaaatgatgacacattttataaaatgcctttgtatcttgcaatatttttatagtcacattttttatgtctataagagagtagagacatttttctagagggtttggattttgtgacaaacataccaaataattgtgaaaaaaactgtggtagagacattttctagaggcattggattgtgtgacaaacaaaccaaacaattgtgaaaaatatgtggtagagacattttctagagacattaaagtgtgcatcaaacataccaaacaattatgaaaaatatgtggtagagacattttctagaggcattgaactgtatgaaaaacataccaaacaattgcgaaaaatatgtgacagagacattttctagagacattggattgtgctacaaacatttactattgtaaaaaatatatgatacctatatttttcataaacaattgtgaaaactatctgccgctgatgcaatgagcttgccgccccttcgccgttcactcctcacgtgtcgcagctaggagtggtaatgtgccacggcccatgggccctttcacaatccatcttagccttcaaatatttttagctcaaaaatctattaagtctcagcccaactctatttgggtccagccctcacattttataggctaatatgttgggcccattatcacccctagtcacagcaatggctcgctccttggagaggtaggccatccacggcatgtagctacaccatccatcggagccgcgccctcggtttgcgactctggctttagctctttcaggtagctagctgtatgctctcattgcggctcatcctatccccacccccaccattgccaccccacaccaatccccttccgcttctccggggagtgatgactatccatttcctctcctcaaggccaatactgctagtctagatgccattagcaccattaattaattggctctgtaaatctcttttaaatcttcccatcatcgtactaatcctcactcatcatcattccattggtgcctggattatttcaggttttcctctaatgttgcttttctatcctttgcattagccaaactacacttgtatagagtaccacaggtcagtaactgttcttaccatcttgaaagattttaagtttctcattgggttatttctgctgattttccttatacacctttggtttcattgatccatataggaacaaattggttaaaaaaggcagctgctatcttgcggtcccttatttgctagtttgtgcaatttacggctactctctacttggtatccatgtatacaacaaggtctattatatagtaattttggacaagatcagaagacaaagatgtttcgaatatagtaatcctgaaattaagaaggcactaaaatggtatgtatcatgttctaagccaagtatattggattatatatgtttaccataatatcccatatattcattcatgtccatgtacatattaatatatatcagtggagaaaatggtatatccaatggatgttggggaaagttcttcatgttttgcactgggatgaggccgaaggcgttggccatttcatcttcttgtccctcatccagaccatgcttctggggctgaagcgtgccatatggactgattttggatgcccagtttttaagttcattaatactaatttacccttttttttggtacaatatggaaattaactatgcaaatgtaactgcttaccagatcatactcctactcaacttggtcctatactttctctccagaaataaccacatctgctcaaaatccatcattgggcagagattcttccaattcatttcgtagtatgatttcataaacataataaaaagaatcacatattaatataccaagatctccacaacaaagtataccattaccactcagctatataaatatcacaaacacctttttgtttctccttccaacactacattctcttttgcaatcctgatctcaatgcagagcacctcacctccacatgcatggaacatggcaaacgaagcaaaatgttttttcattcttatgatcaattatcaagtgctaatacctacttgcaatattcatgacatacacacttcttctcttttcaggttaccacaaaaatatctgaagattatgctcttcaccctcctgtccataccactcgagataagtacaaattcggcatgcgtgtaattgaagaaatgaggtcatctgcaaacaagaaaacttctatcgctattacaggcaattccacaaaataagtcctcaaaattctggagaagtctcatactccagttatcacattggtgcattccttagcgtaaggaaatattaataattatttttttttgttaatgtagatatattttttgcaaatattttaaatacttttagttcatattggctacacattatgtttaaattgtataattatctttaaattttatttcataatgatatgatctactaaagttctataaatatcttataacataaactagttcccaaagttatgttttggttactgtgtaaatttgaaaatttcttgtttctatgagcagtggatgtactattttcccatatatttttattatttcctagtacattaatagtgtgaaacatctagttggcctcaataggagtggaaaaaaagttagcaatgcataaatatggttgtggcagaagagagaaatgccatttcagtcccagagaaaaaaaaagtcatttcagtgatagctactagggcggaatttggttatgacgtaaaatggaacttttgtatcaaggaagggtgaacagagcatagacatgaatgttgctggtgaggttgattagtttagatgtatgtttttaattaccttctttggtaacaactacaaataaagtaaagtaaaggtagaacaccaaaatatctgttgtgcgtcacgtacttgagtccatttttaaaatagttttcacaaagctaaggtaattcgcatatcgtatatttaatagtgaaaaaaacaattgaatgcttgtattacactgcttctcttgtaagttgtaacatgtagacaggggcgggcccaaagggtagtccaggtaggtccaggactaccctagaattcggcccagtgaagaccaggtattcatttttcctggcccaacaaaaaaaaacctaactctattttctgttctctcccgtgcgctctccccacccggcctcccacccccgagtcccgatcgactgacagcgacggcgctcccgcgagccgtgaggctagcgcgactcaggcgctcttgccgtcccgcgaggccgctactcgcgctgccgctcctcccgccgcttccgtcagtcagtctggtagcctcccggctggccggctcccgccaggcgcgcgtgcccatccggcagccgtggcggcagcgccgctaccttcgcgcgccgtgctggcaccagcacggcctcgccctctccgcgactccacccctggccggctggccgcgccctctccgtcccacgtccggccgtcgcccggcggcctcccggattcccggctcccgcggtcccagcgttctgatttgatggatcattgggaagcccttacacgggcatatggtcagtcggctgcaggtaactcgagcactataaggggaaaactcacacgcgaccaagcatacggcggtgacggtgggagcgttggcggccgcggtggcattgaaggacattgaaggacttgcaagcttttatcctaaggacattgaaggctctgatttgatgaaacttgagctccaacttgatacatatattgatgatatgagagaggatgatagattcaaaggccaaaacaacattggtgagctctctattaagcttgttgaaacaaagaagcaaaagctcttgagtcttgactagtattgtaatatcctatttatctaaagaccttatgttatgtttgaacaatttacattttcatttaggtaagatttaaacttatttgttattttctactacttgtattgaaccatttagagttatataccgtatcgtttaccactttttatatcgaatcatattgtattgcattcggattttttttggctaggcctgggttcaaatcttgggtctgccactgcctgtagatttgggatgtaaatgcttgaattaaaggcaaaattattggagaataaaacaaaataacagtagaagggtttggaaggatgcaaaaatgtagtagcttttggataatcggatgcttacataatgtaagttgcatttgttgggatacgcgtaggctacgatagcataaatcaaaatttttctaccgcgtaaaccaggaaccatacaagtattagatcatagatcattaccactcgacgcgctgtgtagcggaagtaagcgctaagtagccgaaggaatgtcgggaacgtagcgcgcgtcggtgtagagaaagtagtcgatcgcagcagctcgatgttatcctcctcgtgcgttctcttcgccgtgctctcacaccgatcagcaccgcaaaccagcggcacctctaccggtatccacacatacagggacggaacgccacacgcagacgtgctagtgtctgcgcacggctagggttttgctcggggaggggagtggcagctagggtttctcacgtgatgtgatctatccgctggtcacgtccctcacgaatatgtaagatccatgactcgggcttccaaggcccataggacttctattcggatccctatccgaattaagctcatattggatctctatccaatcctcttattccggcttattaagcgtgcaaccctgtaggttcacgtaaactcagctgtaacccgaaaactccttttcggtccacatgtcaacagcagcccctagcagaatgtattgacccaccggacatacataaagatcatatcggttgaacctctagtgtatacttgtatgaacccctttgcctcacgatatcgattaaactcaaggctagatatgtgccatcctctgatagctcaatcattcactcgaacttgtgattgactcctaaatcaccattggcatggccatgcacttccataatctataacatcgagggggccatatatatcgctccataggaggggcaaatcccatcttgattatttatatcccaccacatgtttcatagcatgcccgaaaactatttttataactatccaattacggagtagcgtttagcagtcctaagtaagctactacacatgttgggaaccatgataatctcaggtctaaggatttaataccaacattaaatgaaatcaccgatgacacaacacatatggctcttgcagtgtctcatgttgggtctatctaacaacatgttcccaacatgtgtccacattattaatttggtatctctataccatgatccatgagacataatcatcaattaatacatatgctgatcatttaaacatatttattccacatatgatattttatcaggtatcctttagaaatagcaacatacaacataaagagttttatgaaagaatcacatattcattaaccaataatgagttatctatttcaaggaacaacgtcggataaatatataaacagagtatgtgatacaatcatctctatgattgcctctagggcatatcaccaacaacattcctttctttgtaatttataaattgatgtaagtacttgaaataaagacgaagttgttggagaaatagaataaattgacagtaggagaatttggaaggatgtgaaaatggagataagattggagtaatttgcttatcgtgttacatgaaaggcttcatggtcctaattttattgaaagcatgaaattgtattaatacatgtatactaccttggaataacaatattataggcatataacgcgccatttagcaaatcaccaaaactggataaccatgacagtgaaaaaggcataaatttttgcaccggactccaaaagacaaaaaattcgataataaaaagccacaaaacaaactagacttcaggtcacaataacttggaattcaacgtcaccaccatcatacgctgcatgaagagatagagtgttgtaggcttcttgatgtctggcatcgttaagaaaggggatcttgatttgtacgcaacaaataaagtgtgtgtattgcaacacatggctcactttttttttgagaaatcctttgtataaataatacacaaatgttggaaggtggtttttttcccaatttaacttgctagtttgtcaaaaatattgatatgtgggattgttttacctgtttaacctgcaagctttagcaatgcccatatggccatatctcttgtgatatatgtggatagtcctggaatttagttgaatttcttggcccattattttgtccttgctaaattaatgtctcgatccacattgagacccacttacagaaaattgatccatcaacaacatttttttctatagtggcaggaaatctccaactcttcgatatgcgctaactagttaatctatttacttaatttgatatgggttctcttgctacccaaaaaaaagtattgatctagcttacctggaaagaatggatcgctacccttggagagctaatgataatggactaatagcgcattgattgaaccgaccctgacgtaccactagggaacttataatctgacccaatatgatgtataaaaaatggcttaaatgggcttatctcagctaccaaactaacagatcagcccaacaatcaccctaggcctgaacctgacctaagctagcaatttttcctgaggaataagttcactttgtgtccctctatttgtcgtccagtccgattttcgtcccttggccgtaaaaccgggtatgacgggtcccccaacttacgaaaccatttaaatgaggtcccttggcagtattgtgttcgatttttgctgagatggcgcttacgtggctccttttgactaggtctttgtctaacgtgtcattgacatggcgcttacgtggcaattagataaaaaaataataatatccgtagaaccacatgtcagtcgcacacacaaataataaaaaatggtgggcccatgtggacccacacgtcattctcactaccctcttctctctatccccctctctccctcttctatcgctctccagccggcggagcgggatgggcgggggccggagcggacggcgacggggcagagtggctccgctcgcatctcatctcctctgctagggagggtcttgtagcgcaggtggcgtacatctggcaggggagggtcttgtagcgcggttggtggatgacccttgtacccggttttgagaccaaaggaccaatatcggactagacgacaaatagagggacccaaagtgaacttattccttttccttgaaggcccaaccttcggtacaatggcctacaacaaagcattccactggtttcaaatatttattttacccattacaatttttgtttcctaaccaagatcactgaactaacggctctatcaattatgtcggccacgctggttgaatatatagcacgctgtcatgctgagattatctacgtgtacatggatggattattgatacaatgtataatacatgcgatatacaatactgcagcatcttcgtagaaatttggtcaaacttttctttaaaaaaaagaaatttggtcaaatttaaaaaattttgactagaaaaaaaatcaaaacgacttataatatgaaacggatggagtagtttataggtgattgtaattctctcttaattaaatgaacgaaagcttcctctaaaaaagactacatgggatgaaaaattaacaattaatttgtagatttatgggcctagtcattttggaggaaaagcaaaggatttggattgctaaggattaattcctatgagtgtcattcattcataggaatgtaggtataggaaaaccaaatgaaattttctattcatagaagtcgcagagagaaaatgtaagaatttttccatccactcaaacttcttggaaaattcatatatatgaattaaagtatctacacatttcaattcctctacattttctattcttatgtgttaaaattcttccaaaaccaataggcccgtacatacatagttgtactctcttagttcctagattttatttttcaaaattaaaatctcaacaatctggataaaaattcctaaacgttatgagtaattgcaagtatactaccaactattcctttttgaggtaaaaaaaataaaaacacatatttatatattacacttaagtatggatgtatggaaacaacacttgtttatcgttattaaattgttgtaataccaagggaccgaagtttgcaatccaaattgttagctagcacaccaagcaccaaaccctgcaacgacgacacatatcctcatgtcacgaggagccaacggatatcacctcagagtgtcatcaagcagggatcgttaaaaccaaaagctcatgaaagtcagtgagatgatagggagtgtttggttcgatatattgctaggtgccaagttgtagcaaattgcacgaacggcaaagtgactctagtgttgaggaatgatgacttgccgttgttctttcatggatgctattttccatggtttcttgggatgtgaaaagcactggaaaccttggcctctactcctgttgcttcccatttctaaagttagtttcctcttttcctgataatccagacagttgggaattctgaaggtcatatatatggatttcaagctgcaaaaattcactagggttatttgctaatttgccctatagaaattattggacctctttggagttgggaattattgatgtttgtgtggggataaacttttgggtatgtattgctcatttgttgttaggatagtggaaaagaacttcaggtcgctacacccttatgtagagattctttttatgtgcgtacttaagtagttgtagatgttgaatacatagtacgttgcattaaatgtatacccctcattcgaaatagttttgaaacaattgagtgagccagagtgagacttggaggtgattgtaaatagctttagatgtagttgtagatgtgtaatatacggtactttgcattaaatgaatacctccattcgtaaatatcttttgatcaacttgaaagaaacacaaaaaataattcataaagatcagaattcaaccgtgttttttttatctctttgccttgtaggtgttgtaattctctgttaaatgaatgaaatctcttggcttcttctaagaaaagtacatatgatga

SEQ ID NO: 65114 - DNA, 540 bp, Oryza sativa
acatgcatcacaccttttcttacgcaaagtacttaaaaacttttaccataacacatcacacctgtggccaacagacgctataaaaacaaagggttaattagatctatgtcattgcaaatatatcgcactagaaaaataacattactattcatgaatcggttgcatgctactgcaatattttaaagttagaaccgtatcactccctcacgatttctctccatccccatccctcaattgccacctccacttcttcgtctttgatagcacgatgccggtcgactcatcatgctagtcgctagtcgtgtctctaatagcacaacgccggtcaactcatcgtgctagtcgctagtcgtgtctctaacaacaacgaggatgcgtagcgtttcctcctcaaccaagaggaggagcagcagcttagaaggctcttgtccacgagcaatgtcactacaacgatggcggtatcttgatcaagttagactagtgtttggtttatcgccatagttataacatgccatattttcttggcaaaatttgctacag

SEQ ID NO: 65115 - DNA, 9691 bp, Oryza sativa
cgccgcgctccccgatgcgcagccctctcccggtctccggcaagctcgccgccaacgcccgcgccgcgtactagctagcccgcgccgtgttcttgggcagggcagcctctccgcggatgagcggcggtggtcgccggcggcgaagcttgctcgcggctgctctgttcttcttgtgggtgctcgtgttgtgtacatgtagctgatcatcactagattaatttaattaatggtgttcttgctgcctgcccttctcttaatctctccttgtgtcttctctaatggtcatgtgtaatgatagatttattatgcagggattttattgataattatatatattgcaagtcgatcagcaagatttggtcatttggagttgtgtttgcggtttttcttcttgtttgaattacgttacgcacttacgctgatggggtttatcagtggtgcaaattgatctgatcttcaccgcaatatatttatttcattttgcaattattttgctcgcacaatataatttcttagcattgttgtacgtcaacaagtcttaaataaaagtactcctacaggccacttgcagggaaaaaacatctttttactggagtgaaaaaaaaatattgggagtaaaattctggtgatttttactgacgcacacatgctcgccttcaaaagtgaacctgggtaaaaaaaaataaaaatagaaataaaattccatgtcactgtactttgtgattaatggtagagtgttatgttttattagttcctttctgattgtacctgcagtatgtatcatttctgtgctcatcaagcagaattttttttttacagaattaatgtatgtaaaatacagtttgatttccttcattatctattattccgtggtttgtgacgcgggcaaagtggtacaagcgcggactttgcaggtaaacgagaaaaagaaaacaccaatagcatgtcaattgggacttgtcttagtcacagtctcgcagatgatcaaacttgtttgaagatattcaattgtggacgacagagcttagatattttaagcaggtcataagggagaaaattgtttgtaaaataaacccaaaataaatggtgtatttcttattgtttgtcaagaccattaattatattcctgtcagattttggctcccaagtattacctttggacatagagggaggttcttggctgtctactatttgacagagctgcattgacaatttggggtatctaatgacatcatgtgcttgatcaaaatgattaatccagcttcttataatgtgcaatcatgtgccaaataatacacagattgtgtacatttgaggggcagaattcatataatctgcaacatcatgtcccatgcaatgatatcccaactgaaaacggtgtatcactagatctccaataaaatggttgcacttggcacttggaagagggccagccaaacttatacaatccaagcaacaatattattatgcgtgtacggatgcattatgctggcttccacgagtccaaaggcataacactgaaagtgaaatcctcatagagacatcactccctaactcccctattcttgtagcctcaacgaaccctatatcttgcttcttggacactttaggaccattttgttttgatgaattcgatgagtaattgactgttcgatcctataacttgtttggtttgatgaacatggagtattacctcttcatagcattatcagaaaaatgcacctgcttaatttatccaaaaatagagaatatagtcatctcaccaaaatcatgcatgggatgatatctgaagattgatctacccgtcctagatagtttgattcctcgatctaaacaacccataaagttacaaatcgtccatcttcagttactgaatatttttgttgctgtaagtgttgtaccatttattgtgttgctacaatgaaccacagcaggtagcatatcgcttaacttaaacaggaagagttgtccatgcatagagagatttggtgagaccactcatggtcatggataatatctaacagtgtgcatatcaatgtgatgagtgttacttgtggttcaagacatgttttgcccaatttaccaagaaaaatgaacacgtatatctaacaagcagacaggcaccaaccaaccagtgaccaaacatgaacaggaagctcatggtgtgatcatttcatgccatgatatgatcaatataatcaagttcggttctatatagatcaatcagatatgcatcatatccaagagtcccagaagcaaacatcaattgctaccggtttgcccatggcgcaatcgatggcaaaacagctaagaaaccatgagaccacaccaccggctggtgcccacaaggctgtaatggtctgaaactctgaatttcttataacaattgcagtcagatgggtctcagcaataagaatttcttgcaatcatgtccgtccatttttatatccaaccgtgtacaaaccctttcgcatctttgcgtacatcagatcaaaaatagacggctcggattgaaatccaccggatagatttgaggaaagagggtgcaccacatgccatttttcaggccatgccatgttgccatgcacatgcgccccacagtgccacacaaaacaccccaaggaaatgtgctgatgccaccaccctcaaggatcatcaaagagcatccccattggcaaatgcatgattgcagcggattgttcacaagggccccactcgggagagggaaacgtcagaggggaagtgtaggaaaccgggaaagaaattgaaggcattaatcgaacaaccaccaactatttcaggcttgccaatgagcgagcagtggacgtgccctacaccatgtttgcctctgaattttgcgtgtgaaggaactccagctccataacagcaacttcattcagtgtctgagcttgtgtacgtgctctttcagaaagagaaagaagatgggttacttgacgttttgtagctagcgacagggcgtcaatcagctcagctaccctgttgctgcacctgatccatcctgaagctcacccatttctagtactccatgagttagcacagtgtctacatggctcaggattagcaaaaaagtactccagaaaccattgaaacctacaatcacggaattgggtcacggctaagtgtaaaggaaaacacatgcttcacttcatgtttattactcaaatggaatggtgtacaccagtgtgaaagataactgtccaggtgaaacagcatccttggaggaaggcaacatcaatatctacatagatcatggtaaatgaaactatgaacaaaccagggttttaccggtgacactaaaaggcaggaagtcacgaggaagcacaaaatgaaaataatgattctgggcccaaggcaacatgcactgactttaccctactacggacaaggaattgtttataactgacagccgaagccctgataccacagaacataaaaatgttaagagaaaagctgacatacaacaatgcaagggcaggttagtttgcaggcttagtcagctgggactcgccatctccttacagccctctcaagtacttcagctcgttcatgtacacgtgctgcttcttcttccacccaagacctgatatcatttggccagtgtaaaaaattcatgggttaaacttgttacaaaattcatgggttaaacagtgttaaaatacatatttgagcatccaaggtgtacacttgtttaacaagacctgatatcaccttgggttaaacttgttaaacaagtgtacaccagtgttcttaaagcgacaaggcgaggcaaggcaacgccttacacacaagcacaagaggcatactagagatatacgaggcagaaaagagaggaagaacatgaaggggcgaggaagagcagggagacagatccattggcgatgaagggagcagcaggagggagacaaccatctcctctttccatcttcccctcttatctttccatcttcccatgtcgctatgtttccaatctctgcccgccctattctctattctctttccatctttcacccttccctctccctaaatcgtcgcacacgagatttccatcctatcttcacgcgatttccttcccagcatgcgcaattcactacagcgcatgcgcccttgaccccaccttgcccatgtctacctgatttcatgagatattaggatccaagacgtgtggaagggtaggcggtggcgacgctctgatccctgatggtgctcagatgcctaggcgacgcttttaaaaccatggtgtacgccactgttaaacaagtttaccccctccgtcccaaaaaaaaaaaacacaatcctagctaggaagctagacacatgcatgtccaggttcattgctagaattggtcttttgttgggacagagtagtacttaccaaaatactcaaataccatggctacaagaattggcctgatccataagtataaattttgtgggttagtctgtctttgggctttgaactcttctagaagccactgtccatctggaacttaaaaaccagtttttttcacccttaactttcagaacctgacaaacaacaccctagagcctatattctacagcagtttggtttgaaatagcagtgggtttctctaacatgaactttctattggacaagtaccactgatgcagagctaagtgatgtgcaaaagcaaccattctttcaaacaaaaccactatagaataggttccagggtgtttattgtctggttttagaagttgagggtgaaacaacccttttttttagttcaggctgaaaaatagacttcaaaaagagttcaagactccaaaatgacctttcttaaattttattctgatgactgatcttcagcatttcttcaaaaccatcaaatatagtagaattttagagcgttcatgttaaaagttcagtaaagggttactttattgttcggaatctaagatatgcaaactaaatcaaatctaagagttgggtacatagttcacatcagattaaccagctaccaaactacttgcatgtgtttgcaaaagatcatacagatagcagcaacatctatgaagatatatccagaaaaatattttcaagtgaaagagttgggtttaaaccacagcatctaaactaccagctcctttaaaggagtaaagaaagcatctagttctgaactactgcgcattacattacatgtattcatacaagtgcaggcgctaatagttttcaaatatgaaaatatcaggtaataattaaaaggaaaatgtaaagactgtataaagacagaccttagcatagtaagagcttccttctcagcttcaagataagatttggattcagagacagcttgatgcttcctattcacatcaagtgagagcttttccaggttttgttcctcagtcatgacctctagactttccatggctagtctatcatacatcccatcaatctctgacctcaaattcataagttcctgattctgatgttctagagctgttctctctttcagtaagaccgcaagttccttttctctatctgttttctcatttgcaagctcttgcagcacatgttgaagctgcttatcaactgcaacctcacggatttcctccactttcatcttgtcctcccaatatctttttatatctcctctattaattaactcttccattatttcacccataacagaaagctgggattgattctctgcttctagtctgttcaattcatcacgtattacttcttccattcggccactggtcagtgcagcagctgcttgtgcttttgtaacaggtttatgtggttgaaggcatcttgtgtttcctacaaaatgtaattattgttcaagtcagctgaagtacattgaaacaggatagctatgaccttttctttggtcacgggacacaaggatatggataacaaaatcagtcacaaaaaaggcagaagaaagaaaggtttagaatcagactgaactacatcttatactgatgggaaacatgtccatgcacgaaaatcagcatagacaatgttcttccataagctctattttcataacagttaaattgaaacaaattacggaatggcaagcatcatattttttttataactttttgaacctttaatttttaataattttgaaaataaacccttccaaaacttattttcaagatttgaacctttggccaagccaatcaggctggcgtggcaaaacaatactgccacgccggtctggctgccgtggcagcattgtctgtcttgccacgccactctagctggcgtggcagaacaaaactatcacgcctgctctgggtggcatggcagcgttgtctggtgtggtaggacaaaaatatcacacctgctgtggttggcgtgtcagtgttgttttgccatgccatgcgggctggcatggttaaaaggttcagaattctgaaaataagttttggaggggttcattttcaaaatcaaaatttaagaaggttcaaaaaaagtaacaaaacaaaacgaatattcaaaccactagtataagcacacaatgctttagggaataataggtcttgctatgcctaagttagcataacagaataaccataatcttagtaaattaagaatcattcggtcaaaacatcaacacaaaataaagactactaacaaatcataccaaaaactttgctgatgatgctctgttcaccacccatcaaatctacaagtatagatgatggtacatcaggccaagccctcaaatccaaaatgcgaacatttttactcagcatctggactgtaaccagagtcaggatttacaaaagaatgaaaccaagtaatattatagaaacattgcagaatatcataagaacaaaagatatatgtaccttctggtctagttcagttgcaaatggatgctccactagtgctttccaattaacaagatcaaaacgtgatagataactaaaaccaccacacacaaaagaaaagaacataacaagtaagaaaaatgtattagctgtcaataaagggataacagaaatttcatacgtacctgttgggtaggaagtttgaatttccactgtcactagaagaaccacttgttgatgttcccaggaagttcgataacttgctagatacaatgcctgattctcctaaagcttttttttttttgtaatggacaaaattagagtttataatcacatgctattaaattataggcatctggaaatccaatggagtactccttaacaagaaaatcatggccaaagtagcgtagagaaggcaggcaaatgaagacaggctccgatatctaagagcattgttgagtgagttcagtaaccatcagtataataacaacttacattggatgtacaagaaatctgggtcatcagcatctatatcgtcgaaggcacttctgactgatccaaaagttaatctattagggatgatcctatgcatctttttcctgcaaaacaatatcataaagaaggcaatactaaaatatcaagcaaaaaatatatatggctttgttttgctacctttctaattttgagtgtaacttaatgaaccatcttgcgaattcccttcgagaacaaaagtcgctggagctagcatctttttcaattatctgatcaagcacagaagttgatgagaatatctttggataacatttgtaagaattaaatcacttggtcatatgttgaaagtaatggtatcattaaaaataatccaagcggtcaagcttatttattgtgttttgatcaatcactagtcaaatgatactccacaagaatggaccaattattattcaatgaaactgcagatcaaacttaaagacaaaatttacaaatgtacttcctccgtttcacaatgtaagtcattctagcatttcctatattcatattcatgttaatgaatctagatagatatatatgtctagattcattaacattaatatgaatgtgaaaaatgctagaatgacttacattgtgaaacggagggagtaagagcaatatcacatttctaaaaatcgaccctatgcacctattaggcgcgagacaccaagtagccacccagattaggcattagatggtgcactaggtggctaactaaccttggggtctcttgtcctgctattttagtggtcaatggttaacttttatgtaattttatcgctaattgcttggtatttacaagccatgttggtcctaggtgccagagctgctgaccctctagcgcctagtgccttcttgaaccatgacatcagatatcatatgaaactggagttgataaattaatagaaggtagctagaaggataaataaaactttaaattaaattcatcctagcaaactatgtggagtattgagatttaagaattatagcaacttctgttgaaagaactacagaccttcaaattaatacaaaaatagcagttgtctcagtagcatgcaagtgcataatgtatcctacctagctaatcattttcagaatatactgtgtaagacccaaaaaaaagagaacacaaggtaaggtaaatgagcagcttattcaccaacgaagtcaaaaaacaatgcttcaacaatacagagtaggtagcaggacatttatgatttgatatatttcaacaagctacaaacaagtctggcatacctgtagcttcttcaatatagagaaagcctcctcgtgcatgggatctacaggagctctaaatagaacatgtacaccaccagctggcatgtggttttggcttgaatcatcagtttttgtatcaaccctctcgtcattagctgtctttgaaacatcaatattatcccactccttgtcacctgcatcctcctcgggagtctcttttgactccagtgttgataacttctcttgaacatagtgtaatggggcatgtacaaattgctgcaaacctgaacacagcattattttttacaatttatttaagtgttcgaaaacaatgtcaagcaatcgtgtgttcacatattgcattgaggatctccaacacaatgcactgaacaaagcatattcagtatttacaaagcaaaaggtaactgaactcttaacaccagaatgaacatagcagattccaacctaatttagcaccggctgattttgtacaaaagtagacagttcgcaacaaggcaacaaccgaaagtaagaaaatacaacaagcagcaaaacataagcagcagggatgacgattgagaataatttatgcactaaggtaacatgaattaagacaatctaatctataatgctcaactgcattctcctttccccttgtaactagcggcagcagcagccagcagattctcttaccctgtcatagctaagcgtcccactggaatggataactgaagctcctcaatccatcccatacatttagcattcaaacacacagtgaaataggcaacaccaccgaagtatggtgttcataatcaaaatggagataaaccagtgagcaactcacacttcctcgacgacggcaagtgccacatcatccccaccaatgcgatcgccgccgaagcccccagcccgaccgcgagagctcttcgggaacccgcaatcccaatccccactgcagaaacaaaagagaagagatccgctcaaagccctcatcgagcgatcgaatcggacagaagagatccgcccccaccttccctcccgcgctccgccggctgcttctgctgctgctgtgctcggggactgggagccacca

SEQ ID NO: 65116 - DNA, 1249 bp, Oryza sativa
ggtgcgcgaatgtcgagacgcaactagatggttacagggggacatgatataacaattaacaagggaggatcaatgcaacaaattaggtgggtccgccaatctgccttgcagacgggacgacagattaagtgcgatcctatcaatgcataatatttttcaagcaacataattaaatttcaaatataggctcaagatgttcaaaggtggcttgccttgctcgagatctggagcttgatcctcgaaatcctcgcactgcgggtcttcgggctccgaaactacacgcgaaacgggacaactcaacaaacggcgaaaataaagccctattaatgacctctaagcgtgccattagatagatctcgagatttgaggaattttggaagttgaacggagtcaaacggatttacggttgggaaggtattgaatttctaagattattggatttttggtctaaaggaaaaggatttaattaaatcctttttggaaaagaaaaagaaaagaaaaggaaagagggagggattatagacttttcctcgggcggctagggcgcggcccaagggaaaaggagcggaccggccgagctaaatgggccggccggcccaaggcagcccaagtgcgcgcgcgcgggaggggaggagagagagggccggtggaccgggctcaccgtgcgcggtcccgggtgggacccgcttgtcagcggctcggctcaccgtgcggagggagcacgcggcgcggcgctagggtgggggagggacgcggtgcacgcgcgcggtctgcggaggaacggatgcggcgggcccacgcgcagcctcacggctcgcggtggaacgcgcgcacgggaggggctgaccggggtcggcccgtcccgacctcggctgggccggcgccgacgtggcgcctacgtggctgccacgcgggccggcgggaggtagacgacgacgcctgccggaacggacggcggtcgatagcggcgagcgacggagcaaaccacggcgatacaggcaaaagcgagcacaccgggtggttgcacgtgacgaggggagacgagccaacggctcggattcgccggagggagcttgaaggcggcgaatcgcggcggcggcaaccggcggcgggaaaaggggaaaacggcgacgaggtcacgaggggccaattcccggtggtgagagcatctacgcggccacgggaatccgatgctagcgtcggattgggcggagctacgccgagcgaggctggcgacgagcgggtgcta

SEQ ID NO: 65117 - DNA, 10612 bp, Oryza sativa
ggggagggggagggagagggcgagagctagggtttttgcggcggtggcctcatcggacggcgtccattttgggccgtgcgcatcgcattcgcatcgaccgaagagctttgttttatcctcctcctcgacgcacgtaggcgctgctaattgagctgttcacagatgatggacgacaaaaatcaaacgcatcaatttcgaaagtaaatttcacgaaacttcggaatatccggtcatacttaccaatttactatacttttaatcgggcattttacaaggttataacaatattaaactattttatctgggactataatgcgtgtttaatatgtagactcaacttagacccaacttataacaatgtattctctccatttcataatataataatctagtagcactggaacgtgtcttatccgatactaggttcctatatttgcaatgaaggaagttagtaagagtaatactttatcttaaaaaacaatgtattatatgtgtacctgcagactggtggatcagatcttagttgaacaaaagttctattttgtaaagttctctgataaaatcacaagcactgttggagttctatttaaagttgcagcaaatcgttttgacgtaatagtttcactatgagagtaaaaaatcattcgctcattaaaaaatatacacctcgatgttgatatatcgcagtccaaataaaatctagttgaaactttgacctatagataaatctacatggaagaatgttgagtatgatctttttgataataagcaaaagctgtttcgttggtatctaagtttcccacgcctaacgaagtgtggcatggcacaaaagtacggtcatgaaatctatctttcaagtttatggtggttaataattaatttctcgtttcgtttgcgctgaaagtctttctccaaaccaaaaaaacgaatgcagcctaagttgtgaccgtgaaataaatatttacataacagactgtggcataactaaggtgtgacttgacaaggtgaagtaatgaatcaaacgaccccttggtaccattgatactgtgagttgtggtgtatggttccatccaaattagtcacgcacaatggtggtgttctttttctcctgaatatatgaagatgaagtttttacgcaaaacgaggtggtattaacatatgattaattgagttttaattattacaaactaaaaaatagattaatatgatattttagagcaacttttatataaaaagttttctcacgaaacacaccatttagcagtttgaaaagcgtgccatgaaaatcttaatcttcatccaactcttgttgaagaaaagaacgagaccaatgtgtttttactgtggtaagccgacattacgtgaatgaagcaaccagtcaatttgatggtatataaagtcaattcgaggaaatagacaataaatccctaaattaactctaaaattaagtttaaaagtttaaattttggctacgcctgatagcaaacaaattttaaaggcctataaatttggttagggcatgaatttattgctagtttctactatctctaaagcatataatgtgggtcttgcatgccaataaggaaaaaaaaagaggtaactccttatgataatgatatatgatttatgtagatatttgatgaaactcgtgtagtattgaaaagttccaagtttcaatcaactcccacatttcattgacagttatattttttctgttcatacttcatagtgtagcaagtaacttctttaacaaattgatcacaccactatatcagatttcataggatgaaagggaaagatggacttccaacattcctcctatagaattgtctcgttgcagtcgtcttatcaacccgatcaaaacatagacgattcacatcaatgcaatggagaactggagaggatagtgagcttacaaaagagctattcccctttcaactggatctttgtcttcggggcttcaacttaggcttgaatcaaaccatacactgctttgacaaagattaacagacagtttccagtaatcgttcccagaaaaagacaaacatagccagttcagaatatgtgctcggactaagaaatactccatccatttttaataagtttttagagaaatatagcaattgttataacatcaaattagttttattaaatgctaacattcacaaaacaatatgtttatttggtgttgaacatgttgctttgtttttctattaacttggtaaatttaataagtttgattaagaaaaaagttcatcttataatatgatatgaaatggagcgagtaataaacaaggaatatataaaactttcatcgatgcctattgctacaaaacaaatgtttccattccaagtaaacattctcacacaaagattacctattacactcaggggctgcctctcgctaaagaaattcaagaactattcttttaacaacatatgtatgcttctactttctatcctgaaaatgatttctcattgatcaacttgaaaaatatgtttcctagtgagtcatgtgtcaactatatgagcacctccacatcatcctcggcgctttcttccaaaaggagatcatctctttgctcagccttcttccttctctcattcttcttcctggtctcctcacctatagcattggcgatggcgatgggtagccaaaatccaggcctttcgaggaactgagctcggtgaagaatcatcgcatcacgccgtgtcacatcaatgccatcgaaagtccacaccgcaactgtggcatttcctttcaggcccaaggaataccagcctaaccccgaaatagcaatatccatactgttcacatcccaactgacccccgacacatcaatctgtctttccgtccagtgacctaattcggcaactcgctctggcctgatcggtggctgaataacaacagcatataaatcagtttgacaaagatggaaaaagtatgtttatttttgttccaatgcttctcttgtcagtgataataacccaactacataaacacttataatagagcagtggtagcaccggcagtgctcttcaaaaaattaacagaactttgtctgtgcaacaggtgtttaacccttagattttagacaaccagaatttcacatgtgcttgtttattcgactagcatgtgggatacactaccgttccatagaatagccttactttgatgtaatcttcaagtattatgttcccattaaatatagtactatattctataattaaatgtactgttgggcatacctgaagtctgatgccaaaatgtttgtcccgcagttcttcagcattttcagtcttccccagatggagggacacactaggagatgcccaaacagttatgtagatagtttggactgaagcttttaacacatcaagtcgtgttaaacctccaatatgtacagattgtcctgcctgaaacattttacaaccattggagggatcaacggaatctcacagatcatgacacaacatagaagtatggacaaccataatgtttgaaactttgatagtacgagttgaggactgatagaggctgctaatgtgtgaagtgtttgatagtacaagtttaggtcactaaaccatccaagggatactcagtgcaaagtgtttcaaaagtcaaaatatagtactacctctgaccgacactgtttaatgtgtgattaactatactatcactagtacacaatttcatcaatattaataagttactacaaaaggaacctaggagtaactacaagtacgacattaagccttaaagtgatacagagtggagaacttgcacatgttcagattttgtcatgtgtctatatttatacatttcaagcttgagcagtgaccacaaagctaataaaggactaacaaaagcttgaggatactgtttcgcttcaaacaaaatgagactattggcacaacagattgaatgagataagtcatttctagctatgaaccccagtagataaactgttctatataggcaatagttagtcattaataggtcaagtacttttacaaggaaataacatgattagtagaaatgtaatagactaaaaaactaccttcaccctgaagcaccttggccggagttctttccgaatttcaaccatcttgcgttcctcactgtttaatctcattgacattatatatggatgcaataagccaggagtgtcatacattttagcctttgctggcaaaacacctgttattctcaagattcctaatgtagttcctggcacagcagcctcagtcaaccttgtgattttgacaccttgtttctttgcaaatgcattaattagagtggatttcccagcattctgtgcaccaatcacccaaacattgctacggggcccagctagttccttgacatatgagatcaagtttctgacagacaaatccttatgaacactgatcaagaaaacagcatccagctttggtgctccgaaagccttagctcggcctctcacccacttctccagcctcactcccatttgctgccatggcagcaaatccaccttcgttccaacaagaacaagccttggcgtttcactcaacttagaagttccccgcccctcgagcgccttgaacagcgacttggcagccctctttgggaatgagccgtcaaagtccgcgcaatccgctaccatgacgataaccggtgtgccagctgaacgtttcatcagacgggacgatatgaaccgatcgaaatcgaagtccgggatcaaattctcagccttgtcattcttcacatgcccataattcctcagtgagtggcaccgggcacagaccacggcggcgtcctcctcggcctcggccttcttggcttcccgtgcccggcgtttcctctcggacttggacagcttctccttcttccatctctcgagtgtctcctcagtgatctttccatacccaactcccggtggggtgaaaccatccagttctttcctccatttctcctcctcgtcttccatctcctcatcccaatccgagtcccagtcgctcgagaagccatcgatcttggcatctatgtcagccttcatctccgccccatcctctccattctcatcctcttcttcaagaaattcatccaaatcgctgtccagaccgtccaattcggcggcaagatcagattccgacggcgcaccgtcctcctcgtcgtctccaagaaatccatcaggctcggcggcaagaggaggcgacccgtcttcccccatctcgtcgtcggagaggcgggaggggttcttgaagaagccgggcaggttggggtcggcgtcctgcatgaacacgccgcagccggggcagacggggcggccgacggcggcgtcctcgtcatccctgccctcgctgatgaccgggctcggcggcggcggcggcgacctgccgcgcttgccggccgtggacacggcggagacgggggagaaggagaggctgcggctctgaggcggcgggcagaggaagaaggggaggacgcggaatggcggggccgcgccgacggcgaggcgggaggggaggcgagctgctgctgccgccgcgacggtagcggggaggaggaggggtttagccattggaggcggcaggcagcgcccagcgccccagcggcgagaggataggggacaagggagcgagtgatcgtttccagtccaaattgcggggagatctccgaaatttggagaaattgtgaaacaaccctccacaaataacaattgatgccttacaggcctgtttggcacagctctagctctagctccacctctcttggagctggagctcagccaaataattttagctccacctaaaatcttatataccgatttctgggttacagctccgtcttgtgattgggccacgtggcaccacgattataactcagcctagattctcgactggaaaagtgtgccacgtattcccactcattcgcagccatccgatgacatattaatggtgacaaaacgtccagcggatctaaatgtaaattgcaaattttaagagggattttttctcaaatgagaaatctcatctagaacaaccaggagcagaggaaaacatactaggaaaaaaaagaatccaacaaaaaaaaagtctggcaagaataagatttctcctctccgaatcaccatgccatcgtctagctaacaatgacagcgacgatgaccttaagcttgatgtacctccgggagcttcttggtgccgccctgccttgatctacaccaccataacctgcttcgggtgacctacctccacctagacatgagccagataaggaggatgcgagagacgagaggcgagaagtggagctggcggagggagatggaggtcccctgcgcctggtcgcctcgatctgatcgtctctccacctaaaataggagctgaagctgggtggagcgctatcacaaaatgaactagagatttgaagttgggttttagctttccacaactccactccaaatccaactcctaaagctaaattttggggttggagttgtgccaaacaggccatgaatttaggctactccacaactccactctagatttaacttctggagataaatttaagagttgcagctctaccaaataggcactctaaaaatatacatatcatctaaaaatgtatcatttatatccaatttaatagtctgttcatataatagttacatataaatatatactttatcattaaaatctagtcacacatctcatacaaacatacaaccataaatctatatctccttgacatgtgcttatagttggcttaggacatgtacaataaccccatcccagtcaactaatagccaagccacgtcaccatacatgttggtatttcttaaccttacagataaaatccgcaagcggacgaaaaataccgatgtagcacttcatctgggagtattcttaggtatcgatttccatagggaacatgtgtgttaactccggtttaagttcatccaaggacacgaagctaaagataggccaaggatagagagatttcaccggtggagaacagtgtctacggaaagcttaactttaatcctaatgaggtacttcgggcactgtccagctcgctgctcccagatatcgctctactgcacacccgggaggacttcagtgtcgtgaggactgtcaccacctctatacccacctcacacctattgtgagatgcagagcaaacaccagaaattaattacctagacaccacgtctaagcagattaattacttactttaatgttagctacacaccaaagtaaatcactatattttagttgattatagtgaacgatgatcccgtactctaaataggaactaaccaagagataattctcaccaagcaaaactaaattactcaaaagataattctattataactagagtaattaacagagcgtaaagaaatagggagaggattaccgacaactccggaattcctccgacttctactctactctcttcccaatctagtatacagtatagtacagtagagcctcttataatttagcttgtgtattggagtgagtgaggtgaggtctttatataggggcaggtatgacggttatggaacgtgaaaagacacttctgccctccaaccgtcattcaggagctcatctggaccgtccacgcgaagccccagatcgaacggccgtgggagtgaacccaggtctggcccgacagagcccatcttcggcctgttactccttctctgcctcctctatccatttctgctagtggaaagcccaattaatgatgctcttcggtagtttctggcccactcgtagtatggataggaattattcttcactcaagtctatttttggtccaactctggtggtttattacctgcatacaaatatacgccaatactcgtggaatatgtcagaatttaacattttcactatgttggatgttttatttttatggttttatgcaagtattggtggcataaaatttgtcattaacaaccgccaacaatacacctacgtggaagagagaggacatgagagagggagagagagagaggagtagacgcttaatctggtgctagcagaacacgagtttctagattagttttacctcctgtgaaaaaaaatactggcttatgaacgaataaagaaaggcatctccggtgtcataaaatgtgcatagagatggcttgtgtatgtgtcggttgtagaccctgctctagctgatttggacagagttcagagtaatcaaccatcttttttattgctcttgcccttataacctactctctccgtcccaaaataaaccaacatcgtacgggatgtgacacatcctaatacgatgaatctggacactcctgtataaggtttgtttattttgggatggatggagtactattgtacttgttctacaaagaactttggaagtttatagaaagtttcactattgatagtgaaaattttccatttcagtcagagcttaagatcatgggatttagtaattattttgcgctgaatggttgaatggattcatgctttcaaatgagttaattaactattataaagttgaaaatagaattaaaacgatattttaagaaattcagatatcattatttgaaaaatatattcatatgtagaatattttttgcaaagatctcacagtttatgaggtcaggaaggggtgcatattcatcgttttatctagtcgttggaagcaaatgggtacatttacaaactgagatgaaatgaatttgattgccacaaaaaaattgaagctcacaatagaaaaacaatagaaagtacctccatatgtgttcaactatatgtgcaatagcaaaacaaattgaaaaataacaaaagaacaaattgaatacaaaattccaatcttgccatgtgttgacatttatacatctgatattttttgtgccggactttcttccatacttttatgtcccacttcataacccaaaatgatgttgatttttaagtgaaattttgactagtactttgaaactttgaattcttacctaaaaatatttcaatagaggataaaaggtaaacccggttatcgcaataagggaaaccctgcatccattccacaatgttagtgcttcatcacatcattactaggtatttttgttgtattgctccagtagtaattcagtcggagaaataaaataagcatgggacaaaagggttagatctcaaatatttaaactactaaatcatgccccaatcttagcgcttcattacattgccaccaggtgtacttgttgtattgttctagtagtaatctagttggagaaataaaataagcataggacagaaaagagttagatttcaaacattaaaactgctcaatcatgaaaaatcaaacaataaatattcaaaacaaacattgaggatcaactactaccttgtatttggaaatttcaaaattttcaattgttaatgttgaaataattacaattatttttgaaaaagtaggatctaaataaaaatagtaaacattgcctataaaaaaaatagtaaacattaatgttggaagtataaaaatataaaatttgaaaattattaattcagatttaaatcaatttttaacaaagagtaaaaatacatcgtcgatccccaaacttgtcccaagataccatccagatccaaaaacatggaaaacgaacaaattgacttagagacaaatatgtcttttgattcaaactaaatcttggtacagattatagctggtaattatcattaggaaaatgttgtctctcatctctactcttgatttaatttccatcctactcctaaattgggaaatttgatcattgtactttgaacattggggatacatccatccacccatttaacatgctttgtcattgatctacaagatatccaagttgatatatttaacatagcatcgggtaggacccacacgcactattatagctgatagtggaaccgatgatttcctctcaatttctctcctcaataataagtgaagtaggtcttatcacaagctcaaatccaacttggccttgccacactttgtcatctctactcaatttatccctaactatttagaatggagaattgaatgtgcttggaaactttgtaatatctaaaatgacctaggatagaatagaagcgccacctacacgcgaattagcttccgaggtcgagcagtctcaatttcactacaggatttgcgaatgaatgctaggctgggccagattatatatattaatcttgttttgggaagctacataatatatgttagctttttgttgttcaaagctacattttttatggtatattggaacatatgatatgtagataagcacaaaccataaagaaaagctacccaccttcaaataatcaacttgcaccatatgtccatgcttagcattttgtactaattcaactaaatctcaattcatatctaagttcatttatttgcagttctacgcactacacagaaatgaatagtatttattgtgttgaggaaaatttgggaaaatcatcactgaataacaaataacaacaatgcaacaatgaatagttgttgcatacagtttagtgattgttgtgtattttgttgtttgcaattttattcatgaaggcttataaaaaatgttattcactagttaaaatgtggcct

SEQ ID NO: 65118 - DNA, 10777 bp, Oryza sativa
aatgaccaagcttctgagacggtaggagatcaatagaaggaacgatatgagcatttgtgcaacgagctattcgatccaaaaggggcctctttatatttaaaacgagtgatatgttcttttctagtagcaaatcctgagcatagcgagaaactgtatgttcaaccaaaagcaagttaggcttttgagcaacaatcttcgcgactgccattttaagatgatccgtttcctgtatattggagaaaacaagcataaggtcattgaaagcttgatattgtatacaaaaaatatgaaaaaggttcatgaacctgctggagcaacgtgtcaatgcttgatagctgattcgtgactcgctggtactcaagagcacctgctagtaggaggagacgaggcttctctattctggatgtcatgcgcctatgtgcaacattcttcttacagactactccttttacaacagtgctgaaaaagcaattggatgcaggcttcagataataagtaaactgattaaatgttacatgaagataaggaatttattgatcaaactaatactacctgatggtcaaacaatatgaagggaattatatgtaagtaggattaagataccaatagggatcaaacatttacattatgaactgtgaaaagacattcacctttcactacggtgcccacacgctaagcatttgaccttaacatatccaccaggatccatgccaccaccttggcttgtgtctggtctgagaaagtttgcagcttcccatgatactgaagtaacaatctccaaccaacctgtttcatcaccctcgtgtaatgaaatattctccacctgcaacagttgtgaaatcaaagccctgaaatgcccatcgacaacattcttcattactttcttatgttcttcacttgaccgatctctgtttcggaattcaccactaccaaagctactggatgatcgaatgcgacgctgctcactatcagctacaggctcatcgtcatcgtcatcatcaaacaatccaacttccatctcatcttcttcatcttctggttcaggaggaaaccaaaaaagttcattcttctcaaaatccaatggatttgtatcagtactttcaagagcataaatggacgaagcagccccacactcagaactattgtcaggatcaggttcatcatccatttttgtgacaggcaatgtgctggggaatccttggtcagtcgcatgagaggatacttctttagaaattacattttcttcaactgtcggagatattgttggattataggatgattcaagctcatcgaactcatctggaccataataatggtcattatgctgttgatgttgtacctgcctatcagagcagtaagcagaacactcttcttcttcatcatcactcctgaagaagactatcacacgatcagaaatccttgtaacttgccaattcatcaagtaacacataaggtaaaaaatcaatgaatattcagtgtcaaactcctgtgaagtaacaaagtaaataaaatatttttagccttctcaaccttctctaatataggtcatcatagaagatcgatacacttgtctcttgttttcgggtcatttgtccttgctgcttaaatgcgactatgctcatgaataatcaactcattttctcaatgttagtctaaataatttaactactttctcaattcttgtacacaaatctaaaacaacctatattttgagccgcaataagtattctttgaaggaagcaaagcatattctacaattcaaaatgggtttcatcatacatgtcatttcatagtaatacctgtttgtgtaatagccaaaatgaactgaagaagtctcatctttgtttgaaacagcggacatacttttctcaggcacatgggtgtctagcatatcatgacacactttgtcttgggaacttttgggtggactaatgctggaagcacgagccacatgttgatagtgtccagtagagtaagatccagctgttgtactaacactatttatggtgatagctgacttggtgctaaacagacttgcctcagacaaggaaggactaagcaatggcatcatctgcttgttagcagcggctctctcttgctcccattgcttaaagcaaaagttgcagacacgaattttgtccccttcatcgatatttctgtcagggccacttgaagctgggatggaatttgtggtgcacttgccacaaaaaatgcgaccacaacgccgacagtgatgcctgcggttgaatatggtgaactgtgtgtcacaatcataacagactctgcaactgtgatcaggcatccagaagtccctagagacattgtctgggtttgaccgacgtggcaaccacgacgtcaaaagctttactacatcagcaaaagttttatcagaggcatccatgggttgctgcaatggtaccacctaaaagagcaattcatacttgcatcctcatctgctgcaacaaaaatctaagaaattaagacgtacattagaacgtattaatgcaaaaactatccagaatttaatgcattacatacaagattatagacccacaagaaagcagttttgctatttatcagttgcctggcttttcttatctatcagtcatctaaacttgtgcaatatttttttttgttgttgtttgatactggtaacaaccaacatcaaagcttttttttttggtaaaatttagattagaaattcactacaataaaaaaacacataaatttgatttgttggatattaatctagtgttgaaaagtgttattgatagataagaaaaagccagacacttgacaaataaatagatggcccataaaattattattaataataatgaaaaagttagcaggagcataatggaactctaacaaatgtaagttttatatatactgacaaatctaacaaggtaatcgcctagactattactgtacacaaatatatctctccatgtttgcaagaaagcaacatatatctttctgtgtaaatgaagaacaaaatggaaaacggattaatgagcattcaagagccattgtgacatgacaatacctaaaagtgataatgaacaacaacacaacaatccctaaacaatctacaaacttaattcctgagttacgtgattccatcaggaaaggcgatagaaaaaaccgtgaattacatatttacacacactccttcagtgtggcaacatggcaacagcccgacggaatcaaataatgccaagcaatatacctaagaaatatcaggagatcgatcaggccaaccaccatctacagacctcgcccccacattgcgtcgggttccgcgggagcgggagatcgagcgagaagatggccgccaccgatggccaacacacacacaccccaccttacggaggcgacgcgagagctcccctcccctcccgaacacacccaaggcaccgtctcagcgtcctgtaccgccccccgcgcccgtgtcgcagcgaggcggcgggggcggggcggcggctcggagcgtgccgctgggcattcgtcgtcgtcggcggcggcggcgccaacacgcccgcgcgcgcggcctacgcggtgcagcgcgccgcgaccgccggcgggagaatcttccgggggggatcgaaattccgcgccgcgaatccggcgagaggaggagagcgacgaacttggaggagagagggaggagttttggtttctgttttgatttttttttggggggttaaattaaatgttttgttttggtgggcgtgggggcgcgagggtgacatgtggggccagggaggcgagcaagtcgcggaggggcccacaatgcgcgcccttttggaagcaaatgaggagctgcggttctcctcttcctcattttataacacaaggaatatttttaagatacttcgaggaggtggtaagtatacttaattagtcaaatggtgtgggtttaataatgctcgaggagcgagagacatgccagaatcctggaacatgcaattttgtttttattataactcttctgtcagtaatcatgttatgtacccattttagtaattctttttttctaacatacttcttccttcccaaaataagtgcagtcatggttttccgcgcccaactttgaccgttcgttttatttgaaaattttttgaaaaatttaaaaacataagttatgagtaaaatactattcatattttatcatctcataacaacaaaaatgctaattataaaaaaaatttaaataagacggacgattaaaattgggcgcggaaacttatggctgcacttattatgggacggaggcagtagattgcatgacaatttttgttgacacaaatcctacgggaaaaaaaagagatgttttaccttgaaccagaagacagcatggattacggtttaatgctactcctaattgcattgcataggagaggcgtgcgcaatggtggtggtgaggtgattgcgaatgcgatggggccgcagcgcgctacctcagcggcggctgtgggctcgtgtggtggggaagggagatagctcaagttgtgggcccgacaacgcgtgcgccgcggccgggctgagttgggaataagtccattttggctcccttacctagtgaccggatctaaatcgtatcgttaatccgtaataccggatatctcgacccctaactatatgaatttaaccggtgtaatttgactttctcggtggttttagagggcagttttgctaactggacacctacatgacggtgttgacccggttttcgtcccacatggcgttttttttaattctaatgccacgtaagcgtcacgtcaacactacgtgggatgaataccaagtcgacaccgccatgtaggtgccatatcaacgaaaccgtcctccaaaaccgttgagggattcaaagcgggcttattcccgctgagttgttggtcgggaagggcatcaatatgggccggtcaaagggagaaggatggtgatgggccattagtccatgaaggaagaggttggcccgtcaggctacactcatgggccagaagaaatggaggaggacagcctgattttggattctctggattttcatatgtggtaagtcagaggctaacagttaggggtggcaatttcttccgtgggccgggtcccctgcccccacctgcccctataggggtgggtgcgggtgacgatttaaccgtgggtgcgccagggccagggccctgcatttgtgtgggtgagggacggggggcggggggacataccacctgcgggcccggggggtatattacctcttaaaacatagcccattagaggctcaaaaaacacatctcagtgaaagtcatatataaccaaccagcagacctaaccctagccgacacacggaagctgagagcttgagatgcacgtcgagcggaggattcacgcgctaagactctgagaggtatttcttgatctatatttgtggaatgatggatcatgaaaatatttctgtttttgctgaattttgatgatgctattcaagtattcatgtattcatgctcttttcgatgatgtgtcacatgtgtgaagtatgtacaatttttttccttgctaaattgacgatcgtcttactttttcgtagatttgatagagtagctactcactgcagggtattggtcaggttgcggggccacgcaggggccgggttcgggggtggggcagggccgttccagcccaacctgccccgttgccatccctacaaacttagcacaaagcagaaaacacagtgagagaaagagagacgcaactatgaactgctcctctggtagtctggtacacttcgcttctaccgtagcgagcaaatcagtctttatctttcgtcatgtagtttggacagcacgatttatatatagtgatattcccgcgttttcttaatgagttggtagtttggtacacacattttctgtttatatccgtatcacatagtacatactccctcggtccctaaatatttgatgccgttgacttttttaaacatgtttgaccgttcgttttattaaaaaacttttgtgaaatatataaaactctatgtatacataaaagtatatttaacaatgaatccaatgataaaaaaatgtcggtgatatgggcccgggggtacgcacagtagagggaagtcgccttcccgtttggccacgtggctgcgcggcttggccttcccccgccccctcggggggcgatcaggtagcgctgaggtggccagggggcctcggggtgccgcgtcacggcccttgggccctcggcgcgcgctgccctgaggccctcacccagccaccacgtggcagggagagtgggtggagcaggaggctctgctccgcgccttcaatgcgcagcaccccaaccgtcccacgccgcatttaatgtggcgtgggcggacgtgcggcgccgctcgattgatctatgtcaatcgagcttgacctgtctgtgaccggtcaaaagcgattggacgggtggcagtgccctcacgttccgccctgtgtcaggcggagtgggggcaggtatgccccatcccatcggcacactgccaggagcgcccccgcgcatggtgagccgccaaagtctccatacaattaatggggaatgacaagggcgtcccccgtgtcatgcggaggacggtgctggccttacctagagacgcacaaccaccttgcttccggttgaaggcacggatggaggtctgatccaggcttggtggatccccctcccatggaggggtaggtatagacggtgcatgtggtatccccttgaactataaaaggaggacttcgcccaccgagaaaagggacgactctcagtaactcgagctctagaggaagaacagttaggtttccccaggagctcaagaccccttgtaagaactcatcataatcccacgcacaggagtagggtgttacacttcccagcggcccgaacctatataatcccctgttctcgtacacaaattcgcagcgatctaatagttagaccgcaagcgaaagtacgctcttgatcatcacgccatctcctccggccgaactcacaaaggggggtcttacgaccacccgctagagagggttactcctcgacagaaaataattcataattacttaaattttttaaataagataaatggtcgaacatgtttaaaaaagtcaatggcgtcaaatatttagggacagagggagtatatcatttctcaatttattatttataggagtgtagttattaacccttttcatattgatgcttgtgtagtttatttatttatcaagttgtttttttagataaaagtttttacgctcagctttactaaaagcatctaccctataattcactcagtattacacctacatactcattcatcaaatttaacggacgagaatcatccaccgcttcagatccaacgaaccatacctccctcacctcccaccgcacaccgctcccacccacgaaaaccgcatggcgctatcattgccggctcgccgctccctcgctctccccgcgccgcgccatcatcgctgccgcccacgattcgccaccgtccccgcaccacgccgccgcccctcgcctctccaccgcgccgcccctccaccagcagccgtccctcacaaatcgtcaccgccgtcatcagcgccgcctcgccgatctcctctgcgccgccgcccacgattcgccgccgtccccacaccgcgccgccgccgtccacgattagccgcctctccaccgcgccgccgcccctccaccagcagccgtccctgacaaatcgtcgccgccgtccccacaccgcgccggcgcccctcgcctctccaccgcgccgccgccgtccccactgcgccgcatcggcctccaagtctccgccgactccaccgagcacgacgagctcaacacgaagagctccaagagaggcccctctccttcctgctcgggtcggccggatctaggaggagcagaggcttcaccgtgggcttggtagggataccggtgagctctcccccgtgactcctgcctcctctggtacagcgaaatcagttcttcctcctctagggcttagcttgttccttctattctgattacatgattaggttagggcgaattttgtgagggctttgctgtctaagattatgcgagtaaccaagaaccgatggtgattcaaaataagaaaaacgatggatgctttgttttttttatcttcgacttggggacttggggttgctattactcgtgagcttgccctaaaataattgaattcaactaatctacactttagagcatctcaaatatcatgtcttttgtcaatccaaatagcacatatactgcaatggttgagaacaaattggatggtgctggtataatttaaatgtttagaaaaaaaaagtaatgcagtaaacacaatgattcatggaataaaatcaacaaatggcgacgatcgccatctctgaatcaatggtagtttacccctgctatggatatatttcctgtatagaaaatggtttattggataatgtattggatgtcatattgccaattctccattgattttatagtaattagaacttcacataaaaatgctgatgtcatgcaatttcaattttgtatacaactagcaaattgcctcgaatatcattggagtagtgggtatggtggcactgattgcattgatggtctcttgaagactttcttttttcatcacttagctgtccatgttcattgatatttttttttggcagtagtaatcatattaagactatagtgcagtttccagttaatcagaagcaatcaattgagggaaattgagactcccaagacttccattttcagtcaatcaaaaggttattttttgttctcattgacaatttctaactcaaattctggacagtccagcacgacctcggccaagaaggcagcaggtctacgccaccttcttcccgtgctgatgccgtgtctgagccctacctcaccacaagtactgctccatttctctttttgaatcaccaccggttcttgatttctttgtgatctaaatattaaagatgtttattccattgattaaagatgcttgccattaggaaatatatatatattagctgcacgttgtgtagaactcaagaatgcttagaggcactccatgcatgggttgttttagctgcacatgtactgtccggctgttcaaatttgagctattttccagttaattatttaattaactcttaattatctgattcctcaaatattttccaatatagttattccttcaacaaaataattgacatatcagttacttcttgcgggtaacaaacccaccgccggagagcaccttttgttttcttattttcttatttgtctgccctatcaagtagcacgccatttcaatactctttattcttccagcagtgcacattattgtgccatttcatatgttagctctaaattcacatgtgttagctctaaattgacattattatacaacttccagcagtatatgtcttgctctgaatttgcatgtgttagctctaaatttaagatgcttgatatagattgtccttatgatgctagctgcaatgaccccattatttcaatgtaaaggggggggggggggcactttactattattgttttttgatgtatttaagacgatcaaatcctgtgcactgaatgttagggtcattcagtattattctttatcttggtgataatctgaaattccgaactgtgatcttctcccaaacaatatgcttacatgttccctcactttcatttggcactatgcttaaattattatatcgtctcaaacatgatctaataaatcattgcatttagcattcgatcagaatgaaagttcttgattaacttgcatgtttgatcgatgaagccaacaagctggtgaacaatttgatccttcgtcaaattgatgcgagggcccaaccaataaacccactaaagctaactctccgattgtgtaagagacttacaaagaaacttatggagcgtatgtgttcccagtaaacaccataaacttatggagcgtatgcgagggccacagcttacagcacccccaccacattaggattatcaccattgaaaacacaatcattatggtgtttccaaatctcctaggctactaaaataatcaaagaattcaatctcatccataccccttttggagcaaccttagtgactttgctccaccatcctaaaaacatgttgtagaagactaaggtgcagccaaaaccaaacccaattttgtgaagattaaagtccatacttgtcggatcatgtactttttgctggcttgagttaccagattgatatccatctggaggcaatccacatgattgggaggattcttgtcttatctaatctttggtttggtcctgaaaaccaactatttataaggaattcttgaagaaatttctgacaaatctttcagaagtaagaattgctacaattaatgcagaaaaaatctgttacatggctgtgtcttctggtagtgaaacgaaaggtattattagcaagactgctacttttatctgttcttttattcagagttttgtattaccatctttttcacactaatatttggttttatttggcatcatcacttaaggggatgttgtttgattttgatgacaaaattaggatccaagctatttctgcgatttagcctaatcaaatttaagaccatgcctttctgagttgatatttcaagcagcagacatgctatgcgataaaggtcagcacattgctatttttcattgctgaagggtctataaggggcttcgtgtaaatttacgccatg

SEQ ID NO: 65119 - DNA, 610 bp, Oryza sativa
  unsure (1)..(610): unsure at all n locations
gtgtagtggtatggatatccattacctgtatgggtatggtttggggagaatttgcacccgcggttagatgtgggtattagagcgcgaacttttaatcataagtttgagtatgaggtaagaaaacttgcagtagaattatagttcatgtggatcaatttatttgtgtactgaagagaagagagttgtaccaaaggtaacctagtaaccagattatttgagcaggcgaccaggcatgaggcatccactgtctagctttagtagtactactattgatcaagtcaatgtaacaatatgtttggtagcatatgatgtattcttgatnnnnnnnnnnnnnnnnnnnnnnnncaagccgatgcatatcaaagaaatgaatacaatgagttccacttaccatcttgggaccaacaaatatcttttaatctctctgaaccagagaccaccattaaattagacgagcttcagaatcttctagttctttcggcgaggggaatggattgaccttaaaggaagtggattgactttgattctctcaacaatctcaaattccagaacatgattacaatgttcgtacacacgagagaatcgattcgtccagccgaacgacttccat

SEQ ID NO: 65120 - DNA, 687 bp, Oryza sativa
actaaggtaccattatcgacttatctattttaacatggctagaaaaaatgcccgtgcgttgcaacgggtaaaaaaatttttgatcgctatacacttttcagtcccaacccaccccgccgtcttcctctacttggcttgcctctctttgacctacccacaagtggagctgtagtctcaactcgtatggtcggctgccgtattcaacctccggaagatagttccatgtccatacaatgccagaacagatcatttctatcaaatccggtcaaatctttctcgatctttcaaaattggttaagggcttttgatacactcaatctcttctttctgtttttatcaaaattgaaacgaatctggaaaactcgggatagaacagtaacttttaaatggtgattaaatccaataaatcaaagtgggattgaaagggaaaatcatgtagaggaaatgacgagggagagtagtggggaatcgatttttgcaatcaattggaggagagaacatatgatgaggtagatcgacatagcggtgacgttagggtttggcctggtgatgaaaaaactgagcagataaaaaacaacccttacagcctaatgacgaaaaaattggttagataaaaaaagaatccttattacgtgcgcacactcttacacatgtaaaagaacggtatataaaaaaataaggaaaaaa

SEQ ID NO: 65121 - DNA, 664 bp, Oryza sativa
agccatccacagcttaaccaatgcattgcgtttgaaccggtagttccgtggaaacatactacagtaagcaaagcatcgccggacctgttcgttaagtttctggtagctccgccactgttcttgtatgatgtcagtacacggtacttcattatctctaattttttgccaagagctggcatctaaatttttgcatagcctgtctcctactcgccttgctgcaaccggtaatcttcttagcttatttgcgatccctctgccaatcgaatgtagtttttgaagtttttggctatcaagtactctcacaccatcaagtgcataatgcatgaatagatcaaggaaatcattatcatccatctcagaaatttcaacggggctcttggcacctagggacatggctgtaacgccccgattttcgttcgggaataaaaatcaattaataatacattttctagaaattaaataaaagttaaatcaacttaatcaagtgaattattgagggaattaaaaatttcctttaaaaatcattagctgagaatattttgtaatattctttgtgccctaaaatactctccggatttttccgcaaatttttcggagctcaagaaataattttaaagtcacaaagatcatttaaccaattaaataaaaagaaaacaataaaatt

SEQ ID NO: 65122 - DNA, 1185 bp, Oryza sativa
ctctttcttcttacccttccctctctcactttgctgcaacactgacaaaaagcaatgcacagacgctaggagctcgtgtgcgctggcgactaatttaccgtccgctcgcaccctctttcctcccttctctcgtccatgtcatcatccaatctgacgtgtagctcatatcgccagctcaatctaccttattaaacctgctcttagtatttgcatggctattatattcgtctgggacaagttatatattgatcgagcatgcgtgcgtgcgactctgccggccgttgccaagacaaatttcacggcgtccgcggctgcatacaccgtgctactactactttcgtctagtgcatcatcatagtcactcgagctgtgtgctgtgccaatgtgcagaggacggagtatactacaattatggtttagtaccggagaaattttatgatccttcgtaaagtatccataggtatctaaagtttacttttaaaattttaataactcgagatacctagcatctctagcatctaaagataccaaattttacgatagaaaatatggtatctcgcaaaattttattaagaatggtaaaattatccttactattgcgcaaagctttggttacctctcatcgtgtgtccctagcctgttaaaatttcaaacttgatatattcaatgtttagttttggcttttcatacagtttttttattgtttttaaattgctaagagcaaatataaaagttctacatatattttttgtatggttttttttagcggacgagggaagaagctttggttaccacataattctcaaggaataaaggaatgtaatgtctgtttagatgataggagtgatatctctgtcctctacagcaaacagggctgaatataacacgctaaaattggcaaaaacaaaaaaaaagctttaagaaagaggaaaatccagatcagatcgaccaatatcaccttactaggaaaactctggcccatgcgatgtcgcccaacaattctaccgaggaacaagatctggccagttcttttcaaccgaatggaccgattatctaattttatgataatatttaagaggatacagatacattaattattacaaaattggaaagtcttatatatatatatatatatatatatatatatatatatatatatatatatatatgattttgcaataattt

SEQ ID NO: 65123 - DNA, 11106 bp, Oryza sativa
aagatccaagtgaagaagcaaggcaagtcacacattccccttgagcatgttgatcccaatttacaaatgttttactgtttgcaaataaatatgcatgttttgctaattacatggggtcagggttttacctatctgctcgcttgtgccatgtttacttgatatctgtcctttgtcaaccatgggtaataaatcgcctagctggtgttactttgatgacctagctagaactatatgcttagccatgcttaattaccactagctcagtcgatgggataattgcagtattagacattttagtatcttggtgagctgcgtgctcgagacatctggccatgcttcatggtcgtaattattcaactaaaatgcgactgaatggtgggctgtgggtgcatggttttgctggtcgcatccatggcagttaaggaccggttcgcgggatgccttggaagaatttatcgtacttaccacaagccagcgtgggcaacggctgggcttgtagcgtagctttcctctagccgacgcatccaggcaagggtgggcgtgatggagtttggatgggccctgcgacggcctatgcggcttccggattcacctaggcacgagaggggactgcccgctgccttgcgaggagtgggggtgaaacctgaggtgtggtgtgcttggttagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgtgcccgcggttatgggcagtcgaccagattcaccgtgattagtctcacacttaataaatcgacccaatacactgtagtttaggtgggttggttgggcctgttcaacgtggtgtagcgttgatcagtggagatttaatgttactttaattactcaacagttttactgttttgctcaataaaatgttttacaaccgcctttatgcaaatagacacaaaccatccttgtatccccttgcacgtctgcatcgttggtgtggcttgctgagtacggtggttgtactcagccttgctattattcccccttttcagaagtgtagtgcttctgagctgaagatggagttaaaggaccaaggctcagaccccagttgagttttgcctgtggagtggagctgaagccccgctaggatcgttttttttttccgctgctgcttttgtttcggtgtgaggactaagtgcctcttctgtaagtattttacgcttattttacgtttggaactgtatattacttgtcgttttgtgtaccctgactggtcctagacagggatttaatacgcaaaatagtctggaaatttgggttaaatttctgggcgtgacaatggctgcatctttggacaaagctgtaactaggatcttacttccccgcttcccaaaattcagtgtattacgtacttggtcccgttcttgctgagcaacatccgactggagaccatccagcgccagcaagaaccttttgtctctcaattccgcttttagcttattttctagggcatcaagattttggtacttataggatggtcgcccaatggctccttcgagcatctgtctgtaaattttatccacactgaaactttgagaaacatcaacccacatgacaggtgaaaaatggccatcctctttttcatactcacagacatattgtgcaaggattgtcttcccggatccagcaatgccatagatgccaattgttgttgaataacacgggttgttgctggagcctggttcaccgtcccctgctgcttcgcgcaacatatttactatctttgtacgatctacatctcttccaaatactcgccccgtagctgaggaagtagtgcccgacatcgtctcctcgatagttgtctccgtcattaataattctcgattcacaagcccgcccttagttagtttttgtagcttctctaggcttttcttcagcttactggttgtgtagcttcttctggcttttcttcagcagctcacgtaaccatgagtcggtattagagggagagctgacctgcattaagtttaggcatggcagagtcatgtaacatgaaacgtgcttattggcccaaaggaaaattttagtagcatataagttttttttttttggacttgtagttttatggctccttcagaacgcatggatgggcacatgaatcatttctttctatataagtacaatccactaagtacagttatggcaataaagttctataagtgagccatcggaagacgactcacgcgtcgcctcctctcgggcgacacgggaggcgcccagctcgccgtcgcccgccgctccctcccttctcctccttcgcctcaccgctgcccgagcggccggcagcaaagtcgcgcggccgcaaggacggcggcgacggggcttcgctcagtctcaccgcacaagggcaggggggactgccggcatcgggaggcggaaaccgcccagatccgtgccgaccggctggacctggcgcggcggttgctggtggcggggtacttcgttcgggcggtagcatttggcgggggtggcggcggagtttggaggcgctggtggtggaggacgaggctgccagatccgtgccggatctggcggatctggcggggaggcatccggcggcgcccgacgctggcgggaggatgtcggcgtctgctgggggacggtggagccggacgacgactggcgacgggggcagcttcttgtccggtgacggagggtgcggctggtagcgacgggcgcgacgacgcggaggccgcgacggtggcggaggggcacgaggccgcgcctgcggagttggccacccgacgaacagatcgggcgggcgagcttgcggcggtggcggcggagctcgcggcgatgggtcggcggcagcgggtgagcgacggcggctacggcggtgcgcggctggtgatgacgacgacagcggtggctgaggcagccgcgacagcgcccgtggtggccggcgcgaggctctcggtggcgacagcggcgcgcggctggtcacggcagcagcggtggttgacggcgcggtggctatggtatctattactctagcgggtgaatatcaattttcgcaagcgggactagatttatggtattatctgtagctattttttgcaaatggtgatttttcatagtccgactggaaaaataaatggtgacattgggaaaaatcgtttttctggtagtgaaaagtatttgcaagttactctagcgccatcaccattggtggaggttttgcacatctcaacatcatatgtcggagttttacttaagattttaattatttctatctagaagattattcttcgttatgaatttctaaataatatttattggctttgtggttacatgtaaagctacacacaatgaattcgaaaacctcatctcatcgtcccttatttaaaatttgggtttatccagaaggacatttgtctatctttttcttcggacgagtttacgggtcggacgtccgatcggtttagagaaaaatcgggcgccgatgttagtgcccgatttacgtgcaaaactattttaaactgatttttctcttaaattacttatccaaatcatgatccgattgcaccattaaatttgttacaattaaatcttcaaaacaaaaccacacatggatatattccgacgaaaaattttttaagcttattattgaattatttttaaatgttgcacgatgttccattagatatatcggaattgtttcactaagtagattgaaaatgtttcactcgtttgaatcgggtgtcgtttcaccttatataaaaacaatgtttcagcaaatagcgaaagaatgtttcaattcactgcaacatttgatccatacatagtgaaacattataagtacactaggtgaaacatttttcggtggaacaaaaaatgaaatgaattctcttaatagggggtttccaaaatatgtgggttttttttgttgcaatggaatatttcagtgcactgcaacattagatctatacatagtgaaatattgtgagtacactagatcggggggaacgcccgattggctccacccccgtcgggctcccgagccctgtcattctcctttttcttttcatgctttagaatgcatcacatccaacaatttatttttatctattcgacaacaatgcgtaggttgtcttctagcaatagccaataaggcttttgatgggaatctatgagtaaaacagatgattggaaaatataggtaaaatacaaaattaaccacttggataaaccacgtgaattttaggggagaattctaaaaaatccccttgtcttgaaccattccaaataaatttcatatgatttttggaagttctaaatttcaatcttttgttccaaactgatcaaatactcggtagaatatttactgtatgattcaaacactaaatttcttccaaatgagccttaaaaattcctttctacgatgttttcaagcaactttgtactaaagcttcagcgtttaatcttgaaaattaaatgaaaaaacaactgtcacgtgtttgaactaaccatgtgcttaaaaaaatggcaaaatttgcaagctggatttcaccgtcatgtcacaattaattacttatatattattcccatgcatacccactctagtctccaggccattctgaatacctaagcaaaattgtaaaaatggtactccctccgtttctaaatatttgacgccgttgacttttttaaatatgtttgaccgtttgtcttattcaaaaattttaaataattattaattcttttcatatcatttgattcattgttaaatatacttatatgtatacatatacttttacttatttcacaaaagtttttgaataagacgaacggtcaaacatgtgataaaaagttaacggtgtcaaaaatatttagagacggaaggagtactacttttatctcccccagtcctgaaacttcttgtggtgaaggtggaggagggggctagaaggtgtaaagtatactaccattgtggactaacaagtttatctgagcaaggtccaaaatagagttgctaatgatggaacaatctccgaattcagttgatatatcttatcatcctcaagcttgccggtcttttgccatttgatttggccacgtgccatggttaatctatactttctgtaaagttataacccactaactctaaagtttcacatgcaaccataccacatcatcacccactaacaataattacatattcaacctcatgcaaacatgcaagagcatccacaatctatttaattctacaaattagcacgcaagcatattcaatcaccacatctcacatcatttccacaatagttttacaaatctctattatttttataatatttaatatatacttataaacatgttctacattaaagtgcgaatttcatttgtttcttgataaatatcgataagccctgagatttgattttttttctttttactcctacctgaattgtaacgaaaaataatattgaaaattacttagtaattcccacagcaaacacggggaatcccctagtttttaagataaatcatggccatgggaattatgggcttgtttggtttagtgctctacgaatactagtattggtagtgcaatgtatcaattcttttttattattatacggatagtaaatcagaatttttattatagtaccaaattagttttaatatatctaatattgaacgtattttgatattttatttttttataaatatggttagtaatttgaattagaagggggaaaaaaaggtcacttggtttggtttgcagccaaagcgacaaagctgcatgtggagggcgaggttaaggtaatcgtggatgtccacgatgtcctctgcgtcgtagaaggcagatctgaggctctgcacccacttgtccagatacggcatggatgtcatgtgttccatctgcctacgcagctgcggctcaagacatgccaccaggttgcgcagctgggcttcttggtcgcagttgagcaggtcgatgcctttgttcaccgccttggtggtcatgggcgacacgatccatccgatcgtcctgatcgcccacccaaccgccacaacctccaacgccatgacgatcgagactcaaagtaaatgctgcttgttggttaattgaacgatcgatcaatataatcgtctctcgtcgacggagttggagcacaatgcaagactatatatgcttggtgccggccggatttatggaacgaggacctagctatagcttaactcaagtcaagtcaaccccggccggtgcaccatcagtgaggctatctgtggaaattaatctaaaggaaaatcaacccacgtggggtttgggttgttcccccaccttatttttttgaaaagtactcattttattatatagaaaagacagagattagggaaagaatccccagtacaaattgatcatacaccaaaccatcctttctaaagatgagacagactgaactaagggaaacaaattcctgatgtagccatacagtgataatggatgagatcgacaggagtagcggcgttgccgtgacgactacatccatgggccttcattgacgtgcacaccgcttgacaaaccgataatcccctttggttgcctccacgggaacggcacaaattgaaggtttgttgttgagtcgtagattttggtgtgagcttcaccggactttaacagttgatttccacggagtttatcattgaatctgaggagcactgacttgcaatcctgcgaaacaagattgctcggacggtctgccctcaacccgaacgacgaacccagcatgggtaccactgcatagaaacatcaagaaagaggtccccaaactccggccaaccttagtcaagaactaggatggcattgattgatctgctgtctttctacttcagcttggagctcaacaaaggaggatgaggagaaattaacctggtggccagctgcaattccttgatgagcaactatcatccccagcccatctaccaacagatcatgcaagcaccaatccgaccagcaccaacgcagcattctcgagaagcacaggctgccaaatattttgttacctgctgtccttgaatccgagagctgtcgccaccccaacaaacaccgtcgccgccccaacatctggagggggagaggccggagacggagagggtgggtcatggtgtccggggacaaggcagccaacgccgcaactgtcgttgcgtgccggccagatgcagggagggggcagcgccaccaaacttgtgctggatctgacaggttgaagaagttcctttgaccgatctgccttcccctcattgcaactcctcctctgtttttccaaactaaaccctcggcgactaaaagcgactccttccgtcgccgggacgacggtgccgaactccggcgatccatcgacttgaacaaacgggaagaacccgacgacaggaagacccgactacgagagaagaccaacacctaagctaatagattactaaagggacgaaaatcccgccccctcccctcacgccggcgatcggagggtcgccggagatggaagggaaggggccgggagaaaaggggattttttttttctccggaaacgcctgtttcaggttgttcccccacctgacacccaatccctccctgtgaatccccctctcgtccacttgcgcgggtggttggtgggattattagcagatattatccctgggtttggatagagggggattagaagggatcactaccattcaaaataattcagaaatgataagaaaaaaaattgatcatgaaaacagaaaaaaaatcaatgtgcaaaataattgtaaaaagcccccaaaaatagaaaaacgtagatttaccacagacgaattctgaaaaatagtccagaattttttttaaaaaatcataattttggatagattaaattctacaagcagtaaaacatccaaaataatcatatgttttccatagatatgctagtcacagacaagagattgagttgtcatactagtatagcaatagattggaaattaagcgcatatatcgtcttccacattcggccctgcatatactgatctgttgaaacagtacaattacagactcctaaatctgcagttctgctaattgaattaccattctactacgaataacagttctgcaggcaaaccccaaaagaactgacgaaactaaaactagtttatcatcaagcccttgaaaacaaacttttccttgtctccgaatttttcccaaaaataaagagagttcggcaactaccaccatcagcttccaaatccatcaaaagtcatgtctcttaatcttaaaaacctgaaaaacaaacaggaaacattatggacacctgaatagtcatatgaaaatttgtttggaaagtgacaattattctgtgttaatttggaaaactaaaataagaagtgagttatcatctacaattctggaacaaaaatatttttaagacaaggaagaaggtcaggcacgattaagcccagtacatatactcacaattttcagcttttaagcactcaaccatacttgctatagaaaacaaggactatttggacagataaagtacttaccctgatatacatcatctctacttgtctttgtctgaacggaccagaaagccagcgtctcatttttcatattgttcttccctgaaaggttaatccttgaatataagcacagaacttgcaatgccaacagttgcaatatcaacacaaatgagttatatgtcgatttgtccgtactccgtagttctgcactacatatagtaataattgagctagtcaatgatattcatgtttttgtcatatctgtgagaccatgggcagtggcagcactgctgaatgtggtaaattcatcagatatatcatataattattaattatgttcgtgatagagcaggtagctccttggaaaaagaaaagtatgcataatacctgttatatttgtgtttcttggagtatcaaccaataatgtaggacctgtccagcaaagaggaaatcggtcaactttaaatatctataactacctgacaaattttcactcaagtttcatttgcaatttcctttggaatgtattacattacagagagtgcacttctaaagaattgttgaataggcatttcacacttttcacagctattatctcacaacatttcttcagctaaactgttaattttgttgatcgaatcatatcaggtgaaccttcaatgttggaacaaagccaacgaaaaaattgatctttgcaagcagcaggacaagaagctgtgctctgcacctctgcatgagagaagcaactggaacaatgacaggctaatactagcacctaacactgaaatggagctgtctaatttcacttgatcctgtcaactgtcagtatacaaagggagatcgtgcaaaatcagaaagactggtttggcttctactcgctcatcttaatgattggtgggagaaaggacagacaccgagcaccaactaggttagaaatatgactaatacttcaatccatacagccactcaatacatcaactagcaacaaattcatccactagaaaagtcacaaaatcttttcatagtaggaaaagaggagatcaagaatcagacctgcttcttgatgtccgggctgttgccctcgaccttgccctctcccgcaaccggtgaatccgaagcgaggaaggagagatggcgagcggcggcggctgtagcgggatggagaccggcggtgaccgagggcgggaaggagaccagtggtggctggagatatgctgctcccggacctcgcgccgcctccaaacctagcgccgtgaggagtcgaggaagatgagcgccgtgtatgctcgggaagaaaaaaatcgtctccgagacgatttttctgtaccgggggtttggcatggatcgggtggagaatttcccccaccccacctcgggccaggcgaacgcgtacatgcaccacggaagaaaattagatctggccgggatggcacacggggatttcggcccattccccccaaacctagcctataagaacgaggcctgagagatctattcttaaatcatttgtgttgatcaggaaacatgcgtatgggacaaattgatgtgttcgcactatattatcttccatagtcgacctaattttttgcacatttaattttggggggccataaacctgcacgaacggcgttcacgaatcaatgaatcatgggctaacacttgagtaagaaattatcgttgttctcagtcaaattatttgacatttgattttgttttgtatccgtgctagttggtggctcactactgcttccggttcaaaattttcctctcgttttgtgagattgaggtgactagacttatgactagtaattattaagacccacttttgaatcaaacggaagttgtaggaattttggagaattttatcctcataggattatttttctagtagatagctccttgaataaaaggaatagacacaaatgaatcctatggaatacctcttccatgcaagttttggaggaaatttaatatgaagtagaatctcatgaaattttcttttgactttttatctctcctctaattcctgtgtttttcttgtgatccaatcaaacgaccattcttattatttttctgtgttttgcaatgctttatttcagtgccccttttaattggaggaaaaatggaagaaaaacaaagaaattaaaatcgtacactgttcatgcctttaattgctaggaatgagtaaaggaaaaatgtaggaaactttcctattcctatgattctggaggaaaaatataggaaatttaacattcactctaagctaaagttctagctatctcgcttaggatcgagacaaatctagtagctcatggtcacttttctattcaattagtgtagattagatatgtataagtaaataaccaactcaattaactccaataatacagacccatttacggtccaatcaaacactgtgttttccaattctctgttttgcatatgtttcatatcctatttctttgtttttcctattcttacaat

SEQ ID NO: 65124 - DNA, 521 bp, Oryza sativa
accttgggcttcctgttcggcgaaattgccctgcgccgccaacggagggccttcgccgcgtcggaaccggcctcgaaggggatggagtggtagaaccacttcgccatctaatggcgatcccacttcgacatggcggcgttcaccggccatagatcggagcgctcggggcgaacattaaagttcacgctcccgaacgccgttttctttgtcccggctggggtgaccactgtcttcgagttcacggtgccatagaacacggcgccgaaaagctcggcgctcggttcgaacctggcggtccggcacgcccagtcgaagatggtgactcggacaagtgccgatgggctcagctgggaaagctccacctggaaaagaagaaggatctccggcaacaaaacgttgcatggaaactgaagccccacctcaaaaaacacggcaaataccatcgtccggttgtcgccgtgtttcggcaccacggcctttcccggagcgaaggccttcccctccaccagcaggctggcgct

SEQ ID NO: 65125 - DNA, 2688 bp, Oryza sativa
aggaaaaaaaaactttccatcttctttaccggtacatatatgttaaacaaaagcaacaaaacttcaacttcacgtttgaagatagctttgccacaaagcgaagctaatttaacttccggttcatcttctccgcttacgaaaagcaattacgtaccactgtttcagcctattttgctacttcctagctttagttttcttaaaagtagttttatctggtatctagatgcagttcctgaagtttcttggctagtaagcgcaggaaaaagaacaacttatatatgatgatctcttaactaactcattctagcctaaacaacttattgctgatgttgaaaggtccccacaacaacagcattccccatacctagcgtccacagtatgcagggacaatataatttattgatgtaaaatcctctgtagacaaattgactagggaagttataatgtttaaaagcgattaaaaaaattctccttgctttaactggcatataacttccacacccacatctctaacctatagctaaaataaactatatatttttttttgcaaacatgcaaaagttttaggtgtcgaattatattaggtggaagcaacatagtacacaatgcaaactgtagatcagtagcaggagagttatatggattgagagattacaccattgaacatgtaaatttgtagacaatttcagcagggggagaaatagggacccaaagaacaaaacgtcataataagtcaaaatcgagcaatccctcacaaatgtcaagcaactaaagcctagtcgctcgcaacatgtgcatcatctagctactttagaaggaaagaggatcgtggctagagagaaactaagtactccatatttttttttgacatgaattactgtcaggcattagcccaacagtatagcttttataaaaaaaatggaaaatatttacatctaagtactccatattcatatctaagttcacttgtttgtgtttctaccatgtgaaataaaattatttgtatgagaattcgaggacatactaggaaattcatcactcgataaaaagaatgacacatatataattagcatgccattcatcacccgataccaaatatataattagcatgccattcatactcgcatttgaatgttaaaattctaacaaatatttaatatgcaaaatctatcacttgttctctttctttttcttttccattacctttctctcctttttcctatgacatggcaagtttcagtgggcccaaggactacatatagcaacatgataaactgtagattgcagaggttctattcttgtattgttatcttgatggatcttttaaaatagatgtagctttgtgataaactttatgctaaatatgcagttttacaataccatactgtgatgatttcagtattaaatttgtagttttgtgatatggcatattaagtctatcgatttgttattgttttatcaatttatctctagtttttttaaggtttactagctccagtttcaatatatatctcatcacagcaaaacaaatggagtaaatgaattctttgccaagattgatggtccccgcagaaaaaaggcactccttgtgcctcacacctataatgccgagacaatattttgttgtaataattattgatgaacaaactaaaataatcaagctacagggactaaaatgtttttataaaaaactctacgctttaaccgacatagaatttccacactccaatctttactctccagctccagaaaaaaaaaagaaataaatgatataactctatattcttttatctgtacacgcaaaaattttaattatgtcttgaattatattagaagaaaacggcatagtacacacaacggtagctttagtcaataaagtgagcagttcacaaattaagagattacataatatagaattccaaactatttaggcagttttagcatgtaaaagtgggaaaagaaaagaaaagaaaagaaaagaaaaaaagaaacagaggccggccgggaccaaagcgtagacatcttgaatcgaatgcaagtgtactaattcctcaggcgtgtcgaacaaccaaagcccctcggcaacatacggaacatcaagctatggcacaccaactttagaaagaaggaagattaaaccaggagctagctagacacagcagacaagttaagtagatattaatccccacacaatctccaaattaaaaccatgcatgcttatcatcatcaccatcaccaccaacaagaatgtccatgtcatccttccaccatcgatctctccatctctttcatcccccctccacctataaatactgctaattagctccctctcttcttcatccaagctagctatagctagtatatatctgacaaattcagagaaattcagagagtcaccgcgagagcttaagctagctagctagccggccatggcatcgcatgtggacccgctggtggtggggagggtgatcggcgacgtggtggacctgttcgtgccgacgacggccatgtcggtgcggttcgggaccaaggacctcaccaacggctgcgagatcaagccgtccgtcgccgccgcgccgcccgccgtgcagatcgccggcagggtcaacgagctcttcgctctggtcagcacacacacacacgcacatgtgcagcagaattatacttgtgttaattactagtcccttt

SEQ ID NO: 65126 - DNA, 4272 bp, Oryza sativa
ataggtaaaagcaattaagaaacaatccaaaacgccaaaataaagaagggtcaaaatcaaaccacatttttgcatcatctgctactgttaacatcctagagatgagttacaacttacaagattgagcaggtttacctaatgccgagcaactaattaaaactagatattgttggtaaaacttctatatacaggtcattaacgatttaaaaggtaatcttaaaaataaactgtaataaaaaattaataatcagcttcaaaagtagatttcaaaatttaaattttgacagcgatggaagcgttagtctagaaatctcgtgaacgacaggtgcacattacgtttgcaatcgcaagaggaaggaggagaagaagacgaactcgttctcatccgcggtcaaaatatattttggcatagcaagaacagaagaagcgcccccatcgtctcaaggaataagccaaacggcatatttaaacgaaagataatttgtgaataaaacttttatatacgtgtttttagcgatttgaaaacaaagattaaaaaaacttcgataaaaaaccccaaaatattaacttcaaattaaaaatttaaagttaactaataataaatataagtataaacgaaaatatacggttagagaagagagcaggttgaggaagagaggggaagcaaaccgagctgaaccatgcggcgatggcgattgctctctgctcggaccccgcgtagagagggcgatatttatttaattaatgagtaatcatccggacagcgatggatttgtagccttgtgattatggggggcttatggcgatgaggaggatgacacggccaatgcctatccaaatccaatccataacgcatttccggttcagattcagaatttcagacacaaacagcgatccatcgtccatgtagtattatacccttttgatttgattactcattcctccttaatccttgccacgtgtgcagtccggccaactaactacccggagtgtccagtcagcctgctttgtttgttcaaacttgatccaatctgattggatctgattaacatgcactgctcgtactaggagcaatataattattacaccagaccccctctcctgcttggttcagttcagttcagttgctactaactgctttcttcagttgtgtttgttacaacagtgcttcaaattattcactcgagcacctaactttgaatttgctcagatcgtcctaccagtgagctctaacaatctcattcgtggaatgcggcctaagctttgtacgtactcccaatcttaataaaatttggtcggtctaatagcatgtcacagaaccgtgtcaatgttcaaaatcttaatgaaatttggtcggcctaacagcgtatcgatgttcagaacgacgagcgtcggtcggagtcactgtacagttgcggagagcaaggggaagtaactcgcattggctgacaggattggtcatttggtccatgggagaagaagatgccaaggaggaggtgagagctaggacaaagagtagtacataagctgatgcatttactgcattagggtaaagtacaggttttacttaagctgagcttagcagagacagagcagctgttgttggtttctgtaacagggccggcagggtttagtgttagtgtactcagatatttgtcaggtaggactggagtagtagttagtaggagtaactggtttttgcttttagtcaaatcttttgctttcgtgtccaacatgaccacatgtgcctacacaggacacagatgatgctgctctcaacagagagatgattgagatcacgaatttgacattttgcactaatatatactactgggttaaagatgtgtttttttttttacttcttccactcaaaaaaagaagtgatttttactcttccaagcactggagatgagtagatattttattatgcaaaatagtagcaggagtaattggatcatccataagctatggcaatcaacagcaagaagagatttgacaaaattcatccaaatcttgtaactatattatagatttatatatagttggttatacatattggggatctgtacacttgcttcctttcgatgcctcaatggctcaaaaggagaagagtggaacaagaagaagaagaggaggaggattgggagttgatggaggagaaatctcgcaatcaagaacctggctgcggcttcgtcgccggccgcgacgcgctgctctcgccgccggggaggcccatctccacgtcgcggtcgccctgcgccggcgccggcgggggcgggggagtcgcgccgccgcagcccagcagccgccgcagggccgctatcctcgccgcttccaccacggcggcgactccggcgatgggtcccgccgacggctgcggcgggaaggccggttgctgctgatgatgggacgacggaggcggcggcggcggcgttgccgcggcggcgccgcctgtcctgacggcgtcctgggagccgaagaagagcacgttggtggggaagttgggcgactccgcgtcagcctccggcgggcgcacggcgggcggcggcggcagcgcctcgtcgatgacggcgcagcggcagagcgggcaggtggagtttgaccggagccacatgtcgacgcactcgacgtggaacccgtggccgcaccgcggcagcacgcgggcggactccccggcggcgagctccgtgatgcagacggcgcagtccgccgcggggtcgccgccgtcgcccccctcggccgccgccgccaccaccttcgtcggcagcgccgcgatggccgcctcgtcaagcccctcccgcctccgcacccgccgtccccggggcccccgaacacgaaccgcgcgcgtcccctccctcccccaccgctgtcgccgccgatcgtgggcgcggcgccgcggtacctcttggcgcagaggaagaggtagaagcacacgacgaacgtgatgaagatcgccgccgccgccgccagcatcgtcgccgcggccgccaccgacgtccccgtcaccgccatcgatccctcgtcgccaccgagtccgcccctctcctcgcgttcttggccgccgccgccgccgcaagaagaaatctgagtgtgaattggggagtggaaatggaatggaatcgagccgctgtgtacaggagagggggtgttatatacgggcaagtggtgaaggatttggaattggaatttggaatttggggagaggataagaagaggatttgagttgagttgaggtgaattaaatttggacggggaggtgggtttagagggagggagggaggaggggaaagtgagtgagggagggagggagggaggtgaggagacaaggggaagggatatagtggtgtgagtgccgactggtcaatgttggagggatagagacacatcaaaaacaaatttaaaaggtttttttgaaactgagtattagtaaaaagaaaatctatgtattttgggattaagaatatgtgaattgtggggtgatatgagtcactgagcgagggtgatggactacggaaccattcgaatttcttgtgtcatgatttggagggaaaagtttgttttactcgcacaattgattctgtttgatcacttttagtctcctaagactatttctaactcattttatgtctaaactattaaagttgctaattgtttttagttacatgtaagatctcatatatccacagttccataccgccatacatttcatatctgatttaatacaaaaaaattgcaacatcatatctctcggaggttataatcaagacaatggccaaccacatcaagtgcctacaagctacaacataaacacccactactagaaatcaaacatgaacataacatccaaatgcactcaactttattcaggttaaggctgtgtttggagcattgggttcctaaccgctccctatcgtattccacgcgcacgctttttaaactgctaaacggtgcgttttttttaagggttaattggatctatgccacgtgaattgtggcaaatcaaaaaaatgccacacctattccggaatccggtgcatgtcactactatttcgtcaaattggaaccataccacaatgtacgccccgcgcgcgctttgccaccgttttagggtaccatattttcgtatggacgtttctgccctcgtgttcacgtgtgcttagaccagctccggtccggctcgaacagcccggtcaccattcgttccccacaccaaaaccctagcttcttggaggcggcgcaggcgacggcgccggcgcaatcgacggcggcgga

SEQ ID NO: 65127 - DNA, 31548 bp, Oryza sativa
aagttaccgttgcggttttcttttttttttaactgttctattgttttggaccaggctggtggttaacataccaggtggaacagatccttctcaaggtaaataatcatgcaagcatgctagtaccttataatttcctaaacaagcttaagtgatatatatagtacagtattacttcctaattgacactctttcttccatgcatcttcacttttactatatatagtcaaatatatcatgtattagagtgtgtttagttcacgctaaaactgaaagtttggttgaaattggaacgatgtgatggaaaagttgtaagtttatgtgtataggaaagttttgatgtgatggaaaagttgaaagtttgaagaaaaagtttggaactggccgtgtttagttcacccccaactaccccaaacttccaatttttcatcacatcacattacatccaaaactttcctacacacataaacttttaactttttttccgaactttcaactttctccaaacttccaatattttttaggaactaaacacagcctaaacaaggccttaattccccacaatgcaattaaccgagttgcatgcactgattttgccctgtgcaaggaaggtcgctagcaagcgctagtagtagcagtaagcaagtagcaaccgaccggctagattcggcgtagctatgcagagcctgtgtccatttcagccagctatagctgcaggctgcgcacagtaggtgccagccggcgagcggccacctgtcggccgccacgagcaacatgtggcggggctgcgggccccgccggtggtacacgtgtaagcccacctccgcactccgcgccgccacgtgtcgcacgccggacgacgacgtcggccgccaccgtcgtcatcgtcatccggccggtcgtctcacatcgctagctggatttaattagtttaattcgttggattaattaaacagggaggaggctaatctagtctagctacacggttgttttggctctcatcgaccctgatccaacgacaaaaaagacgtcgcctagctttttttgagttcgtcctggtagggtgggtggtgtgacctgctggcgtgatctttttcatctggcgactcttggaagcttttggccaaggacacgtagtcgcttatccatgatgattaattcacactgtacatttggtatcttcgtagtcaagagtaagattgctagctagctaattcaacccaagatcacccgtcaagagttatagtggagttggttcgcacgcgcacggttgatcttgtaacagcgaccgtcgtcttatcgttgattaaagctgcatcataatttgatttgataattaacacatgaattatattactccgtaggcaagcagcagccagaagctgtttaattactgattttgatgtgttcgtttaatttgtggatcgatgcaggggatgtggtggtgccgtacatggggccacggccgccggtggggatccaccgctacgtgatggtgctgttccagcagaaggcgcgcgtggcggcgccgccgcccgacgaggacgccgcgcgcgccaggttcagcacgcgcgccttcgccgaccgccacgacctcggcctccccgtcgccgccctctacttcaacgcccagaaggagcccgccaaccgccgccgccgctactagcctccctcccctcgctcggcgtcgcccatccatccatccatggacggcgacggcgacctagctagctaataagccatcggtcggccatgctcgccgtccaaactatcatgcaccatatcatgtcgtcgtttatgtggttaattaattatttccggcgttttattactgtgtggtgattaattagctgaactattgttttgatgatggtgattgttttagtacactacggacacacgcatatacaacactacacgcacaaccacactcacatcctgtgaatgcacccctaacatacgcgttctaagcgacggaaacctaagacacattcagtaccccgggtcaagtcatctctgtcggacctaatctatcacctctaataggttcggtcctcgcaagatattaatcatcagtgatgactcccctcatatatggcgggtgaagacccatcagtgacgataaacatctccgataggccgcatatagaagaggcccaccatatgtaaggttgaccaccttgactaggtagtgtttgctaactgttacaggtaattgtgacggatctatcacaggtaattgtgacttctcatatgtaatggcttgacaacgtagtgtaaaagataagtcattgatgagttaattggaaaaaaataaattttaaatattggctagcctcaggattgctagcaatgctctcaaaaaaacaaatcatatcacaatcacatatattcccagccgttctccccaataggcaataactcccgaccaacaacccaaaatatgtacaaaaacatacaattcaaactcccaagttacatattcacaatgcaaatgtcttcctcatatatttattttaactcttaaagccaaaaatttacactgttatatacttgacgcccatggtttcaaacaatgacatgtcatgttaataactagaaaaggaattgaataatacgtaatacaaaatgatgattggatgtaaatgttgaaaatattatgataatttagtaacctatcctaaattaccaaaaatgacaaaatgtgaggagttcggggtgccaaggtgttttagtctctaacaaaccaacttggcacccatagcactccccattttgtgatgatttgataatcaaagaactaaaaataaattaacattgcatatatatgattaaataacattgtcaaccacaccgaataatacttgtatgttacataaccaagattgtttaatatattgaccacaactagcactttgatcatctacttctcacgaaatactcctttctacttcatgatttccgcgagcatgaaagcagcaatttcccatcttatagaagatgggttgatggggctaatttttcacatagtattacgttgaataagacctaagtatgtattgaggaataatatcggtttatataaacaaaacatgattttgagcacaaacctcagggtcggagtcattcacttgtttcattattgttgacatgttgtggcacacgtggagaaccacactagtccccgatctgtgatgcacatttgaattcggtgttgatgatggtatcactagctcggatatgaccctgattaccttatatattcatcaaccaaatatggattctttctatgtgagagttatgtgttatatatttgaacaagtattattgcattatgaattttgtgtagtctcatttgcagatgtacttgcttggataaagggaaagaaaccgagtgcaagaagtaaagaagttgattggggatcaaactaagaccttccaaagtttactctaacattaccacatcacttttggtctatagaaggcaagagatgaagttttgtacgttttggattcgtatctaggtctccttacaacataaacttcaaacggatctagccgctgatctagaatgaatctcaaggcccatgagttcttgttgtaaaacaatccacgtacctcatttagttcgagtttgatttggaccttgggccttataattgcgtcatgggctaagcccaggggtggacgccctagggctaacactaggacgtccctaattatatttattcagtagccacatagtatagactggggggttttgcttagattatttctaccattgcagtttcatcgctagtacggtttgtggaatcccatctttgagatcttaatcattcatctacgaattgagctgcaatataccttgttcttgcttgtgtttttcgattcgcatgtagggattagccttctccgcgaggtcaactgggcagcgcattgttgataaccaaaggagacatggcgctatgatctagaatgaatctcgaggcccataagtacttattgtaaaacaatcagcatacatcatctagtccgaatttgatttggaccttaggccttataattgtgtcataggctaagcccaaggggtggacgtcctggggctaacactaggacatccctaattatatttattcagtagccacatagtttagattgggttttttcttagattatttctaccattacagtttcatcgctagtacggtttgcggaatcccatctttgagatcttaatcattcatctacaaattgagttgtaatataccttgttcttgcttgtgttttgtgattcgcatgtagggattagccttctcggcgaggtcaactgggcagtgcactgttgataaccaaaggggacatggtgctatgattgtagggttcggatcatattgatcggaagtcagatcatgtctgtcaagtttctgccaggtcaagaattatcaatacctatcagaagatcggggtccagtttctcattagttgatatcaaagtgccagattgtctgttaggtacaccctgtatcttttaggctaatattttttatacctatagccaaaatattgtcacataaaaatattgcatccattatattacctagccaatttgagacgttggattttttgtttagattttgctttgttgaattataggttgcattgttgtgtcaagtgtcggtttagttttagacttaattgtttatttgagtcttgtatctatcgtcactttggtctagggtgtgtgtttgtcgcagtgagttttggtccaattttgcatctcatcattttttttgggaccttgaaaaattgaaccctatcgtcatgggatttccttttatagtttgcggaagtttgtgtcatttagttctggagtacattgctagggttcttgtgcctttatggtgcttgtttgtgcatctagattagattggagaagatatcctccaccacgtcaaggttgaccctgctccacttagttggaccaagtaagtgttcattcgaagttggttatgattagggccttcagtccttcactttctatagtgatcaaattttggtttgcataaacggtactttgcatttgattctctatagtttttgacttttacatttgagtccctataatatttatatttactttttagtccctagtcgaagttcattcctattacaaaataaataaaaaagcaaaagaaaaaaaagaaaaggtagaaaggtgctaaaaaagaaaaaaaaaatgaagttgtacctaaaaaaaaggcatagacatagagaatgggcagcggggaaacaggtgccccacatcttctttttcgtgtaggcatatctcacacatcacggactagacatttcttttcaaaaagaattcactacgccgaatcaggtcacatttgacgggtttagccctagtcagagattagtggtcactgatgattaaactcattttgacgggtaaatgcccgtcactgttatggatcacctctaacggattgcaaattacaaccagtcacaggtaatgttcaccccctttgactggtcacatcgcaagcacgatgcgcccgtcaaaggtgctggttaccggtgaaaaaaaacaaaatataatatgttgttttgctagttgtagttgcattcatctcacaaattcacacacaaaggacgaaagaaatgccgcaaaataggtttacatgtaaattaacttgcactggcaatagttctaagcacatcatgaaatcaaacaatctgggcagcacaaaatcaatagaggacaacataatcgatcaaactgaatcatcacaaaatatgaatctagcaaaggaggagagaaagacctcctgagcaccaccgtcgcacccacctccacctcccaagcgccatcatttgctcccaccggaactgaccgctgcaaggtcaagggcagtcagatctaatgacccccgaccttgggtaggctggatctggaggcggaggggccaatggcattaggacctcaagaggcggcctccaccccgagcttatttcagcgtcgacatcgccttcgatcccgagctccgccaccaatcttccaccgccttcgccttcgcctccgcgctcgacctccaaacacacattcacatccaaacacacgtctgggcatcacgaaatcaatataaaatgcgccagaaaattaatgagaatgaaacaaagacttgccattgacgatgaaatcctaaagctgctgttgccaagctcaacgctggaggaggatgtcaacgctgatggtgcttcggcatcatcgtcgcttgagcggatctgcaggaggcggctgctgatgaccttggagcagaggacgaaggaggaggtggccggagcatggggccatccagatctggtggtctccaaccaccttgagacttgatttggtgccaaggagcatggggcggcggagagatggtggtcggcgaccttgggcggtggtgggcgaaggaggcggcggcctcgagctcctggaggctagtggcgagcgaacgtgacagtgacgcggtcgtgggaaggaagccgcaacaaccggtggttggcgggctggtggaggaagcgagaagagaggaggaagagagagtggaggagatggggagggagtaggggtggaggagaggaggagaaggggcaaattggtgggtggtaggccccctgggtgggggggtgggggttttcttttttttaagtcaccaccgacggtataaaaattgaacatgtttgaggtgagatatctcaactgtgacgggtgcaaacataaaacccgtcacaggtaagaggtcatcagtgacgggtctatatgtggacacatcaaagacgttatgtgttgggtccttgtatagatccgtcaaaggtgagtacttacctgtgacatgttattttcctaagccccatctacgacgagatttattttaacctatcagagatgatatctgtcggtgacatgggaccgggagtatcgtgactagaggcttgggcagccgcgctcacccacgtggcctgaccccctcgggggggggggggtcgggcccgagggtgacgtggccacccctccctctgtctccccgaggggtcgggccgctcccgtttcggccccgagggctggggcgccccgaccccctgtggtgttggcgccacgtgtgtgggttaggtgagcacagcggcgctcacctaaccgtatttattgcgggttggacgagcgcgccacgccgcatttaatgcagcgcagcgcgctcgcttatccggtccgtgaccggtcgcagtatgtgaccggtcacagaccggtcagattgcgggttaggtggcagcaggcggcctgtcacacgcctcgccccgtcccgtcggaatgatgagagcctccaggcactcgtccctagccggagccggcgtgctaactcctggagttggcacgtctgtcccggccagattcatgccaggcttcatcgcaaccattacaaggaagtcattgtatgaagaagggcagatgtgcggcatgctaaactgacgcatggtggacaagaatgaccggtctgtaactggtctgacgccggtcatgtcatcggcagacaaaccgtactcccacgttgcatctgcttccggcgaagtggaggtaggtatgacccatcccatcggagggtcattcggacagtggccatcgcaaatctccgcccattaatgaaggaatgacagggtgatcccctgtgtcaggcgagtgacggcgctgggcctcactcaaggacaagctgtgatttagcttccaagcgaaggcgcgagccaagtgctggtcaagatagggtgggtccccacccaaaagaagggtaggtagaagtggtgcatgtggtatccccttgagatataaaaggaggaccttgcccaccgaagaagggggatcgagatccaaaacaaaaataggagggacgactctgagaatacctgagctcgtagaggagagaaagatgaagaggggttctagagcctgaactctcttgctctccagctctctgtaactccttcacacacagatccaccataacacaggagtagggtattacgcttctcagcggcccgaacctgtctacatcgcccgtgtctcgtgcatttgctctctcgcgaacattccacagatcgagggtgaagaacctcacttcgcgcccccggccgaaccggcaaaggggggcctgcgcggtctcccggtgaggagccccacgctccgtcaatatcaatcatgatgagacatcactactactacagaatcccaagtcggtgccagttaggaaacccccttaggtgccggttttcccatccggcaccatggaggcggcacagataatggaagattaaaggtgccggtttcaaaaccggcacctttgaagcgcacatgagccaaaaaaaaaaatcagctcgatgcatcgagccgtcaagccgatcccacaaatgacaaatgacaaatgacaaatgacaaatgacaaatcacaaatcatcacatcatcaaatcatcacatcaacaaataatcacaagtcaaaacatcttccgggctatcggaccaccgccgcctcctcccctcccaccgctgccgcatccccttccgccgccacctcccctcccgccagatctggtggaggggagggcgccgccgccacctcccgggccaccgagtcaccgccgccacatccccttcagccgccgagccgtcgccactgcatccctttccaccgccacctcccgggctgccgtgccgccgccaccgcctcccctcccgccaccgagccgccgccgccgcatccccttccaccgccgagccgccgctgtgtggtggagagagagggagcgtgagagagagagagagagctgagagaggggaggatgcggagagaagggggtgagaggataagggaagagaggctgaggataaggctgaatgccaaaggagagagagaagccaggtatttaaaaggtgtcagtcagcttggctcagttggctccgccgggttctctaaataggtgtcggttacctataatataaatatgggtgtcggttcttccaaaaaaaaccgatactaatctagaagttgtcgatttttatttagaaccgacacctatctcttcacaaaggtgccggttctagccaatggtgtcctgtggatgcgcttttttggtgggaaaagcattataagtaccggttttagctgttccggcacctataatggtgacacctatttgatgttttgtaatagtgcattttggtccgtcacaggtaggccatcacagatgggctgatttggcatagtgattggtttttatgggcacaaacgcatttgggtaatttgagtcatttgatgtgaagatcgaatgactgtggaatgaaaagtgaatttatgtgtattttctactagctaggtggatgtagcaaataatataactacttctttttatatatattagtacaaacctatagatagatacaacgacattccgattctcatcgtttcatcctggaacaaaagtgaaaaatgacattcaggaactttctctaaatggaggctgcaatggctcctttgctatgtctctccacgcgcgtgcagttataaaaaaacttaacttgcatatcattcatctttcagttgtgcatgcatgatatgtaaccacttggagagttaaagtgcttatgacgtacagcatcagagtgcttattagacaacctaaccccattcgcatgtcaggaaaaagatcgatctaattaattaacagtaatataattaagagaaaaggtaagagaaatagcggctattggaaaagtaaaaagatcgatctaattaatgaaaacatgcccatacgttgagatacaagtgtataatctaattggtttggatatatatgtccgaatgaattgaaggctatggcaagaaaagtacctcatctgaatagaaaagggatcagagaaaaggtaagagaaatagtggctgttggaattggatgctcagtcgttgctgattcattgggttctttctcatcataaggtatctgtcattctcaccgtggattcttcgtctcccacacaggtggccaagttcggtaagcatccttattttaatggagctaggcagaaatttagtaaccacaaatgcaacaaaaaaaaagggaagcattgttagtagaagagtgattttattgttattattttaagaggtactaggaggcagtggtggaaccacaatcttcctaagcctactgctcaattagtacaatttacataattttacttttattttatttttttttaaaaaatgtagcataatttgagtaggtattttgagtcaggagtaacttagctaccctactccgtattatcctaccttaaatcttaaatattaagatacattagaaaatattgtatttctggcatcttcttaagacctaaatgtccagaaggttaattcgtaagctgtatttcaaataggagaaatacattagtttacttatataactctggccatcaacatttttttaatatttatgattgttctaaaaatataggcattttttcttaaaaatacatgtggttagtggttacagtactccctcttcttcaaaatataatgtgtatgaatctaaagaagttatattttgtaacggagatattgtatagagccccactacagtgctctttactcgtagtagaaatcaatctgaaccgttgatctcatttgatcgaagggtttagatatatttatactatcatcctagttagctgtagtagaaatatggaggggcattattgtaaaaaaatatgtagaggggtataatcatcatttagctatgagtaaactttttttccttcttttttagctttttcgatggaatatatgagtaatatcaggacaatggatgagcacatatcgatttagtcggggaaaaacataaatgacaaagttagccataatcactgtattagtaaattattgatttaaccttaattcaactagtagtattatattactagtagagagagctggagaatcgctctatagtatattatacaatgcaaataggtgagtgaagaagttagtatgaaggctagctagttcgttggagtatgtatgtattttattggacacattatagtgcgccacctttttttttttgttaggggccactcaagatgcacgcgaactatctatcacgcgtacaaattaaaggcgacagaggtgatatcagtctcaacctaggaagcacagattctccatctatatggtctcttttcttctctttctttctttctttttttctccaggtatatggccacttctttgtactgtcaaaccataaaatgccacgatcggagtagccagactaggagctactacttcatactcatgaagtttaggataatacttaagtcaaaccttgggaatataaatcataaataatttttaagttgttgaatttaaaaatgtaaaaaatatatgcatagatttgtcttgaaaaatacttttataaaaatatacatatcacttttcaataattatttttataaaaataagaagttaaaattgtgttttggagaccgtgtcgctgtcctaaacgacttttttacgagtataggggagtataagtgagagatcgctagccctacctaataatttcactccgatgagaccggaggtatatgacacgtgttaattaaggacatatggatcaacattcatggattgtttggtcggagaaaaagtgaaatattcatgtgtgtttttttttctaataatttcgctccgacaaggaaggaggcatggacacgtccaagaatcgatcgagcatggattctttggtcggaaaataaagtaaaatatattcgtccatcaaatcaaatatcgatagcttcgaataggttttgtggtccttcaacgtttgcatgcatgagagggctgcattaatttcgaatggtttttgtgagacactaaggaagaacgttttaacaatacctgttagagtttgtgttaaatatatacgttatcggttacagtttaaaatttggaattgtactaagtgttagaaatagagtaaggtactaccacagaacagcacatcagtgcccccatcatcagtgccggttcaagaaaacccgacactgatgatagtttgtccaaaagtaagcttgcactatgcatatctttcactgggcattgatgaggagacatcagtgcggtcttataaccaactgatacggattgttttgcaataattagtgttgggtcttaccagttgaagcgagatgactacacttttggtgggaaaagacatcagtgccaggtattcttaatacatcagtgtcgaactttcatcagtgtcgggtttttagaatacccgacacgggtgaccttaatcatactaatacttattttagatacatgaacttaactttttcatacgaacttggattgtgacaaagtttacatagaaattgtagctctcgacgagatctacggttttgtagttgaaaatttttttatttgaatttttcaaatagtcaaatacatgattcaaatctcggttaggatggctcaaaggaaaaatatccatttgctgataggattgatgtgtatgtaagttggtaaaaataggtgcatgtgaggagagattgtgggttcaaatctccatcgtgacaaaattacatttgatttgaaaaaaaatataaaatagtggttgcattttcctatatacacacctaaggatggtaggagtataaatttttatgtaggccaaattttaaatttggatccgtatcatcaatgccggttgtagccatgaaccggcactgatcagtcctcatcaatgccggcaggggcggatctatccattaggcagggtgagtcgaccgtcccagctacgacccgtgtcgccctacacccctaagaccctccctactctcttataatagtcataggccattaaatttaggtataacaaggtgtgaacgtccaacagattagtctctttcttcacaacgcatgcacgtcgcaaagaatgatcgagacagttatgcgattgaactataaatatgatatgtgttgtgtttgattgctcttatcgagtaaacatcttctttctctgccccatctatatttaaagctgtatccatcactgaacgccggtccttaacccggcactgatgaccccccttccccctccctcatcagtgtcaaaagtttagtgccggtttgattttttgcactgatgaggggttacgacctgacactgaagctattatctgtagtagtgagggtcagactctattctaaactctctcctaataaagggggcggacatattgtaatcgcataatgacttagcataggcgagagatagtagctacatacgacatctagctgaggaccgttgtaactctgatatattgtaattatactagatcgggaacgagcgactgtaatcagttctccggaaatataggcttcggctaaactccattatcatatattatctcagtggctccaacaattttggatctcctataacgcttttccgcatttggttactgatggtaatttcggactggttttataacaagtagtatcagagtcagatttggaacccgaaactatttccatgggtcacatggtggagagacacggtaaacaactcttcggggttacatgggttaatgtgacggggaagattgatgggtctgatgtgacgagggagattgttgggtttagtgtcatatcggcacgacttaaaagataggtgtagtcctcactcatcagattatttttttgggttgcgtaggtttttttctgaacgactggttgcgtaggttcaagatataaaattatgattctggttagacctgtggtagagaagactccatacaacttgaatgacccacgattgatgagccgcactaagcactctaaccataatgttaataacaatataccatagcattttgaactgattcacggtttgtcaagtagcattgtactggctgctcttgccatctgtgctacgtactgtcaaaaatatggcagtttagtgtaatggtgttaaaaggaaacattaatatattccttcctagcgttttgaactagaagaaatattgacacccattatgggcctccatactagtaaagaaaatcgtttaggataatgtttaagttaaaccttgaaaatatagatcatgaataactctcaagttattaagtttaaaaatgttaaaattatataaatagattttcttaaaaatactttcatatatatatatatatatatatatatatatatatatatatcactttgtttacacccaaatttggcacctatggacgaaatagaggaaaattgccaaagtttggaaagtgacgggttttcttcacagggccggtcagaccacaggtgtgtgggcagtctgaccggcttgtagggccggtctgaccgcaggtatgtggacagtcagaccgtcagggtccgagtccgagtctgttttcgtcgggtctcaggtttccttgctcaggaaggcaggtttcgtgtttcctttggtttctatcccgagttagacgtggagaagggcctatatagggcaagaccaacccatatttaatggataaggccggttcattgtaaaacccctgaatacaacctacttgtatcgtttttttaccgtgttttctattttaccctagtttagtccatctttgtcggtttgcgccgtaaactgtccgccgccgctgcgagaatgcgacacctctttgtaggtttgtcctgaaaatcttccgttttgcccacgagacgggtagttatcctcatatcgatctaaatcggctccgctagccggtttagctagttttatacaaaacccattttgatttggcattttggctagatcgaggtggttggcgacttcatatcactgcaaggcgtttaggtgttgcgattgtgcttgtcgacttgtcacaaaaagttgccaacacgatttttggcgactccactgggaacgatctaatcggccatatcctcgtttaatctagtaattactgttcattaaatcaggagtttcggctaaatagccgaaatcaatctacactgtaattgctatcgctacgcactggtttcatcgccggattaatctgttcggcggcgaagttaattatctggtcgtcactgaatccatctgaatacttgccgttcagcacgccgcgtataccgaggatcatcgtcaggaggcagaggccggctcgacggcctcgtttctttttgtttcatacggcaaacagagaaaagatcaggctactagagccgatctaccggcagacaagcagcaggagctttgtttctttttattactgtgcacgtgctaaaacaaagatcaggctatccaagccgatctacttctgttcacataaaaaaaaaacaacaaagccgattcctactgtatcggttatttctgtgaagcttcaatttctccaattttttgctaggaacagtaacataagaagaaacattaagaccgtatattaatctattcggtcaacgattttggctataagctatatggccggatttaatcaagaaatttcttcatcaactataacaagcgggaacggattcaacaatattactgcacaatatattaggaccgatcaaggcgtcgtgagagtaaacatcccgctacctcaagttgtagtttcaccaaaggtaacctccgattcgcccaacccatactttactaatcaaaaggttaatgatcgttgtgtagatgcatatactatttctagttttactcctatacaatatgcttatagtgctatggggggatcaacgggtgtttatacaggcgattacacaggaatcggctatatgcaaaacctagctaacggtatgactggtcgtgacactagtctaaccgcaccctaggccggtcaaaccgtgcctactattttggccagatcgggcctcttgtggccggtctgaccgcaccacttaccaccggtcagaccgggtcatcggtcggtaagaccgggtgcttggccggtcaaaccgggctatctatagccggtcagaccggttccctgagaatttctctaggtttccataccacgactagcagtactgattttaaatattattcatcacctgttaatactgttagtcatgctattccacatgtccctaatgcctacaatagggatatcctcccgatactaggtatggctaatataattatattgcgccgcaacaaccacctcttaggccaccaaatacaccaccagatccacatagacctaaaaatatggaggagttaattagtaccattattaggaatacatttgggattgaagcggaggatcgtgctagggagtaccaaaagccgtatccagatttttatgacatgatcccacatcctcgtggttatagaattcctgaatttaccaagtttagtggtgtggatagtaggaccacatgggagcatgtagatcaattcttagcgcaatgtggtgagactagtaatatggatacatgtaaattgcgcttgtttcctttatctttgtctagtgctgcttttacatggtttacttctttaccggcaaattatatttttacctgggctcatttagaacaaaaatttcatgattatttccacactagtgaaactgagcttagattggatgatttaacatcggttaggcataaatacaatgaatctgttgctgattatattgaaaggcttagagatgttaaaaaccgatgtttcaatttgaaaataactgacaaatatttggccgacattgcatatgatggattacttgattctattaaagagaggttgaatggccaaatatttcttaatgttgatcatgtgttgcatgaagctctagctcaggaaagccgagtggatgacaatagcttacatgccaatttagatgatagtgcaatatcatgtatagccgaaccaagcgatggttcgggttgtgctaataatttgtgcaatgatgtcgtgacaagtatagccgaatcaaatgttggttcggattatcttactagcttggatgataatacaacaaccattatagccgaaccaagtgttggttaggattgtgttactagtttaaacgatgatagaatagctgaatcaagtagtggttcggattgtgttgctagtttagacaatgacatcattgaaaatatagccgaactaagtgacggtttggattatatcacaagtgaaagtgaaatagcattgtcacctaagaccgaatcaaaaatcggtcatgtggatgttggaaaaaataatgataatgtcttgcgggatagtatgtgagatagaatctaaaatagttatgcatacatatcaaaggctgtatcctgaacatgtagattcggtcccatacccgcaaggttttgaggtgcccaacttcacaaaattcacaggtgaggatgctagaacaacaatggagcatatcggccaatttattgatcaatgaggtaaggccggtagtaatgatttgcatctatatggtttagttcgcttgctcctaattcaatttctacatggtcacaaatggagcatgagtttcatggttatttcaaagatgcaagcttgatggagcaaagaccgattgatacttcatcggtcacttgtgaaactatttcggttacatctatccctaagaccggaattgttagtgatcttgtccctgttagttctattgatgttggcaaaaagaaagggaaaagtgttattattggggatcctccgcccaagaataggatcaaaaatgcgaaggccgaagatcataaagttgcaaagaatgagtcatctagttcccaaaagaccaaaaagccgaagctcacttttgagatgcttatggctaagtacaagaaaggattagccggtcaacgatttgataatcaaactagtgattcaaaaagaccaagatcatctcgtagggagagatttgatcaaacaccaaagaaatcggagccatcaactataccaactccatacaaacctccggttgtgatgccatggtattcacatccaatgtcgccatttggttatccttttatgtattacatgccatggatgcctcaaccacctatgccgtgtcatcaagcatggaagcaatcacctaggatagtaccaagtcattctaacttaagacaagaccgtttcccacaaaagaatcggtctggtggatcaaaggtgaaaaaggtgaagaaggtgtgggtgaggaaagaagccaaagctccggaggtcgttactatcaatgaggaatctcaagatgttcatgtacctactggagatgtgttgaaaactatacaagcggagaagactgaggccgatgctgttgctgtcgacatcggctgtctgaccgagatagctgtccggtctaaccgccagactacggccggtctgaccgaccctcctggccggtctgaccgacggcttgcggccggtcagaccaggtctagagaccggtcggaccggggggcattagagaagagtgggaaaattgagaacaacataggagcttccacttcgaccaaaaatatcaagaatcattgcttagctcctggaaaacaaccatagccgaagtggataccttctggcttatctcgctctcaaaataggaggctacaacatcttcgggccataggtaaaaaagaaaagaaggccgaagatgtggagaacaaaacatctaataatttagagcctcaaacaacacctaagcgagtgtggagacctaaagtagtaaaagttaagagatcggtgatttcccatagaagtaacaaatccaatttgatgagagaagaatcatcggtcattagagataagtctcctccacatgatgctatggggattagtgcggtatccatcttgccttcgaaatcatgcaatctagaaagccgattttgcttggggggcaagacattaatatgctcataaaggaatcaagagagatgaacagcgatggatacgacatcagatctttgagccgccgttcgttggatgctaaggcaaggtatgagtttattgtgtttactgttatatgcctatgccatgttaagaacattgcttgctatctagcacatgtgtgtttttgcttatcaaattgatattatacatacatgttgcaaatgccagttctaagtagtggaattggtaagttggcatatattttatttgaagtatgatttggctcatgagtctttaatatttcttaaaagccaaatcatacatgtttttatggatcaccatataatatatagatttcatgtttatcgcgtcatgaaaatttttcttattagtaattcggctaatgtcaatggtcaatgtgatgatttgttctagagttgttttatttaggaacattggcattgttaatattttgcatacatgctcaagccgattacttacatttgtagtttattggaatctatgtatgtgacacatatgactttggtgattcattattgatcatacttcaattggctaagtgttttaatgccatgatgattattgtttcaaaagccacttgaattagtattcatctaaacatgttagttggatattataattatttatatgtctagagaaggaattttggtccaataatttgatacaccaagcatctggctataattaatgtgaaggaaaaattatatactaaaggccgatgtttaacttcaaatgtttggacgaaattggcgaagtcacagaccaggggcggtctgaccggcattgcacggccggtctgaccagtggtggacttgtggtctgaccggctctgcttggccggtctgaccaggtagacagggcggtctgaccggcattgcatggccggtctgaccgatcccgggcagagagttgggtgcacgttacaattgattaaaatgccgaattaattgtgaattcggatatttgtgcccatgagttagaaatagcttggagaattcctttgattagatatttgaaagatactacacttaagattgatcggaagattcggcggcaagcgctcaaatattatatcgccgaaaaatagatggagtattacttagatatctaaagttgctaggagagtagtgcatgaagggatttgtgagattcatcaatcggcccgtaagataaattagttgcttaggagagtggggtttcattgaccgaaaataattgatgattgtttcaaatgctatagagggagtgaagcttgttaacggaccggcaatgttcaattagcacctaccgctgtgttggatcctatcattaaactatagccgttctgaggttgggctttggatttcattggtcaaatttatccttcgtcatcaaaagggcattggtccgtgctagttgcaatggattacttaactaagtgggccgaagccgtgccgctcgagaatattacttgtacggagataattgactttatttttaagcatattgttcatagattcggttttcctcagacgttaaaggagcttcttttatgtctaaggaagtgagaagttttgccgaatcttatgatattaagttgttgagttcttctccttactacgctcaggctaatggataagccgagtcgagtaataaaacattgttgaaattgccgttttgccaattgaggtaaatcttggctctcttcggtatttcaagcaagacgacttgtcagttgaagattacaagaccttgatgggaagcaattttgaagacgtcatcgacaagtgtttgaagaatttgaaggagatgaagacacttcaagacggtgtttccagagagcaattaatgggaaatacttgaagaaatacttcccgagcatttggcaagatgcttaggaagtcctatgaccaataattggattatcgcgctgagataacatgttctatgcttttacgttcacgtatgttcactaaaaaggcaggggggcatgtgtttacacccaaatttggcacctatggacgaaataagggaaaattgccaaagtttggaaagtgacgggtttccttcacatggccggtcagaccacaggtgtgtgggcggtctgaccggctagtagggccggtctgactgcaggtatgtgggcggtcagactgtcagggtccgagttcaagtctgttttcgtcgggtctcagatttccttgctcgggaaggtaggtttcgtgtttcctttggtttctatcccgagttggacgcggagaagggcctgtagagggcaagaccaacccctatttaagggacaaggctagttcattgtaaaacccctgaatacaatctacttgaatcgttcttttaccgtgttttctattttaccctagtttagtccatctttgtcggtttgcgtcgtaaaccgtccgccgctgctgcgagagtgcgacacctctttgtaggtttgtcctgaaaaccttccgttttgcccacgagacgggtagttatcctcgtatcgatctaaatcggcctagaggctgattttgatctccaaatcggctccgctagcccatttagctatttttctacaaaacccatcttgatttggccttttggctagatcgaggtggttggcaacttcatatcaccgtatgacatttaggtgttgtgatcgtgcttatcgacttgtcacaaaaagttgccaacacacttttcaatatatatttttatagaaacaagaagtcaaagttgtgttttggagatcattcgctgtacaaaatgattttctttacgagtacatcggagggaatactaaaattgtccctaaatatataaacactaaacacttctggaaaaagtacgaattaccccctgaactatcgcggtcgaccgaattacctcccctagaccacaaaacctgacattcttcacccccaactatgcaaaccagacgaattacccccctcgaccaaatccgtggtggttttggtctacgtggcgtacacgtggcagtccagtcaacattctatttattaaaaagtatgggacccacttatcatactcctcttccattcttcctctctctcactcttcctctctctcttctctctctctcactctcgatgatcccgtcgaggttgtcgttgatatcaatggcggtggtggcgccgccgttgcgttagcagcacgaggacaacacaacgatctccctgatgatgaccaccgcctggagcctcctctgcaggtcgtcgtgcttggcgacgttggcgagcagcgccaccgacgcggtcgatgagccgatggccatgatggccttctcgtcgagcggcatgacgagcaccagcgacgcctggacgtcgttgagcagaccgacgacgctgacgagtcactcactgcggcgaacgatgcgaccgccgcggcgagtgcgctggcggcgccagatgacgcgaggcaccaccggtccctatcggactcccgcgcgaggcggccgacctcgcgcaccgccgcgccgcacctcgccgcgtcgcccgcccgcgcggcggcctcgacctcgcccaagctcaacacctcgcccgcctgtgccagcgtgacaggcacccgcggcgtggggatccgctcgacgccacggcagtggttggcgacgcaccacgcctggatgatgcagcggagggcgtggttggggatgaggtcgtcgacgcggaggtcacctttggtaaccgggcacatcgacgacgccgtcgctgccgtcttccccgctccggcggcgagcagccacgcctcaatgccggcctgggcttcatgcgcatgcgcgttgggagagagatagagagagagccctcatgcgcgtgcgggcacgccgtcgggcgttgggacagagagtctcgccgacctgggcttcatgtgcgtgcgcgtcgtcgggccgctggcgccgtagcccgacgcgtccggcaaccacggcgatgagaccgccgtggccgcgtcagatctctgtgcctggctcgaccagttcgctgacggtgccgctatgccagctctcctgacggcgccagagagagagagagagagagggggggagggggaagccacgccgagggggcggctgctcgtcgtggccgcagccgccgccgcctcctccttatcccctgctgccactacttccgcgtcaccccacgccgccgctgctgccgccgctctgtgttccccgcccgcagccgcagagaggaagagtgagacagagagtgagaaggagaggaagaatggaagaggaatatgataggtgggtcccacattttttaataaatagaatgctgactggactgccacgtgtatgctatatagactaaaactaccgcgatttggtcgaggggggtaatttatccggtttgcatagttgggggtgaagaatgtccgattttgtggttcaggggggtaattcggtcgaccgcgatagttcgggggggtaattcgtactttttcctgtataatactcctcaagttgttaagtttaaaaatgtaaaaattatatcaatagatttatcttaaaaatactttcttaaaagtatacatatgtcacttttcaatatatatttttgtagaaacaagaagtcaaagttgtattttgaagaccgtgtcgctgtataaaacgactttcttgatgagtacgaagggagtactaaaattgtccctaaatatataaacactaaacacttctggactttaacggggattaattaacaagagaggtgaaaccaaattagaaataataatttgtccacgatatgatattttcaattgttgacaaaatgctacttccactttttattaataaaactcaatattatttttacaattttgtacgactaggattcattacacattgtttgctaatactattttttatttaacagtgttgtcaaatataagaacgaattattggtctgacagtgcatcgccaccatcttacgattgtcgattctcccggttaattaatttatacgaacttggagctatctgagctagatactgatgaacggtggtgatttggctgtgtacatccgtttagatgtagaggccggtttaatccattatcttaaaaaaaaaactgatgaacggtgacatcatgatccacaaataccctgaggaacaaaatcgaattcttccaaagatggtaacaccagagcaaaacacatttagggtgtgttcgccagaaccggttaccagctggtacagtaaatacggaaaacggagcgatccattaacgcgtgattaattaattattagttattttttttcaaaaatagattaatttgattttttaaagcaactttcatatagaaactttttgcaaaaaatgtaccatttagcagtttagtaagtgttgttgacgagacacgtatggctcaaacatttagtagctagctagctagattaattaagaagaataaacaattcatactaaattcatcatggcaaaatgatgacgccaatgaaccagatttctctatcatggatatcagtatcaagtttgatcagtttagcacaataatgcacctctgattattagcggcatgcaatatatgcttttttaataattctaacaatgtctgcgattaaaaatttgttgccagctttgtgacgcatatataccagggcagcaaaatccttctttcgggatcggtaaataaaaaatggcaaaaatttttgacgtggaatgtatatataaacctatctttgtaagactacactctagtttggtggtacgtaatttgctgaaaaacattatgaccattattttattcaattggatggataaaatttataggaatgaacatttttaccctgtgacaagttgatgttagaatatgtgtcgaatatactagtcctatttgattacgattgaacttggagttgtaatagttggtagggatggagttagagtcagactctataacccggcatctcttttaaatagagaggggggcaccacaatgtaaccatagtgactacaatgcaacgtagacacgcatagagatgatggcggcgaagccatagtctcgtacggctaggagctatattggttgcggaggagcactcataatcagagccccggggttgtaggattcggctgaacctcgttaacaaatatcgtgtgttcatgtgtcgttatttgacgtgtcttgggtaatcaatggcttaagcgatcaagaaggatagtcgtcgttccgctgtattaactaacttttataacaagtggtacaagagcagaaggttttagtattggatcaagaagacatgtggaggaggaaacatgaggtggtgatagcgcatcgacaggagatcgtcagtagtggcgatgagatcgatggcgacaacgaggacgttgcggaggcgacgatctcgctcacgatcagaccggtgatggcggaacgtgaccggaagacgaggccgggcatggccgaaggcgttcagagagataggaggggtagcgccacggactgcacgcccgacgcacgcggcgatcatggatccgtggcggcagggaggctagtgtcggaagggcaaagccggcgagcgttcgaacaaatattattacactataagttttgtgtgttctcatttatagagatacttgccttggtaaagggaaaatatatggatgaccaaagaagttgattggggaccaaagcaagactttccccaagtctactccaacattaccacatcatttttgatccatagaaggcaagagatgaagttctgtacgttttggattcgtattcgttcagacctcctaacagcatcaacttcaaacaaatatagccactgatccagaaggactctcggggcccatgagtacttgttggaaagcttatggagtctactttgatatggttctagtcctacatcaaaattctttccaaggagttaggaaactacaaaacaagctatataccttatccagtcggagtctgatttgggctttgggctttgtaattgtttcgtgggctaaaccctatccctaatcatatttattcagtagtcgtcatagttcagagtgaggttttgcttagattatcttatctaatgtagtttcgctactagttcggtttgtggaacccaaaattcaagtgctaaatcattcatatgtaattgagttgtaatctaccttgtttttggttctgttcttcaattcacatgtttggattagccttgtcagtgaggtcaatcggaccgcgcactgttgataaaaggagacatggtgctgtggttgcaggttcgaatcgtgtttattggaaactggattgtgtgtgtcaagtttccaccaaatcgagagttgtcagtacctatcggaatatgattttaggtttatttttaatgtagtatttacagtgctatataatatataaaataatatttacaacttgtttcaattgtaactttgattgtaatttctatctttattaagtgcaaatatttgaaatttgtttgttttccttcataatgtaatatatttttttggtgaagtcatatatatgctttttctgattaagtgacatcccacaaactttcttcggcatatatgtagaatgaaggagcctttaaaacaaatagtttttattggatacaaactttgtaattctttataagctcctttttttcttcctgtaactttgtacatattctgttttaataaaaatacactgctaggcaaagccctggtagtttttcggtaaaaaaaaaaatgacatcccacaaatgttccatgaaaaagatagacaaataaatgaaaattttgattggcccattaaggaattgacgtgggctccgtcatgacccttacaacaggcaggcccattaaaggccgaaacaactcagcaaacctatatgagtggcatacatctgttgttggaataagttcacatgagtccctcaatttgtcaccgagttcaagattcgtcccttgagcgcaaaaccaggtacaacgcatcccccaacttacaaaaccacgcaaataaggtccgagagaaagaaatagaaactaatcctatcctaccctaacaaaacggatacaatacgatcttatccacatactctaatagtccttggcgggcctcgcctcggggctccccgtctccccagcatgatgtacgtcaggcaccctgccagcgccgtgatcgacgacccacagtccgacgatggcccggagctccggccgccgctccctcctctcccgtctcccgtctgtcgcggcgcacagctcctctgttatcagctaccacacgccactcctcaaccgcctctccgcccaatggctgtcgccccctgcgcttctcccgccgaccggcctccccgctcgattgttgtcgtgccctgcccttctccccgccgaccggcagccgccacccttctccctctcggcgtgcctggagagaggagaggggagagaaaggaagagaggggagatgggggagaggggaggaagaagaggatgggtgagaatgacatgtggggccccatcattttttattaatttgtgtgtgaaactgacatgtgggttccatggggtttattattttttcccggatcaaattgccacgtaagcgtcacgtcaatgccacgtcaaatgaagactgagtcaaattaaccacgtaggcgccacgtcagccaaaaccgccgtccaaaccgctgagagacctcatctgcactggttttgacaattgagggacccattgtatctggttttctggttgaaggacgaaaatcagattcgtaacaaattaagggacctcagatgaacttattcatatgttgttttactacttaatctaacggtgcaaatatttgggtgattttacgttgaaaatctgtcgacacatatgtagcccctcccaattgttaagttacaaatttgatatattttagcagaaacgaaatatgcagaatgcgagttttccatttttgagatattttaatttgtatctgcattttcatttgagtacctgtaatattcacatttatattttagtccctaatcaggtcagtagtcggttcccgttgaaaaaagtaagacagaaaggtgctgaaaaaagaaaaagaaaatcagtgatccttttgatatgttttgaaagtgtagaattatgttttgaattgtggctttgttcgttactggaggttcccattcagaacagtgcgcatggaaaacggaacggtccattagcgcgtgattaattaagtattagctaatttctttttcaaaaatagatcaatatgattttcttaagcaactttcgtatataaacttttttgcaaaaaaaacacaccgtttagcagtttgggaagcgtgcacatggaaaatgaggcagatggagctgggaacttgattcgaacacactagcgaagggtggcccgatcttcacgacagtaggtagaaaccaatgataacttgctgtagaaacagtgggtaactagctttatacctgccaaggttggatgcgaccaagcgacggggagagagacaccgaaaccgtgaggacttcgactcgatctccgaacgaccgcaaaaccacaatccggtactaatcctcacaatacggtgcagctgaactggaagccgtagagcacgaactaggggacctcaaagagatcttcctcacaagtccaagaagaactcgcaagaacaaaggggtgtaagatactcaagcagctcggctgcaaaaaccattcaggttatcaaatcatcaaaagctgttttctggaagcacataggagatatttctactaggaacaaccctcctagataggtatgaaacgtcctgaaagtttgaaggacataggctagcccaaaggtctcaacaagcgaattcccgagaatactcgcgcgtctgtttggatagtgagcagccttcagtaaaaatgtcattactccttattgggaagtccaaatgacatggggtaggttgcgttggaaagctaacttaataagatttcacaccatgtgcataatgcactgcgaaatattgtagattgatacagttttgcatggaaagttggaagtcttggcaaactgttggccttcaaagcagtgtccactaatatggccataactctttagtgggaaatccaatggacgagcggtttgttgggtgtgaaaatagactcaataagctttccagaaagtgctcattcaccttcatagcttttgagaatcaaaagttatgacgatttcttgaactagtccgttttgaagctgaactggtccgtttttactggtcctttttcaccgtccgattcagcttcctcttgttgcatattcataagcacaaccaaagtagaacgtttaggtagtataacattctcatctatagatgcatctaatcagtccttccattacttgatcacgtgtagcagtagttgaacttggtatagtcataactgggatgtcctcaacagaactactccctccgtcccaaaaatactccctccgtcccaaaaatactcaacctagtattagataaagttttctagtacaacgaatctggacatactcttatctatgttcattaaacttttttggacgaagggagtagaactatagaaacacagccttagtgtggttaggtgtttgcttaatccgtttccgagtcgtttgcgtccctaattataaatatatgtcaattgagatgttaggtgaataatgatacaaatctatatacctcaataaaagataacagtgatagttatgctacctgcattcgcatgttttataaattagttcccagtatgtcctccattatgcaatagtctaatatatgtttaaatatgaaaaacatatattcaaataaatgtgtactttaacatagcaaaacatggatattttgctagtggacagtaaaacctactatttttccccctttctgcgcgagcaccctacaccttgcgactaccaatctgtagttttgcataggggatggcattgttcatgcataacaatatatatagataacacaagcatgccactgttatatcttgtacagcggcagcaaacttgttagcctggttaggtccaggcaacaagaataaaaggacatgtcaggaaatagaacgagcttaaaaagaaatgcttggaactgcaaatgtgttacacccaaaagctacgataagctacaaagtgggtatggcaaaattgttcattctgcacacctttggtccctggtgtgcaaaaatttcccccaaacgcagcacaacttaagcccttgaaacctttttcttaacagcctttgatttcctgcttttcttctgcttcttgtattccttgtacaagttgatggatgacaacgtgtggttcagctcagctctcaatctctcattctctgagatacctcttagtaccgcaaaatgattttttaacttctctttgagttcatctccacccgcaacgcaatctgatccctcgagcgctgcagggcttagggcaacaaactccttaccacgcctcttctttctgcagtttagtggcaacaatttattcgctggtttagacaatttccgttccattgacaagtctctatatgcttctagagggcttgcatttgaaattggaacaggattctgtgtaggattcaaattggccatgctcaagatatttgaggccattgaggaaacagaggaatcgtaatgcttctgcagaaggctaagctcccataggactgaggcaagtgccccactcagataaggatctttagcttctgggtcatatttctgcacaaatgaaaggtagcattattaggtaaacacaagctgtaattgatgttgatgaattgcacaacacaagggtagacaaataccgcaactaagcaagacagggagccaccaccagaatcattttccaacatgtttctgcacttgctattcttttgaagaagatgcttcagtgtgattaatgctgaaatattgttcaaatatgtcagcaattatgtcaaaggaaatgaaacagatgtttgtacttaatacatattatgtactgtccaggaaggaaaaacaaacgtaccccaatggatctaatatttggactacaatcaaggtagaaagactgggaaagtgcaaggcaaaacaaacacaaacctgccatggcttctgcagaaccaaaggacaaagcaaaggttgctaggcgtttaatgaaagcagctgctcttatcatatcctgctgtttgccttcccagagaagtgtcttcagagcatcagctaatacctcaccacgatctctggatagagacagaaatcaggttgtgttcttaagttacttgaaaactttgcaacagctatcttagacataaccaccattcgatttaccaaaaaatgacaacacgaaaacattctgaaagtgtattgttgatggaagacacaaagtggaccgccataagccatgaattaaacatgttggtcactgctgcctccacattaataaaatggtgcttaccatatgcaagactgtataatgttcttctattatacattataatcggcattggagtacatgataaaatgcattgtcagtaatcagcatggttatgtggtatagctgtacataactacttcctccgtt

SEQ ID NO: 65128 - DNA, 15822 bp, Oryza sativa
caaccattggcaattagcaaaatacttagagaggaggtagctggcattacagtcgaagataggtggataggctcctaactactctagttggtggtgcacttgaggatgctaggtctttcctcttctggggagtcttcttcttttttggtgtcttttttttcctaggtgtttttttcttctttggtgcagagcagcttgcttcacttgttgacactcctggatcatttccttgcctgcacacttgtctcttcctacaaaaaagtgagaatttttagaccatatggcaagcatacaagcctgaatcttagtgactacaacatagcacaatatatcaggagtgtaactaacaataattatcaagttgggtttttttatcaagttggagttaaagaatacaaaccgcttgcacaaagactaattaagaatagaagcacaatgacagcaatataccgtttttggggggtgcagtggctgctcatatcatctgcatctgcaggttcagccagcttgcatgttttctcaaaatgtccaaatcttttacatctcttgcatttcactctctttcttccaggctcaagaaatccccttattctctgtactctaggcctcccagcacctctcttctgcttagggacatgcaccttgaagcccaaatcaactactggccactgtgtcctgtcagtcataggtggtactctgcctgcataagctatcctgaacatttgcacactataatatgggctcacaaaatcttgtatccttcctccactgctgcatatccaggccaatgcatgcctgcatggcttccctgttatttgccaagccctacaagagcatttttggttgtctaggtcaacaatatgccttcttgtcttgttgtcagtatccacaagtgtgacctctgcaaacccatcatcacttctggcaatcttcaccactttaagaagagatgtggcatcattagctgtttcataacacctggaatgattccatcatccattttcttgccaacatctcttctagtggccatcttctccattattaactctcgtatgctgtcaacaagttcatgaggaagcagtcctttcagatttctgatctgagcattaaagctctcagaaacattgtttgtcagatagtcacatttgctgctttctccaaagccacatctgtaccaaattcttgaatgatgttgctcaagaaactctattgcatctggtttcactgcatatatttgctgcatatgttacttgaaaccctcctcggtgtagctcctagcagctggatacaaatgctcagtgataacagaaccatggtacttttttaagaagttaacatagaggtgcctaatgcattctctatgctcaaccaggatcactaaatgcagcactaacagccttttctaaccccttgcatgccatcggtgaaataacctacccttcaggacaaccaatagctctattcaattgtttcataaaccacaaccaattgtcctgagttgccaaatcaaaaattgcatatgatacataaaacagccagttgtgaccatctacagaggtggctgaagctaactgtccagtgtattttccagtcaacttagttgagtctacaccaacatatggcctacacccttgcaaaaagccatctatacatggttatagagctacaaaaaaatgcttgaagcacattttatttcctaacttctccaattcaatttcaactatactacctggacacttcctctcaatttcagccttccagttgaaaagcaactgaaaactttccttatatttaccatgtatctgttctagtgctaacttcatacctgaccatgcctttgaatacttcaacttgatctcatactgttcttgcagcttcccccttgcatccttagcacccttctttggattgttcttcaaccaatcaccaagcctatcagcaacccagccctgtgtagccatcttgccctctcttagtttggtagatgcacatttgtgttcaaagggaagaactgtaatctgcatgacatgacatggtgataaaaagttactaaaactaacactactttcaggagatgaaaaaataaattaactaaaataatacatttataccttaattgttttcttatcatggattagggaagcacgtattctccatggacagccttcagcgcgacaggttgcaatgaatcttgttttagctgtcttcaaatcagcaaactcaaaacctttcttaattgcataatgcctaactgcttttctaaaagatatcatgtcagggaatagagcattcttcactatatttggattctctggatcatgcaacactcgaacaacctgagggtcttcatcagtgacttctacctcaggagcttcaacccctgtggcagcagtctgagaggattggccaccaacccctatggcagcaggctgagaggattggccagaggtgtcaggtggctaagtaggttttggaggcagatacaactgctcatcattaacaccaacatattcttcctcattatcaaacatgtcaggctctctaacatctgcttccactgttgtaggctgtgcagaacctccaacattagtagcagcttgtccagaaccatcattgtgggaagggttctcaggtgggatgatagcaatgggctcatgcacacaacacacagaagcaacatccatgctttcctcaagaactgctacaagtaggtggaaactggcctcggttgcatacatctcgaaaatatctggcaaatcagtgtcccctatgagcctaacatcctcacccaaatttttgttaaaataccacactaagggagattggttcgagccccacttaaactcaaccctcaaactttccattaggaaatcaaacgaaaaactctctgaatcgattacccaatgcccagtgcctcctttactgatgattttcctaccatcagcatctactgtcgcatagggttgcaccctaacatcgactgaaaaccaatgcctaccaacgaatgacaaaacaataactcaaatcgcacatacaaagttcaaatcgaaactcaaatcgcaattttatctgcataaagagttcatgggggaaggtactcacggtttggaagcaacccgtacaagggatttgcctaaatacattgccaacgcggtgggggatgcaggcgtaggcccctgcgcactcatcctcccattggcagaggtcctccccttcggctgtcgtagcctccgccaccggcctgctccgccgccgccttgctccgccgccttcgcctgcgccgccgccctgctccggcgccgaagcctgcgccgccgcctgcgacgccgccctccatcgccgttgcctgcgtcgccgccctgctccgccgccttccgccgccgtcgattgcgccggcgccgttgcctgcgccgcctccaagaagctagggtttcggtgtggggaacgaatggcgaccgggctgttcgagccagaccggagctggtctaagcacacgtgaacacgagggcaaaaacgtccatacgaaaatacggtaccctaaaacggtggcaaagcgcgcgcggggcgtacattgtggcatggttccaatttgacgaaatagtagtggcatgcacccggattccagaataggtgtggcatttttttgatttgccacaattcgcgtggcatggatccaattaaccttttttttaaagtttctatacgaaagttgcttaaaaaaatcatattgatccatttttttaaaaaatagctaatacttaattaatcacgcactaatgaaccgctccattttccgtgcacaccgtgcatgttgggaacggatgattccatgtgtatatgctcgcacacatgcctatgagtactcaccctctaataaacttatcatgaagaagataaaaacacacccacaaaacataattatagttatcgaaatttaaactctaataaatggagtcatatacacactactttgtcacattgaaagagttatgtaattatttatcacattgaaatgtaagaaactaatgggagtgctggtacgcactaaaatataataattattacaatatcaagataattgatgcatggtgtgcacactacactgatgtctttacgtgaattaaaaatatcatggagaggttttagtaaatggccagtggtaaagaaaagaaatgattagaaggagaacgtacacacctacatctaacatgcttgtacacacatcacaacgtatgcactcacgaatatacacttttacacttgtttaaaccgagaagagactcgtatcacattcggaatatttgtaagcactgagatttaaattaaacccttaatagtgaatacaacttcactgtctacttatgtcactcctatggtaagagtttcattcacattaaatagcatgacatgtcaacatttttattgatgtgataagaaattaataaagtgagagatgaaaaatcatgtctattcccagtacagtttatcttttatatgttacttatgagtatgtgtgagagcatgaaataaatacatggaaaaattacaaaatcatcccagaagtcatctgaggtttaacattacactccataagtcatcttgttgcaaatgctcatcactatactcggttttgttgcaaaaactaccccagtgcacacgtgcttaaccatcatcagcgattctatttatgcaatctccaaaaactgttaagattatattcttagaagtatttaattttgttaaataccacgtagacgcatcacaatttatgaaaacatatcgattcggttaagcacacatatactaggacgattttttaacaaaattaagtaggggtggggatttacaataaaaataacttatgttgtggaatgccaaacttcaattgaattataggatatatttttaattttcccaaaatacattgtataagctaatttaattatcaattaaataccaattacttatgggacaattgcttatttctaccccgttttgaacccctaagtaccaatttgaccctactttttggtgtttgcttatttgaccctcatttttaaaaaggaagctcccgtataaccctgttctgttaagggcaactaacggtgttaactaaagcacaaaatatctcttctgccttactcatttgacctattacatgtgggacccacccatcagttctctcttctccacccctcctctcctctctactctcttatcttctcttctccatggatcggcaagacgacgagccggcaccggtcctggtgacgacgaggagtggcggcggtgagtctgggtggtggagctcgagctgcggtcagtggatctggagccgccgccttcgtctcctccctccttccgcgcgcctgcgcctttgccaccgccacctccgtcattacgcgccgaagccaccttcttctttcctccacgcaccggctgcgctgccgctccctccctccacgaggcgctggcagcgtgggtcttctccctcagctgctaccgccgtcgctccctccctccctcaacgagccggcgaggccgctcaccccctccatgcgccgccgccgcaaggagagagagagagagaaatgtggatagggttgggtggatggatagggttttctaagggtattctgggtattatgaatattagttgcatttcttttttttatttaaatcaaaacttaacgggctagtggaaacagggttagacgggagtttcgttttttaaaaaaagggtcaaataagcaaacactaaaaaatagaatcaaattggtagttaggattcaaaacatggttaaataagcaattgcccccttacttatttgtcaccattaggacacacacctcaaatggagtggccttaacaaaaaaaatattggccttaatgcatgtcaaattttttatttaaattctataggatatatatactcggagagcgtgccataataaaagatgttttctcaaggcaccgtacataatagccattgatgagttaagtgtagggcctagatgggccgtatctatggcaaatgaatgccctagatgaggagcaataatggaaggatggggggcactgccttctctgttcgcgataattaaaagcctatgtgtccaaattcataatccgttctgtcattttgctgtagttacaggaccaggtacagtgtctcctttgcaccgttcgatcgacaagctttgtttccaagctgaggtgacccattttatttgctcctcagcgcgtatgtacaaacaatatgattatatacaggtactactcgtaattaataatcgacgaccacggttggtgcttaattgtgcgtgaattcgtaaacataaagcttgttcccgccgtagtagatatcgagtgatactctctctctctcttaactttttatttacacagtttgactattcgtcttattcaaaaaaatttaaaattattatttattttatttgtgacttatttttattatccaaagtactttaatcacaaatttttatttttttatatttatacaattttttttaataaaacgagtggttaaagagtgcaaataaaaaatcaaaatcctttatattgtaaggatggagggagtagatagcatgattggttgtggtaacttggttcgtacctacacacacaatgtgaccagttcctaaccagaagtactgactggtgtgaagctttgttaaaaagaatatactgaaaaatgccaaattttatagtaaaaaatggtaagtatgtccttaaaattcgattttcaaaagaagtaaaagaaagtttgttctaaaaatatctcccactagagtttagtttggtaaggttaaaaatgtcaataaatcaaacatgatttgttatgttttgcagtatctggactgcagaggctggagatgtatttcctatctttcatcgtcttaaagagaaaaacgatatgttcatttttgcctatgataagatttgtttaagctatactagcaaattcattcagtgggatttgcctaatttggaacctggtggtgcacaattaattaattaattaattaaaatccggcggaggcagatcggaatctccggcgggacggacgcctggagtcgcgcggtgggccgtacggaggcaggcatacaggagcttttcccggtctcctccctttcatttcactgattaggttctgttgattgtcctaataagttaaaacagattaaaaattgaattttcaaagttatttctcgagttgattttaaaatattttcaacgcagtttttttttcaagttatttttaggtttctaagaacagatatataaaaatcttatctacaaattaaattttattctataataaactgatgacaccggttcacaccacaaagatagaaaatattcgtctcatgagtacgtcttttaaactactaaacactatatttttattaaaaaatagagaaaaaaacattttaaaaatgtattattaatcagcttattaaatttaaataattaagacttaattatgtgttaatgacccatcatttaacatatttcttcatttttttcttctcccagacacagatcagcaggaggacgaaccaaagacgaaagaaaaggccaggcagcgagtgggccgccgctagctgctcgtctcgccgccgattgctgccggaaacttattcatttccccactttaattagttgtccatggtggatggatggactcgtccctgtggggctctgcttgctgccttttgctgctcatctttttctcattccaaacagccgaacctgccgactatatggcgattaattctactaccttttcttttcttttttggccggttttcctctgggggataatggggccaagatatgtgaaaccaaaccaacccagtgttattgctctcagatttgtgccactattatctttaatttcttgtttttttctttacaccttaattatgtatttaccgactatcgcgatctcgctaccaaccggtggcacccaacttccttcttgaccacgtacttcctccatactcataaaggaagttgtttaggataatgtttaagttaaaccttgggaatataaatcataaataactcttaaattaatgagtttgaaaacgtaaaaattatatgaatagatttgtcttgaaaaatatttttataaaagtaagtatatatatatatcactttacaataattttttttatagaaacaagaagttaaaattgtgttttggagaacgtgtcgctgcaggtccaaaacggttttctttacgagtacggagggagtacgtatctactgttggcaatctttgtctatacatagcgatggcactgtttcaaatgtactgactgggtttgtatttgttttgtcacgtacgttgttttggctgtataacagtgtactagtaaaaggctagtttctcggagagaaatacatgagcaataatttgcggttagtgactagtaactctgagacaactcaatttattgataagataagtgtcatttgcacatactattagagcaggtacaatagcaggctataaactagttataaacatatttcgagaagataaagggctattttggtttgatgccaaaatatgccctacaaaattgttggcattttaaatagtagtttggctagtgtttggtttgatatcaaaatatactactaagagacataagttgtcaaaaacatttggaactatcaaaatttgcctatggtttggtattgctagtattttggcatgatagcaaaccaaacaagcccaaaagagaagagagaaaaacagcgggctagagatgatttgtagccagctgcagtacggactctaagatgcaatgtgtgtacaacaggtgagaccaaatattaatagtgtattatatgcttatactccctccgtccccatatgtagcaacctaggatgggattcgaatgtgtgtagtccccatatgtctattctcatcctagattgctacgtctatatcagctattaaattgactatagatgatttggagctagttgttggctatattattaaatttgcccttagcaataaaaagagagagagagagaaaaaaaagtagtgctaatgtttaaccctcaggtgatgtgcagcatgtgctagcgtagcatgtacaaagtttttaaccggtactgaagggagtatatgacaagctgtagttgatgtgattttcttttccaaaacacagcgtgaacgtatacgctgatcatatacgaccacgcgaaatgatcaaccctgtttgcgcacgcgtatatggacgctctatccttacgagcactttcgagtgattgagtttttacattgataaagttaccacattctcccttcgtttcatattactataagttatttaacttttttcttagcctaacaaattaagtttgataaattttatataaaaatttagtaacatctaaaatagattatagtttaattaaatataacattgaatgtattttgataatatatttgttttgcgttgaaaatactactatattttttttttataaatttgattaatctttaaaaaatttgactaagaaaagattcaaactgacttatagtatagaacgaattacatatgagtatatctttctagttacccgtaaatcaaagcattcatattaaatttagaacttaaaactcgcgcgaatatgttctatcacaggaaatctaaaagttagctttcgctcgatcgattcgagaaatttgacctgccgaccaaacagggcgatatgtactcccgcaccatatgtgattggcagcttggcacattgtacagtacttctgcctcactgcctcaggatcttcactctctggcaactgcaactgcaaagcaacaacacaggcacagcctcctctgatatgtagcctgcaactactctctccgtttcataatgtaagtcattttagcatttttcacattcatatttaactataaaaaaatatgaatgtggcgcgcagttaaatatgaatgtggaaaataccaaaataacttatattgtgaaacggaggaagtaatatttaactgcgtggctatcctttcacgacaagggcgagccacatatttgcatgggctttatcaccgacatttgctccaattatgagcggaccaaaggtcggtcgtggagctctcacggctacaccatccaatttcatcgctgtagtgcacgaggcccaccgtacaggcaaacatggtaggccaggtttatatcaagttcaataatatagttaattaactgatatcacataatttaccaccaatctaatagtcctttgctgttgatatacactagaatatcattaatatatatagctcacctctctagctctcacaaaagtactccatctgttttagaatattggatgtatttattttgtaggggaaaagtcttaggccctctttatttaggcttataagccaacttataagtcgaaaaatttaagccaaaacaaacaagcagctttttcatttggcttttttgaagccataagccactctaacactattaagccaaaagctaggttggagaagcttttttggcttatatgagacagatgtatgactccaccactaaacttaggacattaaatccactgccttataaatcatataagctaataagctaacttaaaagtctaggccaataaaactaagcctaaacaaagagggcctttagaccaacaattactttacgaggatataatttttgttacacaaaaataaataaataaaattcatatttaagaatacttagttatgattatatttttatattatctaaaaaatgattatatttttatattaaataaaagatatcttattaaataattgttggttgaagtcttatcctaacaaaacaaaatgtgtaatatattttgaaatggagtgagtagtttattagagcttatgatacaactgactataaatgctcactttttatctctcttcttcatataattacaaatataatgttaaaacttacatcttaactttcgaattaactattgttacgatcttcacttttggactacttacgtcagaatgtaaagtcttaccgtaaaacatgataaaaagaagtcttaccataaaactatattccattacattggtagtatatctgtggcttataagctgtaactaataataaatacagtcttgatcctaaaataaacaaacttagtatgagatatcacacagtgtgttttgttctgggactaggtgagatggaatgaaaccatccctgatttttggggttgggatgattccacgcgcgtgtttggtttgtaggataagctaatttggtttcacttggctccacaatgggccgaactgaagcaacgtatatttggtgggaataagttcacttaggtttcttaatttgtcgcaaagtctaaaattcttccttgaaccgaaataccagcccatccgccaacctataataccgtgtcaattttgctcccttggcagtacagtggccggtttttgcaaatgtggtaagtgggacccatgtgggccccacatgttaatggccctctctctcccccgcgtgagccttggagaggggcagctgacccgagggggcgggggagggggggtgcactgatgggagggcgcatgacgaggacacacaacctgctggtgatcttcatcaaacaccacaagttgaggagatccccgacgtctccgacatggtgacgctctacggcgcgccggagctcttgtaccggtccttctacttcgactcggaccgcctggagcacatccgcgcgctcgccatcgctaacaatgacaacgagaatctcctcagtaggcggcgcaccacatttgaggcactgtctgggctttggaccttgcgtcggagcaacagatgaagctacggttcatcatggacaggcgacgttgccgctcccgagggcggtactccggtacgagtacatgaggtcagtagtggactacttcaacgtgatgcgggcgtggccatcgctggcgtcgacactgttgatcatgatgtggtcctagcttgtcttccatgatgccgacttcaggtggggggagccaatgatatccgaccccgtcacgctgttggagaaggaggtgatccctcttcctaatgcacggcaaggagagaaagagcatcaatgtcttgcttggccttccaacatctttcatggatgtcttccaagtgctcatggacgggggagggcgcgtgacacgggggagggggagggggatggggaggggggagaggagggagaagagttggccgctagcatgcatatgcatgtctcacatgagtccaactcatcacgtcagccaaacctggccactatgctgctgaaagattaaagttgatacagtattgtgagttaggggatggtctaaacctggtatttcagtttagaggtgaattttagactcggcgacaaaatggatgacctaaagtcaacttattcctatctggtggagcaatggcttttgtctgtttcaacgtttatagtgctaatgtggtgacaattgtgaagacatattcagttaattaaacacttgaatctagaacgactttgctactagaggaccggccaggccagctgaccatgccttttagggtttattcggttcgtggaatttccaaattaaaggaaaaggaaaaaaaaataaagaaataggatgtgcactttatttcttaggaattttttcaagaggtctcacctcgagctaagaatcatatgaaaataataagcttgtaatactacaagtctacaacccttaacaatttggtaagaggtctcacatcgtgctaagattccaaaatttgtccgttgaaattctttttgagatacctgctatccgttgaataaaatgcaaaatatttttgttgataacgtataatatgctattgctgagaaatgtgcatatgtacatgagtgttttgttataaatttctgttagcgtactgtttgccttcaagattactattactatactttaataataggtaaaatataatttagaaatgtcgttgcgttatcaactgatgaatgataaattacaaacctagacctaggatagtcactctcccagaagaataatagataataattcaattaacagtaaataaggaagaaatgacgttatgctccaatgaaaaataaacaaaaaccaaggaagaacatccaaaacacaggattttacacttcaatggagatttgccagtacttccggcaaaaacaacaaacaaacgtatttttcaatcacggaccaattaatgaaaagctgaagaatttagggctttaaagttacaaatgaaagctctatatattttaacaaggcactggagcgtatatgtaagcatcagatgtgtacagctagaaagcagcaagaactaaaaaggacctatctgtaagatgttgcaaagtaagaggatgcaaaaaagagaggcggtggggcgtatatgtaatggagaaactgcgagggaaaaactgcaaagatgtaagggcctggatgtaagaaataagaataggcgagggcgcataaagaaggcccaggggcatatctgtaacaaaatgtatggcctccagggacctggacagaattctcaaaaaaatttggaccatttctcgatttgtgcgtgtcatccttgcgcaggggccatgctaatcttctctgtatcgttccaattttatcggatgtctccgaagagacgccagggcagttggcgcgcgggtttataagttggtctcatcgtccctaggattctgatgtggtactaacctctctcgcagcgccaccgcacaagccatcggatctccatccaacggtccagagtggccagcgccacccgcgcggtaggatgcgcgtgggctgcaccttccgccgcggcccaaatcagcgtacggaccatggtatttcgattctccccctcccggcccacatcacatgcatgctgtaatcaagtttgagcattatccgcccgaactgatcgtcaatttcaacacgtttaggttaattaagaatttgagccactgatttgatttggttaatggtttaaatttgattatttcatctagtgatttcggtgttcagtgttgccctgtatataatatcttgccatgtaatactgctaattgctatctgaacaattttggcagaagaatttgtagctttacgttaatactgcagtagttttgctcctcgataattcagtcgtaatccttgacagccaaaacttgacgttattgctaatcaattgccaaatgaatattatgaattactccatatgctcaacctcaattgattactgaactttattcttgtaattagaaaacctgctctcttcattagaaatttatgaacagaaaattcttgccaggccggaaaaaaagtcggaaactgatattatttgcagatattgcaggaactgcaaagccctctgaacttgccaacaaaagtttgtgcgtataattaagtagtagaaacagagccatttattaaacggttttgctatacttccggcgacataattttcacaagattacagaccatttttagctctttgattttagtctagcaagaatcgtgccgctaaattacttcctccgtttcatattataagactttgtagtattgcccacattcatatagcaacatgcatgaccatttaattacccatcctatcaagctttggccatcatgagcaagaaaagagtgatatacgcgtagagtaaatactgctagctcattttggttaaaattacattttagttacatactacttacactataactttacataattgcattatagttacacactactttaactagaaatttggataattacaatgaaattacagtaactgttgtaatttttaaatcttttgtaagcatttaaaatttatctggaacacattcatatgaattttttgaagttcgttggtcatacactcatacataagggcatgcaacatattttgtggcccaactggaaaccaagccagaccatgatcgtgcggaggttgtatgggcctgtcgatcatggtgaaatttgattgtattttgcctctgttttgtgacaacattattatagatattataatagtccctttatcaagaccgtgtttagttttctccatattcctaactttctatcacatcatatcacatcaaaaactttcctacacacataaatttccaactttatttccaaactcctaactttcttcaaacttccaacttttttcagaaactaaacacatcccaaattatgctccgattctagtctccgagaagaccggatgctccgtcacctgctccgcccgcaacatttgttgcctctcctccccaaccgaaatcgatggtgatggagacgaaggattcctggcaatctgtaatagatagagccaagagctacctaatcgaggcttccaccatagtggaggttgaagtttccatggcagcacaagtgaaatagaattttcccttgatgattcgctatcgatgcataaggagaaggccataatctcatagatttgcttgctacaggtgtgaaaggcggtttgcgcagactctgtgcacagatctagagcgctcctacctactctttgtgcactaactcatgcaaaaccgagaaaagttcgattaataactaacctgaaagaacccctagaaaagacccgacaaaaaaaaacccaactaaaagctaaaacctattgaaagaaagtgacgactcccttcaattgttagggttgaacagctagaatcatgtagcaggacgagcgattgagaggga

SEQ ID NO: 65129 - DNA, 773 bp, Oryza sativa
gataaacaattggcatatgagattattggttttgatatttggagattatgggcgaactggttttggagatgattgatttttcaggtgatgaacagggttactatttttctcgggtccggtcagaccgggcaattgctgtcggtcaaaccagcgctatgcgagcggtcagaccggccaacgctgtgttggtttcggtttcgggttgtttgtttggatatccgtgattgtttcatgtttatggcttctagatggatactatacgtatgtaatactgttgtttgctactaatgagttaagttggagatagcttggtctcggaatatggtttctttatttgattcatgtgtaagtgacttgatgcctcgggagagtattgccggtgatggattgggagtcgacttggggataaggcgatgtccatgacggtcaaatatcatgcgggatacttaggatagagttcaatgcacgtggttggtgaagattccatatggcatacgatggaggtattgtgtgcgtataggatgcggagtcgaatttggaaagagtccaaatttggtatgattggagtttgtaaagtttgtttcttttacgggaaggtttcctaggtggattaggacttctagtatgagtttggttcgtggcattaggctgcctacctcatgtataaatagagagggagcgtgaggcttcccagtatcactatcgagagcattgagttgatagtttagttaggtttcgagtttagtcgagattttcgtgaggagatgtcccat

SEQ ID NO: 65130 - DNA, 1719 bp, Oryza sativa
ccatatacccacaatgattgattctccgactggttacatgggataataaatcatatggttagaatatgtataggataagactcgggtattgcgttgtcttgtgtatcaagtaaataacctgtaatcttagtcggttatgattgtaaagtagttatagagatttaaaccgtaaagataaagtctctatcttgtaatcccagcttctccaactatataaggagggcaggacgccttattggggggcataaccacaattgagatcgtcagatcaataccacaatcagcggaatattttcccagacaggagtaagatattacttctcattgagagggtctgaacctgtataattttttttatctcataacccatctactttcctacttgttcgctaccccttttagtattgctgaaatatagttttgacagttggcgcgctaggtaggggcagcgtcaagttttctcgccgactagtgcgatgggatctacatcaggcatcgacgacttcgccttcccccaagagcaggtgtatcgctttggcagccttgacttcatcaccgacaatttcggcaagatctcttttcttagctcggattcaaaccagtcggtaggagacaaccactccactccgtttggtttatcaaatacggcagagacctaccctaaagttttctcccttgagttggcgtcaaaccactcgggtgagatcatgaagacctcaccttcttcaccaagttccacttcagacgtgtcggcataccctcaaatcaccatgcgactaatgtggatgtggattttcattcctcaagaggacaccccttcgttttttttaaattacacagttcaacgcagatactcacaacgcacatccactcacccctatgaacacacgcaaaccctacccctacgagcatcttcgaaactgagccggcaaatccatcttggagattgacgaaatcaccacaggcgcctcgctgtcgacgggtacatcgcctaccactgaaaacacaaagccgttaaatcctggaaaattcgctcccacgaggagtccaaccaggacctaaggtgctactgagactcttgtaaccactaaatagttatcaaaatattcgaaaaaaattgacaacatagatttatatgaaatatatcactccacaaacatgcaataccaaattcaacttttataatttgtaaaaaaaactgaaaatagttattgtacattctcagctttatttgttattgtacatgctgctgctgctgctgattcgactcggacaagaaatgcttttcttttcttttttcttttcattttccaaattcgagtttttttggaagtccaccaaagtcgagttctggcgggagccgtggtcaacgtgggccgaaccaacacgttacggcccaatattagtgggccgcacggagcacaatataagcccgttcaggcccaaccgtacggcaaccacctccgatcccctctcctcactccgtctcggcggcggcggcggcggcgaggcgtctccgacgaaaaccctagcatccctccccccacctcgcgtctgtctacgaagccatggtgagtagcaaccactcccacctctccgttccgatctgctccagatccatctgaccgatttctgttgttcaggagaggcgagatcgcggcggcggaagcagcagcaggaatcctcatggagctccggtggaagaggaggaggagctgg

SEQ ID NO: 65131 - DNA, 25136 bp, Oryza sativa
attcttcttcctcctccagcccactctctccccccattttcttcttcctctccctcttttccccctctcctccctcaaatttccatggagtccagctgggtagcgggggctcgagccctccccccttcccccgcccccatactggctccgccgctagcgacagatccagccggcggcggagctcgagcgcggccgtgtgggcgacagatccggtcgacggcggagattgaggtgcagctagggcgacggctcggagtgtggtggagctcgaggcatggatccagcagtcggcggctcgaagtgtgacggcggatcctgggcagtggctcgatcgtgggccacggatccggccgacagcggagctcgaggtgcagctagggcgacagatccgggcggcggcggttcggaacgtggcagagcctctaggtgtggccggagtgcgacgacggatctagccatgcagctcgggggacgggcggcagcttggattgtgggcgaccgtggctccgggcacgggctgcagatccgccggcggcggaagcttcgggagtgggcggcgctgcgacgatactgccacgatgacggtcggcacaacaatggtcgacggttgttgatgcaatttcatctacatgtattgatgtttgcttgttgaaaatgaagtggaaaattgatgcagtgttctctggaggtggattttagtatggatctgatgtggatttgaatttggattggatttgaaactgcagctctagatgtttatttggcttgaatttggatttggattttttttttttgcaaaaatttctttttgctggcggtcctcttaatcgtccacctatgaagcggatcgtaaccgcaagcgaaaataatagattttcgctggcctttgattactggcggttgtaccagccgcttgtgaatttcggctgcttgcgagaatcattttttatactgattattagcctggtgaaagtttaaattgttaacaaagaaatactccctccgtcctctaatataagggattttgacattttgtatatactgttttatcattcgtcttattaaaaaaatttgaaattattatttattttatttgtgacttgctttattatccaaagtactttaagcacaacttttcgttttttatatttgctcaaatttttttgaataagacaagtggttaaacagcgcaagcaaaatatcaaaatcacttatattagaggacggaggtagtaaattaaatacgagtctagtactggtttaggtctcgcaacgagttgcaagtacatggttgttgataaataaatacatccaacctagtacagtttcatcagggagtacattttgacaagatctataaatatggtacttggtcagataaaatgagagctaaaagagaggagaagagaagggatgtgcattttaaagttcttttctacgcctcaaattgaaaacttcagctcgagctgagggctcaaaagagagaaaaaaaataagataaaacttaccagtgagttcatatcagcgagggaacagagagattttatagcttagctagcatgctgtaatgaacttacatatgggattgggaggtattggtaataaaagaatcactggtcgtagtcgttcatcgtcacactttttagaccctgtttgtcacaactctaaattctaactctcaactctaaactccaacttaaatggaagctagctcctataaaagccgagatgtgtatagaaagtgtttggctagattactcagctccacgccaccatgtctctcgtcaccattttatcgaacaccatgttagcgtcaccctaccgttgccgttgccggttagccgagccgctgccgcgggtcagcctacggggccttaattacaggaggaattgtccattgtgcttgtcttgatgagtttaattcctggtgtttaaatctccttgtaacagagttgccacttgtcttttcaaaaaaagaagttgccacttgtactccagcaaaccgaaggtaccattcaggctgtatggttgcctttgtttcagttgtgcatgtcacttcaacatttggaaggaaaacagtagacgaaccttctagaatgaaagtgactctgttgattctaatcatcaaggaggatgtcaatccattagtgtaaaacacacccatgatgctctaattaattacttaattggtaggagtatatatgtacatgcaactgatgtaagctgcgacgacgtcttgtaaaaacaaaccgcatgaactctgaaaccttatctttgctttgtattgtaacacatttttagcacctgctccctttacaaaaaaaaaaagttatgacaaataaagcaaatcaggtgacaagtttgaatctggtgatgcacagaatgaaaaggaattaaataagatgacttttactatacaatatactggtagtatatattgctagtataaataaggttatgttgggaatatgtcgcaaaatagaaaatgatcagtagttatttcgtgttatatcttcactccgatagtaattcttattgtccgtatgtcagatcggattactgaccggatatggctgaatacagggcacaaccaaatgtttttgattggatcgatagattcatcaaacacataaaaacattaacccgtgttagataactagtgaaacacataagaaaaataaaccattttacccctattatactatagtcgatttaagtgggtactaaaatcaatctacacccttagattgtttatactaccagtatattgtaacagttcttaaaataaatagtagaatgagagatgaacagaaacaaaagcatctcgttctgtcatcaaaagataacgtgtcaggttatttggcatatcaatgcgagggtatgcaaataattaaaaatctcacgagaagatgtatataaaaactactcacgacaatgcccttctttaaaacataaaaactactcagtgcagctcttttaacagcatatattggtttccattctttttgagcagaagatattacaactaatcagtcagtataaccatagctcttcaaatgtctatactttgtcttaagggttaattattggctaacgccagatgacacaaaacacctactccctttgtcccatataaaagccaatcctagcatcccaagaaaaaatagtgaaggacgaaaatgaccaaaatgcccctcattatttttaaaagtagtaatggtgagtgatatgtaaagggtattgaaagaataaaacttcttgtttttttatatgctgagggtaggtatgatggtagaagctggttttttgggacaaaattcaaactctaaaagttgagtttaattttttggggacggagggattatatgtgaaaagtccaaatgatttgaaaatttgaatatgatttgacttgatggaaaacctgattgttttgttttacttttacacactgtatttattcttgcaaagttagcaaccatggtttagaattcataattttaccaaaagttgaggtgaaggtcctggatatcaggatatgcttagtgaacattgactcaacaataatgtagtgattttttttctgtccaagctttcgactcaataattatttgaattttctaagacaattttcagtagttaactagctaaaattccacacatacaaaacactagcatcggttccttgagctttaatttagttcatctcactacattatttctttcaactgttacttggacctaccaaccacatggttcctcggcacattaattcagactgaaataccgaatgatacaaagccagggagttcattactcagtttgtctggcaatagaacagagcatgcataacagggcatttctgtacgttttatactacttcaacacataaaactagcaagacccagagcagggaatatatagagcaaccatgaaccttcatcttcagagtatatagaagaaagagattgcatgtctagcatgcaaatgtcatagtccatttcataggattgggaggcatgggaaatcaaagttgtgcaggactctaggctttctctgccagaattgttaatctctctgaattagccgggtctttttcgagaacacatgggcaaggcagatctatcttggtagaagtggaccacaatgaaatctcatcttctcccacattgcatcctctaatattcattttggaaagatccatcttataaattatcatattcatcgctcttatttgccatggaacaaggtatttgtagcacacatgaaacatgaatgttctcttccaatataataataaataaagcaacccttgtctattaatgattcagatttcttgtcatcaacatatgatgtgtgcactctcaagttggctaataacaatatacattgattaatagaaaggaatttttttaattattccttgagagagatggtttaacagcattgttctcttgactactaccaattgttcttcatcaatgcctccatatatctagcctctacatgatatgcagaagaaagatctaacagagtggaagaagagagatcaagacttctagcagaagagagtacatgtgcaattgaaagatgtgtgctgcttcatgcctccagatgtaaagtactagagctgagagagttcaaagagagcagaagatcagtgttccatgatgagcacacatataccagtatgagattgattcattgcatgcgcatatagtacagacgaattacatgggattaggaggaaccgagaatgaaaggagtgcgaatggtttccttctgaccggccacattcagaattcaaataccaaatggctctgctgtggaagctgagcgacatggttgcgttgagtgaaactactctggactcctatgatcctatcagatactcctaccttccaagtatgtgcttaaccccgatcgagaagtactgcgattgattcgcaggggatcccctatttgttatttttttgtcagaagaaaaaaatgacagctgaaacaggttgatgatgaacgaaacagtaaggtagatcaaacaacagtaacagaatgtacctatctcccatccgcctatagcagtatacatgcacatagatcggtaaaatttctcacaaagagaagcacatatatttgtttcaaatcccttgctcttttcacagaagatcaagaaagagctgcaaagccaatttggaccataacatgttccatagtggtcttcaaatatgccttcagaagttcacgttgagcttctgctgtatgttcattatctgaagaaaagaagtccacctaaattatgctttacaatagttttcgtatgactcgatcacttggtaagttgatattggttctgaagagagaaggctaaacttcagcagaggagccattttggcttgacagcaaatttcagtcaatcatttggctgaccttgtcggatgctctgctctgtaacaaccaaaacacaaatttcgatgttataaccaggtggtgaaaacatatctatctatctatcttctattatatactaaaagtccattaaacctgctacaaacgctcctaagctgccaagtagcgctcctaaaaacactcttaggttgccacgtggcagtttataatctcacaatcgattttcatttaaattggtgggcccattagattagatctattgcttcgtcttaatattctctgtagatataggtgaaaccgtttacaccagaaaaacatacgtacgtactatggaaagaaacgatcaaacgaacccttcagcatacgtacgcacgtacgatgcatcgtaccataaatagctattaaaaatgataaaagaaagatactattcacttgaaaaaaaatacttatatatgcacgagtaaaaataataaaagctataagacctaaaaaatatataagactagaaaatatatgtacgtcggtataagaaaatagacgttttttaaaataagactttctatactataaaaaacaaaacttattactccacaaataaggtggtctagcgtttctacaattgccacatgcatggctctctacaattttgctatcaattttcatttaaaatgatggatcattattttagatcattagatttgctcatttcctcttaatttcctcggtatacaaccgaatgttctattgaaaaaaaatacaaagacaaatacatatagacgataataaacctttagatattgttcccttaaaaaagtacgtacggatacacgagtaaaaataaaagccataatactctaaaaatgtatatacgtcggtaggaaaaaatagacggtcttttaaaaatacgattatctatactataaaaataaaatttattactccacaaatattatcatgtggcgtttctgtaagcactcttagaataccacatggcactctataatttcgttgtcaattttcattcaaaatgatggatccattattttatatcattaaattagcctgcttcctattaatcgagagaaaccatttactggatgtttgattgaaaaacaaatataaagaaccatacgtacatacgataagaaagttataaagccaaaaaaatatttatcagagtacgtactacgataaaaaaagctataaaacaaaataaacatttagatatactgttcccttaagataagtatgttataaatggtctttttaaaataggatttgctatactataaaaaatataaattatcactccacaaatatggtcatgtggcgttttagcaagcactcttagaatgccatgtggtactctataattttgttgtcaaatttcattcaaaatagtggacctattattttggattatttgattagcccgcttccttttaatctcatctatacgagcgaaaccatttagcgatgttctattgaaaaaagcaaagaaacatacgaacacatgataataaagctataaagcccaaataatactaatataagttggtagaaccatcgaaaaaatatagacgattttaaaactaggattttctatacgatagaataaaatttattactccaaaaataaaaatgcaagttaaactagatcaatataaaaaaaattaaatgtgtttacacgcaattttttttgattatttttaaattttatagtcaacttataatcaggtgtattcaaatcttgataacataacatagttatattataactaaatacattatagcacctggagctgacatataataagtaatatcataatatttttttaaataatttaggcgtcatataataattaatgtcatgataatcttcgaaataatttcacatcataatttatggtcaaatatcacttaacaattatataacactaactgaaatctacatgcatgaaaaatgaaacaacattatgttttttaattatatctgatttaattttagtttgtgtgagattgagattctcaaagttttttttttatttttcataactattggattggtatgctcaggcaatgatcttgctataatacgaccccttaatctatcacaagaattatggtcatatatgtttttctttgccaaataggtttgataacaaatgaacaatcctataacatgagcatgaaactattcatgatatattttcttatagtagaggaattataatataatggtcataagtgataattgatgaatgtaatgccataaaccacagtgacataactataagtgcacctcaacaaattagttattataaataattttgggaaataaataaaattttagaattagtaaaggtgtctcatgcaattatggacaataggtgatgaaaaaaaacaagatgctaaaatatagatctttgtcaaaatataaacaatgaaataatactctgaacattgtcacggtcacgtgtttgtttagctatatatatttttagtgatcaacttcactcatttctaaagatgacattgtatttgtaccataaaaattaagcagctttgattaacaccataaacaaaattgtgtctaaataaaacataaagaaactatattttatgggaataactgaataactatttacatcacatccatcttctctttgtttccctagagggcaccgagcatggataccacaactatagcgtggggcacacatatggttgacttgaggcaggctcagtggaggccaccattgataatagtgctcaacttcctacttactggtgcaatcgtctttaaggatgccgatagtgaactaggattaattcaaattgtgctccacactggttgtgagactgtgagaggcacgactatgtcaacccatgcttgaaggaatcttgatggttctccccattagagggacatgtctattttttaacggtgctatcctaataaccaatagaagcattagttttagaatatttatcagtagatttagaaataagtgttggcataaacatttaggtacatagttgaaataatgttttatgtattaatgatgtattagacttattttggtggtttagatggagttccatttattaaaatcatatctatcttttaagaacaatgataataagtaatggtgataatagcaaagtttacacttacctggacaaaagtgaattttgattaaatctaagagacattcttatcatttatattaaagtctacggtctatttcacaacataattttttgttactacgaggcaaaatctataatttgttatatgtatatggtgagatatgacttaattctcttagcattatttatataaacaataaataagatgcacgcgcatctgcgcgggcttcctttctagttttattctaaaagatcgaatgaatgtggagtatgaatatgtatgttctaattatgaaaaactactagatcagggacttgtctattttttttcttcactaaagggtattcagtcaatgattcatattgtttgctaattataatatagactgctcctccatttgccatgttagcttcatactacctgtcgcaaaataagtttagctgtgagtatctatgccccatgtttgaccgtccatcttattcgaaaaaattatgaaaaaattaaaaaaatagtcacacataaagtactaattatgttttatcatctaataacaataaaaatactaatcacaagaaattttcaaataagacaaatggtcaaacgttggatataaacagtgtaaaactgcatttattttggaacggagggagtataaatttgcatagttttaactgaagaaggttaattttcggtgcttacagctggtatagtactacatgcaagtgcatgcttcatcaatacacagtacaggcatccaacctcagaagtattaagactttatttgggagcaaaagtaaaaaaacagtaacacaaattttgacaagatatcttttggcttagaccaaagtactcacaagaacagatggagagtgcggaaatgagataaaagggcaagtgaggttttgaggtctctcccacagaccacatgagagttttttcacttctacatatgtaagttactagagaacagagagttcaaaagaggacaagaaaatactctcccatgagtatttatcaataagagatccaatgcttaacatatgtgtggttacatatatgggactgggaggtttcagaaataaaattaaggagagatgaaatgaagttttgggcatcccaaaatcaaaaggtagtaaacatgaagcttatggttatgcatgatttactagcttctagctgtcagctctcggatcgacttagctattctctaatgcaacaaaccgaagaagtcaagtcgtttgtccaacattttcttgaagcttatctggtagatcgtgttcccataatataattgatattacaacacttactgataaattggctcttatcaaagggaacccttgtactttgattgtactctcgtgtaacaggaaacgttatttcaatcttttccagatgcattttcgattcggttatggaattcaaatgagataatcatttcagtaattcagaaactattaagggggcttatatgaaaagttctggcaaaatcaacttttcatctcccctacccctggtcctgatttcctgaatgtgtctcactgttgtctataaatggatgcaggtctctaacttgttgtacccgataacaaattttatttgggaaattatagatgcaaaatgttcctgtgacacaggaggaagagagattagaaggcaagcaacgttctcacacaagagagaatgtgcaatcaaaagatatgtgctagttttcatgtctccagaatttcgaaagaactttagagagctcaaaaggagaagaaaagcatttcatgaacagataacaatgtgagatggattcagtgcatgctcatggtaattttcaaggatgaacttgggattaggaggcattgggagtaaaaggagtgcaaatgatagatgaccaacttttgaattcaaacaggagtgtgcatgaatatatgtatggtttacctgtttgttctcaggttcctttataatttaacagcctcatgccttctggtgaagatttggcgttgataagggcattctcacctttggtgaagctgctctagactctaatcatatcactgcaagtgagtgcaatcaaccaaaccaattcggaaggaaaaatcagagagaaagtggtaaacaagatgagcaaaatagaacggtaaattagcagtaaacagatccaatatacatctagcagtagacaaacatcaagtcatcaatgatgtggtattcacctcaatgaattgcaagtaaaatctcttacagaagagctatggagtacagctgtttcaacaatattatgtcccatagtactcttcaaacattccttgtttaaagttgacagggagctctggttatttgaacagatatcgcatcaaatttattatgatgtaatttatgcattatcacaattttttcgacataactcggtgataaattggttatctgaagagaagtctaaacttcaccacaggactacaggggctcattttatgttatttttatgccacggtacaatcctagtagaaaaaaccggaccggtccttgacccggtggagtgctcggttcactggtccacccgttcaactgttgggtcactggttgaaccgtggtttattcctaagtacattttgtgtttactctcaatcaaaatatcctagcagccaggtatcatttcattttgaaagagacatttctttttgaaagaaattgagcgcatgtaaataacctgtgactattctcggggatctgtcttggcattgtgatgtacgattcagattggcttaattgatctcagtcacatacgtcaagtgatacaattgccccgagaacacttacttcctagaaattttaattgtttagtaaatataaaatgaaatttttggtggtttcagtgaggagcaggggcggcggatacaggcatggggcagctagggcttgagccccatgcctagcttcatgatccccattataatcttgaaaaataccatgtaatttctaaaaatatttgaacgctcgttagttcagccctacgcgtgtagattttctggctccgccactggcgaggagtgaagtagcattgtcctctcaactacatgcattcaagctcaatggcacagctttatctgggagtatgtgtcagtatgctcggataaaacgagagaccagatcgagggagaagcaggaagagagataaaaaaaagggaaatgtgatctctcccacaacagtagttacgtttcttctacatgttaataattattatggatcagaaagtacttatcactcgagagaccagatgcttaacatgtgtgtagttatatatatatatatatatatatatatatatatatatatatatatataggacactcatatggggcaccatggtgcccgggcaccatggtttcaaatgcacaaaattactcaaatttttcaaaatttttaaattgtgagtatatacctagttataagaattcgattcatacatatatctatcaacaaaacaactcaaatttaactttatttcacaattcatgattacatacctaactaattatatgtatggatgctatatacctagaatcaaaatctaacaaaaacaagttcaaattcagttcaaacttgctttgaagtagttagtaaagtagttaatgttaatacctaaataattgaaaaagtttcatactcatttgaattggttatatactcaatttcaacaatggtgcccgggcaccatggagcaccaaacaaatttaatatatatatatatatatatatatatatatatatatatatatatatatgggattgggaggtttcagtaacaaaaaggagcacaggagtgaagatttgagcttggtagcgaagaaaaggaggcagcatggagttaattgtatcgtggtgattagtagtcatcattcctctgctatctcttgtattacaacgaagcgaacacatctcgtcattggttttccctgctgcttcagtggattgttctggaacatgtcagactgacatgattgtgttttcccataattactattacaacttactgataaattaattgctgcttatcataggaaacaaaatgtatttttttctcccgtgtaatagaaaattgagacagaattgttttcagcatttgatatagtctctcccctttatttccttcttttccaaatgtattctctgttcatattaaattgagtattgtatttcgattcggttatctcaaattctaataagattgttgtttcactaatcgtgtaaatgttatgcgcttatattaaaagtttaggcacagttcactttttgcctccccaaccgttaggcaatcctccataatccagggtttctaactagggacggacccagaacgactggcccaaggcctggaacagcctacccggagaatatgactttgcatggtggttacatggtggaaaaatgtatatccccatgagcctccagtcctagacctcaggccacagtctaggtgccccgaggcttaggtccccggtctcttactcaatgtacccgacaacaaaatccttcaagaaattatatatgttgttatttccttgagaccaatcataaatatggaacttttttatttatacaatgcaattataaattcatccataatggacttaatagcttcattaatgcatgcatatatccatgctcaagtgggcatgttactttttgctcagcaagagagataagaaggcaagcaaggctctctcacacaagagaaaattaagtgtgcaatcaaaatatatgtgctagttttcacgtctcctgatgtgaagtagagcttaagagagctcaaagggagtagaaaagcacatttcatgagcacaaaccagctgtttgagatagattcagtgcatgttcatggtaattggtagggacgaatatgggattaggaggcattgagaataaaaggagtgccacgatgaaatatttcacttttgaattcaaacaggagagtgcatgaatatatataccgatgattcattgcctcccagcttactttatagtttaacagcatcatgtgctctaatcaagacttagcgctggggaagacgaactcgcctttggtgaagctgttcaagactctaatcatatcgatgcaagatataacaacttgagcaagatgatcgaccaaaccaaggaggaaacacaaagaaaaaaaagcggtaaacaagatgagcaaaatagcacagcaaattgggagtaacagatccaatctccacctagaaatagacaaaacatcactcattgattgttggtattcacctcaatgaaatgcaagtaaatttccttacagaagaatttcggagtgcagggcagctgttccaaaagtagcacatgagattaaataattaggatcaataaatcaagttggagagcaatatatgtaatatgtcctatagtgctcttcaaacatgcaagcattgcttaaagtttttgactgaaagcattgcttaaagttgacagagaagtctagtcatttgaacaaatgtttcttcaaatttttctaaggtaatttatgcttatcacaaatgtccacctgcgaaatgaaagggggttatctgtaaaatcgttttttaacaatgctcatcacatggttggctgtcagcttgctctagcacagggagacgaaggacagggtggaggggccggcgtcgcggcgacaactagggttttcatccccgagccacccatgcaaggggtacacggggggtcacgggttggatcaatagttaaaatcctcaaagtacttaacaattatgatgtagattgatgttccaccttccatgttagttggatacattcatttatttttaacaaaaacaaaatgaaattttggtgctttcaatgagagtgttgtagcattgtgctccatactacatgcatttaagctccatagtacagctttttctggcagtaaatacagtaagattagcaggatatatgttagtttgctcatataaaacgaggccattgagggagaggttggaacagagataaaaaaaaagccaaaggagagtatacagttctacatgtaaattattagggaattcagaaagttaagaggacaaagaaatactctcccatagcattttatcaatgagaaaccagatgcttaacatgcgtgcagttacacatatatgggattgagaggtttcaggaataaaactagggcatggagctaactacatcgttgagatttactggttaagagttgtcttcagactcttcagtgaagcccaacagtcctcttttgcaatgagtcgaagtcccttgctgcctgagcagggaagttttcgaaaaattgcagtgattttgttgactcatgaaacatgtcatgatagattgttcccataattgccattattacaacattctgatgagttgtttgctaataaaagtagaccaattgttctcttctgtgttaaaattgagacagtactattcttgacatttgatatattttttccacatttctaatggcagaccgactgttggggctagttgaggcgccaaccccacttgaaagatttgcctctaattagattgtatcaaactttttttaatgaaaagatcaagaccaaataaatttttttttgtgaaatgaccaatttgttcatagatttattttttcgatatgttaatatacttgtgaattaaaatagaaaaagcattttttttcttttgatgatatgagcatttggatttcatgttgtttttatgcgatgatagtaatgtcagtgcatgattttgtgacatttcttttgaaaagatattccgtgctatttttatgacatttatttttgaaagatattgagcgcatgtaaacaacatgtgactattccaggggacctctcatggcattgtgatgaacgattcagattggcttaatttgattattatgatgcagactgatcctcatgttgccgtgttaacttcatataaattttattgttttttatgtcagtcaattgcatcaagatgatataattgtcactagtacagaaccggacatctaaatcactccatctataacgacagacagcgacccatcacaaaggtactcacctctgatgggccggaaaaaaccccatcacagagacaccgcaggaggcacgaactgaggcctcattgctgaacccgtcaccacaagaggcactttgccgataaagatgagggttcagacccgttacggatgactagttgactggttttgtactagtgtaccatgagaacacttcaaacctagaaattttaattgtttacagaaaacaaaatgaaattttggtgcaatcagtgaggagtgcatagtagcattgtcctctcaactatttgcattcaagctcaatagaacagctttatctgggagtaaatacagtagtattgacaaggtataggtatatatatgttacagtgctcggataaaaggagagaccagatgagggagaggcaggaagagagataaaaagggcaagtgtgatcttctcccacgatagtgttcacatttcctctacatgaaaattgttagggataagaaagttgaagaggacacgaaaattaatattctcccatatgtatttttcaccgtgagaccagatgcttaacatgtgtgtagttctgtacgtagttacatatatggaattgggaggtatcaagaaacaaaaggagcattggagtgaagatttacaaactgctgcatctgaaaaagggaggcagcacagagctaactatatcgtgttgatttactagttatcattcctgtaatgtggcatagctatgatatatcctgtgcgtagtatttcatcgaagcgaagacatcacatcattagattatgctgttgcttaagcagggaaaatgcatgtgttttgggttcaacagatattattgttttggaacatgtcaggtagaattaatattgtgttttcccataattgccattacaacatactgacaaattgccgctgatcaaagggaacaaactgtattttgattgtgctcccgtgtaacagaaaattgagacagtaatgttttcagcatttgatacagtctctcccctttatttccttctgttccagatatatttctctattcatcttaaattgagtagtatatttcaattcggttatcaaattctaatgagattatcatttcattaatcacgtaaatattaggggcttctgtgaaaagtttagacaaagtcaacttttcacctcccaaatgttggggtgtgtaggatcgaatagcaagaactaagccaactagctgaggagaggtgaatggttggagtaccaaaaatcaaatttttttagcggaattaaaagttacccttgttatagatcgagatcagtctgactgaaatagaggctagctggtggtggtgctccaatctgaccacctgctgttgtttgtcgccgcctccgatctaaccgccatgagcctaccaatatgaccgggtagtagtcctcggcctgacagttgttcactcgccggtgtgaccgttgaaactcgagcaaacacaattcaaagatctctcaaagtagattgtttatttctttctactcatgtttacaagtgcaacaacagcatccgtcacataaatctcgactaaactcgaaaccctaactttactctaaactcaactctcacaaaatcgataccgagagttctcaaccccccctcccccttctatttacatccaaggtaggcagcctaaagtcacaaatccaacttgtccaagaaatcttaattcactaggaaaccttttcatacaagatacaaacttatcctaacacgattcaaactccaatcttcccaaatttaaactcctttcaaatttgactccttatctcatacacacacaatttccctatcgtgtgtgagatggaatcttcaccaaccacgtgcattgctctttagcctaatcataccacatgatatcatgatcattgggacatcatcttctcctagattgactcctaatccatcaccggccatactttctcgagacatcaagacacacctacacatgaatcaaacaagaaacaatatctgagcacaaattctttccaaatttaactcaacattagcacacagcaatattacatatgtgtagaaatcatctaaaagttataattacaagataatcacgggtattcaaataaataacccaaaacctactctaatctggagctagccggtcaaaccgtcgagctagccaatctgacaacacacaacacactagcctgaccaacctaccctgcctggtttgtatggctccacacagatagcactacttcgccaataatatccaaatatcaaaattaattatctataataccaattgttcatcacaaattaataatcaaaacaaactttgatttcacagggtgatcctgaatgctctcgatgttctccataatctagggtctctaatcagggagggacccaaaattgggctaaggcccaagcaagcccatggagaatacggccttgtatgatgattacgtggtggtaaaatgtctatcccatggtagtcctaggcctcacgccatggtcctggtggcccaaagcttaggtccactcctgtctcctacccatggtacccaacaataaaatctttcaggaaattatagttgcagttgttttcttcagactaatcgcaagtgtgattttcttttttatgtataaaatgcaattatatattcgtccgtaatggacttaatagcttcaacaacgcttgcatatatccatgctctagtagacatgttgctttgctcgggaagagagataagaaggaaagtaaagctctctcacacaagagaaagtgtgcaaccaaaatatatgtgctagttttcacgtgtctccgtatgtgaaagtagagctttaagtagagagctcacagagagcagaaaatcacatttcatgagcacaaaccagtttgagatggattcagcgcatgctcatgagtgacatgagtaattggtagggacaaacatcggattaggaggcattgagaataaaacgagtgcggtgaagaaatttgtaacttttgaattcaaacagaagagttcattatcatatatactgatgattcattagctcccagcgtactttatagtttaacatcatcatgtgttctaacttctaatcaagacttggcgatggcgatgacgaactctcctttggtgaagctgctctatagtctaatcatatcactgcaaaatagaacaagatgagcaagatgatcgaccaacccatggaggaaaaacgaagaaaaaaaaagtggtaaacaagatgagcaaaatagaacagtaaattgggagtaacagacccaatctccatctagaaatagacaaaacatcattgattgttggtattcacctcaatgaaatgcaagtaattaaatttccttacagaagaattatggagtgcaggcagttgtttcgaaagtaacatatatctgtcccgcttagtgtttgcatgtaagattaaataattacaaccaataagtcaagttggagaacaatatatgtaatatgtcctatagcgctcttcaaacatgcaggcattgcttaaagtttatgactgaaagcattgcttaaagttgacagagaagtctggtcattgaacaaatgtatcttcaaatttataaggtaattttcatgttatcacaaatgcccacctgtgaaatgaaagggggttgtctgaaaatcgttttttttatagtgctcacaccgcacggttggccagcaacttgcactagcacaaggagatggaggatagggtggagggggcggcaacggctagggttttcaccccgagccacctacgcaggagaggggtcacgggttggatcaattgttaaaatcctcaaattacttgacaattatgatactgatgttccagctgcaatgttagctggatacattttttttttctatttttaatatttttgttttttgaaattttggtgctctcagtaagagtgttgtatcattattctctcaacaaaatgcattctgtctcaaaaaacaaaaagaactacatgcattcaagctcaatagtacagctttttctggcagtaaataaggcaagattaacaggatatatgatagtttgctcatataaaacgagacccagattgaggcagaggttggaacagagagataaaaaggctggcctctcccacaggccaaaggaaagtatttacagctctacatgtaaatcaccaaagttaagaggacaaggaaatactcttccataagatttttatcagtgagaaagatgcttaatatgggattgagaggtttcaggaaaaaaactagggcatggagctaactataccgttgagatttgctggttaacagttgtcctcagtgaggcacagatgtcctcttttgccttgagccgaagtcccttgctgccggagtagggagttcctcaaaaaattgccgggtttttgttgattcttgaaacatgtcatgatagattgttcccataatccgtactgaaagcaaaccaattgctctcttctgtgttaaaactgagacaatactattttctaatttgatatatattttttacatttctgatggcggataggttgttggggctagttgagacaccagccccacttggaagacttgcctctaattagacaatatcaatttttttaatgaaaagatcaagaccatatctttttatataaaaggtccaattttttcatagatttattttttggatatgttaatttagctgtgaattaatgtagagaaagctttctttttcttttgatgatatgagcatttggatttcttttttttcttttgatgatatgagcatttggatttcatcgggaaatattcagttaatattgctccactcatgctatgtttttacgctagcctccctcaatttgcatcatgaattcgccattgtgcattccattgtttttcatactatgttatatttcattatcttaaaaaaatactatgcattttctgttttctgtccatataaaattgagtggtcagttatatgaaatttgaatgagagaaacatttcacgaattaatcaaatgtcaggaaagttgaggggcttgtctgcaaagtttcaggtaaggtcaacttttcgcatccccgaccgttgggagtgggcccgagtgcgtctctctcagctttccacaaacggatccgggtctctgacccggttgtacccgatatcaaattcctttcgaaattatggacgcaattgttccttgagaccaatcgcaaatttgaaaatatttatatgtatgcagtgcaagcatagattcatccgtgatagatgtgatggaatatctgagccgttcaagtaacaaactattaattgtgtttagtgtagaggattaattagcgtgtgacctgcatgcacgatcgtgatttgccaccaaatttcaccaaataattaaagtgcccaatttttttttcaatattttgtcttcacatgcataataaaaattgacagttgaaatttcccgacacacctttcatttgacttgctccaaaatatcggtgattaaattatctcctaatttcgtggacttggtcccaaacaaagacgaacggaattcttgttctcctcagtcactgcgaccaaaaacttgtcaaaattgactcaacactccaggtccaatatatagtatggcaataatcatttaccctaaatatgggaagcacctaataaataaataaataaataattgaaaccatttgagtagatgtcacgacaataaagaataaggtgcaccataaaaggaggggaaaatttgtaatttaattacactatttgtatgttgttagccactgttttgatgttgatatgttgccttcttctgccttatcaagtcacattatattgtgcacgcagtagcaacttatgaagtttacattcatgtgtacttttgtcactacatataatatgacacctattaaattccatagaaacattttcctcattaaaataatcaaattttgtcataataccacacaagctttgaacttaattatcgcaattgaacgcatcaaaaacttgaaattttttcacaaatttctccttcacacaaacaaaacttattgaccaagtgcagcaaaacttgatccatgaataacaaaatgattagaagtggaaatccttcatgaaaaaaaaacagatattcaaaattatttacaaaaaacttttatatatagagagagagttttaaaatcaattcttaaaaaatcagaatcaacctaaagtaagcttcaaaatttaaatttttgttgctactaataaaccaaaagataaattatgcgacacgctaataatacagatctatgcactttaaccattgcgatcaaacgtgccaaagtttctcaaaatgtatcctcaatattaaaaggacccatattattgacccaagaggtgcaaaacttggtccataaccaattctcacaagtggaaatccttcaaaaacaaaacaagaggtaccataacaacaaactaatcataataatccaaacacatgcagtttaccccccgaaaaaactattattcacaactcagtccctaccccccacacgtcgtcttcaacagctctcttccccttccgagcgccatcgccattcgaaaaccaagacccccctcctccccatcaaaacccagccacaatcacccggttccaccccccgatccagccctcctcgccgcgatccactctcccgggcgtcttctcctcgctcccacgatcccgccggtggatcgggccgccgtgattggtgccggttcgaggcgccgtgattggtgccggttcgaggcgatgatggccgcggcggtcgaggaggaggagatggtggagaggatgcacgggtgggcgagggacatggacgtggcgtcacgcagggccgaggaggaaggtgggttctctctctcgggcggcatttcgtagaacactctgggtgtgtgtgtgggtgggtgatttcttgatttgtttgctctgctgttcttggttgacccgtttcgggtttcagcttcattttttgggttttttatggtttagatggttgatcgaactggggagaatctcgtattgggggctctgatggttttgattttgacgtttcaacttttttttggtcagattcagtttagtatcgattcggctttttcaaattttgttggtgcgattcgggttgatgatttagttgggtggtggtgattaaaggtttcatttaatagcctcgcttgaaattgagctagtgttgagctcacagttgtgtcggtttcacgagatctttgtgtggggagaagggtttatgctttatgcctttcttggttcagactaagaagtggtagctgtaccatactggtataccttgatgtgtccagataatagtagcactatgaaaattagtatacattgatgtgtccagattataatgccactgaaaattatgtagtgatgtaatgaattatgaatcgtgttatcataattttgtggtaagcaaaaatgttgggcatgtttaggacacttcttagcagagatttttagcagtatttacagtacatctagtcagtgtgagatgatggtttactgggttgacaattgcagcaatgagacggtatgatgcggcaagttggttgcgaagcacggttggggtagtgtgtgcaagagacctgccagatgaaccgtctgaggaggaattccggcttgggctgagaaatgggattgttctttgcaatgcactgaataagatccagcctggtgccatacctaaggttgcatttttcgcattcaaattttatagattattcagaagccacaaatgctaatatgtgatgacatttctcttggcaatcttaaaatgtttccaggttgtacaagcccagtcagatgctgctggccccacggatggctcagctctgtgtgcatatcagtactttgagaatctgcggaacttccttgttgttgtagaagatttaaggcttcctacatttgaggtgtccgatttagaaaaggtaactctgtcatgctgatttggagagttcatgtcacaagccactttttcatcctagaggttcaattttctttagacaggcttcccggcttacctcatcatttgcaatactgcctttggtcacaaatatttgttgtttagaacaagtgtctggtcaaactttttaaatcaatttcttaaatatttagattggacacaattaaattatacagattttttctcaaaaagtaatttcataacattttaattttaatgggttttaaagatatttgacaatacaaattagtggtaaaatttacatttggaagattacgtcgctgtccaaaatgacatgtatctatgactagagggagaaatcttgaaatgaatgttgcatcactaatatatgagtcacttgagaaactgatgtattttatctgccaattcgaatgtagggtggcaaaggtgttcgggttgtggattgtgttcttgctttgaagtcattcagtgaaagtaataaaacagggagacaagcttcgtgtaaatatggcggcctttcaaaacctttgacagccagaaagtattttatactcaagaatactgatgcttttatgaataagataatgaaagggcactcagcagaggcaatccagagtgaattttcagaggggcaaagcatagttactgatttttctatagagtctaatgagatggtaagaactataatttggtatggtttttttgggcacaatcatgcttatacttcttaatgacctttaccttcttgtttgcagactacttcagactcccttagcattcttttgcgtaaagttctcttagataagaaaccagaggaagtcccattggtaagcctattttgcttgaagcataattgattattatgtgttgtgattgatgaacattgagaatataacaaaatactctctaatttggtcagattgttgagtcgatcctaagcaaagttattcaggaatatgagcatcgaattgcaatccagaacaaggtgtgttccgttccactataattatgataatgtttctttttttgctatttagaaaatcaggtttctccaaattacttgggttccgaagttagtaataagacttgatggtttggtgtttttgttgacctttatggttaggacatacaaactttaatttgggtaagaaaaacatctcaggttaaattcataggagattgtgtaggttctgtgtcatgttccagattatatacaccatcagaagctgaaaatgcttctagttgtgaccagatgagggtatattatttatttgagtaaatttcacatcatttattctaaatctgtggttgctacactctactcaattttttggtactttaataactgatgtttgttatggtgtatatgaagatggatgaggaggagcaaaatctcttgaatatcacggaacaggtcaaccatgtagttgtaaatggtgatggtgaagttaaacagttccaactagaggcacagacaaattttgatgtgcaacaaaaacagatccaggtattactttt

SEQ ID NO: 65132 - DNA, 18454 bp, Oryza sativa
tgctcgggttgcagggggaggagaagatgacggagtccgacatggtcgccgttctctgggtaaccaaggatccatctgacatgcatgcatctattcgatcgatcttgtgcattgcgatcaacggattcatggatatatttgatcttgcgcgcgtgcaggagatgatctttcgggggacggacacggtggcgattctgctggaatggatcatggcgaggatggtgctgcacccggacatccaggcgaaggcgcaggcggagctcgacgccgtcgtcggccgcgggcgcgccgtgtcggacggcgacgtcgccggcctgcgctacctccagtgcgtcgtgaaggaggcgctccgcgtgcacccgccgggcccgctcctgtcgtgggcgcgcctcgccgtgcgcgacgcgcacgtcggcggccacgtggtccccgcgggcaccacggccatggtcaacatgtgggccatcgcgcacgacccggagctctggccggagcccgacgagttccggccggagcggttcgcggaggaggacgtcagcgtgctcggcggcgacctccgcctcgcgccgttcggcgcggggcggcgcgcctgcccgggcaagacgctcgcgctcgccaccgtccacctctggctcgcgcagctgctgcaccgcttcgagtgggcaccggtcggcggcggcgtccacttgttggagcgcctgaacatgtcgctggagatggagaagcctctcgtgtgcaaggctaaacctaggtggtgatgatcaaggagtatggggctgtttggttggttgctgccctgagtaacataacatgcctgaaatttctgtgcgcctgagtggcatgtgagaagaccaatgcatctaacctggtcaggcagcttgagtatatgcttgtttggttggttgttgctgcctgagaaacaaatatgcaattacgcctttaatcattacacagctaaatcaagtattaatgggccgttacaaatcttgccacaaattgcatctgaacctcctaccaagatccatttatgacccaacttcccatgtacaagcacaaatcttgcatacataacgaggataaaaatctaggaaaaaaaagcagggaaaaagagagaggagaacgcaatcgaagagtcaaatagatcccaaatccgtgcatcaggagcgcaaccttcagatgattctgtccagatgtgcaaatgcatctggcaacctgcaaatcgatctgcttcgcacgaaaggcagcctgggcagcatctagcatgggcgatgctgctatgctgggatccggcaagatggcgacgacttcacacgccggcgggagcagcaacacagctttgcagggatccggcaagacggtggcggcttcgcacgccggcgagagcagcacggcttcgcagggattacgaaagacggcgggcggcggcggcttcgcacaccggcggaagcagcgcagcttcgctcctggaatctacgtcgcgtggccgcctccgagaaagattaggattaagatggtaagtatgtatcgctgttgctgcctggagctcaggcgatcgatttcggtcgcctggctcaggctaatgacgggaagggctgcaggccaggcgaagggtttgggatctgagggcaccaaccaaacaagaccaggctagcttcaggtcaggtattttcctctcaggtaacgaccaaacagcccctatatgcatttggtctctctctagggctgcatggattatattatcgcttttgctttgatttggtttcggagatcgagagattttgtacattttgatatgcatgcacggttctactagcacaatatgaatatgtttgtcatctgatgagataattaagcttgacccaggtgaattaagtgcatgaagtactgtggcacatactctcttcgggctgataatacttatcgttttagataaatgtgaagtcaaactttacaatctttgattatgaatcatttttaaaatatttatctttcaaatatggtgattattacatgtatagattagtcgtaaaaggtactttaataaatcatatgtttgttaacacttttatacatattataatgaaaaataatggtcgtgcactcgtgctcttgtcgaaaacgataagtattatcaacctgcagggagtagttaagttatgtgggtgtttgaggttaccataaaaatatatggaaatgtttgttgatactgagggcatttcaatatgcttaatgtttttttttttggttttgaggtttgatgcttctcactgtttgttttgagattgatgatgttgttgttaatgcaaatgacacagagagatcttgaataaaagaaatggtgttcctctgaaaccactctactggcatatctcgggaaaagatatcctcagaagcaattgttcattttagcggattatacacgatcgagtaaaattaaatgatgttcctctgaaacaactgtactgccgttatacatgagttcaaaattctcctcagaagcaaccgtggactttatctcatgtacaattaatggctaccatgtacattaaccaaacacaactcaaagagtgatctgatttcaaatataatttgttctcacaagagttaagagaattgttagaatccaagagaacatacatatgtataaaggacacaacatgacatttgatacttcctctatccacaaaagttacatctatttcagatttgagttttttcaaataagttgtttctatttgtagtatttatgcattcaagacttaaatgaagagataaattaaatgttttattataacccaaagagtcatctaaatactcattggttgtatgcttgcatttactccttgattttgtaacatctaaggtgattctatttcagatttgagttttttcaaataagttgtttctatttgtagtctttatgcattcaagacttaaatgaagagataaattaaatgttttattagaacccaaagagtcatctaaatactcattggttgtatgcttgcattcactctttgattttgtaacatccaaggtgatttaatttctccttggtcttggtgtcaaaagtaatatggagggagtataactcatctttttttttctcgtttttttctttgcgatggcccctttctcgcatttctatgaggtttcattgatttgcattgcgcaacaggccagggtgaagccagctgactagccgataatatcattggcgtcaactccattacatgacttgatacggtgaaccttgaataaaaaatactattactctctccatctattttgataggcatatttcattccaaccacctattctcttaatgactttctcggatttaatacgtgactctccattcttccacacaagattggctacatggacatcgagaaatgtaaatattaataaatcgcttgtttagtagaaataactagtagtatgtttaaattgatgataagtatcaaaataaatacttatggatggagggagtatttactatagaggactatcgagatgaaatatgactatcaaaatagatggagggactccctccctactggtaaatgaagttgtttaggacaatatttaagtcaaaccttgggaatataaatcatgaataactttcgagttgttgagtttgaaaatgtaaaaaatatataaatagatttgtcttgaaaaatactttcataaaagtatacatatatcacttttcaataaatatttttatagaaacaagaagttaaagttgtgttttaaagaccgtgtcgctgcttaaaacgactttctttacgatttacgagtacggagggagtatttactatagaggactttgaatttcatcgggatcggctgacctcgatgatcattactagatcctgtcacgcaagccctatggcatttgttaccgaatttttttattttttaagacctttttatgttttgattttttagtagactacttcaaaaaatattttcataaaccgaaacttttggccaccaaaaagccgagtggctggcgtaacaagttgtttggccacgccggccacagtggcgtggcaagagaggatggtgtagaaggccagcattatcacgtagcgcgcagtcaaaaggttcagatttgaaaatattttttaaaaggaaaaggtacaaattatccatccgaactaacgcggtcgtccgaattacccctctaaacctgaaaaacagacatcattcaccctcaactttcaatacatgacaaattacccccatcgacccaatccaaagcggttttgtcctacgtagcgtacacatggcagtccagtcagcattttatttattaaaaaatatgggacccacctgtcatgctcccccctctcttctctctcactcttcctatcgctttctcgccagtcggcggcaggcgggggacgcagcgacggtggcgtgggacgaggaggcggcggccgcggccacgacgagcagccgccccctcggcgcggacccccttgccctccacgtcgccgcctccccctccctcgccgacgtgtccaccgccgctgccaccaccaccaccactccccacctcgccgcgtgcccccgtgacctcctccttgatcccccgcctgtttatactcatctcgtcacccgcctcatcatcaacagcagcagcagcaaaagaagaagaagaaaaaagagtgatccagctagctcgcctgagttcatctgctgtgtaatttgagtaattagcaacaatggcggctgctaccatggcgctgagctcctccttcgccgccgccgccgctgttggtgcgccatggcgtggtgtcgtcggcgccggccgcgccgcggttggcttcccgcctcgccggcgtgctgtcacgctcgtcgtcagggcccaggccgaggtgagctgagcgttcttgattggtttcactgtgcctgttctggtgatttgcttcgtgtgctaacttggggcgacttcattgtcgtcgttcgatcgatctgcagccggaggtggagccgacgaaggaggagacgatcacgtcgactccgagccccgtggcggcagcgcccaaggcgaagccggcggcgagcacggggctgtgggacgtgctggcgttcagcgggccggcaacggagcggatcaacgggcggctggcgatggtggggttcgtgccggtgctcgccgtggaggcgtcgcgtgacggtgagctcttggaggaggccaccagcaggggcgggctcgcgtggttcgccgccaccgccgccgttcgtccgtcccgcccgccgcgcagccgcttccgcgtcccccgccgccgccgcctctgtccgtctccgcgccgagggggcggctgctcgttgtggtcgccgcctccgtctctgcgtcccgtgccgccacccgcacccgcctccatccgtccccgcgctgaggggtgccggttcgtcgtggccgcggccgccaccgccgcctcgtcgcccgccgccgcagccgctgcgtcccccgtctgtgccgaccggcgataaagtgagaggaagagtgagagagagagagagtgagagagaagagagaggaagagagagagaggagtatgacatgtgagtcccacatttttttataaataacatgctgactggactgccacgcatacgccacgtaggacaaaaccgctctggattgggtcgaggggggtaatttgtccggtattaaaagtttgagggtgaatgacgtctggttttcgggtttagggggtaattcggacggccgcgatagttcggggtaattcgtattttttcctttctaaaatgatctattaataaaattaaaatataaaaaggtgtaaaaaataaaaaaaaatcttggttaccctcgtaaacttccaatatttggcatatattatcccgttccatcctatctagccagaaatacttttttttttaaaaaaaagggaagtactacttgtacaagtagattctcttttaaaaatatccatatatataatttgacagtgacgtaaactaaaagatttgtaggattaatttccctcttacgtacatctacgcatttcgcttttgtacaaatgatttagatttaaaaaccataaacaaaatgtaccagtacaccgagcacttgcaccacaagtccacaactaaccgggcacagtagttgtcatctttttcttaaacaaagctaaattaacttctttttttctttgaacaatttagaataaagctatttctaacttcaaaaacaaaatgttttggttgtgcggttatatgccatggctgttagtatgtattatcacaccatccaggatggtatggataactaaacctttatctccttttttttttaatcagctaaacattttctgccccacgattgtttttccaccgtaacgacgctatttagaattgtgggtgacagatgattttaattaggtcttttacggtgcttgaaaggtacccatgtacctcttaacaaattgttatccactgttaatctttaaaaggtaatttaggaaaaaaaattattaacacggatagcttagtactccctccttccctaaatgtttgacaccgttgacttttttaaatatgtttgaccattcgttttattcaaaaacttttgtgatatgtgtaaaactatatgtatacataaaagtatatttaacaataaatcaaatgatataaaaagaattaacaattacttaaattttttgaataagacgaacggtcaaacattttttaaaaagtcaacggcgtcaaatattttgggatggaggtagtaattgcttaatttccaccccgtcgagtgcctaataaatcggccatccacgatatcatgcaggtgtcgagtggctcacctcaatcgatcttcagaatatgtacatagtgatcaaatagctaaattaggcatagaaaccagtaggggatcggatgcgcagcgcagggcattgttgatttgtttttgctggcaaaatcgatcttcagagcctggaatacaactgctggctgcatgaaggcctgacgacaaagaacgggcaaggaactagcagagcagacagcagcccggggattcgtgcggtggcggtgacggcgacctgctgctgcgtacctcagctgcgaccggcgggcgctacgggcgcgtgcgacggcggcggtatacggctgctgctttcgtacgctacgaccggagggcgtgtacggcggcggcgagcggcgggcgtgtgcggcctcggcgagcggcgggcttttacgtagcgacgatcagcaggtagttcatgtaggttcctctcgcatgcgttcttatccttcctcgtttttttcttcctcctgctgaaacgtttgtagcttctctcgcttttgttctttatcgaaaaataatttaatgaaaatcaattaccattttacccttcccctctccatacctggtccaccattttaatacccttttaatatcttttttcagttatcttctctctgtccattagatcattgctgatcaagggttctaattaattttaagcattgaagaagatctctcaattttattatatatatatgaggagggcgagggtgagagcgaggctcggtcctattttttttcccctttcattcgcccgttctgtccccatatattgcacgataatgatataacctcatgcgaatgtatttaccatctatcactcaacaaattaatcagcgttaaggggaaccaatcaactgacgagttccccgccaccttacgatagattttgtgataaaaattttttcttagaattagaaaatgttggtagtaacttattttaggagatgcactatcaatagtttagtggcaagggatgtgtagttataatcataaggttctgtgtttaatttccaacacgctcagattttttttaaaaaaatatttataggaacatctctctccaaagcacatataacatatggtacatcgttcagttttacacagagaccttgatttatgatggccaacacacgacatgaccaaagactaaactttggaagcagtcaacagcctaagttggtatagtcactatctcctttaacccggccacacggtcgggagataagtgggaactgggaaggatacatcaagacattgtccaaattaaacatgttatcactttttttataaactttttaaactttacttttaaaaataaaccttccaaaacttattttcaagatataaccttataaccacgctaacagactgacacggcaaaaccatactaccataccggtctgattagcgtggcaacgttatttggtcatgctagtctagttggcatggcaatattatttggctacaccatcctctctgatgtggtatgacaaatttttcacacccgctgtgagtggcgtgtcagtgttgtttcgtcacgccagatgggttggcgtggctaaaaggttcatattttgaaaatatgttttgaaagggttcgtttttaaaataaaaaatttaaaaaattcaaaaaaaaacttatcactgagtataaaggggccaaaatgaaataataacacttgatctatataattatcttttttataatagaaatcaactaatccaatctctcaatcaagaagtattcggcttgatcgagtagatatttatcatctgactttcttttaagtttaagggcctctttaagacgcaagataaaaaacacagaaaaaatatagaaaataaagtagtatatttgtttaatcgtaaaggaattagaaatacatgaaacatgaacagatgtcctttgattacaccacatgaaaaaatgaagcaaaggaaagttttcaagaggtctaaccttcccgtgaaatagaccataggtatgcaattgtctgaaaattttttcatccatttccaataaatcaaatggatctatattataaaaaaaggaactgaatccttaaaaaaatagccttcactaatccttcatttaaatgggagtatttctcacggagaggaggtggaggaatttttttttggaggcaagaggtgggggaatgaaaagatgtagagcagaacagccaaaagcaagaatggttgttaagattttggattaccttacactttttttaggaaataaatattgtaaaggccagataccctttctttttaaggaaagtgcacaaactttacctccagctccaaatattttatataatatttggatcggagaaaaagaagactgcaagaagaaaagggcaccggaattattctgttttgtttattaacaagggtaaaattagaacacatatttcacaagaaaacacaaaggatatacacatttttgttattttggacagaaaattaaattatgatattcagtgtataggacctaacaagcgcgactagaatctatgttattccagtttctgtttctgttggtgacggtttggtagaaagcattcaagtgattgtgaaatggctatcatgataatgattcttgtggggttggaaagcatacttctgtagagttagtattttttaatgtcacattcactattttctcctgataaaagatgaagatatcatctaaagaaatatataaaaaatagaaaacttatcatgaccatgtaaatagtctgaaagatgccctaatacaattataaatgcaaatctccacccaagataattcttctacactagattttatccagataaactagattctagtcacacttttaacattttgtcctgttcggtagggaaaggcgggcaattcactttatacactccaacactcccctcacgcgagaccccctcaaatctcaagcgtggaatattggagtgggctgcaattattttatttaattgcgcgccagccaggattcgaactcgagacctctagctctgataccatattaaattgcatgcaccagccaattacacctaaaagcctaagctgataaggaaaggtgggcaattcactttatacactccaacatagacacacgaaacgagaaatccattgatgtttgattaattaagttctaattatttttgaactcataaagtagataaatttgatattttaaagcaacttttatatataaagttttcgcacggaacacacagtttagtactttgaaaaacgtgtgaacgaaaaccaagataaaatatgtatcttaataagaaaagaaccgtttatatgccaatgattattttctgggtattgtttgtaataatgaagcgtttgttcgttctgtaacttgctcaatgaactaacttttcagtgacaaatatttgtaggtcacgctggtctgaaaagaaaatttttgtcacatcactgcattggcttgctaacaaggcgtcaaatgatctgaatgtttcatgctgagtgttatgaatctgatgctctcggcaccattagattcataacacgataatccttttagcgtttttatttactagatttactccatcataagtagagtattttttttgttgtaataaccttaggatacttgtgttgcttactgctaagcttagcagccggttcaacctgtttgtagtttcaaaacctgacatattggaaataaaaaaactgcatatacatcaaaaatcaaaattaggaaaaaaaacttgtgctcacatcctcatcaccattggctcaatgatcatctgtggctataatcaaaagcatattgatgagccgaatatctcactgatcacgaatctcttgcaatatccccgaccaattttcaatgctgatgtgcagcaagactgtaataggcaggggaatccctgctgctctgtggatggaattaaaagaatggtgaatccaccggtccaagctctgcaatactgcaaccgtatatgcttctctgaagctctcaacaatggtggtggcgacagagatgcgcaattgcgcatccccaatccacaaacgatgcgcgattcgtgatcgaaagcgtcatgcggttgggatgatgatgatgatgcacatttttttccatttgctggaggaagaatcagtagcactacaaggaaagctaggatggatattgatgacttgtctagtatataacatttggtggatgcatgttgcacatgtaaagggatgcatggtaatagtatgaagacacaacttctgcaaactgtggataagcaagaggggatgaaaaggattgaaccatctttattcggttaaatcgtgtacttctttgttacaattggcaaccgcactgttgtcgtaatggtcatctacatcaatagtagatgcattgcaacttcgcaagccaatcatctttatcacaaaaggggctactcttatctgctcaagtgtgttattgtaatcagatcttgttgagcacatgaactgaggatcatatcatagtagcaactagcaagcatgcattttttataatcttagctttggtatggttggttaggatacggccatgctttcccataaagatttccaaagcattatacagatgcaaagctcttctaaagcaaaaccaaattaacaccaaatcatcaccacatgcttcaagcatgcacgcatgcactgttacccccattgacaaggcccaaataagactgtaatcctgtaaagaatcttccgaggatagcatccattgctgtatgcaatcctgcagaagattttgcatgccatgtttgtttagttttcagaagcatatgcattaggtagcagaaagctagtcatgcatgcatcaagcttaaactaaactacatgatttatggacctatgatatgaggcactatggggctaatcattggcagctgaggttatggtcatgtcaggtcaggtgtgccatacacataaatgcagttggtgctgctgatcttttggctttagttaccagctaatggtgtggaggggcatgactgactgatgatcagctggtcactggaagattcagatagcttagtggtgatctgtctaggtcgttatctgattctgaatgatgtggttgtggtcaatcatgcagcagaaaatacagcaaaaatatgcttgttaaggtgagatacagataggtgcttcaatgatccagaaaaaaggagaggcacacagcttctaaagccaaatactaaatctcaactgaccatttctattagctgatttaagatttgcacaattcggcttttagatatgctaaaaaggctagtgttgcctatttgttaggtcttgataaagttgagtaagattataacaaggtgcgggaagaagctagaaaccagggtcaagtaggctaaacataagaaaatttcaacgtctttacgaggtttgcctatttgttccactagatttagaagtttgtgaggtttgtaaagctattttgttttctggatccccacaacatttttctttttatatatgctaccgtcttatattgttgttttctggggctttcttactaaagccagatcagtgaatcggcaacatctttacgaaaactatgctcgttcagccggtaattgaccatattaatcaactaaactattcaatatgatactgaacaattcaaattatatatacagctaaaacagtaaacgatgaaaaaaaggatgccacttaatacagagaagacactcgatcagttgaaaactttacgaccaccaccacactagaacggataccctcatctcaatcgggcggtaagccccatctcaatcgggcacagcgtccgtcacaggctagaagtcactgatgtgaagagttatcttaatcgggcaaacggccgtcacgaatgaatatatctcaatcgggccctaagtaaagcccgtcaccgatagctttgacccagacgaccagtcaaactatagcccgtcacagatgacctatctctatcgggccacaactagcgcccgtcacagatgactactaacctttatcgggcctaacctagagcctatcacagatgatactcatctcaatcgggcctaaactatagcccgtcatagatgactgatgagctcaatcgggcctaaactagagcccgtcacagatgactgctgacctcaatcgggcctaaactagagcccgtcacagatgactagtgacctcaatcgggcctaagctagagcccgtcacagatgacctcatctcaatcgggcatttagttatggcccgtcacagatgactataatccacaaaaaaaataaaatttgttttttggctagcctcaggcctttgctagccatgcccgctgcaaaaatgacagaaacaaacacagatatccaatatccccagctccccagcatcacccattcatacatatgcattcacatacacagacatcaacatatttcacacaaccacacattcacagccatctcatatttcacatccattcacatatttcacatccattcaaatatttatcatatttcacctgcaaaaccgagttaattggatcaaatatttatttagcaagtcttaacataaacatatgaaatatatacataaatataagcatcatagttacatcatcacagttgcataataagtgttcatcattgcctaaacatagaagttcaacattgttcatcattttagtttaagcctaaacattcctttggggttaattatttcgcggaggatgaagctggctatctcctcgcgaacctcctcaaagctggtagtcagagacttggttattgtgccctacattgtcataattccagattagttgatcgatcatatataagtactaaaatgtagttagtctatcacaattgagaccaccgacctcaaactcagccaaagtcttcaccttttctctatacagaagtcgcatgttgtggcacacatggaatccgcactggtcacctatttgttgcttcaccgggaagtcttttttgtggatgagggtgtcatgtcctgtcttcctgaggcctcctctttgcacgtattgggcccacgcttcatctatcgctagttgaattggggtccaatcatatgcgttcttatcaattctggagttcaggtaatgacatgtactccatttaggtgttatgaccagaaggatccaatgggcactgcggcattaatatagtgaaagttaattaagtactcaaggaatgtgtcatgctgttgtgtatatttagttaacacacttactattgattataggcacacataatgtactccttgtctcggcgggaccacaaggtgtcgtagatgtagttgaccattccttgatggtcattctggagatttgtgacagtgaccacttgtggatcaaggaaggcaacttccagtgcatgcttctgacaccattgccaacttaacctacacacaggatcaacgatcttgtaagcaagttaaaccgattgttattaccagaatgagttgggcgacaatacttacaaggagtagcacttaaggaggcttgtgtccaccgctcggagcctgtagaggtcaaaaagatccttgaagtcgaccacgatataatttgttggaccaaggaatggctttccatcgtgctgtccaaggatatcggtagctttacttggcttcctggcattagatttctccatgtagtataagtgaaggtccttgcaagcggtgcccattgcggcaagcatgtcatctccaaccaatggcatgcctagttggaaggtccttgcaagcggtgcccattgcggcaagcatgtcatctccaaccaatggcatgcctagttggaactcctgtggagcgacgtatttcttcttgacctctttgcccttagtctcttcctggcccttgcccagatctagctttcttggagctagaagcgaggcttgcacctttcctccccttcctctcccctttgctttgggtttatcgagagtaattctctgaggggaagagtgtgccttcctgctcttcttcatcggtgggggttcatgaatcgccttgctgtcggcctccgttcggtcctccccaaaatccgtgtcgtactgcaactgcacatcgtaagattgtgcatgacgatcttgagtaggaggggctgaaggagcagaggcgggtctctttggtggacgaccgcctggtgcagtggttggcctcgctgtaaccctgatctcaatgaggtccttgggccattggatgaaggtaccacgggcatttcctagtgagaggacctcgtcgttcggtggatacttcagagggaacagctcgtattcgggcttcaccgagtcgacttgaacttttgcacagtcggccctgagttgcgctccatgcactcttgtctctggggtcggcttgtacgcaagtccctcggctgctggaacagtgaaggtcggcatcaccctaactgtgagggtgcagctcgttggttcctgcaatagattaatcaatttttttagaatattatatatcatatggattcgttacgtctttcatgtattgagtaagttcacggttaccgttatgtggtcgacggcgctgtcgaccgatgttggactttccgccaactcagttgatgcgcaactgctgcgtttttcggtgggacttcctaactctttgtgcgcagcagcagcggcggcctgggggatctgttgctcttctcggatctcttgcctaatcttggccctcatcgactcgagcttttcgtcgaattcagatgtcagctcagctcgtatcgactcccggatcttggcttcaaggcgtgcatctttctccgccttgttggaagtccgcttcttgtactaccacgcgtagtctggaaatccatacttccagggaacagaagacccaacgccccgtgtccgtccacgatgttccttgttgcccaacgctttcatgaggaggtcgtcctcgcgtctttgagagcaggcctcttgcgaggcttgttgctcggcaactaactccttctgcattacaatttagtggggtcaaataaactgcacgatgggaaacaatgcgaacatctagtttgactagacacttactatagcttcgtatactcgttgatcttctgcatttggcatgaagattatgccatcatcatgtttctggtacctagccctggcccagttcctagcccgagggtgtgggatatcgccaaacacgagcggtgtgcacgattcctccgcttcttaatcctcacgctgccattcctcttccttaccggcatatccggcggtaccaagccggtgcggatgctggttcctggtctggagcaagcgatatgcctcgcttctagctctggactcgggggtcgacttcttcgcatggaattcctcctagacctgttccatgatccaaggaaatttctctcttggatctggatttgccgggttgtagacgaactcgccgactagcttagtcttgaagttcttccaagcagtgcccataaccttgaaagcagcccgcctgagacagtcctcatgctccgcaggataatcaaagctctccttgaacgttagccaagcaatgtccttctctgcggccggcacgagcttgaagtcgtcttgcagaatactgaatttctgcctccctatgaccccgcagatagacctaaatcggctcaatattttccttggagatgtcggcaaccctatggcgtccaccgctgttatgcggaaccgttccttaggaattttgttccctgtcctaggagtacgtgcccttgaggacccactagttgtcgtcgacattggttcgctttgctgagacattgtctactttcttccaaaaaaacaaaaaaaaacacaattgagtgctacaatctattacaatctattaaccacatttcacaataatttcattaatgcaccacatttcatcccaacatgaataaaccacatttcatcccaacatgaataaaccacatttcatcccaacatgaataaaccacattttatcccaacatgaaccacattgcatataaataaagttaaatgaaccacatttcatcaatcactacaatcatctatcataaaattcataaatgcaccatatttcatcccaacatcgacatgtctcactcacagttcaatcacatatcatccacatccatatttcaatgacatgtcattcacagttagcagaggacggcgcgatggaggactcacctgaggatggccggtggggctcggtggcggtggcgcccgggctcggtggagggcagcgccggtcggtggagacgccggtcggtggagacgccgatcgggcaggtcggcaccgggcgggcggcgtcgtgctcggtgggggtcggcgacgtgggtcggtgaggacgcgggcggcgacgacgaggaaggccaacaccagtccggtcggtgtaaagcctcggtggcggcggcggcgggctcgggggggggggggtcgtcggcgaggaggctcggcggcggaggtccgaatggagggccgaggaggctcggtggtgacggcggcaggcttggcgagggaggacgactgcggcggcggcgggctcggtggcgacggcggcgggcttggcgagggaggatgacggcggcgctagggttctaaggaggcgggaaactgtagcgggacttagaaaaattttcgatccgatctgagaaaccctagttatattagagtgatgagtcatctcaatcgggctttgccgtagaaccgtcacagatgactcatcggtgacgggctccatactaatgcccgattgagatgacattcaggcccgtcacggatgactcatctgtgacgagccctaagataatgcctgatagagatagattaatctctatcgggcttgaactaaggcccatcaccgatgactatttttccatttcccagataagtctttatatttgtgagtacaaaatatatagctgctgtataataattcattttattagtcataacacatttttggatagtaaatgatttcaaatcgaaatatggtcaacaacaaaaatgattctctcatcaagatctacaacttttattttggtcatttatctatataactttgtttctaatagcttgaaattgattttgacaatatgacaaatataatcaacatttgtaaatactaaatgatttcaaatggaaatatggtcaacaataaagttgtcctctcatcaagatctacaacttttattttggttacttcttcatccgacaaagtgatagttatattattcacaaaaatcacatttctctcatctggtttataaatatcaacacagatatgtcaattttgtaaacattggtactatcactttgtcggatgaagaagtgaccaaaataaaagttgtagatcttgattagctgtacaagttagctgtttatggctttcccatttaaagtcatgtaatatttacaaatgctgtttacatttgtcatattgtcaaaatcaatttcaagctgttggaaacaaagttatatagacaaatgaccaaaataaaagttgtagatcttgataacctctacaattttgttgttgaccatatttcgatttgaaatcattgactatccgaaaatgtgttatgactaataaaatgaatt

SEQ ID NO: 65133 - DNA, 70692 bp, Oryza sativa
cggtggaagagcaaaccccgcgccgcgtccttcacggggcggtcggcgaacgcggcgctggacaggagctcccgcgccgtgtcggggcggctggccacgacgaaacgcgtgaggccgacggagaagaacgccagggcggcgccgccaggcacggacctcgacatgtccgcgagcgcacggtgcgcggcggggccggcgagcgcggcgagcgcgcccggcgcgccgggcgggggccggcggcagcgggagagcgcccacgcggggccgcccgggacgagccagagcagcgaggtgacggcgaggagggcagcgaggagcggggagaagaaggtggtggagttggccgggaggaggaggaggtagccatgggtagtggaggcgccgagagtggcatccatggcgtgtgagaatgttggggggaggcaggagggtgcgggcgtgggaaggggagattggagggtttaaatagcgagagggttgtgcttgtgcactgtctcgagtaacaaagggcctgttcactttgatgaaaaaaaaaaattggtagccactatgctaaactaaatgtagccactttttttgtaattttactaaaatttggtaaggttggtagatatagacttttctcttgcatactctctttgtttaaaaaaatcaaatccagataggagtgtaagcgggtttgtccgtgaacctgcttataggtaaaattagtgggtaatatattaatttaatctataaataagtttatggatccacacttgcatctctgaatatggcaagccggaccacgacgtgaaaattcataagttattatctatttgatctataagtgaacttgcaggtcggcccgcttcaatccctgaatctagacaacaaaacaaaactgtattcaaatttactgctaatagtagtatctattttggacggtggatgtacagatttatcattgaagaaaaaaggttttaaattttcattttttaaaaaatggctttgaagaggcaaaaaagaaaaaaaggtctcggatagtagcaatttgccatgaaatttactaaattagtttgtctgtgaaaaataaacgtgttgttcactttgttttatgggatagagtacggctctttgtttggcagcaagagttctttccttgggataaagtattaaacggtgttcatttttaaaaaaatccatacaaaaatttcttttaaaaaatcatattaatctattttttttaaaagctaatatttaattaattatgtgctaatgaatcaatttgttttacatgtgtaagaattagttctcaatttcaacatcaaaacacaacgtaaaagtgttatttgcccttctcttttcgaaaaaacaacatctcctctacacgaaaaacggagcggttcattaacacgtgattaattaagtattaataaaaaaatttcaaaaatagattaatttaatttttttaagcaactttcgtatagaaactttttgtaaaaaaaatacaccgtttattagtttaaaaagcttgcgcatggaaaacgaccgagatgggtcgtaaactggaaggtccgaacacagccaagatccatacccaagtcttgaaaggatgagctggtgatttgtggtgtcttttcatttacacctaccttcttttttcaattataaatagttttgatacaaatcgtttatattttgattataaattatttattttttcttagtcaaaattatatatgtttgactaaatttatagataaaattagcaatacctgtggcaccaaactagtcttattaaatttaacattgaatagtatttgatacaaagtttatcttgtattggaaaatgttactaaaattttgttacaaatttggttaaacattaagaagttttttttgcgaggaaaactttaagaagtttgattaagagtaaagacaatcgacttataatataaaacggagggagtagcattgtgctttattcaaagaattttcttgtatataattttgcattgtatgcacactgacatctagtgatagattttaatataaatttgttggaatttagcaggtaaaaacacaagcattccgctagtgtagaagagaaattggcggttttattttaacgcgcacatataaatacttatattgtccatttgaaaaaaacgtttctattgtcttaaaaaaaattgatgcatgcctcttcctctaccacttgatcattatgtaaccgtccattgaaatcattactcctgctcaaatgacgatcgaaactaaatgcaggcgtaatcactgccgttacgtacgttgcagcaatagcaatcgccaaattgatgatctttcaaaaaatcttctgcctaaccgtccgatgagttgccgttcagtttttcaggtaacgagactgcatggagcccagctataggtctagacgtctcctccctcccgaaataaacatagttataagtttacgtgtccaaatttaatcctttgtcttatttactctcttcatcctaaaatataaggcataaccacttttctctcatgtctcatactccatataagacgtgtatgcatgcatacattaattagcacctcatggtccaataaaattgatttgttttaaatcctataccattaaatctccctatcacattgcttggatgagtcaaggtgatctaaccaagaaggtgattaaatattttcttggtctttgtgttatgagtggttgagaattatattttggaatggagggagtaaattttttttatgattagtattttttattgttatttgattataaaatatgaatattattttgtgcgtgacttatttttttaatatttttttaaaactaaataaataagacaggcggttaaagtttaacacggaaactcatgtttttgtttattttaggacagaggtactactccctacgtaaaagaaagttcctagcgtagcatccaaaataataagtacagtagtgagacaaagagacgaaaataactcattaaaaaggtataaaattggggttggataaagagatactacttcttagggcaaaatgccgcactatttacgtctcaattgtaacaaagaaattttagaggaattcaatcctataaaaattttcctacgtggttatttggataaaaggaatagccatatacaaatcctataaaatttctttggattgacacaaaacataattttggaggaattctaacttgaatttcaatctctcatgaaaaatcatttgcgtctgtttctctctcttctgctttctatgtttgtcatggcggttttttttccccatctaaatattcattccttgaaaaataaatcggtagctatatctcttttctacttcatatgttggttctgcattccatccaaacaattattcttacggttgttttttaattcttgggatttaaggtggtagaccactttaatcatgtattttgatatatatatatatatatatatatatgtgggggaaattacttttagatatatgtaaataggtcactttaatcctgtattttgatatttttaattggaacgaatgtttgcacacttccacgtaagaaaaatataagtgctatttttttgtcatttgttaaaatgatagacggttaatatgaaatgtgggtaatgctagaaagtcttataatatgaaatatgggtaatgctagaaagtcttataatatgaaatgattagttttataaggttacgttcatttcttattcgttgattaaggagaggtaaaaatgtttcagctatatgaattgttttaaaagtaaaatttttttttcccacaaatactcgaaccaaattatcataaaattatagatttaataataaatttatcccaaaactacatgtttaaggccaagtatcacaacactacgaatttaataataaaattatcacaaaattatggattttgggtttaaatccttagctctaatattatgtttgagttataaatgtccaaattttgtgattatattgatgtaaaacctataattttgtgataactttattactaaatgtgtagttttgtaatattccatcttaaatttgtagttctataatatatttttttgttaaatctataattttataatacatcatattgaatatgtagtattgtgataatttacctaaaatatatgtagttacgtgaaattcactcattttttattttagaacgtagagggtgcagttgatcctgtttgaaggtaggtgggccccacgggcacacaatcagctgtcagcatcgcagagcgaggcggcggcgcaggccggagctggccgatgtgtcgagcggcgttgagccgctgactcttgctgtcttgcatgaaggaaatgtacattgtcgctacttctacagttctagtacttgttttctaggtccacgtcgcagaggatgtaattctgctgctgctacatgtctactcgcttcgtttggttgggctttaaattccaaatcctaactctaaactcttatgtgggagaccaactaaaaagtgtttgcctagtattcggaaaaaaaaatggaaaaaaaacaatccataatacctcgtgaagccctaggttgctgtcccgtgtgcgtcgccagcggcaggccacgcgctgtcctcacctaccccgcgtcggccatacgccgtccccgcacgcgccatcagccacgcactgcctgcccgccagtcgcgcgcgagagagaggggtaaggagttgtcttgggatggttaagtggcatttttatgtaaatatgttaaaaaaattcagtttcacctttgtattttttttaaaggaatagctctgctaactccactcccaaaaacagaggatcagcttcagataagttggagatgagagctagagtttaccaaacgaggctgactcgtttcattaaaattaaatctaaatataatgtgatatattatagtattataaatctagataacttctagtcagacttagtagaaaatgtcacatcatatcaagattattttttatgaaataaaatgattattttttatgaaataaaaggagtaccatgactagcctgcactcacttctgagccccaagtgttttttttttaaaaaaacaccacttactctctctatctcaatataaatataaatgattttaactgatttctatcccaaaatataaataattttgattggataaaacacatcttaatattattaatctgaatcttcctgtcttatttataatattattatttataatattaagatatgtcatattcaattaaaattatttatattttgagacgaagaaagtatgtccaggtaacacccatttccttcttcaaacgactactacaataagaattcgcactcaccgttttcttctaaggccagctctcctatcatatcattgtcatacagccggcaatctgtgctgtttactggtaggccttcaaaaaagaatgtcacagggaggtgcagatgattgtgcgcacatccagataacgattactaccatacatataatcctgagcaaaaacatagacatgaacgtgactgaaaccaaggcacaggcacacgataattttggaagattcaggcatacgatttgcctcgaaatttaagcgacaggatcatgatcccaggcagggtgtttgccacggagtcataggtacgggacatgcatagagaatgataaaacaatgggggttcccagttctgataaacaaggatagcggtagacttccttcttcatccggtgctacagtgcaccaggatcactccttcagtttccaccaaagaggtagcccagggaagatccaccaccaggggcagcatggaccttggtcgaagggcgatcctgcgaaatgacaatgaaattgccagagagaactataagtaagccccatgaatcagaaattattcaatctcatactgcaaatagtggataagtaactatgtttctatctcagtgtagactgatcctttcttaccagacaccaaccaagcattcacaatttaccagcagacatacgtaacatatgcccaaaaggaagagagatggtttacaaggacaatcaagtgtccaaatcatacctcatgcataacttcgatttgcagcataaagatcagcatgtgaaattagcaatattcaggactaaaggctaaaatgatcaagaattactcaattgtccattctggatgtggaaactagccaattcattcaatagtattataaaaaagatgcccagcaattaaagaactgagcttactgaaagtatatattgataataacaaaaccaatttgaaagttgatgtataatatttttttcaaatatattgccaacaagaagttacttccagaaaaatatctaatggtaccacatttgtgacactaaacttgcatattgtttgactaactgttggccagaacttacaagttctgaatcctgaaatgccttgacccattacaaataaactgtaattctgatgtggataaaaggaaagaaccgtaccgtaagaaagtttccagtgttctggccatcagctctatggtagttgttattgctccggctgccctgaatcccagctggaatctgcttggtggcatcagcctttgcaggtgatggtttctcagcaggagcagccacagccgcagctggtgctggtgctggcgctggtgcaggtgcagctgcaggtgctggtttagcagctggcttaggggcctcattgcctccaaaaaggtaacccagagaactttggccaccaccggcactcccaccacgactcatcttgattgttgatgaagtgaagctgagcagaaatttaaggcaaaaatattaaaactcaaattttcagtactgcaaggaaagacaaaacaaagttgacctgagttcaacttatgaaacatgataatgatcataaagtttttgatactttgatgaacttatgcttctgaagaaataaaaagtttttcagccaaactaggatgtactggttctatatcaaacggtagtttcgttttcaagctgcacccgatggctattagtattttgatgatgtggcacattctccatccaagaaagataaattctttcactactttacatttttattggactgaaacaagaggatggtaaccagagtacaagactaattcctgttgctttccattctaactcttgttctaatgttcaaccattttctgcccagcaacatatagtagcatgtgctcaaatcattgggagctccagtgtgcagtgagatttctaatcatgcaagatagcatagagcagaactctaacaaaaacaacagtacgattgaccaaattattagaataaaccaataaaaaaatcaccaagctattttccttggttaagtttgaatttacctagtgagaaaattaaaaaaaaaacagctataaagatgatgaatacttaattcatagcagaaattatcaacacaaaaaggacaatgcttcaagcacgcaagtgtatatgcttcttaacttgttaaaaatgttctgtgaatctgtatatgttccgtagcaagctataaagagattagttcttactaatagaacacagcaagcatgcagcagctaaacttaccttgtgtactaactttctattgttaagagaaataacttttctcgtgttaagagaaaatgttgtatgaaccatcaatttccaacttacacgtcaagcataaaaggtggctataagcacctagatggtagtttgctattcatgaagtataaacaacacaagaacctttacgctctggtgcgtttactgctcaacattgtgaagtattacatttgaaagcaactttctattgtctataagtacacagacagcaacatcactaccaagtaatttgtgcaaaacaacaagataaccaataaagaaagatcttccgtctccactaggcgtctatgccgctagaaaacagtaggtgacgctcatgtgacgtttattaagacgttcatgtcacgcttactagatattcaaatctaactgcaagatcaggctcatctgaacgaccacaccgttgcaaatactgacgtacatcactatgtttcatcaaagggatgagatcagcacagaatgattcaggaaatccagtccaatcggaccgaaaaactaaacaaaacagatcgtggcatcctcttccaaaggcctaaaacaaaatccacaattctacacatcacacagccacagaccatacaaggacccatcagaaatcgtcccacaaagttagcttccgcagccgaatctcgaacatacattccactcctcgctaatgctctccacgcaattcctacctaccaggaacgcacagacgcagcacaaacaaccgcccaaaagcacggtgggcggaaacgaccctacagacgaacggatcacgccgtgcgctacctacggcgagcgaaatccgccaccgatccagcattgcccgcgccgaacacccgagaaaaagtaaaaaaataaaaaaacaaagaaagtgggggcgacgggatctcgcaggaagatccgggccactccacagcgcagggatcaacaggaagggggggagggagacggatcagcggggggacctcaccgacgaggaggcctgcgtgcagacgggcggcggcggcggcgaggggggggggggatttggggattgggcctcacgcactcgcaccctgcgcccggatccgttcgaaatgggggaggagcgtacgggggggggggggtgggacgtcttgtataggcgacgcggggcggggttgcgggacgggtggccgtccgatcgccgcgatggacggtccagatgtgcaggcgccgacagttgaggcaccctctctgggccagcctgtggctgtgctggtgcgccgacgggacggggacgcgtgatgctcacactgtgctgatgaaaggaattgcataccgtaaccactcacgctcgctataaataataaagattcgcccctatttagctgcgtgtttgatgtgtaatgaagagcatctttgatcaccatgtacatgatttttaggtaatatggtggtgtttgaatctcctgaagatgagataaagattaagtgtttcacaccaacgaggtggtaataacgtgtgattaattgagttttaattattacaaacttgaaaaatggattaatctgatattttagagcaactttcatataaaaagctttcacacggaacacatcgtttagcagtttgaaaagcgtgccacgagtatctaaactttaatcatatgcttgcagaagaaacgaacaggatctatattgtgctcggccatatgttctcaacccaaacatttccaccgtggaagactactatggttgatggatggggaaagtaattacgtgctcctgttttggtgaggtctatatgatgattctgttttcgtattacttaatttatcattcgcccctttaaaatattccgtacaactagcaccgaatataaaaaaaacttgcctttttctttttagttaaaatcatagatattacaataattggattgtccgttctcctcattctctctacttctctttttctctcctattccaacagggaccaatagtggtgatcaggctacaataagcgtggttagtagctagcgagtacaagcaatgacaatgctttttgaattgccccattatcctcatagtatggtcgtcattgtgggctataagcctacaactagtgtcttgatcctcgtgccaaagtgattgtagtatcttctatggacaacgtagttgcctaatctatttcatgcgacctcttcatcaatgtccccgtaatcggttcttatgtcatgtagacctcgataaagtggcaataaacatagaagtatgatataatgaacctctagagactaatggtgggaacatatgatggtctggtatgatcaagatgatagaaaagaagggaggggaaagagttaaaaattttttaccagtaaaacaacaggagaggctcctactgtgatatattaaaaaaatatatagagaatatttacaagagagatttacagggggagcatcaattacagttgatcaatctatgactgccaaatggagatatcttgtctttttactctatgcaaaagtagagtaaagtcctctttgaataaacagtctcgtttgttttgtgaaaaataaaaagacatgaatacttaataatcaattaaggtatatgatatttgtgttcaaaaatataaggaataacataccctcaattttaaggaatgaatgaacaaattgtatatactcaatgaatatagggacaaataagaaatactaggaaaaatagaaggaaatacttaattccccttgaattttatgcatatggtaactctgttccctgacctatttcatattctcctctgttgggttggctttgggtttgacaattgatatgagcagaaatatgcaattattaacttagcctagaaattacaaggcttgatagctatgttcttagctaggttatttaattattcaaataaatggctggactgtgaaaccgctgacactggacaaccaaccaaagctgaactttgtgtcgaactagtaaccgtgcacgtgtaatgcacgtttatatcaaaattatcacttcaattccatttattgttataagcaataaacttatttcaaaccattgatgtttacatgaaacataattgacaaatgaaagtgacaaataagcaaaagctctcgttggtccttttgtttcactaccatttaaaaaaactaagtttcactactcacttcatttgaacaaaattttgcatgtggctccacaagtttagtttttgcaacggattccctctaaaataagcaactgtagaaccatcctctcgccgtaacaatctacaaccaacagataaaaacaataatccgatttaagctaatcaacatatatgactgttagtttatctgccagctctgtccaaggatgaatacctcaatagtacacaattattctcattgtgcatttggtttatggataggcaaaacactacttctgaagtacatgtgtaaataccttgaaaaatggacacgcatagcacaatcatttcactgcccatattatagcttacaagtccacaaaattatataccagagcacagcagaaatgcacataaactatatagtttatgatcaaatatggtgaaaaaaaaaacatactcttccagtcaacccaacttgaagaggaatagtataatatatgcatacattccatcggtgtccaaactgaggtcgaatcacccatcaaatacggctagaattgattaattgaaacattcaatttgaaccatgaaagatatccatattcttgtgggtcaatagttgttaacgtccattattcaaagcttaattccaagatggttagcttcccctgtaagcaacaaaataattcctttataaccatttcttcaaatattgcgggagaacttcggaaccatacatacttttgttagcataaattggtttgaactctaaaacatcaagtaagggtctgtttagttcgcgaaaagaaaatttttgggtgtcatatcggatgtttgaccggatgtcggaagaggttttcggacacgaatgaaaaaactaatttcataactcgcctggaaaccacgagacgaatcttttgagcctaattaatccgtcattagcacatgtgggttactgtaacacttatggctaatcatggactaattagcctcaaaagattcgtctcgcgatttcccccctaattctgcaattagtttttctttaatctatatttaatgctccatgcatgtgtccaaagattcgatgtgatgtttttgggaaaaaaatttgggaactaaaccaggcctaacagagacacatagatttttgttttcaaattgtctagatatcagtgaagcaattgtaaagacacttcttaaatttgttacaagcagtagaattcgtactaagagaataataatttccactatgtttaattgatctaaaatgctgaacactttatatcaattaagcattgtttactctatctatctgctttcctatttggcaaaccaaaactctgaatttgatcatgaacagtcattaagataggtctatatatttttcttgtttcgaactgactacagttttagaggtgaaagcttatttgaagagaagtaaaaaaatttgcagcaaatcaacaaagaaattaaggcatgaattaacagagaatgcaagaaaaagaaagcatgtgcgattcagattgacgatttggttgactaagtgatacgacccaagtaggggtgatgtcccgatctttacggcgtaggatcaagaaccgataactagcctcaaagagaccaagataacttagctgcaaacagccaagataacagtgcaacctgacgatcgtactcgaagccaaccaccgtctctattacggcaacctgaattgagggttcgcccaaccacactctaagttaccaaccaacacaacctggaatcaatcaaggaaaaacctcgaagggaccaggagcaccaattaggggggcgtcgaatgtcgtttctgtaatctcacaaggaaataacaggagcaaaggatctctctgtgaatttgttagcacacaagtgaactctcatttgtcaaaagtcttccaaatgataaaacatataggatatttatactaagaacaaccctcctagttgggaatgaaatgtcttgggaatttactagacataagctaggtcaaaagtcaccataagtgaattcccaagaggactcgcacgtctgtttgtcttatgagcggtcttcaatgatttgtccattactctttattggaaagtccatttcattggttcgtttttcactgggctggtccgttttgcactgaactgctccgtttttgctggtgcgttttgtaatgcactgatctgatcttgctgctccgtttcatcctccttggtgaacctgagtaacagtaaagtgcatgacttaggcaatatataattctcattaatattaaaatatgtttcagctaggagcgagtttacctctgcacggctacatgttatcgatccttgaaatgatggcactagtccaattgatggtttatgttcatatgatagcaagggtagtgcacgattacgttgccttggtgtagttgtggcaatccgagtcaagtctctatctttaagcacagcgatatgctttaacccacaatcaaacaagccaagtagcagcctttcttgatgaaaacaataaggtttgtagttaagcatagcgttaaccttgcattgatgcgcaacaatcacattatgtgtgaatggccttgaccggggtgtatcacgaaatctgtgatgttgccctccatggtaatctgttatgctaatcagtcgaaattaatccataaattgactggttagcacaacaattacggtacgggtacacaattttgtgtaaggcacagatccatgccaggacaacctctcgatgtcctgttccaacgtcaactggtcctggctcagcgcaacatgaattggatttttcattttggggaccctttttcaatacatgttaatgatatagaagtccatttagactccccctcctcatcaatatagaacacctggtttgcaggaaatgtcataatgtaaggagctacctaattcatagaaacatagtcccaactttaagttgatctatgggcatgcgaaaaaaactgaagagaagtgtattattctacataggaaacataatatgcggcagaataaaataaaaggaaatagtgataaaatagacagtgcagcataattgaagaaaattgctcaaagataatgtgcggcagaataaaataaaaagaaaatagtgataaaacagactatgcagcataattgaagaaaaatactggattaaaattataagcaggttttacctatgtccacgaacttgtaaagcgtatatcaaggttcctaaacttggtttattgtgtcatcccggtccaaaacctcgtttgaccgtggtcttgcccacgtggcatgacacgtcgaagatgacatggcacatttttatttttccttttttttcccttcttcctctttcatttctctttctcctttggcctcttcctcctctctcaccttccagccaccgcttgctcccactttgacgctgtcgcctctgcctcctctcccttgccgccacaaccgctgccagcagctgctgctgcttctcggccgccaccactgtctctctcgttgccgcctgtttcttctttgggaaagtcaaggaagaggtcctccgcagccactggcgcctgcctcctccgtcctccgtggccgagtagaggggggtgaataggcggttttaaaacttttggctaaaaccgagttttgtatatggaaacgtaaatcaatacggttttgcacaattcaaaacctcaatcaattagtctcaactatgtgcacaaagtagctatcctatgttgtgatttgcaagccttgggtgataatagcaaaaataaactctagtatgtaaatttgcacaaaataaaggagacaagtgacaaaggatttttccacccgatgttcagaagcttgtcaacctcctacgtcactgttgaggtgagtccaacttcaccgctcaaagcctcaaaccatgaagccaccataagcccccttcgtaaaggggtgggcaaggtgggagccggcccatggagtggtctcccaagcctctatcactatggttgttcttcctccactccgcagatggcaaacaccgagccactcataatcaacaccgggcctcctccacaaccttctcggagaggtcaccgggcaactcctccaaaccgtctaggaggtggcaacctctaagagtaacaaatctaagatgcttgccgaagatgatcatgtgtcactctagctctaacaatgaagcaatgcacttggattggcttaactcactctcaaacacctcactagataaactaagtgcacaagggtgtgagagttcttgcaaggattcaagataatgcaatggagtgccaaaaccttacccttgcagctaaggagtggtatatatacccccaatcactaaaattacctgttggaatcgaaatccccaatttatgttgcctgcaggtctgaccgacatagggtggccggtcaaaccgccgatggttataacagctagaaaagtagcagttacagggcattaaatgcacaggcagcagtagaactatctgaccgcattggccggctagttagagcacccgaggctcggtaagaccgccagggattcggtctgactagcctcggctctagcggctctggattgacaagacgagaccttcaaaatcagggtcagaccgccatgagagcctcggtcagatcggacaacaccctgcggtcagaccgtagctcacttttcaacacaaccaaccgttagtaaaacgacgttatctcttgactcgggtttcggaatctaacgtttttggactctatggaaagattattcaaagggctaaccaacccatgaacaatccatccaagaaatacaactttttccagggataaagggctaacactccaaaagatactccactggacataaccacattaggctacccaaacctataggacatacccacttctctctttgtttgggacttgacagaactcatcacacttggccagacaagaccaccaaatgcacccacatgcatatgaactaatatggcacaagatcatccacatactcacttcatagacccctcttgatagtacgacgcctatctagcaaatccagtctacaccaaacagcaagactgggaaaagactaaaaaacaatcttagctctattatacctttgccttgtgccatctaacttggtgtcaatgcttgagccaagatcaacacttatgaccatttggttgatccatgtttatgccgaggtcttgaccatcctttgtcaagacttttcttgtcatcagaagcttgacttcattcttgtcaacatggcgatgtccttggcttagtgactatcaacccatgatgtcatccattagcctcatcatggtcggaactattcctttgcacatctcaaaggagaacattagtcccaacaaatcggttgtcatcctccacttgatgaccaaccggttgcatatgaaatatatgaatatgttcgttgagtattcattaacaccacaagtgtcatatactcgtgcataagctcaagtgcaaagattcaatataaataataggtgaacatggatctagaacatgtgcaataaatgtataggatttgctcgccctaaatatatgcatacaaataactatacaagagagacaagtgtatgtataattaaagaagaaccaatggggtctatcctatacacatgaagaaggcatgtagcaatgataaagtaaacaaaaaaacataccttcatgatgtccatgtctcaatgtaaaggagactaaataagataagactcaagtaaacattagtctcacacttatataacaataacatggaaatgatatatatgaacctatcaaaaagtaggagataagaagtgatacatatcgctctatctccatgcatttcatccttatcatgattaaggtccatcacaaaagaatacatatctaccacatttcattatcaggaaataacctagttgacaacttatgtaaaagagaggttaatcccataaacattggtttatcatctatcaccaaagcaacaattacacaaattgtttaatccaagatctttcaatcttttctctctttggtaatggataataacccgatataaacaatatagagagatgagatgaaagatgattttgaatcaatgtagagatcttataataaacaaaatatagcataagctcccccctcaagatgtgcatacatatggatatgaaagaacacatatgcacataataaatcagaatcaatcaggagctcacattatattttggatccacaagagagaccaagttagaatatgtgatgtttaatacatacctctcatcatttttattttcatatccaaatgagactagtcaaagaaaagctcataaaaactctagtctcatataattaaatttgtcattaatcaccaaaactaaattaaggcatttgaacttacacatggccactgcatactttctctggccagatagtaaagaggaaggttgcagatccacgaagaggaggaggagggcacgcaacaacaacgaagaggtggaggctgcggcgtcgacctagggtgcatgcggtgacaaataggaggtggagctcctggctgccatcaagtggagctagagaaggagagaagggagagagcggggagctcgtggtcaccattgtcacctctggcctcgagcttccgctccatcgtcgggccaactccgccaccggtgcctttttctctagtggctgacgccatctctctttgcctccctctctgtgtgtttcttgcccatcgccgccgccgctgcatccagcggtggaataagaagagaaaagaaggggaggggaaaaaatggaaagggggaaattttgccatgtcatcttccaagtcgcatgccacataggcaagactatggtcaaacgaggatttggaccgggatgatacaataaaacaagtttagggacgtcgacatgcactcgtggaggaagaagagaaaagaagggagggtgaaaagggaaatgggaaattttgccatgtcatcttcaaagtagcatgccaagtagacaagactatggtcaaacgaggatttggaccgggatgatataataaaataagtttagggatctcgatatgcactttgcaagtttatggagataggtgaaacttgcttacaagtttaagcaccgttggtgcaatttactcaaaatactgaaatataatatgcggcataataaaattaaaagaaaattataaaaaatatctggaatagactatgcgatagaataaggtcatatggtatatggagctcagatggatccagtggggttgaatcacgacagatcgtgcgaaggaggaaggattctcctcctcttcatcgatctccggcggcgaccctcctcgatgaagatggaggaaggatcctcctcctcttcctccatctcctgacctcgcccgcttctgatcccaacgatctcacctgcttcgggatccagtgggctggaaaatcgctgaaaacctcttcccggcgacggcagtgtagggggcccactcatcggtggtgcggagcttctcctcaatcctcaatccagctcgtgctggatggtgctccaccacctgcggtcgcacaacggcccttcatggagactggtcctcaaactccaaaatgctccgatgaacggccaaatctcagcgagtacggcagtaggagaaactagggtttcggagcgagtacgacaacggggaaactagggtttcagaaaactcgaaagcgcgggagaaagaggttagggtttagcaaagactgaaaataatcggcgtgccattcgcatgtttgctagatagcctatatatacttatcactcaaaaatactatatgaaaaaattagtgtgctcattaatttaaaatatgcatatacttcttttcttatttcaaattttagagttttcataaaatatttttaaaaaaattgtgaaccactattttagttttcacaaatggacatatatgatattaaaaaaaattatgtatgtatgtataaataatttagttattatgtatagtagtgaaaaatatatttattataaaaaaataaagaacttgtatgccatgtcaagcaaaagtacaaaatttaatatgtcattttatgcataaattttgatgaaatccaaaaaaaagtaaattttaagattcatcaaaattaattggttcaaatatatttgcttgtggatttgaatatttgaaagatcaatcatttagtatattcagagtttttttaacatatgttgtgtaacaacaaaatacaatcatttttttgttgtggaggtattaatgatcatattccgtgatataagaaagcaaggttaaccttctttctttgtttgttttgaccttctttctttgtttgttgtgaatttttttttttgcataataatttcgggttactttatattctagagttataggagttataggagtagtaacgagtatgcgtagtataattaaagaaggagaatgaatgtaaatttgttgttttagatttgttttgtccttcataattttgggtttaatatatatatatatatatatatatatatatatatatatatatatatatattctagagttataggagtagtaccgagtaggcgtggtatatttatagaaggcaaaggagtagaagttcgtgtgattggaaatagaagatagttttgcaagcctctggaatccatatgtgatatttttatctagatttttcctcacatatgattgttagctgttttttctctagtataaatttatgatttttcttcaaagcaagagacgccacgtggaccaatcgaaagctagcaaaaagagccagctttagattattagatgcgtgaaggagggacacgggtacggtgtaaagtatatttataccacatacgggatacggcgtaccgtatacgtgacctgtcggagtccgcataccatatacgtccaattgttagttgggccggggcggtgagatctgacacaatcgacccattcctttaatacccatgtatgctgggaataagcccactatgagtccctcaaatatatgtccaatttgattcgtatccctcaactgcaatatcggatatcttgactcaacaaatataaaaaacggtgtaatttaaatctcaacggttttgtgagcggatttcgctgatatggaacgttgacttggtccgcctgtgctcacatggcaaccctatcacaaatttagtagggctcacaagtgataagggaaaaaaactatggggcccacatgatgacacgcagcatgagctctcaaccttgagtagcgttgaacgcgttgtgcgtcgggctcgtcaccgccagctcaattagcactgagaatagcgtgggatatctagtcgtggggaagcaaagggcccctgatcagccgtggagaagcagaagccaaaccctgacacccctcttctcgttctacgctactccaaggcctcgctacaccagccccgtgcactgccgggagggtgccgtcctcctcatagctaaagctcttgccgtagtgagatcaagggagaagttggtgctcgctagctccctgtttgcccaccacagtgccactgccacctgctccaccccggctgcttctggtgttgttgcttctcgcatgctagatcgagggcgtcatctggagctcgagcccttcgtcacggcgagcgactcggagtggacaggggagatcacagtggcgagtgaatcggtagggatgtgatggaggtggtgtgcctgttggaaatatagtcatatatcggcatattttaatccaaaatattaagacaataatcatggcatgaacaatgtggggtgatttagtgataaaatctaacataaccaggagcatacttaagatataataagcatcatcatcatacaaagaacgcaatagaattgcgactaacagagatatgaaaaaaatgaaataacagtaagcgaaggttataccctgtgaatgtccctccgctggattgtgaagcaaaactgcctccgttgatgttgtcgttcgcagaggctccggctcccggcgcgccatctccaggtgcgggagcagcagcggcggcggaagacatggtgtagcagacgacgacgacgacgaacagaagacgaggagcagtcgtgcggaagcactccccaaaaacctgatcactcgcctacccggtgcagatctcgggcgaaggtgtggttccggaggccctgcttgttccgatctctcgtgcacgcaagcgatcagaagtggggaagcagaacagtagcagcaccaggcgcgcgcgaggaggaggaggaagaacaccagatggaaagtaagcagcggaatctgatcggattagctctttccttatagcgcaggagcgatatccgcctgttgccgcagtaacgacgcgagatcaattggaattgaatcgcctgcccgttacggaggcaatctcgggattggtccgttgcaaaagacgccacgcccatgcccacggcctcggcccggcctggccggtcggctcggctccgcgcgcgcgtgcgtgtggctttctgatccccacctcaaccggtcaacagggagcctccaataactccctatttaagttgagatactcctcgtttaattcccaaggtggtattattgtccttaacatttattatgggactttgacatttaatagaataaatcgggcctagcctatttattccaacaatccccaccaaatttcatggctcataagaaatgttctcaaagttgtgcctttttgatataccagtgttttagtggagactgttaagttgaacttccacctaggaaatgagctacatcagaccacaactaaacaatgaactatgccttgaattgtcagtcatgtgtgatcaagtttcactcaaacccttgactggtactgggctgccgttcgcatcccctctgtttggagcatataagtcaaactccaggccctttcatgagtatctagagatcgcccaaatctcatagattgtgactagcagtcgaactcatataggtgtgttccttctgagatgttctgcagatcaacatctctgcttagaaaagccactcggatcacattaaggcataagccatcctaccatgcaggaaagaagagaagtacaacatgaaaattagcccttttcaagggtctcttctctaagccacacaatagtttgtttcgccatccaaattcacgggatctccgatcacaatggacaggtttccactattgtgcaaccttaggtgggtatcaagcccatttcccttgatgcactgactatcacattacgtggtagccccttggtaaacttatctgccagatttttagccgtttggacataatccaatgctatcactccggagtttttctgctttctgacatatttcagtcttctcttgatatgcctagatgacttcatattgtcctttgaactgttcactttaataatcactgtttgattatcacagttcattaggatagctggcactggtttttcacccaccggcaaatccatcaggagttcacgaagccactcggcctcaactgtcgcagtatctagtgttgtaagttctgcttccattgttgacctcgttaagatggtctgcttgtaagacttctaggaaacagcgccacctccaagtgtgaacacatatccacttgtggcttttatctcatcagcatcagatatcaagtttgagtcactatacccttctagtacttttgagtacccggtatagtgaattccatagcccatagtgcccttttgatagcacattactctttccagagcatgccaatgatcatctcccggattcgagacaaaccggctcagcttgcttacaacaaatgagatgtcaggcctcgttgcactagccaagtacatcaatgaaccaatgatttgagagtatctcagttgatcccttgctattcttcggtttttccttaatagcacgctgggatcataaggagtaggagctggcttgtagacactatatccaaagcgactcaaaatcttgtccacttggtgggattgcacaagtgtaatcccaccctcatctcctcttagtagcttaatgttaaaaataacatcaacctctcccaaatcattcatttcaaaactcttggacagaaaatacttgacctcctcaatcacattgaggctagtcccaaagatcaatatgtcatcgacatataagcacaagatcactccttctcccccaccatagcgatagtacacacatttgtcaacttcgttcacaacaaagccaacagatgtaagtgtggtgtcaaacttctcatgccattgcttaggtgcttgcttaaggccatacaaggatttcaacagtttacacaccattctctcctgaccttctagtacatacccgtctggttgatccatatagatctcctcctccagctctccgtttaggaaagctgtcttaacatccatctgatggacgagaagaccatgagaggctgccagagcaagtagtactcgaatcgtggtcaagcgggcaactggtgagtatgtgtcgaaaaaatcctcgccttccttttgggtataacctttggccacaagccttgccttgtacttttcaattgtaccatcaggcctaagctttttcttgaaaacccatttgcatcctacaggcttgcacccatatggacgctcaacgacttcccaagtaccattagacataatcgagtccatctcactgcgtactgcttccttccagtggtcagcgtcaggagatgaatatgcctcttctatggttcttggagtgccatccacgaggtatacaatgttgtcatctccaaaggattttgcaaccctttgtcgcttactcttacgagtatctacaatgttgtcctcctcaggatttccctcaggcgtttgatcattgtgttctatcggtgcaaagtgcttatggggtatgacagtttcttgactagaagtgctaggtgtatttttcatggcaaattcattgtcaaagaatgtagcatctctggactcaataattgtaccaacacgcatgtcgggtactccatagtttactattaagaatctataacccacactgtgaatagcataaccaaggaacacacaatcaacagtattcggtccaagtttatgctttttggctataggtacatttaccttggccaaacacccccatgttcgtaggtatgagagatttaatttcttcctttcccattcctcgaatggtgttacttccttatgcttcattggaattttattcaggacatgacacgcagtcaaaactgcctcaccccaccattccttggaaagccctgcagtgtctaacatggcattcaccatctcagttagagtacggttctttctttcggccaccccatttgattggggtgaatagggaggcgtcatctcatgaataattccaaactcttcgcaaaaggatgtaaactcattggaaaaatactccccacctctatcagacctcaaccgtttgattttcctttcaagttggttttctacctcagctttataggtcttaaaagtaacgcaatgcttcatcctatgttttcaatagatacacataacaaaattaagtgcaatcatctaacagtgtcatgaaatatttctttccccctttagtcaacacgccgttcatttcgcacaaatcggaatgaacaagttctagaggtgcaaaatccctcgcctcagatgccttgtgaggctcgcgaagttgtttcgattgaacacaagtatggcacttagaacctttgactaaagtgaattttggaattaaactcatgttagccaagcgtgtcatacaaccgaaattcacatgacagagtcgcgaatgccacacattggactcatcattcttgctaatatggatcacaacattattattattacacacgtcatccaaagaaaagcggaacaagcctccgctgtcatagccttttccaataaaagtttcatatttagatacgacacatttattggattcaaacacaagtctaaaaccttctctacacagtagagaaccgctaactagattcttctttattgaagagacatgttgcacgttcttcagctgcacggtctttcccgaagtaaacttcagatcgaccgtaccaacaccgtgaacagccacaagtgacccatttcccatcaacaaggagaaacctctccctacctgataagaagaaaacagggaaatatcagcacatacatgaatattagcaccagtatcaacccaccaatcaggtgaatgaaaaacagagagaactgtaggtaataatttaccgtaccccgatgttcctctgccctcactaatgaccatgttggcagacttcctgtctttgcgctcaggacagtccttggcccaatgcccagacttgccacacacaaagcagtctccctttgcctttcccttgcctttcttcttaaaattggttgtagccttgggtttcacatcagccttgactttcttgttgttgtgggatgcatgagggttcttcttctgtaacatattggcactagaacctccctcaacctttttgccccggttgtcctttgccctcgccttctcttcaacacccaaagagccaatgagatcagaaacactgaactcttgtctcttgtgctttagagaagtggcaaagtccgaccaagaaggtagcaatttggcaataatgccatccgccacaaacttgtccggcaactcacagttgttgttctcaagttccttagccagcatctgaatctcatgagcttgttctactatagaacggtcatcgaccatcttgtagtcatagaactgctccatggcatacagctcactaccagcgtcggaaactccgaacttggcctcaagtgcatcccacatgtccttccttgaaggcatctgcatatacacgtccactatgttgtcagcgagtacactgatcaatgctccacggaacaggcaatccgaagcctcaaacttaacctcttcctcaggagagagaggtggttcacttcgtttaccccgtatgatgaggatgttaggtcccgatcttccaataggtattgataaacaatcgatttgggcggagtcgcgacacaactcgatctggcttctgaacgaacacgctactgagccccgcaatcgcagcaccacgtctcctctggttatcaaccgtgccgaaaccaggttgacctcgtcgagaaggctaatccctgcatgcgaatcgaagaacacaagcaagaacaagatagattgcaaccaaattgcatatgaatgattaagcacacgaatttggggttccacaaaccgatctagcggcgaaactgttcttgacagaataatctaaggccctctttgtttaggcttgggcttatttgtctagacttttaagtcagcttattggcttatatgatttataagccagtgaatttaatgtcctaagtttagtggtggagtcatacatctatctcatataagccaaaaaagcttctccaacctagcttttggcttaatagtgttagagtggcttatggcttcaaaaaagccaaatgaaaaagctgcttgtttgttttggcttagacttttcgacttataagttgacttataagcctaaacaaacagggcctaagaaaaacccaactctaaacgatgactgctactgaataaatgtgattagggatgtccgagggttgccctagggcacacacccccttgggctaagcccacgacacaattacaaggcccaaaacccaaatcagattcggactggatgagatacgtgacttgttttgcatattcccggcagctcggtaggaatttcaacgtgggaccaaaaccatatgaaagtagactccataagctttccaacaagtactcatgagccccaaaattccttctagatcagcggctaggtccgtttgaagttgacgctgtcaggaggcctaaatccgaatccaaaacgtatacaatttgatctcttgtcttctatgggccaaaagtgacgtggtgaggtagaagtggacttggagaaggtcttggtttggtccccaatcaacttctttaatcatccatgcattagttacgctcggtctcttttccttcgcccaagcaagtacctctgcaaacgaaaacacacaaaattcattgtgtagcaacgtttgttcaaatatataacatgtaaatctaatgtagaacatatgcatatttatttgattaatacataaggtagtcatggttatatccgagctagttatgtcctcatcatcctccccttcttgattagaaaccgtcctcggtatcaccttttcatggagcgtattgtacttatctttgtctatcacaacatcctgtgcggaacatttcttgatggccatatgattggatcctaaaatctttgtagtcgaaaaaccacaacactccccttcttccaaaccaacctgtaagtcatttaactaactagaggaactagatagagaattacttatatgcatgcggtcctctagacaatatatttcatcatgaaaaagaggtatagtcaaattcgaacaaatatatactcgatgcacattatattctcctttattatcataattgccaataatatgaaaaatcacatcagaagggtatggcaattcaaacctagcaaataatttcttctctaaacagttgagtggacaaagatcatcaaattgaatataaccccaagtatttaaagaagatagcaatttaagctcttcattcttgctagcaatgtgaataacatgcttaaactcaacacatagtggcttactgtacaactaacatgttcattcactagttatggcatggatataagtgaaacatcgcacaactcttctttataacaagaaacataaagcaaattattttgtgacaaaggtattctaacaattgtttccactatgggttactctaatgtagcacaagtagtggacatagttggcacatcataaatatgcataccttgattagttgtagcaccattatcattaccttttttctcatcttcagaaattataggcgcttggtcaattagacattcctcaagcatgcatggagctatggataagtctttttgctctccgtctttcttctcttccacctcaacatcttcaacgtcggaggtgcagatgtagcaatctaccgtagcaacgtatgcccgttgactagggcaaatcttctgcacatggccaaatccatggcagtggtggcaccgaattctggacgtgcgtcccgtcgaagcgatagatgaggcactcttggtggatacctgcgaagaacctttacctgaaactgcaggtcgtggggaaggtggttttggcgctgcagaaactccggacgcaactggtcgcttgctcgctagtggggtcgtccagaaagagatgggcttgggaagccccaaagatggctttgctcgcggtatgtatgtgctcgccttattcttgacctgttgatcacgcccctgcaattccttcactgcaagcatagcaaactgaaacaactggttgacagtgttaaattccttattatctactatgtcctgaatcttgcgcctcaatcccatgtaaaagcgacaaatggaatcctcagttcccttcactatgctacatcgcatcaatcccttttgtagctcaccatagtaatcctgtacagatttatccctttgctctaaacgcatcagtttcttgcttaaatctctaagataagatggaggaacaaatatatcacgcatagctaccttaagttctttccaagtagtaggtaaaattccatcatcagctaacctagcccaccacatgatagcaaaatctttgaactcactactggcttgtcgaactctatgttggtcaggcacaaggtgggcactaaacttttgctctactatcatctcccaatcagagtatttctcagcatcataataacccgaaaaagatggtattttaaacttaaccttagcataaggatcatcgggcacgcgattattgttaccttgttggtatcgctgattttgagcgccacccatacctgtcatagcaagcacaaaaacagcaacaaatagtgaaggttatccctaataatctgctacgcggtgtagtggtgcctctcaacaactcaggtaaatggagcaccttaccaagctcttataagtgtcttaccagcaatgctaaggacggtacaactggtggctggttcgtgacaccttgaagcatgtgatgtgacgattgcaaggatcaaagtggtgctgaccagaagtatatatgtggagcttgggaggcacaatatatagtagcaaaggaacgcaattgtactaataagaaaatgcaaagttgaataatagttcaaagtactagtcaatgtgctagcctagcctagactcaactctagctcaagtaagcacccgacaacactaaggactagatatgaatcaatgtacaactttgcactctcaaaacatactcagagaatgaatgattttttttctttcttggtgcggctttttttaagcacatttttgccttttttttcttttttttttggtgcggctttttctttcttttttttctttgcacctttttgccttttctttctttatttatttttttacttttttttcaacaagaacttaccactgactttgaacagggactcaaatgtaaatatcaatattacatggactcaaatgtaaaatgcaaaactaaaattagatcatctcaaaaatggaatgctccaatcttccatttttataaaaatatctcaaaaatagaattaacatgtccattcattagttgtggcatggatataagtgaagcatcgcacaactctttatcacaagaaacatcaagcaaattgttttgtgacaaaggtatttcaacaattgtttccactatgggttgctctaacatagcataagtagtggacatagttggcacatcataactatgcataccctgagtagttataacaccattatcagtatctcttttctcctctttagaaattataggtgcttggtcaatggaacattcttccagcatgcatggagctatagatagatctttttccacttcgtatttcttctctttctcattaccttggttattctcagatgcctgcaaaatattagtgtccaaaacaataggcacaaaaatacgttcgttttgtaattcagacttagttgaagacatcacaatagcatctttcttggtatctctgaaaatctcatcgattccattcttcatcctttgaatattattttcgaaaatttcagtaaaactcatgggtaccaatttcattttccaaccattatgtctaaatgtgcatgtgttagcaacaaaattatgcgatccattattatcatatacctatggttgaccaaacaacaaagaacatgcttgcatagggacaagatcaaaattgccagtatcatggtaatttccaatcgaaaagtttattctcacaattctatttaccttgaacttaccacaaaagttgaaccatttgatctaatatggatgatgatgcggttgtgtaggcaactcaagtttctcaaccaaatctgaactcacaaagttattgcaactctcactatcgattatagtacgacatgctctatccttaaccacaaactttgtttcaaataattcgtggtactgccattgctccgctttgtccatttgagaacttagcacttgttgcacccatgtactttcatcatgtgcaccttgttggtatcgctgattttgagcgtcactcatacatgtcattgcaaacacaaaaaacaacaacaaacaatgaaggttatccctaataatctgctatgcggtgtagtggtgctcctcaacaactcagccaaatggagcaccttaccaagctcttacaagtgtcttaccagcaatgctaaggatggtacaaccggtggctagttcgtgacaccttgaaggacgtgaagtggcgattgcaaggatcaaagcggtgctgaccagaagtatatatgtgtagcttgggaggcacaatatatagtagcaaaagaacgcaattatgctaatcagaaaatgcaaagttgaataatagttcaaagtactagtcaatgtgctggcctagcctagactcaactctagctcaagcaaacacccgacacccctaaagactagatatgaatcaatgcacaactctgcactctgataacatactcaaaggatgaatgattttttttctttcttagtggggctttttttaagcacatttctgccttttttttcttttttttaggtgcagctttttttttcttttttttttctttgcacctttccgccttttctttctttctttattctttttttaacttttttgtcaacaaaaactgaccactgacctcgaacagggactcaaatataaatctgaatattacagggactcaaacgcaaagtgcaaaactaaaattggatcatctcaaaaatggattgctcatatcatgtaggttccacttttataaaaatatctcaaatccactacttaacagatctataaagagggaaatacggacagtcacggatagatctgatctgatacggagtctctcctcacgcgcacacagtactcccctcatgcgcacagtacacgcgcaaagtacggcaactccaaaaccgtttgataaaaatttctctaaatcacaaaaacggaaacccgacgacaagacgattcaatttttcaaggtcccagcaacaactgacgagatgaaaaactggacccaaaactgacgtacaactcacacacttgagtgatgagccctagacctaagtgatgaacagatgcaatactcaaaactaaaaattaaatctaaaactaaaccagcactcgacatgacgatgcaacctagaattcaacaaagcaaaatctaatagaacaatgcaacggctcaaattgtctaggtaaagaataaattttttgtgtggcaattttctggttatgggaagataaattacctaacgggcaaccgcgctctgataccaacttatgagggagttaggtcccgatctttcgataggtatagataaacaattgatttgagcggaatcgcgacacaactcaatccagcttctgaacgaacaagctactgagccccgcaattgcagcaccacgtctcctctggttatcaaccatgccgaaacccggttgacctcaccaagaaggctaatccctgcatgcgaatcgaagaacacaagcaagaacaagatagattgcaaccaaattgcatatgaatgattatgcactcgaatttggggttccacaaaccgatctaggggtgaaactgttcttgacagaataatctaatcaaaacccaactctaaacgatgacggctactaaataaatgtgattagggacgtcctagggttgccctagggcgcacacccccttgggctaagcccacgacacaattacaaggcccaaaacccaaatcagattcggactggatgagatacgtggcttgttttgcagattcccggcagctcggtaggaattttaacgtgggaccaaaaccatatgaaggtagactccataagctttccaacaagtactcataagccccaaaataccttctagatcagcggctaggtccatttgaagttgatgctgttaggaggcccgaatccgaatccaaaacgtgtagaactttatctcttgtcttctatggaccaaaagtgacgtggtgagatgaaggaagacttggaaaaggtcttggtttggtccccaatcaacttcttcaatcatccatgcattccttacgctcaatctcttttctttcgcctaagcaaatacctctgtaaacaaaaacacacgaaactcattgtgcagcaacgttgttcaaatatataacaaataaatctaatgtagaacatatgcacctttagttgattaatacataaggtagtcatggttatatccgagctagttgtgtcctcatcaccgtgaaacatagaagcattgcatcactgtcaaccacattagtgcacgtgttttccacctcttataattagaaccatcaaatgcatgtggtttcagtgcagcagcaaagccaactaccgaaaatgacctatcaggtttttggattgttagaaatatagtcatatttcggcatattttaatctaaaatattaagacaataatcatggcatgaacaatatggggtgatctagtgataaaatctaacataaccaggagcatgcttaagatataataagcatcatcatcatacaaagaacgcaatagaattgcgactaacatagatatgaaaaaaatgaaataacagtaagcgaaggttataccctgtgaatgtccctccgctggattgtgtggcagaactgcctccgttgatgttgtcgttcgcagcggctctggctcccggcgtgccatctctaggtgcggcagtagcagcggcggcggaagacattatgtagcagacgacggcgacgaacaaaagacgaggagcagtcgtgcggaagcactccccaaaaacctgatcacccgcctacccgatgcagatctcaagcaaaggtgtggttccgaaggccctactcgttccaatctctcgtgcgcgcaagcgatcagaagcggggaagcagaacagtagcagcaccaggcgcgcgcgaggaggaggaagaacaccagatggaaagtaagcagcggaatgcgcgcgcgaggaggaggaggaagaacaccagatggaaagtaagcagcggaatctgatcggattagctctttccttatagcgcaggagcgatatccgcccgttgccacagtaacgacgcgagatcaattggaattgaatcacatgcctgttacttttccttatagcgcaggagcgatatccgcccgttgccgcagtaacgacgcgagatcaattggaattgaatcacatgcccgttacggagggaatctcttggaattgaatcgcctgcccgttacagaggcaatcttgggattggtccgttgcaaaaggatagagataggtgcatcgcaacgcacgcctcggcccgacgcgcgcgcgcgtgtggctttccgatccccacctcaaccgatcaacagggagcctccaataactccctatttaagttgagatactcctcgtttaattcccaaggtggtattattatccttaacatttattatgggcctttgagatttaatagaataaatcgggcctagcccatttattataacagcgcctacatgttcgaggagtgtgggcagcccaccgacaacgacgatgatgcctccccatgcccggcaactttcctcgccatctcctctgacatcttccaccccgtcatctccgtctcaggcgtagacatcgtgctgcggatgtggagagctacttcctcaccagcatccgggattccattgctgacatgacagggatgacgcccaacctattgatgccgtcgagaggagttggggtagagagattggggatttgcggtggagaaggaagaatatagaggtggaggatgatatgtgggcccacttcatttttaattttttgatgactaggatgccatgtgagcgccacgtcagcgaatatcattatcaatactgttataggagtcaaagtacatcagatttaatatttcaagaatcatgatatccgttattgcggttaagggataagaattagattaggcctatatttgacagtcaagtggcgctgtggacgccttcatgtgctgtgcaggttttttttaatgttacattcattaacatcaatatgaatatggaaaatgatagaatgacttacattgtaaaacggagggagtataatacatgtgggcgctttggcaagaggcgagtggatacagtcacagaaatgttaattctttcgatttgttgatagatggcaaaatttatgtgtttctattcacttatccacaggcggggataagtttctacggtcccaaacaccgccagacaattaaagaacatctgaatggctatgactacaattaaagaacatctgaatggctgactgataggcagctaatcgctaatcagctcaacgatctaccacaaacagccattactctcaatcgaaaaactattttagatacacccccgtgtaatttcttaacatctgccaaatagcaagagaaacagagttccgtgtcaaacccaaccaacctgcatagcatatatcaggattttcgttacatgagaataatacaccagtgtacatggcaggaccagtactgactaaaaggtcctggagtatttcttgatctcatataagatagaggatatggaaaccaggtccttgttgagagcagagccaccattgatcttcttgacacactcggtgatccttgtatagtacagcagcagctgcgtgagtgccgctttcaggatctccattccgcagaggaagttgctaaaagatgtaatgacatccttgtgcataagctcaattgcagctttccaccgaccggcaaaatccttgactaatggctcgacatcactaacactggccttgtccgagcttgatgctgtgtcttcagctggtaaaacacacacataaagatgagatgccgttgcaaaaaaaggaaccagcttgatgttgtaacagggatcaacttacacgggcgagatttcacaaatttgatcaaatcactgaaatgctccagtagaagttcctcctgcataaatatttgttcattatatcagcttacccctagaaaattttaactatccacacagctccctctttacaaatattgtcaataaagttcaaacgaaaggagaaaaaatggacatctgttgccagtattaaaaatcaatgggactagcctctgattggcttcgtaatcctaagaaaagaaatactaaactgacagtaggcctcccactattttctctggacatgtaaaaattctagaatcaaatggaaaatacagaggtcgtactaaaataaatagactaggacaaacggcaagtggtcacacaacacatcacggtttggtgccctggcaagttaggatgcaaccaaatagcccctaaacagatgcaaacaggtaccccctaacacagtaaaaccaatgaaatgtgcccacgcagaaattatattccattatttctatctcagagggcacattgcataccacatatactgaaatattgctcttaagaacctcctcaaagtgaacttgtgcttttccaccctcagtgccagcttcctgtatgacagctcagaacaaatttaataagatgatactagtagattgcaccacagtacaacttaatgaagcttgaactttcaccgcctaccttcagtatggaaatcgttaaatcatagttgtttatcaggaaaacagtttgcaacttttgtttagggaacatcttagccaacttaacaagcaattcctcaacagccatccgcaaccgctcgagattaagatcaagctgcagatataaataacattatacaattcccataagccatataaaggggttgcttatcgcatggaatgggaatcaataattcttttcagaaatcgggttgagttgaatttgataaactaacctgaccatctccatattcaacattgagatgcacgagggatgctgtaaattcagcatatctcctcatgacatagtgaggatgaacatcatcctcccaaagagtcttaacatttgcatttcgtaagctgttcaaatgcaaatcaaacaccatcttgaagcgaggccagagtgataagttaacctgtgcaagtgtgcaatgtgcacaaatggacttgatgaatttgaaacaaaagaaagattcatggcgaagcattggctatccaacatagtgacccttaaaaaagtcgatacaagtataaaatttcaacaaaaatgcgacaaagcacacaccttgtctaagtaagagtccaaacatgggattcgccgcttaaacatgattagctgcataaaacatcaattccacttagatttctcacatataacaatataaagggttctacctaaaatggagagagagagagagagatgtggcctccttcaaagcaaggacagtcaacaagggcatgaatggtgatatttctaagctgcttcaataggtaactcaaagcgtacctgatgctgatgaattattcggatcataagcattatgccgattgcgtcataacagttcaggagcacagcattgaaatgttcatcaacaacttggataggtcctaagggaaaagtaacagacatcacttgtttgatgtttatgttaaacatttaaaacacatattcattgtctattttcaggtagatgacagtggtaatagtataaaatggcttgacttgatatattcaattaatcagtttggattatctatgacatggagcatttatatgtcagacatgataaaataaatggattatttcctaaagttaaataaaatgaacagatagtatattactttggttactagtgtaatgcaaagcatattcttattttctatcaactctgaaatcttatcctgcacattttctaaatgactgagaagagttatgctcacttgctcagccagaaatgttcataacaaagactggacttttaatttcagcaaaatttaaatcagggtaaccacaaaacatctgaattaagattggccttgacaaactaaatgtatggtagttattcaagccactgtggcagaacaatattgatcaaagtatgtctcaatagtatgaccagcaaaaacaggcatataaatgtatggtagtctttgcacgcattgtgcttcctacgggtaaaggacgatgtaaaagcggtttgggggagtatctacgcatctttgaacttcaggttctaaaatgccaactccatctgggttgattcataattttaggtggatcagatccaaacaggatgtaatagccacatggaccactatttacaaataataactgccttgcggtttgagccatcatttatgagtgtcccgtcacatccctttaaatctgatccatccaaacctcatcaaatggtaaatatgaatgttcattcacatgctagaactgagcgatggatttacactagatgcttctccatttagattactacatccacataagatagacattcaaaaataggacaaaacaaacctgcaaatatgtcattaaacagtgattcttcaccaaagaaatcatcagagaaaaggtacctgcagttagtggatatctatcaggttgccactcattcaaaagccattacgaataaaaatacaagggaaatcaggcttactctgaagtagctgtatcaatcaaaagtttttgcaagcttctgaaaagaacttcatatggatatttttgagacttggcttcagctatgtgaggtatcaaggcaggctgatcaatttcctgacattccaacaaaagcccacatgacagacagaaatgatgctactgtgctgcttcaacaataatatggtactcaaagttcaaaatggcaagatcaaaatctaaataaagttaggtgatgattctgtccaaaactgcaacgaacatatataggcatgaaacagtcaatagcttctgtgagaagaattcaaagcatgttaaaataattctttttggtacaacaagcaacaagattttcttgtctgatcaactatggcaagaacattgcattcatagaatttgactggatctattacagtagagaaatgtatccacaaatttgattatggtgctaactggatcctcaatccttaaatttgtgttggcatgtcatttgtgtccctaaacttgggggttgcatggcacaatcatgttactgaacttgtataatcaccataaatggtgtgggcaagtccatatgtcttgttacaatgttagagacaactcaaaatgtgaacaagacaggactaagtgtctggcaactagccacatttactctaggattatatttatggtcatgtgccaattatgcactataagatgatttacaatgataggtgtctcgtggcatgtttgaccgctaactaaatagcttgttatgttagtccattagttcttgttggaaccttatagcatcacatgacccagtttagctcccagcctccgtgtcatgcttaacaagtagaatgcagttgaagacaaccataagtataggatcgactgattacagctaacagtgaattacttgacaaactacattatcaaaaaaaaaaaaatctaaatgtcagttggagtgtcaggaataaaaatacctttaatatgtttatcctttcacccaaagcaaagacagaagaacgggtcttcagagattcttttcccatggagaaaaggaatcctgtacttctagtttcaactccaagtaagtcggtagaggttgctatgtccagttgtagtttctctaatgcttgaatatacgcacggaaatgtgcactcagcacctgcaaattggtaatatggtaaaaatgtcaagaaagcatttgctccaaaatatctaagaagacacacaatgcaagtgctcttgttattgttatcgactagtacactgcattgcacaagtcaaaagtcatcgcacacagactagtagtgttccctaacctatgcagaaagtttcaaaagtatgtacatatggaattatttttttatgagtaaggttgataccacaacaagcacagcagtacatacagagaattgcaaaaagaacagaatgaagaaaaacggacagggatgcaactgtaacaatccatcgcccaaaagtcaccaatgaccaaaccccaccttggggaagcagcacaagcgtgaaaaagctagcttgggcctttgaactctttgcctaggattaacacatagttgctaaatttggaccctcaagcatgcctgctactactctacactttgtacagcagtgcagtagtaaaccttaccctggcaatgattgggacacaaagctggaccaggatccaggtcatacattgataatctaatacctattcacaccatagctatgagatttattataacattcaccttgttcatggtatcaatataagctgcacgaacttccgcatatatctccttagcatgttccttaagaaaaactatcgtgtacctgcaatggggagcccaaacgaaaatcaagaaattgccccccagagagagggagagagaagaagatttaatcgcatggccatgtagaggaacttaggctcagattgcagttctgcattgtgctgcgttatgcatattgtaaagctatcaaacgaaaaattaaaatcaagtatacttgttttataatcaaactaaggttagacaaaatatattatccaactatcacgtctctccaagttgttccatatttttagaacacaataataccgttgtttgaaacataatattattatatattaaatggaaagcaatttgccagacaccaaaatgcctaaagcagttgcaccaaataaaaggataacaatccgctgcaatgccatacggagacttgtaggcacaaggtgcatttgatgcacttggtccacaaatcacatttagtgcaaggtacaaaaattatacgagtgtcagaaacatgaggcacctacaacaagaacataaaaaagaatcctgctaaccccatctcatccctctcggtctccctttagattcatgacccacaagtttgtctttgacttcagactgaatctgagagcatggaaaatggcattgacccatgatcccaatgactatccatagaacattgctcatgcaagaactaaatgtggataaaacaggatcagagaagaccattttgcatacttgtatttaagaagaacactctgctgtagaatctgaatatttgttttcggttttctcaaggcatagaacttttggatgacaaattcaaaaatctgcaagaacaattatgaacgcatcagtcatcagccataaaactctttagtagctttctgcaattggattggctagatataaaaattcaatcagcaggatgccatgaatccagggacgttttattaaagttcaagttcatactcatgaataaacgagacattttttttccaatcttgccttcccgaacatatgtaaagcctgataaagtttcagagaaatccagagggacattgatgtgacttcttacttcaaatgaccaaatctacaatggcttgtatttgctctggagtacgctatcaagtatgatctgagcaataaacagaggtagcagaaattagggcaactcctaattttaaatgacccatatggctagtacatttgatggtaaagtgacacactggttgccatcaaatgtaccagataaattattagccaacatagctgcatctttcttagtaacaccaaagtggttgccatcaaatgtaccagataaattattagcatatcattctagttaatggtggacataccaggcactttcaattgactcatttctatgatattactgagccaattatctctattgaactgagatgacatagcatgtatgaactaaccagaccttgcaaactcagaaagcacaaaggcatgacacataatcccctcaacccacataaaacagatgctgaaagccatagattgtttcctataattattttgacaaaaataagcatgtacgaaagatgaaacgcacatacaccttcagcatgatataaatcctagacctgctcacactcataagaaactagaagtaataaactagtgattgttcttcaaacctttgagactgctttctgcctaagtctctcaacctcaggttgaacatcctttagagccttggacgatttaaccattgcatcaacttcaatgaacttgatttttctgcttagagtctcaagtgttttcatgtattcgtcattaacctgcagtgttgatgcataggtcattttcagttctcaaacaaattaatcagaattaactgcaaaagaagcaagttgactaggataacaaagtagatccttgggacggatgacacatcaaactaacaattgaaatcttctgttggaaaaaaatatatcaatcaaagacaaagaaaaaaaacagctgcaccaaaaaataattaaaaaaaggacaaatcacctacgaaaggatataaagcagttaaactgaacattctcacggctgagccagaagagaagaaaccattggcataatggcatgtttggatctcttgccaaggactctgtaatagtaataccatagcgtctaaaatccccttttcactagctttgtgtgtgtgcctctgtgattatgtgtgtgtcgggggaagggagcagacccacttatccatagcaccctctaacactctcttctttgccgcatgtaggattaattccaccaaatgactatatttgggccaccacttaaggccagggtattacaccttgactagtcagaattggctatctttcattgacaaggatctcctcgtccacaattactagtaaatacaatgttatgcaagaaaaaatgaggcatcctcactatcaggtagaagcaaggctacgcaagggtgggcaagagaaccaaacatgcgctgcataactacacatggtattggtaccatatcagaaagttgcaaggttagctgcaaacgaacatgaaaggaatatagtgatcacctctccatcgacaattatgtcaatcattcttggaggcactattatatcctcaacaaattttgacaatttagactctgcagcctgcagtatttccaaatgagtgagaaccaacattaggatcatcaaagataattaagcatggaacgaaagaaatatataacatgcaaaaagctataaaaactgtgaaacaattccaagataagctacttttgatgattcagatgacagtgactgcccttataatgttgcaaaaagggctcattttataatttctatgccatgtcttgtacttgagtcttgtctcattatttgataaacaaaaatctaaataacaaatcggtttgtccaattagttataacacatttccttaaaaaagatacaacacatggctgttccttcggtaacaatttatgatgcatgattatttgtcagaagtgtaagatagaaccttaatcgcatatgcaatattttctgaaacattatatcaagcaatggggtgatcattcatgtgtcgatatgtaaagaactattgtagtaacacagaaactatgtatgctctggcatctactcttgagatattggaaggtacaaattttaacagtcataaaatatccaagatgcaaccaatatatgctaaaccaccaatcccctagatatttcaaatcaaggacctagtatgcactcagatcagaaaagattgaaatggaggaataattggatatatgcggataaaatgtacagtatgaagtgaaccaaaccttacgatttttcaactttaatcccatgtccatagatttctcctgaaggacctttatctccgaacttatagaaccaatttctgtctaccacagaagtcaaaagaattgcagaatgacttagtgatcgtaaaagagtgagttacttttgtctataggtgaaagattaggtagagaaaacaggaaaaaaaaagtataaagacttttttggtttgagagggaacattggtcatccaattaaatgataagaaagagtaaataataagctaaaaatgttttgattcaattatgtcaatgaacttctcgcatggatcacatagtaaaaactagaaacattgagcatagaattgtgatacaggtaaagaaagttcttccaaggaggttgccttcatgttatttagttgacaaaaggacagcttaaaaatgcagagacatgatcctggtgaattttcaggtagctcacagtaggcagactcctctttgagaagaagttcagaaaccacgtgaattgctaattgatacaaagtaatactaaagtttgcacattccaaacatgatgataatatgttcagtataactactcattcagctagccagcacacaagagaatgccacagatagttttgtcagaacatatgagaatatgcttttacctggaatccagtcagaacagtttccatttgtgacaaaatgttatcacagtcacgaatctgatcatgcagcgataccaagttttcactttctccaatgtaatcctacaaagagggaacactacattttatccactgccaatttctatttatgaagcatcagaagctgaagatcataagtttttttttccacaacatttgtgcaattatttgatcaacgtaaactttctctggtaagaataggcaagtcattggatggattcgtagtcttatagccatctggcaaaataagctaaataatcttatttcaaaataaaataaaaccatgctgtaactgtattcctactcaacgtcaaattcaaactgcagttcatattcatatgtatataaaaagagcagctctagatcaagcatattaacttggatgattgacgtgaatgaccatatcatatataaatacctgtatagaatccagctcaatttggcgaatgttgttctcgacgccttttgtgtaatcacgcagtttgatgccgttagccaggatatttgccacttcctacatccacacagaaaagtaaaatcagcgatccacacacaagaaagaaaaacagacggctacactgtttcttgctcgtaattgataagtgagctcggaaagacaacaatgcagcacccagggacctgagaagcacgtagcccaaagagagctcaatcgccaagctcgttactagtctacaagtaacaaaaataaataagcatcggatcaacaggcagcacctcgtcgtccttgcagtcgtcgagctcctgcctcaacccctccagcgactcgtcctcatcactgtcgaaaaaaaaaaaccaaaccaaatgttattcaaaacagcgcgcaaaggctcacgttctcggacgttatccacgggacgagatcgggcggcgcggcatcccgtcaccgtccgtacctggcgacatcctcgtcgagggcgaggtcgccgaccaacaccccgaggtcgaaccgctccctctgcccgtcgtgcgcctcggcggcggcgggggcagcgtccatgtcgtcgtcggctgcggcggcggaggggctaccgatgggtggcgaggatgccggggatcgccggcggcggggtggctccgatccagatctaccaccggaggcggtggtgtcgggatcggatcggatcggaggacggacggggggggagggaagtgggtcggatcggtcccggcaaaacgaagatgggggaagaagaagaaagagagaggttgggttgcgaagggggaacggacgcgtattgggctgggctttcaagttaggaatttgtaggcctattgcagtccaggaaggaaaaggttcactccaagtccctcgtcttgtcgtctgagttgtaaaatcatccttaaacccaacgcatctgtaatcttataaatccgggtcagttacaagacagtattgcttccgattttagctaacgtgacgagctgacttcgatcatccagactgagtcagagaccgagacccacatagcatacatacaaaatattctacattagaccagttcttcctctaccacctttcctccatctctcttctctctcctcagctcacgattttagcgagcaagctatgccgatgatcattacagaggcctgacgaggaagcacataatatgctgcaggaggtacacagcctcgctaagctataacggcgagtcggcgattaaaaaaaaaaagtgttccagtgtacaattaattcgttctatatagattcatttttcaagtgaaaaagagccttttgtaactctttatgtaacaccttgactaccattaatacaatagttataaggtagagtctctctacctttttcagtcaaaaaaaaaagtgaaaaagagacatatcagcgtttttacaacagcagctatatttgttacagctccttgcgtacaacactttgattgatggattgcacaaggaaaaaagataaggcattgtttagatcaaaaaaaatttagccaaaaacatcatatcaaatgtttggtcacatgtatggggcattaaatgtggaaaaaaacaattgcacagtttgcatgtaaattgcgagacaaatcttttgaacctagttgtgccatgatttgacaatgtgatgctacagtaaatatttactaataacggattaattaggcttaataaattcgtctcacagtttacaggcggaatctgtaatttgttttgttattagtctacgtttaatactttaagtgtgcgtctgtatacttcaaaaactttacacccaaagaactaaacgcatcctaaagctgtgtttggatgcccttttcccaacccctctctctcgttttccacgtgcacacttttcaaactgctaaacagtgtgttttttgcaaaaaaaaaatgtttctatacgaaaattgcttaaaaatcaaattaatctatttttgaaaaaaaatagcaaatatttaattaatcacgtgctattgtaccgttatgttttccgtgatcactgttccggatgggaacttattctagcgaactgagcctactccctccgtcccaaaaaaaaaacaaactctgagtttccgtgtccaacgtttgaccatccgtcttatttaaaaaaatcaaaaagacaagtcacatataaagtattaatcatgttttaccacctaacaacaatgaaaatactaattataaaaaaattcatataagacggataatcaaatgttggatacggaaacccaggtttatcttttttgggacggagggagtaagtatgttccaacttccaagagaatgtactgttcgtatacatgccccgtacgtagctatctgtcgtatacatccccacacgcatcagagcaagtttaatagtatagttcactactaactccaattcatttattgccaatctaatagtcaattcatacaatagttgcttactatactaataatatatggtcccacctgtcatacacatattacgtcttatagtccgtgttgtaactggctatagatctatagcccgctacttttctcttttatcttttatcttattaaaatatatttgtagttggttaatagtctgttactatacctgctctcacgagacaatgcatatatatgtgcatgcatgtgccagcctgcttgttggtttgtagtggcagccgttttgttggtttgtagctagctcggcatacgaccggctgctaagagcaaaagtttaatagtatagttaactgccagcttcaaattatttatagctaatttaatagccaattcatctaatagttgtttattatattattaatatctgatctcacctgtcatacacacattacgtcttggagtccgtgttacaactggctacaaatgtgtagtgtgctactctttcctcttttcttttatctctttaaaatatgtttatagctggcttataatctgttattgtacctgctctaagttcgatcgtggatgatcgatcattcgtcaaatgttaccacgtccagtgacttatccatggttcaccttactataaaaaatgatttttacggacaactcctttaattttgttcaaacggaccaaagaaacccgtatgtaaaaaggttgggaatatctgatcccgtatgtaaaaagcttggaatatctgatagagggcaaacttgtgaaaattgtttttttaagatagacctcttaacaagcctacttgcaaaaatcgacctatttacacagacggacttgttaagagacttgtctacgaaaatcggtggatagcatgaccggtcacaatacttcccctataattttttaatcctcctagataaaccctatctctctctccatgttctttgctttccatctatagtctcgcatccctcatcacctcccattcctctctctcaccccctgctcagtgggagcgcagctggcgatggcaccaccagtgacgaggggccagaggcctcgcatgtgcacggaagtgacaatggcgccacattattagcatgggagcagcggcggcgatttcgtcgggacacgctgcaattggctctagtgacggcacccttgagaggacatggtagcggtggcggcctcaggagtggtggggcacggtggcagaactccggcggtggcaagccaccacacagcgacagatccaccaccaccgaccttgggagtagcggggcctcagcggtgacgacgatggtagatcgaagctagggtttctattttttttgctgcaaaaatcactttttacacatgggtacatgtatgttttttacatacacctagtgttaggtgggccgtccacccgttcgcaaagatcatttatgcagtcgtcatgataggagatggaaccatggaggcatatatgcaagtatttggccaacatgtccaatgtccaccagattgggacgtcaatcctacccgtggtatgggtatattaccgtgcgcctgatatttacgtacgctggtttaatatatttttaaaaaatttgctacatactccctccgtccccaaggttggctttttttttttgagggagagagtaatatttagagtttgtggtttttgttattgaacaccttaaaaggcatgaaacgacttgtcggagaacgaatctcctctagcagggaagcaacgaacctcccaaaaaaaaacaaaaaaaaactcctcctttcatgattcaaccaaagggcaatttgagatcgagcctactttgtgtgatgaactcaaaacacaatcaagtatacttgtgtgatgagcggtgagccagatatgttcctgctctgtccgtgctcgactcaattcattgtcaaccctagcgatttccattaatgcaatgactatatgaaatgcaaagatgtactatatgactactagttggatgcacaatagtgctactatggaaccccttttcccctctaaataagtagcgcatccctaggcaaaatgactttccaataatcacagttagtaagggatgcatgcatatgcatgatatagtgatgtctgttaatcgtggcaaattggcaatgcaatttgttgttgaaaaataccaagatgccaatactacgcccacttcccgcgcgctctatataaagccatgcgctcccatcgcttcttcctcacaaactttccctcaatcagtcaatctgtatacagcaactcagcgatcttatatttacccaacacaccatgagagcgctcgctgtggtggccatggtggccacggccttcctcgcggcggccgtgcatgccgagcagtgcggcagccaggccggcggcgcggtgtgccccaactgcctctgctgcagccagttcggctggtgcggctccacctccgactactgcggcgccggatgccagagccagtgctccgccgccggctgcggcggcggcggcccgaccccgccgtccggcagcggtggcagcggcgtcgcgtccatcgtgtcgcgctcgctcttcgaccagatgctgctccaccgcaacgatgcggcgtgcccggccagcaacttctacacctacgacgccttcgtcgccgccgccagcgccttcccgggcttcgccgccgcgggcggtgacgccgacaccaacaagcgcgaggtcgccgcgttccttgcgcagacgtcccacgagaccaccggggggtgggcgacggcgcccgacggcccctacgcgtggggctactgcttcaaggaggagaacggcggcgccgccgggccggactactgccagcagagcgcgcagtggccgtgcgccgccggcaagaagtactacggccggggtcccatccagctctcctacaacttcaactacgggccggcggggcaggccatcggcgccgacctgctcggcgacccggacctcgtggcgtccgacgccaccgtctccttcgacacggccttctggttctggatgacgccgcagtcgcccaagccgtcgtgccacgcggtcgccaccggccagtggacgccctccgccgacgaccaggcggcgggccgcgtgccgggctacggcgtcatcaccaacatcatcaacggcgggctggagtgcggccatggcgaggacgatcgcgtcgccgaccggatcggcttctacaagcgctactgcgacatcctcggcgtcagctacgacgccaacttggattgctacagccagaggcccttcggctcctaagcttcgcctacctagcttccacacagtgataaataatcactgatggagtatatgtttacaccatatcgatgaataaaacttgatccgatcgacgacgatgatcagtaatgcacgacgaagcgattggtaaaatataatgtattatatggaaagaatacagtaccacttgattaatattgtatggaaagaatacagtatcatcgagtggacaaaaatcggagagcgtgaaatcatagctactactaattgatgtgcagcatacccatgaaagatattccgatatacatcaaaatgggattaattcagcccaatcgatgtacacgtccacgtctaactatggtaatcaaacccatgaataagaacttgtagtctcttaaaatactacaacgataatttagtccgtatatttgttttgcattaaaatattattatattttttattaacttgattaaacttaaaatagtttgactagaaagaaaatcaaaacgactcataattaatatgaaacagaacgagtagcaattattgacactatccaatgtctttcttccttcgactggttatgggcagtcttcggattactagatccttcagaaatattttcttcatgtttgggaattagttatataacgggatgatgaatgggaagtggattttgatccctcgagggattccctcattgtttgcatgtcactcaaatagttatgaaaaaaatttgacaagatgtattaacatgtgatatatcactctgcaaatatgcaagttcaaattcaacttatacatctcgcaatgaaaaaaaacaaatttaattgtgaatatatgttaactacctatggtttaatttgtttttcgttacgagatgtagaagttgaatttgaacttgcatgtttatggagtgttatattacatgttaatacatctttttaattttttctaatttttttataatcatctaagtgacatgcaaataacaatgggatattccctcgaggatcaaaaatagtttccccgatgaatgtaaggtttgaggatttttttttcgcgtggctgctttatgttgggttaactaattgtgttgtttctgcaatagcaatgacacactatacttttttgttttgcactacgtctgtcaaaaaaaaacaatatagtattggatatgtggcgtttcttagtacaacgaatctgaactattatgttggtttttttttacggagggagtatgttgtttggttaaataaaaatgatattgctttttagaaaagacgaaaaaaaactgcatgtctaaccctataaatggctgattttcatgtgttatttggatgagtacgtttttagtctttgctcaaaatgaggcatgacaatcagtcattgttacgtcaagtctcacttgttggagcagacaacaatagaggtgttcttcaatggtgatggacagagacgtggcaaccggatttgcgaaagttgtttctctttcatatcgaacttttgccaaacttgtttgtgtggtacggtagttctactgtaatagtgttgatcgctgtgtataccatggtcagaatgttttgaaagaaatacgaagaagggtttttttaatcattatatatcctgtaattatcatggaaaacatttcgttttaatttggaacggggggtgaaatagctgagtggactaaatagacagaaactcagaatgtgatagatagatgcatgcatgcatgtatgcgttcgtggaattccatcgatttctggcagcaaatcaaagatgcctgcatgcgaacggcaaggtgcagatgaagtgatgtagaagtagctagctagtcaacgaggactagctatagctagcgctagttagaccattaattcacaatgctcccatgtggcattcaacctaggcacaccgaaccgaatattcggtgccatttcctccaccagcagagcttttccaagactgcgtagctctttgccatcggttcctcatcagtttttcaggaagagagaaagagagaagaggagagggatgcgtcgtcgtccccatgctccacgccgccgcggggaggaggacgaccggacgccgtcctcgccggagaagctcgccggctcaatagggggaaagcgacggcggcggtgaagatcgatttggcatcggcgaactcagagagagaaagaggggaaattcggcgagttgtcactccgcccggctccgcgaggaccaccgacggttgggggagtcggccgcgtccgccggtgaggttgacctcgatccgcgccgctgggagctcacccgccacgctaggcttgatccgcggggccgcgtgaggccactccatggacgtcgtcgccgagacttgcctcggggtcctccgccgccgacgatgtggggagtggggactggcagtggggaggagaggccccgctcgggggcgtcacccgagaaaggggaggagaggcgctgcccgggggaggagatcaggctccgcccaggcggccggggcactggcgtgaggggaaaaggaagtgggtgtgaggataaggtgagagaaatgatttttttatagttgtgtggatcctgtttgaggctacatagcactgtgaaacttgtgacaagtattattcttcttgtgtttttatcctatgtggtagccccaggctctgcaaaataggtggcgcactgctaatgccattaatgcgcagagcgcggccagcaggaacaataatgcccacgtgcatgaaacatctcaaagtcgtcttgcactgttgcattaggtacgtttacgtacacagtaatactaattcattatacatactactactagcaagagctagagctagctggatatttaccgcaagtggtatattacatggtcaactagaccatgtacggaagcaattcgcccatcgataattagggtatgtttagttcacgaacgaaaaatttttgatatgtcacatcagatatacatgtatatatatttgaagtattaaatatagactaataacaaaataaattacagattccgtctggaaactgcgagacaaatttattaagcctaattaatccatcattagtaaatgtttactgtagcaccacattgttaaatcatgaagaaattaggcttaaaagattcgtctcgtaatttacgaaatctgtgtgattaatttttttatatatatttaatactccatacatgtgtccaaacattcgatgtgatagggtgaaaaatttttatttaggaactaaacaaggccttaagctagagggatatatccatgtcctcctaatcgatgcggaccaagtcgaaacttgacatacacgactggctagctaggattaaattaatgcaacaagatatgctactgtcaacagtcgtatcatccaatcaggcgagagttatgagagaaagagagagcaatgtgtgtaccgagccatctagatcttataaatatactcctaaactaagacttatgatggcatgagaatggaggcccccgtgcgctcgtgaagagcaacacgggcggcgacccatgccgctgcaactccaacccccccaccccaccccacttccctcccttcccccttgccatgccgccggagccagcctgggcgcagtgatgatgcaacggcagtcgccgccggtaatggaggatgaagtcgtgggcggtatggttggatctgtccagatccatcggtggcgcacccggatatggctagttaggggcgggtagcatcacaaaccgtataggtggtgggggtagccatggtgtcaagctggagtggaggaggccgacggctgctataggtcgggctagcgaccgagctcttggaggtggcaacaacaggaattcttccttgtcgtggttaggcacgatggtggcttggagctagcatgaagggcagcggtagccagcttggcttagactaggctaaaaatagccagtcatggcggtggcgtggcttgttagaggaggcaaagctataccttgctgccagccagtcatggtcgatggtggtcaggagagataaaggtatagagggtgatggagggtcgcgtcccttgatgttggccgaacactctctctttttttttttggagctccacttctccttccgtggagaaggtagtagtgggataacaagggtaggcttgggccaccgagacatcgctgcccaaatctagactctctttgaccggatgtggcgagcaggctactggatagcggatcagagggatcctgaggtagtgcacaggggagcggtggcatggtagtaggcgctaacgatgaggcatggtggtggtgtgggttgtcttcctaatggttggcttgatatcctatctatttgtcgagctcctcccccctctcagtagggagctctgtaacaggatgaagaacagggtgaaggtggcgcatggaaagttttgggctgccaagacaacacaactccaaccgatctctccttggtcggatctggtgaagaggctagtggagatctgagccagcgtagcgaggagtggagatgggctagaaggcgttgatggcggagagcagttgcggaggacgtctaaccattttcccaacattttggatggacttccttcaatcaaccgtgaaaaaaaaaaggcttatgggccgttcagtacgtataattaattagcccaagcagcagctcagcccattcctaaccttgcacgcatcagttgcactgttctccatgtggtttagtcacgttgcctgaattattttggctcgtcagatcagagctgaaggacatatattggattctattttgtactgggactaattaaccataatatatgttaataaattttcacctgagaattatcaagtgtaaatatagtatagtcgtagtaacttatatattacaccctccatttcataatataaggtacaaatacttttaaaagttgtttcataatataaggcgtgtatacattcatgccattaactggcaccacttttccactaaaatattattatttaaatcctccaccatcaagatctctaattttattgggtgcatgcattctactccctctgttttaggttataagatattttgattttggtcaaagtcaaactgcttcaaatttgatcaagtttatcgaaaaatagtaatattttcgacccaagataaatttattataaaatatatttaattactaatttaataaaactaatttggtaatgtaaatatcattatatttgtgaataaacttactcaaacttaaagtagtttgactctgatcaaagtcaaaacattattagggtaatctaaactatgaggtgataataataattttttggtttttgggttaagggtggttgtgtcttatatttttgaatggagggagtataatttacatatataaaatataactttacaaaatcttgcagcaacacgttatttcccggaagcagaggttacagggctaaatcccctcatacacgtgttatgatttttttccctattctacttgcacaaatattgatgcaaatctaacggttcaaaaaagttagacacatgttaatatgttatattgcaattatatgtaagttatgatatgattatattgtgtgtgtgtgagagagagaaaatatgttggtagttacaaaatcatttttgaacagtaaaaccggatatgacgcatcctccaacttacaaaaccagtgcaaactaggtccctcggcggttttgactcagattttgttcaatgtggcagctgactcagcgtggaacccacgtgggccccatacatcagcctattcttgccctcccctctccacctctcttcctctcacctctcttcttcatgggcagccaacaggggagtagctgggcgcaggcggcggagcggcgcccgggcgagcgcaggcggtgggggaagcagcggcacgggcagtgcccggcgagggagctgttgcctgcagccggtgggcgtaggcggcgggaggaggagcgggcggcgcgtgacagagcagcgcgctggcaagcgaagcggccccgcgcgggcaggtgttgcggcagtggccgtggagctggaggtggggccaggcgtcatggaggtggacacggtggactcggagccccggcctactcccgcgccgcatcctccctctctccgcgtgctcgctgtcaacccccgccccatatcctccctcttcgtgcgtgcttgccgctggccggtggcatgggagcaagcgagctgtccgtggcgtcggcagcaatggcagcgcggtgtatgaggatggggaggaccagcgttgtcgctgcatcatgtccttgtcggcaccgcacaacgtcactgccaccgcgtcgccccctctcaccacctcggggctcaggctcgtgggctcgctgctggtgccagtgttgagagggggtcgccgcccgctggatgccggatgccacggctgctgctctggaccgccgccgtcgttggggtatgtcgttcggcaaagtgagagaaagtgaggagggagagaagaggggaagagagagatggtgatgtggcatcctaacatgtgggtcccacgctaactcagcgaccacgtcagataaaaccaggatcaaaaccactgaaggaccaaagtgaacggttttgtaagttgagggatgtcatacatctggttttgcgattggaggatgattttgtaactcgacgacaagttgagggaccttcgatgtactttttccatttgtacttacagtatcagatcatggaataagttcactttgtgaccctcaaaagtgatcaaaatctaatccgtgaccctaaaccacaaaaccggatatctcgacccccaaactcttaaaaccagtgcaatttgactcccttggcagttttgtcgacgtggcgcctacgtggtggtattgactgggtctcctttacacgtggcgtttaagttgcatttagaattaaaaaaatatgtgtgtgacccatttgtcattgacatagaaaagaaattgtgggacccacgtgtcccttctctctttccccttcctttagttccttctcccgcctagtcgctccctctctctcccgcggcgggcagcgagggtctgggcgagagccggcggcaggagggcgggcgggggttggatcccctttgcgaggagctgtgctgctctcctcctgttcggcgccgaataggagctggcgcgagcggccctcgagcggcgagacgcggaagtcggaggacggcatcggaggaaaaagagagagatgctatgggtgttggaggacgctgggtggcggaggcgggaggcacaaacggtggggtgcgaggagcttggccgcgccctgcttgaactgcagggcgccaccgaccaggactttgacgctgtcacggtacaggtacgcgtactaccctcctcccctaagtattttggtgtcgggagtctgtgatggtgccggcaccggtttcatgtcatcgggaggtggtgtggtctccttcatcttcaccgtggtggagctcagcccgagcgccgccgccatcgccgctccagtgcctgccaccgccactcccacgtctctgctgctcgcaggccgccgcgcctccgccgctcgccacggtctccgcccgccgccgctccggccctcgccgccaccgcgggagagagagggagtggcgaggagggagaaggaactggagggaggggcgagagagaagggacacgtaggtcccacaatttattttatgtgtcaatgacaaatgggttccacacatattttttaattctaaatgccacctaaacgccacgtgtaaaggagacctggtcaatatcgccttgtaggcgccacatcagcgaaaccgccctccaaaccgccaaggaagtcaaatcgcgccggttttagagttggggggggtcgagatatccggttttgtggtttagggtcacggattagatttcgatcacttttgagggtcagtatgtgaacttattcatcagatcataggcgcctagcattctccagtacacgggccttcactcaaagctcattcgaagctcacgctcaaatggggcagcaggccagacgatctagcgctttggcgctcctcgtcctcgagatcgtcctcacgaccccgccacaagtccacaacgcgcctacgccgatctcccagatgcctatttctcaataagatgtgcttctatgctttcaaagaaaaaaagcacgaaagttaaagcgcataagtggctcagattaaaagttgattaatggagtaactgtcattagcgagaggcacttttgtccaagtaaagttgagtccacgtcctggcacctcgagcagcgcagcgcagctcttcctcgtgagcagcgtcaatgccccttcccctcctcgcctcccatggtatggccataaggcccgcccggcctagacacggcccaaggcgatcaggccggcacggcacggtcggcagttcgtgtcgtgccgtgcctgcccacgggctgcccacggtacggtcggcaggccgtgccgtgcctgtggttccacgggctgcacacacacacacacacacacacatatatatatatatatatagctaatataagtctattttatgtccctacttgttggcccatgccatataatatgtgtatttttcatccctattctttgtgccgtatcttacatatggttgaaaataagtctgtttcacatccctgaacttcgtgtcgggtcctgccggcccagcgtgccaaggtaacagcccagacatggcactgccgtgcctgggccaggccgtcgggcctcgggccatatggcctcgattccacgcggcgcgtggaaccgcacacgcttttggctcggctcctttggcagaactaactatgtggcgctcgcctattaccaggccgcgtaccggttccgcggcaacacggcgtggctcaacttgcccgacaacgccgcatcccgtgggttgcttcacgcctccgtggacgccaagctctaggctgtgccagaacatcatggccgccaagaacgccaagtcctccatggcaccgcctccacttcagtctctgccactgccacctcctccgcgctcatcaacaactgctccttctcgtcctctggcaatgcaccgtccgctgactcatccctttccctgtcatagtcgttgttgatgaaaaacacgaggcctgagagatctgcttaactccagtgcaggtccaaaactcgccttcgggtatgctagcatgccagttgatttgatcctgcaatcaacatgaaataaagacaaagaaagaactaaatcgataaacgatagccgatcggctaagtgccgatgacatatcatttatctttgagccgatgtcatatatatacatcgatcgacagttataaatgaataataaagaactaaatctacttgatcggctgtagatattaacaatatataatccttatgtggatatatacttaaatcaagtgattgggatagatcggtcgccatgccgagacagtataaatcacttagattgaaatatatacaaacaacaaaactatatatgttcatagcatagccgatcagatagatctagcatgtatcggctagtactccgataccactctatattaagatattaaagcaagcagaatataccaaacaaaagcataatatacctaaatgcgataagatcttaatataaaggacagatttaacatgtcagtaaagcatataaaacaaatgtagttaaatcaggtaagatcggctgaaactccgatactaccctaatcggcaaccaagaagcaggctagagattgagattctaatcacgactcataagatcaaacaactgatgcagctataagtatgaaaagaaggacaatatctagacaatcaagccattggaagtttcatagagtggtagatatcatataatctaagccaatgttgatatttaacctaatcggctgccatctattgatagacgttagccgattgtaggttagatagcgatattgccagagattatataggatatatgataactctacgaattacataaacaagattagagtatcataaagatggaagcactaatcccgagaacgcaagccgtcataacaagttttacctcttgttgaagatcgaaaccgatgcagctcaacccgaaagcaagaactcgtcgaaataaaactaaagcaaaaagggtggcgatgcgccgagattgtattgaacgtatgtgttaattgattacatggggtgcggggtctatttgtacccgaaaattacaaactatgtccatatcggacatgactcctatctctaacaaactctaagatatcataagtctttatggcagacttttgccaaaacatatatctaagaaaattacataaaatatcctaagtaatatatacaattgccttctcaggattctatccatgcgtggcaatcatcttgaagcatatcaattcaacccgatgtcttacaccaagtcgtattgccagaatcggctgcatcaccaaaccaagtctgacttgaacttagccgatctaatcgtagccgatccggactctagccgattcctactctgtttctgcaacgatcttcatctttgattccgcttcaatctaatcctcatctccgatgctgatattaccaaatttggtcgttaacagtcgtacaccgccaccacgctcgagacgtacataccgcgccgaagcacagagatgcaagcctgcatgcgcaacagctcgacttcagcgccctttccctgtcatcgtcgtacaccgccaccacgcccgagatgtccatgaccgcaccgaagcacagagatgcaagcctgcatgcgcaatagctccacttcagcgaggcaccgtggggcgagtctgctgccttcgcctaaacaagtacccgtcctacgagatcgaccgtccgggactccctcctcaccatcaaattaaccaccaccgcttggttagtactcacatcatcgttgttagcttaatagccgccgccgctatgcagatgggattttagatattctgcaatctactgcaccgacgggcactagggattagcagttttaagcctcctgttggttggttcgttgtgtatgcatgcatagatctctctccagactagtagctcggttcttctgttgtactgtcatctggcttctcctgggaagaacaccaaccaaccctgtgatacagaagaaccaagccaatgatactgaagcttgtgtttttgtgttcggcgtacgtctctagtagttatccagtcaatcattggtcgatgctacagaagggtcggcgggccagcggcgctgtttgctgggggagccgcatggctttgcttgaggtgggcttgggctggacgtgtgctcaagtttccatggatgaaaatgcccctcaccaataacgatcactctgttaatccacatttaatctcaaccactgatgcgctttaactttcgtgctagttttttttctggacgagcatagaagcacgccatcctccaaactgaccactcggccatcaccagggactacacgagtaacaattcctcaccgacattcattttgtcataaaagtctggttactgaatctgctcccgtgcgcaggcgatccaggaggcgatcgcgatcccactctcgatttaggccgccatcgccggcgatcttgattagcaacaccggcgacaactccgatcacagtgcccacaccccgttttccgacctttgtcggcgacggccaccgcatatcgtcggttagccatttctggcgccaccaaacacaatttctcactaggggtagcgccgctaggaaccctagagtgggatcggttttggtgtgctagcctccaatcggtacgctgcatatcctatttccctccgatctgtggccatggccgcaatcgggagtggaccaccggtttatgccgaaagtgcacgttgcagatcagcttcagaacctcaacctgactacagaagaagaaaacgttgcggaattcagcgatgatgatgagactggagacccccaggaggttgaatggatgcttgttggcaaggtcctctcgccagcaatagtgcatgccaccacagtattccgggcgatgaaaccggcacgggggaatccctacggattgaagatcagatccatcgacgagaaggcggataacatttttgtcacgaaatttaaagttgagcgggacttgcaacgtgctttgggtggctcgccgtggatggtgggacgccacgtcctgatgctgcagccctatgatggaaacctcaaaccttcagtaataaggtttaatcgaatggagatctggattagaatcttgaacctcccactcggctggatgacaagcaccgtggcgaactcgctatgggattggttggcgtagtgaggaagttggaggtggactctgacggcaaagcgagtggcccttacctacgtggacgtgtggcgattgtggtggccaaatcactaagaagaggtatgcttttgaagacaaaaaaggatgcagcaccagaatggttttatctgcagtatgagaagctgccttattattgtcttgcgtgcggtatagtaggccatttagagctggagtatgagaaaccggtggtccgatatgggtcgggtaagctaccctacgacataagacttagagcaccagagattcggaagaagaaattgctgagcttccaagccgcagtggcagaatcctttggcagtggctcttcgggtggttcgaagcagccgaagggatcatcgttgagatccaaggacgggcgcccgaagaatcctacctatgcgatgaagatgatgagaccttgtcacctccgggaaaccaggcctctacttgagagaaggcttctaatcagggggtggttgcaaatcgtcacttatcctagaataacaatgaagatcctcagattgtgctgcgaaaaaggaaagcgaatggttcgtgtagtacctcggtgtcagaccccaacaatcaagtggccaatatgacagccctagttccaaggggactggtgtcggagcgagtgagtcaactaggcaagacaggtggagaggtggaagcatctatttcggaggtgtcgccaaagaaacagaaaatatctgaatctctgacaatcgcatcatcggcagcgacggcaggaagcagtccccaccgggcacaatgaaactcttacgtttgaattgccagggcctagggcagctcgaggcagttcaagaagtacatgtggtggtctttctctcagaaactcgatgcttctccaacaaggtgcaaggattgcggagtagcctcagtttcccgaatggcattggggtgggaacctatggttgcggtgggggtctcgccctactgtggaacaacgaggtctgtgtgaagctgcaatcatatgacaagcttcatatagacgtgatggtggtggacccggtatcgggtgtggatctgtgtcattttactggcttctatggtgaagctaagagggaacttcgacaccgaagctaggaactgttgaattttctgaatgaccaaagcaatgccccgtggctgtgtgctggggattttaacgaaatcttagatgccggcgagcaatttggaggggcgctgcggccagaaagacaaatgaatggttttcgtgatgctgtggccatgtgtggctttcttgacttgggtttctcgggactgccatacacctgggataaccgtcaagaaggaattcataatattaaggttagactcgacagagcttttgctaacgcctcgtttgcggatatgttcaaacagatcaaggtagttcataagctaacaacagaatctgaccactgttgcctggtgatcgagtgcaaccgatccaagaggcgaagaggtagaagaactttcaaatacgagaacatgtggaggagggatccttcttatctatagctggttaaagacacatggggggatgtaaaccatgtccaggattttggtgagttgcaaaactcgcttaggaaaatgcaatcggcgttccaagaatggatcacacggtttttggctcagtacggcaggaagtgcgcaggttacactgggaacttgagaatgtgaggagctcttccctccatttaggcccatctcggtgggaactgcaaattatgactcatatttctgaacttcttgcacgagagaaaataatggagaagcaacgctcacgcttgacatggttgaaggaaggggactgaaaagcaagggaacgagcaaagactaatcagatactagctctgagggcggctaatggtgatctgattatgggacaggcagcgatggagtcaatggctgtggacttctatggtgacctattcacggcccaaccaaccttggagccagacagcattctgacgcatgtaccgtggcatgtgactgaggccatgaacgagtcgttgtagaggcctttttctggacaagaggtagatcgggctctatctatgatgggtgcccacaaggcgcctgggccagacagcttcacagttggtttctaccaagcgcactgggagacgattggcccgagtgttaccagagctgttctgaattttctgaatggaggcgagctaccggaggcaatcaatcagacaacactcgtgctaaccccgaaggtaaaacacccacaggatctcaagaacttcagaccgatctctctttgcaatgtggtctataagttgtgctcaaaagtactcgccaatagactgcgagtgttcttggatgagattatctctgcagaacagagtgcatttgtgcctggaagactaatcacagacaacgtgctagtggcctatgaatgcactcactatctaaagaggaagaaaggaaaaacgggggcatgcgcagtcaaacttgacatggcgaaagcctaagatcgagtggaatgggactatctccaaggtacgatgttaaaactaggatttgcagaaagttttgtgcgaattatcatgagatgcgttacctcagtatctttctctgtacgggtcaatggacaactttcgaacccgttcaagccgtcgagagggattcgtcagggggacccaatctccccatatctcttcctactgtgcgctgaaggtctctcctgcctcttaagggtggttggaccggtgcatcttgccagaggtgtgcaggttgggatacacgctccatggatttcacacctgtttgcagacgactgcattgttttcttagaagcttcgtagagaggggcttgacggttgcaagatattcttgacttatacaaccgaggatcaggacagttggtgaacagagataaatcagcgatctttttcagtgctaactgcgataatgcatgcaaacgggaggtaagagaagttttacatattgatatggaagcattagcggagaagtacctaggcctccctactgccttggggcgggcaacaaaggacacctttgaatttatgccaaccaaaatcagaaatctagttggaacatggagtggccgtgaagcaagttgtgcaggtagggatgtgctgttcaaatcagttgctcaagttgtaccgacctatcccatgagctgcttcctaatcccaaaggatacttgtcggaaaatgaaatcaatgatagcgaactactggtgggggagctcggcagatagcagacgcattcactagcagcgatgggaactactgactaaaccgaaagctgatggaggcatggaatttcgagatttgagattgttcaacctagctatgttaggtaaacaaggatggagactgatcaaaaatcctaattcactatgtgcccgagtgttgaaaggcagatactatcatgagtcagagttcttacaagccactcggaagaaacattcaagccatacttggagagctatattagcgagaagagatattctgttcaaggggcttgtgcgccgaattggtgatggcaattcaacgaggatctggcaagatcgttggttgcctggacatttcagggggaagccgattactgaaccagttcggcagcatgtgcatgtggtgtcagaccttttaatcccaagtggaagttggaacactgaattaatcaaacaactcttccttgatgtggatgcccaggctatcctgagtttgccggtgagtggagtaagagaagattcctgggcttgggaactcaaaagacattggaattactctgtcagataagcttatcgctgcttgtttgatgaacagaggcagttagatgctacatctcatgcaagtccctcaggagacacgacttggtcccgaatttggaaactatgtgtgcccccaaaagttcgcgtcttctggtggagggtggtaaatgatttccttccggctaaataaatctgttctgaaacgcagacacatagaacccattgctaattgtgatgtctttggaggggaaaatgaatcagtgaggcatgttctacttgaatgcacggtggctaaattcttttggaaccagacgaaaaccttatctggaatcaaggtcctgcacctacacccgcttacttgggcgtgtgatctggtcgacccaaggtgtgtcccatccaaagaggctgcagtaatcttgtgtggctttggatggcgaggaacagcaggtggcatggtgaggagccgcgaccggtgagagctgccacacaatgggctattgataccgccttcgatctctggcaactgattcatccggaaaaggaaagaacaatgattggtaatccaataccctgggaacgaccggctccgagatgggtaaagtgcaatgtcgacgcagccttctaagatggcaaacgctcggcggcatctggggcagttcttagagatgaaaatggaagaacttgtggaggcactgctcggtggtacgagtactgcctaaatgctcttgctgctgaagcattggcgtgctgcgatggcatgatgctagctcgggaaaaaggtgttcaacgactgatcttggagactgactgccaagtccttactggtttatgggagatgagagcacagcaatgttcagaaatctcagctctgcttacacatatggagatcctcagccggaggctggagcttcatagacttcaatttacgttttattagccgaaactgtaatagggtagcgcatgcttgtgcccggatggtatcccagaactctctcaggtggtggagtggcttataaccccaactgaacttagggatatcttaatctaagattgtaaccctgaccgtgattaatgaatctacggtcccccgcaaaaaaaaaaataacaattcctcaccacataaaccacatcgccaaacaaaatcagccaagttgtgatttacccccttcttaagcctatctcaattcctcaacaaattaaatcctcagtttatagatacgcccaccccactaactatattaaatcctccacaaattgtttgtcttgatatgttaattggttaagatctttgtcttttaaaaaagaagacaatgcccatggtacgtatatatgaaacattggaaatgtatctgcccgatgcaaggagtgcatgatattgtccaatcatttgtttttccagaccatatgagacatggctataagcacgacacgatcgagagctagacagctaatctccatgcgcacgcttaattccgtcatgtgatcgatgcaatcgtccacacatattaattactagttgggtgcccgtgcgttgcaacgggaaataatatatcaatttaaaattacacttagtgaaatgatttaattcgattatggtcatatataaatatattaaagacaaaatacgataatatggtatttaaggaaaattaaaaataacttccgaatcaaaatatatgcataaaaatttgcatgtcaaatccaaatatgcatatcaaagaatattagtgacccaaacatcgtgagcttgcgaaaaagcattaagcgccagcaagaacatacctaaataaagatcaattattttcactccttgctgcaaatcgcccaaaaaacctgaactaccataatgttacctgaagttttggtttctgtatggttttgttaatatttataatatatacactgtaggaatcttttctatagtgtttttacataaaaaaaaactgaagattattgccagttgaccaccatgcaaaagtctgagatgcaatccaaaggccaaacctgaggtaaataaggaaaatgataagaggctcatccagaaacctccgcacaaatttattatattatatttctctttttattttggctatcaagcaaccgtcagtgacacaatgcagtctcaattaagtatttgacatttaagaaaatagatggtataagttcagtacagtaaaggggaaaattgcgagaacatcttctgctcaataatgccaaaaagtgacccagcctctgaccagctgacctaagaaatgttgaatatcgataagcatttcttaactgcaatccatttgctctgttcctgaaaccattcacaagatgctcgtaaagaatgatagcatggtgaaatatcactgtgaggaatacattacttgttactaccattacattgcctacgagttttacttggctatatggaaaacagcctgaaaagaattccaacacacagggtgtgtttagttcacgccgaaattggaagtttgattgaaattggaatgatatgacggaaaagttggaagtttatgtgtaggaaagttttgatgtgataaaaaagttggaagtttgaataaaaagtttggaactaaactcggccatattctcatagcaatcatgtcaaaatgatccagtaagggatgtcagcatgtatcagatgtgaagcttctaaattttgtttaataaccacaacctagcaagagcaagctttatactacccataaaaaaataataaaagttcctcaatatcaggagtaaagccagagaggctggtagagggtctatttcattgataatgtgcattatatctggttgataaaccaattatgttctggttaatgagctatacctctgacacatctaaatttcttgttacaaatgcccagtttcctaataagatccaagacactcagaccaataactcagctccttctctattaatacaaaggaggcaaatcttttgcccatctttcaaaaaaaaaaaaaactcaggtcatatacgaattgagatctgttttggcatttaagtgctgagagcaccaagctttaatgaaatttgtgcgtatatggctgcagctacaaatgaaaggttgaagcctatcaacagaacattgttttcagactgtgaacagcctcattgaatcaaatatttattttcacagttcatgaaacatttcaatgtctcctataatatcagtccatgattctttttacccacgcatttggcacctggaattctttttacccacagtttctccctaattatgaagcgtcctcacgttgatgcaatgcaaaaaaaaaaaaaaaaaactaaactaaacgatcaggtctgataaacaatcagatgatggcgatgtcagcctacaatttgcaaggaataaacaaagaccaaacaaaattgcaaagaggtctagaaagctgctcaccaaggtggacctcatgaccgcactgcagccttgctgtagaccatcgtgtcgaggtagatcaagcagtcgatcagggggaagggccgtgaggccttcccagcgatcatctgagaaggccaaacgtggcgtggcgtatgcaaaagatcgcggcggacagcagcacttcgtcggcagaagatcgtcggcaggcaactgatggatagagagaggaggcacagggtatggcgatttgttgaaactacaatgcagaaaacaaacaagtcattattaatacccttcattgacgtgttcagatctactacaaaagaaattggtaagactacactatataaaatatcatctcaaagattatatatgatgtatatatgaatttggtggtgatatataaaactatcagataaaagaattacatagaggtatagaacagaggaaattgagggccatagacctccctattattcctatattgtgatagtaagttttcagacttccctatcttatatttttcagaaactttcagtgttgaaatagataatgtcgcatcccaatgtttgcatatatgaaaatatatacatgtatattaagaaaaaagttctgctgcagcataatatgcatgatagactgactgtactaaagaccatatgagaacatatactactaagtagccttgaattaaataaccatgaacaagtgatatgtgtctggcgatcggcggctgcagaaagttgtcctgggaagaagatcagcggcggcggctgctggagaagtacccgacagccagcagctaatcaccgttctattcaaaccttcgatccaacattcatcaaatcatcagacacagataataccctgcaaacaagttgaaaattttagacattgttgcaaacaagttgaaaattttcctatgtacagcaggataataatcgacaagcaaaatatgcctatattttgctgatttaatggaacacacattgtcttgatcatatatatttactgcatgaataaatctgtaaacatatgaagatgtgttttcaagagagagaatgaagggggttggagaggggcagtagtgaccagctgaggtggcggcggcctggacagcgaccggtggagccggtgaaacg

SEQ ID NO: 65134 - DNA, 1687 bp, Oryza sativa
gttaggagtaatcttaagtacagataataaaccaattattagaatctattcgttataaggtaaaacatagaatatcatatttatgcattaccctgaagtagcaaaagaacactaaacttattgttattaaattgttttaataccttaatttttttaaaaccacacatttgacagaagtctgtaatccaatattgttagcacaccaagcagcaaaacggtgaaacagcatatcctcgtgtcttgagccaaccgatagcacctcatactgtcattaagcatggatagctaaaaccagttatgtactccagctttcagtcttgaaggatcatgagggctgcttaacacaagcacgagtcatcgagaaatacatggaatgcatcaactgctgaagccaccactctcctgtgacttgtattgagaagaagtaactccagtgttcctattgcttcccacgcctaaagtggatttcctctttcctaataatccaaacagttgggaaaattctgaagttcatatggattttaagacgcaacaagtcaacaactcgccatgcatggttatttgctaattggcccaatagaaactattggtcttctttgcagtaatgaattcatgtttgtgtggggatatacttttggttatatatttcaccccttttttttgttaggttaatggaagagaacatttcacgcctgatcaacacccttacatagagatttttttttatgtacgtacttaagttgcttgatatcttaaatatatatgtagttttcggataaccaaaagagctagtgagaagtatatttttttagataatgtaagctttattgatctcagtcattctgaggatactctcgtcctttgcaccattgtcgtgcacacagccaacaaactccaacacactcaaaataagagaaaaaaccagcgtgcaagatcaagaccctacaacccgaaaactaggtcgccacccatatgccggggtaaaaaactccttgaccacttgctccaaatgtagataagccgaagtgacaaagtcctgcaaattgagtttctggagaataacccatgatcggagccaatgtgtaatcaaggaaataacctgcaaaggagaagaaacagttttcctatcaaaaaccatgttattccttgagcgaaattgcccagcaagttgttgccacccctaggaagacaagaggtctaaactctttggtatgtcataaaacccattgcctaaacatatgtgatacgttcctaggcgaacaaatgtttgaagcaatctggattagagaccaaacctatcgggctagccgacaataaaaaaaaataaatattttatcgtttcttctctgtggcaaaaacaacagatcttactccctttcaatttccgcttagccagattatcttttgttaacaccactcctcgacatagataccaaaaaaaatctttactttaagaggcatttttaactttcaaatagttttgttaatattaggagctcccatatgagccaaagcaaaataatgagatttaaccaagaatcttccatctggtgttagatttcatttaaacttatcttccatctggcgagaagtacatacaaaatagttaaaatagagatctgaattcaactggattaatttcttgcattttagccttgtcagtgttgaattgtcacacattggttgt

SEQ ID NO: 65135 - DNA, 2316 bp, Oryza sativa
aaaagcacttctccaccagtgtactacacatgttgtgaaccatgataatctcaggtctaaggattcaacagcaacactaaatgagatcactgatgacacaatacatatggctcttgcagtgtctcatgttgggtctatccaacaacatgttcaccaacatgtgtccatattattaatttggtatctctataccatgatccatgagacatgatcatcaattaatatatatgctgatcatataaacatatttgttccacatatgatatttgatcagaatcctttagaaatagtaacaaacaacataaagagtcccatgaaagaatcacatatagattaaccaataatgagttatctatttccaggaataatgtcggataaatatgtaaacatagtatgtgatacaatcatctttatgattgcctctaggacatatcactaacataaacccgtagcaagcagcgagcggcagcctccacgcgctactccgcgagcgctgcgaagctccggccgacgcggcagtccgcctcagtgccgagccgcggctccgccgcctcctccggcaatgcgtggagcgtcgcgaggctccatcacctccgaggccacgcgcgactccgccggtcgcgtgcggctccgagtctccgacaccctccactggctgcccgcgaccccgccgagtcgacgtcgcgaccgcgtgcggtccgtcgcctccgcggccacgcgcagctccgcacctgacgcacggctcggactcctccgccggctaacgtatagcgatgccgcgtgcgcatccgccgcctccaccggccacgagcggctcgagccgcggccactttgcgcttccgccggccgtatgcggcttcgtcgcgtcagcggccccgcgcggccggcttcgccgcctccgccggccgcgtgcgccgccggtcgcgcgtggcttcgccgcctccggtcaccggcgccggcctccgttggctccgccacgccggccttcgcaccgtaggcaatgccgcacccgccttggccaaggccgcctccgcaggagggccgtgtgcggttgcctggtctcatgacggccattgctgcgccacacatcagctgcacgaagtgggctcactcgtgcgcactcggcgccagcaggccctgagcaaagggaaataggcggcaggtatgcatgcaaatgcatggttgcatgcatggtcctgttcacgtatagattagaaaagaaaacaaacaaaaaaaagaaaggagaaaaggagggcgtacatatgggtccgcggcatgaccaccctcgtgggacgtagattctaatcactcgagtggatgtccactcatttagtgtatgttaactaaatgatcatgaatttttttttaaaaaaattacaagatagattaatatataatatatcactacataaacatgtaacttaaaattcaacttttataagttgtaaaaaaagtaacaaatcaaacttttgatttgttatttttgttacaacttgtagaagttgaatttaaatttgcatgtttgtggggtgatatattgtatatgaatctatcttgtcaaattttttaaattttttttatacccatttagttgacaagcaacaaataggtggatgtccacctaggtgattaaaagtgtttccccaccctcgtgcgatccacgccgcagcatgtagccgcatgcggcttcgcagctccgcctccgaggccccatgcgcctcgccaccaccgcggacaggcgaggatccgccggccacgtgcagccccgagtggttccgcctgccgtatgcggcttcgtcaccacctctgcggcgaccgcggtttgccgcccccgcacggccccgcttgcttccgccgatcgcgccagccggctccttccgctcggtgtgcgtgcggccccgccgcctccacagcctggcgcgcagctgcgcccttctcgaatggtcgcgcatgcgaatgcatggcactgttcacgtgattctctctctctctctccatatatatatatatatatatatatatatatatatatatatatatatatatatatatatatatatagtaaattataaagagtgctccactcgcagcaaggtccagggcggcgctgccacggccccgtgcggttccgccgagctccgccggacaagcacggccttgtacggccccgccgcggggccgcgtcatgtgagacctcccccctgcggcctcgccgacgcggcggttgggccgaaggccacgcatcccgagccttccggcagacctgagcatgggcacacgccatgcacggcctggtgatggcgctgtcccagccac

SEQ ID NO: 65136 - DNA, 10360 bp, Oryza sativa
cacatcagcaagtctgaacaattcctgccacaatgcactagtgaagattctatcacgatcactcactatcaccttaggcattccaaagatgtcataaacattagtgataaacgctttggccaccgtcagagcagtgaatgggtgagaaagaggtataaatttggcaaatttagagaaattttcaattaccactaggattgtgtcaaacttgcctgacttaggaagcccctcaataaaatccatgcacactgtgtgccaagcttggaggggaaccggtagaggttgtaacaaccccggagttcttccatgttctacttttgctctctgacaggtctcgcattgctgcacaaactggtggacatccttccgtaggcttgaccaagtgaacagacttataatttgttggtatgttgcagcctggcctgaatgccccccaataccactatcatgcaaagccaacatcaccgcctatttagctgcagcatgctgtcctaaccaaattttgccattcagtcgaattatcccattcaccaatttatatccaccttgtccttctggatgtaagctaagtgcggctagaagcttcttggtatcagcatcctgttggtactcttcctggattatctccaaccaccttggaacactgatagagactgccaacaactcatctgagttacttctcctggacaaggcatctgcagccccattgtctgaaccctttttgtacttaattttatactgaaaccccatcaacttgacaaaggccttatgctgcatggtccttgtcagcctttgcttacgtaaatgacttaaactcttatggtcagtcagaattaaaaactctgcatgctggaggtatgccctccatttttccacagctaatagtattgccatacactccttttcatatgttgacatcatctgagaccttttactgagtgccttgctgataaatgcaattggatgcccagcctgcgttagtacaaccccaatccctatgtcactggcatctgtttgaaccacaaattgttgagaaaaatctggcagagctaacactggagcctccaacaatttcgatttcactaactcgaaggcttgttgctcttttgttccccacttttaactcacatccttcttaagtaaggtggtcaaatctctggtaatcaccccatatccttggataaatttcctatagtatccagttaatcccagaaatcctcttaactgtttgacagttttaggaataggccagtcttggactgcttttatttttgatggatcagttgccactctagaagctccaatcacatgcccaagatattccagatgttgtttggcaaaagaacacttactctttttgacaaacagttgatgccttgctagaatctctaacacaatcctcagctgactaacatgttcttgtagggttcgactataaatcaagatgtcatccataaacaccaacaccccttttctgatcaaatgggcaaaaattgtgttcatcaatccttggaaggtggctggtgcatttgtcaatccgaaaggcatcagtctgaactcatagtgccctgatggtgtatggatgacatctagtgggcccaatattaccctcctctcttctgtcaaaaaaaaaatattaccctctcccctcacgtgcgtgtgtatgcgtcctcctccctttttttcctccatggtagttaaagatctaaatcatttatttgataccgtgagggagcattctttattcttaaaatgataccgttgttatatattcgactgttctgctctacaataaacaatgcaaacatagataactggttcaattgttatttcttcacaagataaatttaggcttggaagacattgggaaaacaggctacacatgctgattcccaccagcttatacacacgatcaagcacagcttatgtcgaggatatggcatagttacccttattaccacatgatagaccgccatagcgcagatgtgtgcatgcgctgtaatttcatgccatagctattgatatccatgcctttgtgggggagatgtctgttggtgatatgccctagaggcaattatagaaatgattgtatcacatactatgtttacatattttatatccaacattgttccttgaaatagataactcattattggttaatgaatacgttgctatttctaaaggatccctaatcaactatcataagtgatacaaatatgttcaaatgatcaacacatgtattaattgatggtcatgtctcatgaatcatggtatagagatatcaaattaataatgtggacacatgttgggaaacatgttgttggatagacccaacataagacactgcaagagccatatgtgctgtgtcatcagtgatctcatttagtgttggtattgaatccttagacctaagattattatggttcccaacgtatgtagtagcttacttagggactgctaaacgctactccgtaattgggtagttgtaaaagtagttttctggtatgctatgaaacatgtagtgggatatgaataatcaagatgggattctcccctatggagagatatatctgggcccctcgatattatagattatggaagtgcatggccatgccaaaggtgattgaggaatcaatcagaagttacataatctatcacaagttcgagtgaatgatttagctattaaatgatggcacatatctagccttgagtttaatcgatatcgtgaggcaaatggggttcatacaagtatgcactagaggttcaaccgatatgatctttgtgtatgctcggtgggtcaatacattttgctaggggccactgttgacacgttgaccgaaaaggagtgtacatgaacctacagggtcgcacgcttaatgggccggaataagggaattggatggagatacaatatgagcataattcgaatagggatctgaataggagtcctatgggccttggaggttcgagtcatggatcctatatatttatgaggggggtgaccggcggtgtgattgcgtcacgtgagaaaccctagccgccactaccctcctcgagcaaaaccctagccgcgcgcggacgctagcacgtctgcgcgtggcattccatccctattcgtgtggataccggtagaggtgtcgttggtttgcggtgctgatcggtgtgagaccatggcgaagagaacgcacgaggaggagaatgtcgagctgctacgatcgactacttcctctacaccaacacgcgctatgtcctcgatgttcccccggctacttagcatttacttccactgcatagcacatcgagtggtaacgatctatgatctaatacttgcatggtttctggtttacgcggtagaaaaattttgatttatgctatcatagcctacaatgtcaacggtcctggcagacaagttaagaaaattcttgccgatatgctgagaagagcttcgactgctgcagcttccaggtagatccactataaaagctgggtctgcctggtttctagcttctcttatactagattataccccgcacgttgctgctggattttttagatgtatcttgttcacttgaatttgttttgattaaaagaaaatcatgcatacttctgattaaggcagatgcatatggttttataagtccaggggcagcctgctgattataggcctgttagaaccgtagaaccaagcaaagcagcatgcatcccaacaaacataagcatcaagatgaccttgacgtccaaattaattagtgttggtgaccgatgatgaggtacatgagtgttgatcccaattgtacaaccaagcaatgttcggcgaagagtaattgttccacaatatgtgtggtacagaaaccttgtaaaataaagcaatatgtatatcacagtaaaaactgaatgtaaaatgttcttagaatgcattttgtggaatcaaaattctccagtttgatgggaaattaatagttgaaaagactaatttggtgtacaacaatttaagaaggatcattagagcgagtgagaatatttgggaggaggatggggcagaaagacggcgtctattcatgtaattgattggttcaaaacataactggaaatttgataccgaattcaatcaagattgagtatatgagatgatgaagtcctgtcgccgccggtcgaaccgcccacctgccgctggtcagatcgccgaagcctcgccggtcagaccgctcgaacacctgcggtcaggccgccgctatcccaccggtcaaaccacgcgcacacctgcggttaaaccatcgggacctagaaacattggtagatgcaaactcaaagatgcagattgaaacttttcgactttattgcatcaactagtgtttacaaagtgcaccaagagcactcctcaccataatctcgaactaaactcgaaaccctaactttctctcaactctagtctctctaaaatcgataccgggaggcctcaccctcgcctctatttatacatgaggtaggttgtgcaaagcccatgaatctaacacaacttaggactcctaacccacatagaaaaccctctcttgcacatatccaactaatatctttccttatctcaatcaaactttccgaattcggactcccttccaaattcgactcctctttccatacgtacaccatccctcttgtataccatatggatttcttcatcaccacatgcattgtcctctagcctttagtatcccgcttgatctcttgatccctggacatcaacttctcccaagttgactctgatctatcaccagcaacactctcccgagtcctcaagcaactcctgcacatgcaacaaccaagaaaccatattccgagctcaagtttgtcccaacttgactcacattagtataacaacattatccatactcatagaaaccgtctagaagccaaatccctgaaggaaatatccaaatccaacaaaacaacccgaaaccaacatcgatcaggatcctgccgatcaaaccgttgggccgtccggtctgaccgctgcaacacctgcggtctgaccggcggcactcagccggactgaccgccagggtcaaccgaaactgcacactccacaaaatcaaccatcttataaaatctccaaattaacattagcaaaccaccaatattttcatcacaaaatctaaatcaactccttgattctacccaactcgcatccagcacagccgccactgtctgccgccgacgtcgagcctcccccgccgcctagtgtccccatcagagcctccgccaccgccatcgccgacaagtttattcaccccatttacagcagctgccgccatcccattatgtctccttcccaatcgcagttggtgcggaccattcaaaaatggcatcacaatgcctgctaaccccaaagtgccccaactcaaaaatgacctggtttgacgggaatatttttttgctcaagcggtcaagccgttgctgggacaactaaattcagcaacaaagtgcaaacaagagtgatgtgaaacaaactacaaacctggatgatttatgtttctgtcttattgtttcattcatggcacaagtagattcacgtaacatttgaaaagcagcaggtattaacctctagcatatgagtctggccaatgcattctacaccaagcataacagcgcagaactgcaacgaaaatggcacaataccaatagctcgctgctgcacatacatcataaccaacagcagaattccggagacatcaagcatcagaaattttcgtcaccaattgcacaagtcagccccagcaatgccaggatttctagcaaagcgcctacacagtggcggacacagaattaaaaccaagatgaggcgaatatgttcgctcttcataaagaccactaaacgcaataaataccatatttatactgtaatcacatcaaaatatacttaagaaaaatatacttaaggcaaacaaatcattttataacaaagcaataatatttgccccatacataattcattatacaccaaaagattcacaaagcatggttgatacataattttgtttagtactttttaattttagtaatttattatacattaaaatcactttacttttaacaatgttcatgatagggtttttttttatataggcctccatcatttatgttgagcgatattttttttaacttcatactcccatccctaaaatcatgcgtcggccactgctgactgatgccattccgaggcctgataagcttcatcaagtggacgtacgtagagcggaaatgctgttgggcgatccatcgccctggggatggggtagcgatcagattcactccccacctcccccctccctccctccacctagtttctttttttttaccgcattactttcctattttagtaaatttatacacctaaagtttatacacctaaagtttacacatctaaagtttagagaccaaaagtttataagttaaaagtttatatatccgattcaaatttgaatttgaattcaaatatttttttatatatagtatttttatacatctaaagtttatatacctaaaatttatagacctaaagtttataagtcaaaagtttatatacccgtttcaaatttgaatttgaattatatctgattcaaatttaaatttgaattcaaatattttctatatatagtatttctatacatctaaagttcatgcacctaaagtttatagattcaaagtttataagtcaaaagtttacatacccgattcaaatttgaatttgaattatatccgattcaaatttgaatttgaattcaaatattttttatatatagtatttctatgcatctaaagtttatacacctaaagtttatagacccaaagtttgtaagtcaaaagtttacatacccgatttaaatttgaatttgaattcaaattttttatatatagtatttctatacataaatttttctaacttttgtttttaaagaaaattgtgtggtgtactgtagtagaaagagaagaagggaggaggaagggggagaagagggaggagtatagggggggactgatcgctggatcgatcgcccattagaagggccccagtagagtcgcggatctggcagctggtctttgtgccttttatatggaagcaaccaagtaaagattctaaaagatgaggctacttgtacttaaaaacgtgaatattagggaaataactaacctctattattataaaaattgaagatatttttgcccggtgctttggtacatcatccgtgtttgaatcaattttaatctctatatatctctatctaaacttaaaaataagaaatttccaaagtaggaaaaaaagaaaaaaaaagattctgtcgttggtaaaaaaagagaaaaaatagtcctactccaaagaaaaaaaaagtctcgccactaaaaaaaaccaaaaatgtccgtttggtttttttttcaccggcgactttttttcacgtgaaagagttttttttttctgcgcacgcgctattgttttttcttctccggttttttaaatcaccgcacgcctcacgagcgcttttggtttttttgtcaattttttttgtcaccggttttttatcatgcgtgcttttggtttttctcatctggttttttaatcccatctattcgtggcatgtctaccgagttgaactctggcgccacgccggcaccatatcaatcgtgcgttttctctccaatttgagtgcaaaaaaaaaatcgattcccactccctcatcattttctccatgattttgctggctttatttcgtcggatttaatttaccggttgccgatgatgatgacgatcttccccgattgtttttatcccgaattttacactttgattttgggtaaaaaggaaagaggcgagtggataaaaacccttaaccaattttgggtgatcgacaaagattcggccggatttgatgggtcgaagaaaacaggccaaacagagagaggtagtggactggcctagggctgaaaacggcttcactcgtggctgggtcgaagcgagcatgccaaatggagggaggtagcggattggcctagggctgaaaagtaaggaaagctttcgacccaaaacccaataaatattttcattaaatttttttaattataatatatagcgatcccaatattaagattttcattaacaaaagttaattataatgtatagcgatcccaatattttaatttattgttcagctcttaatatatcattgaaaaaacgtttttacccgttgcaagttgcaacgcacgggtattttttctagtatttataaaaaaaaagaagaagggtggggtttcaaacccaggccagctagccctccaacttgtggagcaagtcggaaaaccctgggcgtttctcaagcttcctgtactccatcaagtcgctcttctgtggttacatccaattttccagtagtttgtatgctctccagttaactgacgaggcaaaatgttagtgcagagcagtctggtgtatgagacacattagatctcctgcttgcatgcttgcgtatgagagcaaaatgaccagtgctccttttgagttttgatctgcttcgctgagttttacttgtgaaaagccatgcaacagagtatatgttggttgattgactcatgggattgaagatatatatctcgtagtttaaggatcttcatttttctgtctttcagtatattggaggaaagaccacggtaaataaaatatattacaggaaaaagtgcagtggaaactgaaattcgaagttcatagagatgaaaaaaagatgatctacgatgcacaatatcaaatgaatgacaaaatttaattcggtccaagcatgcaccacttggttgatcttctatacaaaacctaatgggggagtttcaacctgctggaaaatcctaaaattcccctcctcgcatatctgagcaatctgtttgtacacactccaagtgaccgatatctccaccaatcaaatacaaaagtccatagtaattgggtgtatctacgaccggccagatgtaggcgttgttcacagtcactcagcagtgtgtgattcatcgccaatgtagttgtatatgttcaagatgtttaaatgcacttaacacgcaatcgtcactttctaccaccctcagggaaaggtcaatagtactagtagaactcactgtttgctccaaaattaatttctccatgtcaccaaaagctaactcatagccaactcatacggcatgcgctacaagttgtcattggttaaaacattgaaatattatggcagatggccaaggccaacttgtataccaacctaatgtaagatggcatctagctcttcaattaaccttgcactgacaacgattgtcccatgtccacatataaccttgcatattttgtatccatgtcactaggaaacgggtgaagatttgggttgggatgtatggaggaaggacatgagacgatttatgaattagaaaatctagacaacgatatcccattggaacggaatacccttttatgaaatagtacatgatacctgataccctgttgtggtaccagctgcatggtacccgatacctgttactcggtacctgtgatacttaggacctataataccagtgatactcgtgcaagagaatactccatccgtcccacgaaggaggacgttctgctcccaaccaaaagtcccataattcttaacgttgtactctctcaacagcacacactagcaaactcctagaaaagcacccatctaaaaactcctagaaaagaagtggggccatctaaaacagtagcgaactctttctcctccaagctgtaggctgagtttagttacaaacttttttttcaaactttcaactttttcatcacatcataacttttctacacacaagaacttccaacttttccgtcacatcgttctaatttcaacaaaacttctaattttggcgtgaactaaacacagccgtagtgttgatgctagcacccagcattaattggatgcttcaaatattcttttttagcagatgtggcagtgtagtagtactagtcgtactcctacttaagcattcaaatgattagccccaatcccataaattgagggcaaaatggccattttcagacaacactaatttgacccaactatcctaggacgtccagcattctgggacggaggaagtagttaatatgtctataccgttgcaacggaattccattttgtagcagtcctctttcttttctgtatacctagtacctaatctggccggggtagaacctgaacaaaccacacatttatatgctcatggttaggtttgaagtacggatcttattatactcctcattaaaaaatttatcccaattattttccaagtatagctgtgtgcaaag

SEQ ID NO: 65137 - DNA, 1735 bp, Oryza sativa
ttagtccctcccaaggtggatcttaggacatcaaaagatgcttggagacccctacaacattcattcaaagcggatttgaagctccaaggtcaataggatagtttaatttttgaaatcgagttttaggaaaaaccgtactattaagaggggttccaagtgttgttctgagatataaaaagtgctcttagtgggttccttgtggtagaatatttttgggagccatttttgcaaatgggtccagaccggatagagaaggctggccggaagttccggtccctggacccggaacttccgaaccttgcgacatgtgaaattttcctaagtgttgtctggaagttccgaatgtcaggaacttccggacctcttccagttcaaaaatgtgagtaacggctagatgtcgtcacctagccgttatatatatccagatcgcaccttttggccattttcacttcagttctttcatgccctaggttgttctagactctcccaagatccctttgcttcctccactcaaatctagagccattcttgtgagattgagagaatagatgagagtgtaggagtgatttggagaaggtttgaagactaggtgtgtttgagcacttggatatcttgtgggctgttacttgggcttattactcttggagatcttctcctaaacggttaggtgccacctgagagcttccaaagatcatgtggatgtctcgagaaagtttgtgaaggttttccttacctccgcaaggaaacgaggtaagtgagtaaagattcttgtgctgagatttcagaggttctcctaggtagagcaacttgcacttgtggtcttttctagaaggatttgtgagttagatcttggtggtcactcaaattctagaaaatgacctagaaatgttgagttgaaggcctcggacttcttcgaggttctttgcacgggtgaggcaagaggttaatcgagacccagctctttggagcacctcaacggagagtaggattgcaagattcgaacttcgggaaaaaatcgcctttgtcttctctgtgatgattctatgcatgttgctgtgattgtgtatttgctctttcttcctgtagtttaattcgtgcaaattagtttaagtctctgctagatcttcaattttttctgttgcccggaagttccggtggttagaacaccggaagttccggacagtctgagcagatcggaagttccggtgttccacacccggaggttccgaacctgctgaattttaccgctgtgatttgtttgtgaatttcaggaaaacctatttaccccccccccctctaggctacatctttgcgcgttcaagcaccacctacgcgctcaagatcggctcgcaccaccgctgttgccctgcctcgggcaatagtaggtacaatatcatgcaattacatttcaaatcacatgtgagacctccacgtccaagagactgatgaagcaatctccgcggcggagtcagtgttgagaccgtcctagctccggccggatggagtagttcaccatgactcttgaaaacaaaaggaaaaaaaggtcatgatgagattcacgtggcctctggtccgcgaaccaatttccttggccaagtcatgtgagacctccgcgtccaagagacctgtgaagcaatctccgtgccggagtcagcgttgagaccatcttggctccagccggacggagtagttctccacgactcttcaaaacaaaaagaaaaaaaggttatgatga

SEQ ID NO: 65138 - DNA, 625 bp, Oryza sativa
tgcatctagacgggtcgccacgtagttatcccaccaggcagaagcggaccttgcaactggtgtgtagcaaaagcaactttctcttggtcgttgcattgcagtaggttcagcttcttctcaatagcacggagccagtcgttggcctccattgggttggtggtgtttgagaaagtgggtggctggatacagagaaagtctaacagtttggacacgtgtgatggtggaggaccaaactgctggttctgttgcgcctgctgcaacatctgatggtaatgttgctgcatctgttgcatcatcattgtcatcatttgagtgactgttgggttttcgggcggtggagatgatctgctgccagatgcaccactgacatgagctccatcggtctgctcttcgctgccactggcgtcgttggagtcacggggatcattccttgtcttcaccatctggaggaggataggtagaaataagagaaaggaagaaaacagacggctcggaaactaatctttcttataagattaagtgcaattatcttaatcttgattaaaacactgaaaaagaggcacacaactcctaataaaggctgtcataccactcacacatgatatcgaccgccgactaacccaca

SEQ ID NO: 65139 - DNA, 1250 bp, Oryza sativa
aaatttatcccaattattttccaagttagctggtgcaagtcatacgacaatagtactctctctgtttttaaaaaggaaaaagtacgaattactcccacgaactatcgcagatgtctgaattacccccctgaaccacaaaaccggatattcttcacccccaactatggaaaccggacgaattacccccctcgacctaatccgtggtggttttggtctacgtggcgtacacgtggcatcccagtcagcctttttttaataaaaaaatagtgggacccacctgtcatactctcccacctctctctctctcccctgctttcctctcaatgtctctccctcttcccctcttcctctcaatctctgtctctgtctgcactctgcaggcgtgcacgggagtggacggcggacagcggcgtcgcggctatgcccgagcggaggcgactgcggcggcggctgtgggcgtggcgcacgggggcgggcggcggaaggcggcgtcagcgcacgggggcgggcggcggatggcggcgtcgcggcgacggccgagtggaggcgactgcggtggcagctacgggtgcggtgcacgggggcggacggcggacagcggcgtcgtggcgactcttgggagcaagggcacacggcagcatggggacggacggtgggcggcggcgcgcgaagggtgcgctggcgggcggaggcgtagtcgaggcgggggcttggccgagaggaggaagcacgatttttccctgtaaatttcctggtggcttgtcgcatctcgttcatcgtcgtctgcctaagacttgacggacgaggaggaagaagggagcgattggtttcacggtaacaaagggagggacacgcgggcggccggagccggtggccaacggccattttttcatgcgtggctccctggaggttcacgtgattggcagagacgccaggtcgccgtgcgccctgagactgatgattctgtgcttctacctgttaatctatctgatggttttgttctatcatttgagttttggtcgagtccacggaccggacgctcgacgaacaacggcgacgaggtggtcgagcagggcagcagcagccacgccggcgtgcccagcccgctgaaccgctcctggcagagcagcaagcagtagacggcacagccggagcacagcgtccggtccacgcccgcagccgccgccgcagtcgctgtcgtggtgaactcgagcgccgccatcttccattgcgcgacccacgtctcgccg

SEQ ID NO: 65140 - DNA, 2028 bp, Oryza sativa
gccgccgagctcgtctccccgcgctcgctgcctccgctgccgcctagcctcgcctccctgcgctcgctgcctccgccgtcgccgggaggagagagagagagtgtgtgagagagagatagaagagagattatgacatgtgggtcccactttttttttaatacatagaatgctgactggactgccacgtgtacgccacgtagtccaaaccaccgcggattgggtcgaggagggtaattcgtccggtttgcatagttaagggtgaagaatattcggttttgtggttcagggtggaaattcggacgaccgcgatagttcgggggtaattcatactttttccttttaaatatatgacatgatgttttattgttaatcttatttataaaattaatataaatataaaattataattcatgtttacagtatatgtaattatagaaatgtcacaataaaatactgcattcataggaatataagacgtaagaatctaacttggagaaggcaatgtctccttaccccgtatcctgacagggttctccgagttctacttgaataaggaaacgtctagccgcataaatataacactagaaggggagcgcatcgaatcacaagccttagctatagacccacattgagagacagccaggtggaagagaagccctattcaccaacatcagctcgttgagacgtacttggtgaattctagctggtggattagaatagctaacttgctccccctttgtaatcagtgtggtacttttcagagatattcagataaactggtgtaagattattacttatattgagaacttgaaccagtataaaaatccttgcctcctatctccttactataatctcgtgtatatataccttaataccgacaaccccaatacactataaatattgttgtcaggtatagtccatcgacgaaaagctatatatattaccgggaatgtgaatatgcaagagaatatgttgacaatgaatagtggaatagcttatttatagaagagaacttatgctggtatatataagttggagatcagtaatggtatgcactgtccaccagttccaacgccatttctaccgttgtaaaggtagaggcaacactatactactaaatgatggtcttggaaggcatcaagaaagaaactcaaacaagttctgttacttaagtgttctatgttggtgctttagctagcagatttcatcaactatgtgcttattgttccggtacgactgatatgacgtactttcttgtgaaaatgaatcttcactgaagaatcttcagtgaatcttatttggccacttgtaaatttcagcttactataaggccctgtttagttcccagaacaaaaattttcatcatgtcacattgaatgtttacacacatgtatgcagtattaaatgtaggaaaaaaaccaattacacagattgcgtgtaaactacaagacgatattttaagcctaattatgccatgatttgacaatgtgatactacagtaaacatttgctaatgatggataaattaggcttaataaattcgtctcgcagttttcaggtggaatctgtaatttgttttgttattagacaatgtttaatactttacatgtgagtccgtatatccgatgtgacacgtcgaaacaaaaaattttgccaactagcctaagttgtcttgacaaatccatgtttaggttgtaaacatcaactccttaacagattaccggacccttgcaagaaagtagttaattaagggtcactggtgactttctttttttcttaaatgcaaactgtaattttctgccacttgcgcactataatcaccatctaccagcgcagtatattgattagtacaatggaccctgttgcgtcatttatgtgcttcaattattcaactagcacccataaaaaaaatcaatacaaaccgcatacgctgcatagtacatattgtgacgaacaagaagtggtgtatcactgctgtgtatcactgctggttcataagtacaaccggcaatcattgttgcatgcatcg

SEQ ID NO: 65141 - DNA, 906 bp, Oryza sativa
tttctactgcttctaccttgtgatccttgtgattacaagttatgtatactgaatcatttggccttcagtatttatttgtatgttgcttctttcaaagtgctaaataagatgcaatcttttgtaacattgatatgagtgtatatatgtcagaattttctcactatcttgaggttgatcctagtctagtatatataatatagggtgtggtcgtttttctattttgtctgtggtgcattggtaaagtatcgagagttccttgtacttaaagattgattgcatatgatttctgtgcgacaagtttatctcaatgaactaagtccctttgggcatgatctttttgctgatatgttttttttcgtcctgagtcctgactacacgatctagcaccatgctttacttcaaactcagtgatttccaggcagttgcttgatatctttggtgatcaccaggtatggtgtttgtgagatatcactttctgagtagcagacagttccaaaaggtaaaatgtactactctgttcactgaagattgatctgaacgttgttttacatggcaagaagttgaaaagagatcttatggtggatatttaaatgcttactgcctcgttggagtgatatattctctggattttcataggcatatagagccaacaacttgataaactcctcatattgatctcttggttaatcctcaaaaccacaatgttttgttctacagcattgaagatctaagagcagaatgcaactacgaaggcaaatcttcaaatctagtgcttcatttagcttggaacatattgtgattcctaatcattctcctggattctgaactggatggaactatttccaaaactttcaagtttcagcctcattatcaaggtcctgggaaagtaagatatcataccaaaca

SEQ ID NO: 65142 - DNA, 1390 bp, Oryza sativa
ccatgtattcaataaggcagtaaatgaaatgaattgaatttgattcctctcctgttgttcttcttcttcctttgtctccttctattctgcactagattccccagtctctttccatattatattgagttctcattgtattcgatcttgtggtagtttgtgtgattcgatctctcacgaacttgggtcataacaattggtatcaaagccgttccgatccatcgtctcttggtctgagcagtagatccaagcaaggttggtgtttatccttagcgccgtgattctgttccatggtttgagcagcgagaagatgagtgaagacggtggttgtcatgctcatggagacggtcatgtatgctttgaacaacacggcaagcaccacaaagggtaacaattttggtgaagctttgaaaagttagatgtcatgcttcacaaaggaggccatgtatgctcgaattttggtgaagctttgaaaagttagatgtcaatttggaccataccctcggttgtgcatcctcttccccagccggcctccgatgtaaattaatgcttcaccagcatcctcggatatcaccagtaatgtgaatggttgcaggagaaagaaagattgaggagattcagagagaatatgatttaggggggcaacgtagatatttcacgtcatccgttcacactgggacacctaagaaaacaatattaagaatttagaggttatatctccattgacaaaaacatctaaggccaaacctaaaaatggacattttcaaaagttgtcggtttttattgcgacaactagtggaaattcccccttggctacaacatttccactgttctcttttttttcttcttctttcctctctggctcagcttgctcggcacatctgttattttaatattttttaattcccagcttgcatcagtaaccacggcagcaacaaacgaagagtagaccaggcagcaggcagcagagcacaaagcagcagcagtagaaaatagcaagcaggagcagggatgggcagagcaaaagctagcgggggtggaagccagctagagcagatcgatccatctctttacgcctcttttttatccgttctccctttatttatttttgagagtgaatcgaacattagtctagatatcttaaccatgtactttcgtatcggatcagggacagtggcggacctaagatttttttatcttgggtgtgcccacgtaaaccttagtatacaaattgagtatttcattaaggttttaatctgaagatagaacggtactagagaggtgaaaaactacttgatgaccttatctaggctatgtttagttccacgataaaattgaaaatttaaagaaattaaaacgatgtgacgaaaaaattaaaagtttatgtgtgtag

SEQ ID NO: 65143 - DNA, 20219 bp, Oryza sativa
catgtcaccgacaacgaacatgcgagggttgtcaattctttgcctgacaaactcacttaccagctcaggagttgcaaaccatcccgctgtcttggccgttcgcggtttgggggcttgatatggtcggtccattcaaaaaggcagtcggcggttatactcatctctttgtagctgtggattagttttccaagtggattgaagccaaaccggtcgttacaatcactgcagacaaagctagagatttcttcatcaatattgtacatcggtttggggtaccgaatcgtatcattactgataacggcactcaatttaccggcggagtatttaaagacttttgtgaaaactttggcattaaaatttgttacgcctccgtggcacaccccatgagtaacggacaagtcgagcgtgctaatggcatgatacttcaagggatcaaagcacgagttttcgaccgactgcgtccctatgctggcaagtgggcagaacagctgtcgtccgtactttggtctttgcgcaccactcccagtcaggctaccggccagacgccgttcttcttggtttatggcgcagaagcaatgctgccgagtgaagtagaatttgaatcgctacgatttcggaacttcaacgaggagcgctatgaacagggccgagtagatgacatcaaccgactagaagaagctcgtgaagcagctttaattcagtcgactcggtatttgcaagggttgcgccgttatcacaatcgcaacgttcgatcacgagctttcttagtcggagaactggttttgaggaaaattcaaactacacgggatcggcacaagttatctcctttatgggaagggccatttataatctctgaagtcacccggccaggttcttattgactaaagcgtgaagacggtacacctatcgacaattcttggaatattgaacaccttcgtcgattttatgcttaggcatttcgtttgtatctttcctctttgactgctaacttcaagtttttccttgaagttttcagtcggggggctactatgataataatagagtgtgatttttgtcaattcaatttgcttacttgatttatcattgccctgcttggtctttcgacttagtcaatgaggactgaaggtttttaatagcttttacgggttttaggctcaataaggcttgacaaaggcttttaagaaatcaaaagctaagtatggaacaccaagcatagcataaattcatcagtattgtacaaattgtgcctccatcatcattaatcatcaaaatcattgttatatcaatcagtatcagttttttcatcatcggaattatcagacccagtcggccgaaagtcgacatcttggaatctctcaaccacgtcagcagcaatcttgtcagcggctttttgcgcatcattgatgaggtcgagggctgattcttcactcgtcccgtctgcaaacccatcaatggtatcgacatcgattttggggtataaagatttggtcatagctaatgccatgcttgctcccatactcccagcttccctgatattcttgaagtaagtatccggagcgactctcagcttgtcgaagatctcggaagcatcaagtgtactcggactggcgttattgaagaacatggcttggatgagtggggtagcggcattagcgactttatccctggccccttcaagcctgttgagcttttcaactaagacatcaaactgtgcctgggacttgatcttgcggtctgcatcaacagattcacattaatgaatcagcatatagaagataatggtttttgaggtattgattattggtatcttcaacctcatttaaagctgagtccctctgtcttgccagttctgccttgtcattttccagagtttgaatctgcttctccaattgagatatcttggcaacttgcactacattgactctggttaatcaagattacaaagataacaacagaagttagttgggcggagtttgtgcgtaccttttgatgagccactcagttcaaaattggattcctggagctcagcaatccgatccctcagatcatgttcattcttcctggcaagttcttttgtctcgtgcagttgattcctgctggctttgagggtcccgagatgagggactaacctctctaaggttgtcgttttagcttcattcctaagatgaatcctctgcaagacagtttaattagcgcttgaactaaatggcaaacgagatggttgagatcaggcgccaaagagcttacatttacaatgcgggttgcctgaccaagtgcctttttcagtaggcataactcttcgtcctctttttgcttatttattacgatcccttgaggttgcatgttgtcatcccaccacttgaccagaatgggagggcgcgaatcctcagctgctcgtatccggaggatctcttcttcatcaccaatcattggccctagtgtacccatgaataaagatgaagcaatcaaataaagtctgttggattgaaatgatttcagatagcgtgtttacctgtgatgattcccggtcggggacgagtggactcttgtgtcttcacaggagatctggtttctgagtcattgccagcatcctttccgggaggactgtttgtttaagcttcaacctcgggaatcttttggcttggccttgtatccgactggtttgcagtcgggggctcctggttaactccgactccagcttcggccgactggcttgcagtcgtgggtttgtcactgggttttacatagtcgctggcctgcggattatcacttgggtgatcttttgcagtcagcccggtttcttttgaggaatccgcttccatgttagtcgggtcagagtctttctcagaaggatctatgtcagatggtttcctacaagttttgctatcagtgttattttcatgatgggagagtattaatacaaggaagattgttatatgatttgtacctagaagactttctgatttttggtacaagacgcctagaggtcttcttcttcggattagttgacttcggaggtcttctggtcactcctttatctctgagctttccggtatcatcgctttcgtcgtcacttagaaccagcttcctcttgcgagaatctgactggccgactggatcagaagcacttggttgggtttcagaccgaattcttggtcctccgcttccctgaccagtttggcggcgaggtgattggtgctgggagattggaggatctaacttcatcaatgcgaactcctgagcataaatgtcaagcaatttaacaagagacgaaatcatgtttttaaggaaggttggaacgttcgaatacataccggtggaggaggattgaatgcattgaacggtacgactggcagcaagtgtgaatagctgacaacgatagcatttgagaagatcttatacatcctttccttcatgactttgaagtcaagagaatctggatcttcacggtttgggtcgtgcttgccgtcaaattcgaaggctgtgcgagatctctctttgattggagctaactgacacttgataaagtgccgggtgatctgttctccttgaaggccttgttcttttagctttatcatcctctccatcagttccactacttgcgcagtttcatctcccattggcagtgagttccaagtatcccgataaactggaggaagacaggagtactcggggagagcaggctcagggttttgaacataaaaccagtttgcgtgccagcctttgtttgaggttttgaagggcatagagaagtatttttggcttaaggttcccctgagttggaaaccagcccccccaacaacacatggtttgctcttgtttggctgtggtttgaggaagaagatgcggcggaacaaggcgaaatgtggcctaatacctaaaaaggcttcgcaggcatgaatgaaattggtgatgtgaactatggagtttgggttcagatgatgcaggctgattccatagaaattcagaattccccgaaaaaatcttgaggttggaagggagaaaccgccatagaagaaatgagcaaataccacgatttcatgcgtatcgggggttgggaatgcttcgccgaatgctggtcgccacccgatgatctccttcgctggaagaacgccgtgcgccaccatctccttcagattatcttccgtcacatcggagggcgcccactgactctcaaagctttctctttctttcgccatgaatgtgaactggatggtttaatttggtctgagatacggctggaaagggatggggaatcggagcggtggacgcggggagaaatttcgtaaggtttttgaagatggattggagcggattgatgaaccctagtttggccggcgcagtttggtactgtagcaggaaatggggaaaatggcgagagtttcggcggggaagacgatgtgacgcttggacttcggtgtttttagggtatcgggagtactaatgggcctggtcctgtacagtacttcagcccaatattataatcagcgtggcccgttgtgatccctagggacttaggcgctttttgctttggcaatttgtgctcacgatgatgtggccagatgctgttaaaatcctttttaacgtgattcaataattctttggaattattatgatgcacataaaaaggtgcccgacagaaaggtgttataccgtttttgtaagctttcttagtctgcaaaagctgtttgggttgatttaagatgactggtttattaatagtcattcttttagcatgttatatgcttattttagttatggtaagggtcatagcctaggctattagactcattgattaccatgattttttatcatgtttggtggatcattttaagagttttttactcggattcctatcaaatatgtctatttttggaccttttgagtgtttatcactcggccctttttgtattttttatccttgatatgttcaagttgagaagcagtcggctgggtattttactaagtaccatgcatgcttcgctataaaaccactcggttcttgactacatgtttagtttttcaactaattacatagtcgggggttacacctaattaggtgcatctactcgatgcaccatgttttattttcgcccttcgcagtttttgattttagcactcggcaagctggagcaagttgaattaaagcactcggattattgttttttgtttcgagaaggctattttgtcaactgcgaaggtctcgggggctactgtggagattatggataccccatatctacatgacattataatttagtcggatatacggtaccaaatatagatagaatatctctatgaggactcgggttagattctaaacttgtatgtcaaggaaatactcgggatcttagtcagttacgattgtattttatctataatcccatattccgttaggatatggactgtattttgtaaagcggacatcttcccctatataaggagaggtctgtgtgcctcttagggcgtgatcttttttccagtttatgcaatcaataacatactcggcggaatcatccccggacaagagttgggtattacttcttgaataagaaggcctgaacctgtataaaattccttgtcttcaaacctatccactttcctaacttgatagccacccctttttattattgccgaaatcttgtttcgacgacgagcattcaaatgccttggtgcacaaaccgtttcaggactcggatttactccttgatcgctgggctcgatggtttggcggccgagaagccaagctgctctccctcgaactcggcgagctccaccgccttgcccatctccttcaacctcgccgcgtagtccaccacgcggtcgtagagcacgtcgccgccggacgccacgacgagcgccgccgggagcgccaccgcctccaggctggggctctccgggccgaacgggttcgccaccgggtggtccctggtcgcgcccaccggcaacgacatacgccacatctggtcggccatctcgacggtcagcgtggagacgtcggccggcgggttggcctccgccgccgtgcgctccaccccggcgaggaacgggtcgacgaggacgtacccggcgaagcgcgccgggtcgacggccgcgagctgccccgaggcgacgcgagccgtgacgtggtgggccaagttggcgccggccgacaagccggagatgaacgtccgcgcgaagtcggccgactccgcgagccacggatcggcgccggcgccgagcgcggcctggccgcgcagccaggagatgaaagctgcgccgtcgtcgatggccgccgggagacggtgctccggggcgaggcggtactggacggagagcacgacggcggggagctcgtaggcggcgcggaggcagaagccgtggcagatggactggtccagggcgcctatgcagtagccaccgccgtggaagtagacgagcacggggagcttacctccatcgtcaccggcagcggcggcggcggccgtgcgcgacgtgtacacgcggaccctgaggccgtgcgtcgcgtcgtacacgacgtctttccactgaacgccgccggggacgtcgtcctggtacggcagctagctctaccgacgggatgaggacggactcgtcgccgcggacgacggagccgtcgctgaggagcttgacgacgccgtagaagtcctccacgacgtgcggcgccgcgttgtcgccggagccggacatggtgctcatcaacgagtacgtactctcgcttcctcgtctgatgaatggacagagcagcctatgcctcctcgacctcggtacgtactccgtctacatgtgcttttgtcgacgtggagttgccaacatcacaggatcagtcaccagcacgtgaccattgacttggaaagtacgtactcactcagtcccataaaacacaaaacttgagccaaaaccgaatgtgacatattctattacgataaatctgaacatatgtatgttcagattcatagtactagaatgtgtcacatccggtactagattgatttttaataagacggagggagtacttggagagtcacgcacgcaaacgaaagaatgagttttaaactatcgggaggttatcgccttgtcgtttgcatttcacttaaataattttaaaaatacttttgagaatatatatttacaggtgatatatatcattccacaaacatacaagttataatttaaacttatcaagttgtaaaaaaacaaattaaactataactaattaacatatacatttaaatttgtttttttagttgtgacatatggaaattaattttgatattgcacgtttgtagggtgatatatcacattttaatatacataatttttttaaaaaattcataactatttaaatcacgtgtaaataacgatagaatattttatcgagtttatagtttgcccgcaaatgctactagtacgattcttggaggtacatccgggtacatgcgccacagcagccacgacaagccatctacattgtatgggggctactagctggcgcgtgcgcaccagcagcgagcactccctctcccctttagtctactcttaactaactaaattagttaatatacttaacactaataatagtaattagaaaaattctggagatttttttactaacagattgaaaattttttaagttagatttgaaaactttcgatttaagttttaaattttaaagtcaaaatttaaaaactttcaacttaaatttgaaaactttcaacttgagatttgaaaactttcaacttaagatttgaaaactttcaactcagattcgaaaactttcaagtccagattgaaaattttgaaaactttcaatttaagatttgaaaactttccactcgagatttgaaaactttcaactcgagattcgaaaaccttcaaatcaagatttgaaaattttgaaaattttcaaaatcgagatttgaaactttcaactcgagatttgaaaactttcaagttcagatttgaaatttttcaactcaaaaattaaaaactttcaaactcaaaacatgctaaagataaaaaaataaaaaaaatggaaaaaaaggaaagaaaatggaaagaaaacgaaaaaaaaagtggagacgcgcgcacgtcggcgcagcggcgctaggcgttctgggtccgaaacgcgcgccggcggcgcgcgcgtattaggtttttcgacattatatgggctgtacacgggccaaatgcagaagcacatggacagtgggctcattccacccagcgattatggacggcccacggtccatagcatcgttgagaagtactacagatttacagctccaaagtacagcaactcgttgtccatcaattcctttgcttcaatttggaagatcattctgttgcttcgttcgttcaatcgataatattatttcatgaatgccatcttattcagatacaggtttctactttgtattttgacaagctacacgcatataaatgacatcgttcatctacttgccaagttttacagaatcgaagttgcacacttacacaaaagatgaaacagaacacagattcagaccacatgagaacaccaaccatgcatctctactgatccaacttaatttacttggatttagaagttattagaaccttcatctttgtggataaatcgcttcatgactcggattaactcgttggctggctcgctccatggctgcagcgacaagaacaggtgcttctcctcctcgaaggtgacgagctccaccggcttctccatctccttcagcctcgccgcgtagtgcacggtgcggtcatggaggatgtcgcgcccggccaccacgacgagcaccggcgggaacgccaccgccgctaggctggggctgtccggtccgaacgggttcgccaccgggtggtccctcgtcgccccctccggcagcgacagacgccacagcttgtcggacatgtcgggcgtgaagaacgcgccggccggtggctctgcctccgacggcgcgcgctcgacgccgccgaagaagggggtgaggagcatgtacccggcgacgcgcaacgggtcgacggtgagttggcccgagccgatcagcaccgcgacgtgatggctcatgttgccgccggccgactcgccggcgacgaacacgcgggcgaagtcggccgattcggcgagccaggaatcggcgcccggtccggacatggcctggtcacgcagccatgacaagacagccgcgccgtcgtcgatggcggcggggaggcggtgctcggggccgaggcggtagtcggcggagagcacgacggcgcggagctccgacgcgaggcgttggcagcagcagtggaagctgggcttctcgaacgtcccgaggcagtagccgccgccgtggaagcagacgagcaccggcagcctctcggcgtcgccggcggtgggcggccggtacacgcgtagcttgagcccgtgcgtagcgtcgtacacgaggtccttccactggacgcccggcacgtcggggaagtcctccggcggcagcagggcgccggcgccggagccggcatcggagcggacgacggtgccgtcgctgaggagctggatgacgccgcgatagtcctcgacgacgtgcggcgccggcgcggcgtgcccggacatggttacttcttcagtgtgccaacgcttagtgcctaattaaacacggttgtttcgtttaagtaagcagatgggctaattaattaattagataattaatcggttgacacgaagcttcctaatcctagtcgttgccttgatcgccaaaccatgactttggctgtcaagacttagtagatatttttctcttttttttttgagaaaaagatggaaggagtgttacttttcagaacgggacataataaaaaaaaagttttataagaaccacttggtacttttctgagtattatagaagaacaacttcactgaacaaaaactatgtagccatgcacctcttggctcttgcaacgaaatttacatgaccgtacttattactagtatagactatagagctatgattttatccggaaatttgagattacagtttgaatgttcgtgtgatgagatcagactcttgagtgatccaaagaagttattgagtccagcatcagtgatgctctgtctcagctttcgacttacgttatgcgtaagcgggtgatacagagtgcaattctgacattcttacgcgcatgaagctctttttctacaattttgctgccatttttacaaacaaaaccatttttacggcatatgaagggtgaggtctggagtcaatacttttgtttgtaagaatttctggagaactaacgagtctggcgttcggatgcacatgcgatacgacacaaccatacaatattttgatttcaatacgtttaaatcatgttattttgcgtttcaaaaggattgagaaatttacctcaaaattgcaaaagtgatggacgaagcctattatgagtactgttcgccgtctagtcctttttcgctgctagctttcctttacatttttggatttgtcccatttccgacgaatgtcagatgtactccttttcctactagtatgacatgataaatttttgtgtgttcgaaaaaagatggccgaagcccatatttccccaatcaatgggccgtgcagccgagagcctgagatggcagttattcctattgggccagaaatatggtccaatacccaattgaaaagcacttagcccaggcccaagcgcatgtactagtactcccgaaaggaataagtctgcattgagtcccttaaatatacatcggatctatccctcaacggcaaaatcaaatataatgactccaactgttaaaaccatattaagagaggaggaaacattgacatgtgggccccacatggtgactcgactattttgaccaagttaactagccacgccaatcgaccaatgaaaaccactgtcaaaacagtccagaaagccaaactacaccagtttttaagtagttggggatcaacatatctagtattgcagtcgaggatacaaattaaatcggacctatattgagggagttagagtcgacttattccttcccgaaaggccaatctgcttccgtccacgtgactatccaacggctgagattccgtgcagccggttttgcttgcaccaaaaggcgttttctgtgatttttcacaatacctttacaagttgtaaaaatgttacctataccttttctaagttgcaatcttttcatatccttgtaaaatactccgtatttcatatgagcaaatggataagtcaaaccataggctaaatagtaaatacatgggcgatagatattaattcggtccaccagtttcaccagactggtaccctcaactctccatcagttgctggccaaatggcaaaatatcattggacacttatagttgcatcatgcctaatccagattccagttaataataaaccttactttctgagttgacttagtctctatccccacaacaaaaagagcactaggtaagtagatataatggggtagtataaactagatacaagtcgctgcaatgatgcatgcaaaatatcaacgccatatcatgttgacctagcataaacaaaactcaaatccggcgaagtacgcttgtttgctatcaataatgcgagcaaacaaatgaatcttaatagcatcacactaaggaagaatggataatacatctcatccacgtctgttaaataatttatattcagccaggaggagaaatcacagccaagacctcgtctcattcactgatcatcaatcaggtccctgaccagtaatttttttttagaaaatagattttcattaatccggtctctatatccacgaaggatatacacatccaaatcatgaccagtaattgatctattcaaatattgatcgcggcaaattaaccattctaatcaattctaagcaaatttcgattggtttggacgttcatattgcaagatctctcaggtaaatcagccactggccggcctgaaccaatttcctttcactatgaacataagatgcccatttttccaggaaaaaaaaagttaacacaagatatcaagggttacttaatttcagggccttatctgcaacacagccagtgcttagcttagcatgctacatactccaaagttcaaaatctgcagaccaaagcattccatctgacagagaccgcaattccaccagacacaccatttttttacgctcatcatgtatgccttctacgtaatgcagcaccaatcatcaatcatttccttcaaaaaagcaaaaccacacacacaatgccaatcaaacactaagtaattctctctttctgagaaagaagcactatataattcagggacagcaagatcgcattcttagcaagggagaagactgaacaaacagagagagagagagagagcggccatggcgatggcgagggggaggaaggagagggcgccgcgagggtacgtgccgatcctgatcggcgggcagggggaggagagggagaggatcctggtgcgcacggagcagctcaagcagccgcacttcctcgcgctgctcgacctcgcggtgcaggagttcggctacgagcagcgggggattctctgcatcccctgcaccaccaaggccttccgttccatcgtcggtgcagccacgcccaccgccgccgccgtcgccggcggcgagatcaagtcatgacacatgctctttctctctccagtgttcttgttttctcctttcctctttgatccgttttagctctgtgctatgcagagttgttgttagcttagctcatgtacgtacacacggatccaagattgtatatgcagatcacgatgagtttatggaaagtcgtgatgtgttatagcagtggatgtaaattgtgatgttatcttgtataattgcacagagatggaacttaaaaaaaaactcgaatattagggaaggacctaatatcaaataattagaaggggtgaggctttgaacccaggtcgtctagcccatcaccttgtggagctagccggaagacccctgcacagatatggaacttgaaaacaagtaccaaatgaatccaagtgctagcataaactactgctctgaaattttccccaaaattatactaactccgattttcaatgtacgacgcagttagcttttgacgtgatttttatcatttgtcttattaaaacaatatataaatattatttattttgttttgacttgttttatcatcaaagaaactataatattaacttatacttttacatatttatattaaatttttaaataagatgaatggacaaacgttatgtacaaagtcaacggcgtcatatattaaaaaattggaggtactagttttttttttctcaactgcatcattaatacaagaatatattgtggtatgtactattgtttcttctcgactgcaaaatctctttccttttcttaaaacaaaatgaatacaggaatatacacactttgatgatcaaattacagtggtataagctgcttgtggtatgtggtgtgatagtacaatacatactacaaaaatgaactaaagtttcagacataacaaccttaaaacaaaagaaaaaagaaaaagagagagacattcagatatactgtacattccaaactgatactgtattctcattggcgttcagggctaccgacaaaaaggaaaactggtgtgctggtgctaactgaagacggcctctcaaagattctctgaagcaacctcggcaacggaggcatgtcgcagtccaagacaccctcaagaatctggaccacttgacccatcgtcggccgatcaacctcatcctcttgaatgcaccagcaaccgatcttgcacactctctcaacctccttcaagtccgcttcaccacacagcttctggtccagcaagctcatcacatctccatctagaagcttccttgaagcttgcacagggaagtagacagaatagttgccatcagtgtcagtggatgtagaagtagtggtagtagtagtgcattcttcttctgatctggctgagttcctcctgcctgacactagctcaagcagcaccattccatagctgtaaacatctactttcggtgtaattgctgttccactaatccattcaggcgcaagataacctatggttcctctcatggtggtgagtgctctgctgaaatctctccctacaaactttgccatcccaaaatccgcgaccttgggaagaaacgatgcgtcgagtagtatgttttgcggtttgatgtcgcagtggatgattcgatcatggcagctctcgtgcaagtagcacaagcctctggcaactccaagagctatctggtagcgagtgttccagtccaagaacttgccattgctttgaaacagatgtgtgtcaagagatcgatttggcatgtgttcgtagacaagaaacctactgtcgccgtcactgcagaagccaatcagattaaccaagttgatgtgttgaatggttccgatcgatctcacttcagctctgaattgcttatctccttgtgatctaccgtcgagtcttttcacagctatgccggtagaatcacgcagttgtcccctgaagacggagccgaatccgccttcgccaatcttttcagaaaagtttttggttgcagaacgcaaatctttgtacctgaaagccacgaggctaccataattttcactcctgttcttgtctttgttcctcctgatgatgaacatcaaaatgaacatcagcacagccaaaccagcagcgcatgcaccaacgacgacaccgattatcactctacgtttcttgcttctctgcatatctcttgctgagagacggagatacatgatttctccattggaattctgctgctgcagttttgcattgagcaattcagtgtgccaaacaaggcaacctttactgccatatgaataagcagtgcaagagcaattattcagacaaaccttcatgcattcatctgaactgtcaacatcctgcatgctttcagctttgtcaggcaagatgatatcagacatggagtagaacttatcagttgaatctgatgaactcgtgttgctacctacacaatccaactgattctttctcacacatccaccagtttgatcgccttgctcccaatccttcactgatccaacagtgaatcccttcatgcagctgcagagtggaagcaaactgaaactgcagaccgagaaagccccacatacaccgtacacatcacactgaaccttcggattggagtacagcgtcagccaagactgcgagctgtccagccaaacctgctgcttgttccggccatcgacgtcgatgaagttgcgtgtcaccacagcttcatttgacacattgaactggagatattcctctctgctgttgtcgaagaacccaaggtgaaagccaggtgaattgccgatcagctcagggatgccagtgaagtactgaccattccatggtccactggaccagtaggtgacagacgaattgcagagcttgagcacgagctgaggcgtgtcttcgtctacctcgaagcagtaggctccgggggacgggccggccatgctcttcttggagacgagacggcggttcaggccggtgagcttgtcgcggccgagcttcgcgccggggaggagcgtgtcggtcgggtggtcgacgctctgccacagcgtacgaggttgggacatgttcgaggtgtcttgcagtacgaggtttccactgttcagaaggacggctgcagtgttgttgctgttgctggtggagttcttggctgaaacgttggttgaccaggctattgacttggtggttgggtgtaaggcaaccaggtcgccgtcgtcgccggagatggtgagctccggcgagccggcgtcggcggcgtccatgattggctctccgccgttggctacccataccgtggtgcggttgggcaccgtgttgaaccatatgcccaggaaccatttctcttggtttggagccggggctttgaagaagccgagcgcgaacttgccgttgttggagacgaccttgtccttgccgccgacgacatggccaggcttgacggtgtccgtcgcggctgaacacgccggagcaccgccgccgaggaagacgacgatgagcacgaagaggttatacagaagaggaggcatgtggatcggatgtgcgtacgtggtacgtgccaacgtacgtatagtgaggtgcacgcgggagaagagacgaggggcattaagtagaggaggcgacggttacggttcgtgcgcggtgagcggtgtgagtttgaccgaaacataagtggtgataaacatgtactataagcggtggcgacggcgacggtcgccgacgtaagatcgccggcggctaagagccctataacagctagccaagtagtagcgagaaggctgcgtatgtgcgccgtttttaacgggtgattttgtaactgctttccttttgccttctcaacttaatttcgacgaccgtggaattaatcccatggcatttgtgatgccacgttatctcacttgcagagatggttctgtaacgagttattacctgttccagacggcggctatgtatccaagatggatccttccggtgctgtgcgcctgccgttccactgacgtcgtgtccggttcagtcacgtcagctccgcggcggccggccgatcgagataaggtcaacagtgatttaccattatttttttaaaacaaactcattattaacagtcatatatttgttatatattctcaagttttagaaaacagatttttacttgtatatttgtatggattgagatcctctaatgtaaagtcagaggaacgtggtgacttacatgtgagttttaccactcacgagcccacctgtcagtgaccacgtcaggagaagttcatgttagaggatccttttcatcttgtaatgatgtattgttgtcattttttttaaaaaaaaagttattttacacccaaatgcaatcgcacccgttagcgttagcgtgaggcaacgccatttgacacgccataaaaaacacccttccatttttttttgtcctcaaaagaaatctccgaagagtgttatgggtattgatatgtaaaactctaaaacaaaaatatacttttataaatattaaataattaaaaagttaaaatatcttgatctttatccgatctgcttcatctgcggcaggccggcctgtctgatcccttgggcctccagcacgacagggaactgggccgcagaaagctgaaatggagcagtttcggcctagtgccaactcgcgccaaaacgaacggacactgccgcgcgcgtgcgaccgcaactaaaccactctcttggttaaacttaaatcactcgctcgagcaagtgagcaactccacaaggccaagctgctaaccacactcagtaaatcacgggttaagtataactacttaatcagcatttgcaaatgtgcatcgctataaatacagcttttttctaaaacccgtaaaaccatcaccatcagatcgagagcataggtcacagaacaacagtaacaagacactaattaaaacgaagcttgatcaaatggagttcaagaagccaacgatcgggatctcctccttcctcctcctgctcctcgtgtccgccgccgccgcggcaaggccgacgcgccagctagtcgccaacgacggcaccgttgccgcgcccgctgtcgcaccggccgcggcggacgtggcggccggtgttgccgatgcgccggtggctgctgccaatgccgacgtcccagctgctgcggcagcaatgggccctgtggctggcgcggcggcggccggagcaccgatcggcgccagcaccatccctgtggcggcgggcgcgggcgcggtggggatgaacggcggcggcggcggcggcgaccaccctatggtgttcttcatgcatgacatcctcggcgggacgaacccgtcggcgcgcatcgtggcgggcatcgtcgacaacacggccgtcaccggccagctccccttcgcgcggcccaacggcgccgtgctgccgctgaacagcggcgtcaacgtcaagagcggcgcggccggcgccatcgacaacaacaacatccccttcctcaccggcctcggcggcgccaccaacgccgccttcacgtcgaacagcaacaacaacaacaacggcgtgcccgtcttcgccggcggcagcctcccgcaggggaccacgctccagaagctcctcttcgggaccatgacggtggtcgacgacgagctgacggaggcgccggggctgggctcgccggcggtgggcagggcgcaggggttctacatcgcgagctccgaggagggcgtgagccagacggtggtggtgacggcgatgttcaaggaaggcgagttcgccgacagcatcagcttgttcggcgtgcaccgcacggcggactcggagtcgcacctcgccgtcgtcggcggcacagggaagttcgccggtgtgaagggattcgccaaggtggccgtcgtgaggcccggaggtgtgacggcgactgccgcggagcacgagacggacggcgtcgagacggtgctccagttcaccgtgttgctcatcatgtactagttaggtaacgtggtcaagctcaggtttaccaaaatgtttggggctgacgttatcgtggtcaccccatggtttaacggttacaatgagatatatcatggtttaaaaaatagaaaaaattatcacaccgttttataaaccctcgctattaactacagttgtgaaaggtgttgtgcttgtccgtgtgtcccggaaatatgttgatctcataattatgtataagtgcctgtattttgaaatatgaacgaaattttgatcccaaaaagatgaagagcaacatccatctggtacaaatagttgtgaacagttttaatatttcgaactgcgatgttactttttgtggtctaattgatctattgcacatgtcaacgtggcactcttaaatggattagatcaaacccaaaaggggaaaaaatacaaagggagaaaggggcgtcctaatgggcgactggtcgcgcccacgcccaggcgcgcgaccacccctcagtcctctagtctctactatagttactagtactactactacactagaactagtgtaatactgtactaatgtagtagtatatgtatatacatgtatataaactatgtgtacgtataaaaaacctaaaaaatacatgtatacaaattttgtaaatatgtatacaaactttatatacgtatgtataaaaatctaaaaaaatacacgtatataagtttatatacgtgtatttttttagatttttatacacatatataaagtttgtatacacgtatacaaagttcgtagacgtgtatacaaagtttgtatatgtgtatacaaactttatatacgtacgtataaaaatctaaaaaattacacatatacaaagtttgtatacacgtatacaaagtttgtatacatgtatataaagtttatatacatacgtattataaaaaccggaaaaatgaaaaagatacgaaaagaaaaaaagaaaatacggaagaaaacagaaaaaaacgaaaaaaaagaaactgtacacgcgcggcagaagaaaacagaaaaaacaaaaaaaaaagggagaaaccgtacgtacgtgcagtgcgcagctcctctccacgtgcgagtcacacgcgggaggatgcgcgcgaccgatcgctgattagtgatttcggaggttttgccatgttggtagagtagttggtttgatatataaaaaggaaaaaaagcaggggtgtcaacgcaaattggaatcgccttgtctacgtaatcagtacagtattcagtagtcaccgccgccgtgccggctgactagcacctggaccaactcgaagtactactccactgatttgtgggccatgatgcctttggccccgtatgtcggtgataggtacaaattaaactggtacggagtagctagtaatctcttcatcctaaaatataagcgattttaggttcgaggatatatcatattcatctaaaatcttttatattttaggatagaggaaatactatttcgtggtaattaaattaataaacatctcgggttaatttatctgcgccaaatcgtgtcgtggactcgtggttgtccctatctcctacctcgagttcgagtggttggacgtgttgtacgtacttcaaaattcaaatacggttctacatgcatgtgcatcacaccaaaccgatatacaactcgcgttcgttagtatataccaaatcgattaggctac

SEQ ID NO: 65144 - DNA, 1977 bp, Oryza sativa
agtgtttagagcgagtacaataagatgatataagcgagttatacatatagccacatcatatttatgcttatgtggaggagaggagaaaaggcatgctacaggtttatagccagctgcagcacaaattctaataagccatgagagttcaagttttatgatagagatgactatcacatctaatttcattataatatatacatcattaaattaaggggtaatatgcataataggttgcctctaccacacaatcgcaatatctctaacactctcatatatttcttgaaatttgtgtagggttgctccttgcatgagaggtacctatttctctctcatatttcttctctcctctctcctctacctcatttagccctatgtggtatcttagggcttatacttagatgcccatagtacttgccctgagagagaaatatggggaatgcattaatggtagttaggctgtgtttaattcacgctaaaattggaacggtgtgatggaaaagttggaagtttatgtgtataggaaagttttgatgtgatgaaaaagttgaaaggttaaagaaaaagttgggaactaaacaagggtttaactattgtattattagtagactattaagtgagtaatgggttaatttttggatatatgttaacttgctcactatatggttcatcacgtcagtgtcttacggctgcagactgcgcctaaagcattttcccagactctctcacaccgaaacgtagagaaactcgcgagttggccccacgtgtcatcctcacgaccgtgtccaacccagggacccaaaccgaccgacctcccaccacatcccccgttccgccgcctccgcttccgcatcgcgccgccccggccacgaccttctcccgccgtcctggaaccgggcgatggccgcgtcgtcgtcgtcgtcccgtcccctgctccgccgcgtcgcggccctcctcggcggccgcgtgcgcgccagccaccgccttctctcctcctcgccgtcctcctcctccgccgccgccgcagcaaccgagagggcgtcgccgccgtcgcccgcagacccggataccgtgcacatgacggatggctgcatccgagtaggtccccgtaccctcctccctcccttcgttcattccctcagcaagatcgtgtctcccgtattctgtgtggaatataggcataataggaggtttctgctgaaaacttttggtaacatgatgttttctgtttgatttggtaagatttgatttaggtaatctgtcgtgatgttctgggaaaatatgcggcctccctcttgaggtttttttgggctttgcactgacaaaataccgatatagcgaattgaattcggagtcagctagtcaccgtgtgctatgttaatctgctttggaaatgctacaactggaagcacattttctgaacattttcactagttcagtaagggggcaaaatgcaaaagcctgcatgagaattcgtttgggtatgacagccacaaaaaatgggtgttggattgcttttttttttctttttctaaatggaagtttatgttggaagctgtgaagtgtaggacaactacaagcaatgaagcataataagttgttccaaagctcagagtgaaaaactaaaaacactattagacagccgaaacataatcttgtcagcactttgatatttaagttattgctacattatatttggagcatgcacacaccttcatttcgcgttcccgtaaataatagagtggcaatagaaggctttgacgcccttcatttgattgcgccagagctaaatgctgtgttgattatacaagtttgtttggtcacctagccttgcctatatttctcactgttgaaatggagtattctttttgggctatatcagggtttctgtgacaggatttcaattcttgttacatgtgttcagggtctctagatgaatgcattttctgttgttaatactagacagtaaaagtggtttca

SEQ ID NO: 65145 - DNA, 2009 bp, Oryza sativa
aaataggagagaactagtgatgcttgcaatgcataagtatattagaataataatattctactagtattaggtatactaaccttttgcagggaatgacaataaagtggagaatcgacatcaacatagacgataaatcaatcggacgatgtcgagagatagacttatgtatgaatgggccaagagctcagaattgacacgatgaattgggccaaaattcacaagtctacaaagtgaagcaatagaggaagtcgccagccgaagatgggctggtttgggccagcccatggttcagcaaccccatgtccactgttgaggctagggtttggcatggacgtccaagattgcaccccaatgacagttggagggtacttcggacaattccccttccacaaccatcataaccacctctatataaaggcttcactctctatacttcaacacacacctcaagcaagggctctctcattcctctcaagtttagtttagtagtatctagctggtggaatagaattagaataggaatcgggagtccggaagtcttcggaagagttcgggtatggctctagtagctttcctttcctcttttgtaagctttgatgtagtactagcattcttttctagccacatctgtagtgttgccctctatcatagtacattagtatcgactttacattatgttcttgttatactgaatatactgctagcttatctaggagatgttttggtgcgggtatagtgtttgcttatgcaattactctatgtcatgacgatgatattagagtagtatctggtggtttagacgtggtgtctaaattacgggatatcattatttagggttatatattgcggatgagaggtgggccgctgatggtgatagctcagtacgggtattcctccgcgcctatatataatcctaagttaatttcctggggagggtattcctccgtatttagccccggttggatggtcatgacgggctgtcgtaaggaactcggcagtcaggggtggcttctcgaagtaccaggagggcatcggatagagggtattagctagtatatcagttaactagaatgtatatatactatgtatattagaagtacaggaatagattctctttctcttttctttccacctagcttagattatttattatgaggatgagtagaaatgcttgtgtgtcactctacccttggattatcttaacccctgcttagaatatgattatcacaagtaatatataaattattagttgagttctctctacatgatcttcccacgggaaaaaataaatacgatacccttggaatactctcgggtgaaatgctacaatggtatatccgtgcgcttgcggatgaactctgtaaccataatataccagaagtgtttctgcgccattgctgggatttatatttctagtaatgtcgttaagaaacaccaacagctacttcacatgctcctattttttctatgatgacggatgcaccaggatagctattacacatggatactgttgatctagctagaatgcaatccgttggaggaaagtggtacgtgttggttattgttgacgatttttctcaatatccttgggttttctttatggcaactaaggatgaggcttttcaacactttcgtggtttgtatcttcgatcggatcttgaatttcctagttctttgaaaagaattcgaagtgataatggtggtgagtttaataatgcttcatttaaacaattttgcaatgaaaaaggtctcgaacatgaattttcttctcctcgtgttccacaacaaaacggttttgttcaaagaaagaatcatgttttggttgagatggctagaacaatgttggatgaatatcacactcccagaaatttttgggctgaggcagttcacactgtatgctatatttcaaatcgggttttcttgaggtcaaaatttggaaaaacttcttatgagcttcgatttggatgtcaaaccaaagtttcacatttgcgtgtttttggttgcaaatg

SEQ ID NO: 65146 - DNA, 8670 bp, Oryza sativa
tcacgaccaacccatatattttttttgcacactttgtcatcactcgtgcgcacacccatatattttttgcatacttttttgcatactttgtcctcactcgtgcgcacccgggaataattttctggtcagtcacccatcccaaattgctccaggccaaacacgcttaaccctggagttctttgtaaatcggcttccgaaaaagaagttacaacttattgatataagtattccattaatcctattaagccctaggctgggatgtcacggtatatatctcctagaacctactcaagttataaagaatctctctaaaaggccaggtgtacaggaaagtgaaaatcatcctgagttcatgaaagcagagagctcatgatgtttgtgagggctatagaaaaaaaaatatggttacatatctcctagaacctagttaagctttcatatatacttctcattctctatgtatacccctcacaaacatcaagagctccctgcttcaaagaaaaccagtggtactaaattttctattgggacaaaaagcagataccatggcaattacttgttgcggctaaaattgatatccatatgaaattgagaattttcatctgtttggaacaggaaagtgggaattaactttaggcatgggaagcaacaggaatacgggtcaggatttccaatactcttaaggcctgaagaaaacacggaaaatagcacctaaaaagcactgcgctagcaatgtgaacttcctagcctgagatggtgtcaccagcattgcatgcagttgcttggctggccatgcaattcaggacaatctggctcctggcaattgcatcccaacaacactcttggaagaggacagtcaacttgatcagagcagctgctacatgcttgatgcttgccaaacattctccattgctcacatcttctagggccttgttgacacttcaggatggaaaggtgtactaactatagtgagcagactgcgagccgcgaattaactcttcctgtctcacaaacatatttcattggttactggccttatcaatcctgcttgttgacaatcatcggtgatcttcggtggcttcgtgtgacatgaggatgcatatggctgggtgcatgtttgccaatctgtagtcatttcagggcgtgtgctgtgcctggtgtgctaacagttttggattacaaatttttgtttaatatatgtgtggtttataaaaaaacaaatggtattaagtttttttccatacttaagggcaataaatacttatatgtggtttgtttctattttttgccttgaaaaaggagtacagctatacaagtgcgcaattgctcgaaattccccgcgcgcccatataacatttttagaggaagccgattgagagctaagctttcattcatttgagagagaattacgatcactggctataaaatcaaagtgtgttttgattattactctgtgatgaacaattggcatctgagattattggttttgatatttggagattattggcgaagtggttttggagatgattgatttggagattattggttttgaagccgatttttcaggtgatgtacagggttactgtttttgtcgggtccagtcagacagggcaggtgctgtcggtcagaccggtactatgtgagcggtctgaccggctagtccgcggtctgaccggccaacgctgtgtcggtttcggtttcgggttgtttgttttgatatccgtgattgtttcatgtttatggcttctagatggatactatacgtacgtaatactattgtttgctacaaataagtcaagttagagatagcttggtctcggaatatggtttctttgtttgattcatgtgtaggtgacttgatgccatgacttgggtataaggtgatgtccgtgacggtcagatatcatgcgggatacttaggctagagttcaatgcacgtggttggtgaagatttcatatggcatacgatcgaggtattgtgtgcgaatgggatgcggagtcgaatttagaaggagtccaaatttggtatgattggagtttgtaaagtttgtttcttacatgggaaggtttcctaggtggattaggacttctagtatgagtttggttcatggtttcaggctgcgtacctcatgtataaatagagagggagcgtgaggcctcccgctatcgctatcaagagcattgagttgatagtttagttagggtttcgagtttagtcgagattttcgtgaggagtgctgttgttacactttgtaaacacagagagaagtaataaagttttcatctactttgagagttcttcgatttgtgttttctcgggtgccgcggtctaactggctacacaccggcggtcagaccgacaaccacgcggcggttagaccggcggcgactgcaggcgaccaaagctgatctcgacggttcgaccggtgttactacctcggtcagaccgatgatatccaggcggtcagaccgattcatctactccggtcagaccgtgattcgtcgaatttgacggtaacttttaattccgcaaaaagtttgggtttttcggtataccaaccattaaccccccactagctggtttagttcttgtgattcgatcctacaagtggtatcaaagccttgttttttttttggattttaactgatctagagtttttgccatggctaataagtttacaactaagccccatgttttcgatagatcggattttccttattggtgtagtaagatgctgtcagggttatagataccacatacctaatagtagttgactaaatctcggcaggaccactacataccatgtcctatacggaagcaaccttcggatataggaggaattccggataaggaaagataaccagagttctacatggaaacgacaaggactactcggattgtatccatattggtttccctagttctacttggacaaggggacacctatgggtataaatacaagccccctaggaggagagggaggaggatcaacacccaacacaatctacatagaagccacaacatagaaacctacatacgccaagacacgccgccggatatcgacttcagggataagcacggctagtaccctacggtgtctccggatactgtcaggagagacgaaagcgccatctctgatctccccgggcacggattcgaggagaaaggctaccctgttgtcgactacgagtcagatcgtcagaccgtcatgtcgacaatagttagatagcctaccccaaatattgtactggtgtgattatcatgaataagagcaataccggcttcggcgaacaggatatagggttattacctgacaattcaggggcctgaacttgtataaaaatccctgtttccatctcttttacctcagtttcgcgtataccctagtatcgacgatccccataccatgcaaataccggaatcgtgacatcaaacatcgacagtggcgcgcaaggtagggggattttggtgcttcaggatttcgacgagatgggtttaagagatggactctccgacaacaagctactcgacgacttcggaccaggaagatccaacctggccagagtacgtctctcgacgagattggagttatcgtcatcaactatttgattcggcgagatcgatcaagctccaagatatcatcgccgcgaaggataattgttcaatatcgccagatacgagacttcggttcatgtcgactacaacggaacttgccgatctacgatcataattggtcccgaccgagtccaaatctaactacgtgcgcctgtaaattctcaaaccggctggcggctgcaccttgtgcctggatagtcctactcggacatgatgacaagaggatgcacactatacgtgaagtctatacagggaactgaagcacgtgtccaccatgtgacgggatgccacccgttatcaggtatctgatagattatttttttaaattaatctactaattttgtagatatatccggtatatatctacacaggtacgcaatattttcgtacctatttttacaatctatacagcattgtcagatctatattatgtttacctaaagcaagttttttatacaatatctattgcgcgagtgtccccgatgttaaatcgactacagtttaatgctggggactcgctctattttcttccgtataaatcatgcttgctcacagtttacataatgcctgatatttacatctgctcgttatatcctgaaaatactagaatatccatgcagttttttgagtacatactcgatattacctgctatatatcttgtcttctagaaaatatttttcaggaacaattgagcagtcgagtaggttgtggttaagtacaccgcattatcgagaacgatcttgacaaatgcagagtcgtcacgcccaacctgccaaaaaagaccgacgacctatctcatagcaccggccatggctgcactatacgagaaaaggttgttaacggataattcctcgtgaatgccatcggcttgatcacccgacatgattgcgaacggacatccggatatgctacgagttgagtgtgtgagtcatgctggccacatgagacgcacatgtaataaaccaactctagcacctctattgatgttcgagagataattctacacgttcgctggtcctggcaccggtccataacaatttctggcaccacaccagccgtagctgtcccagatatgattatactcgctcgctgagatgtcgaaacagcgcggaagaatttcttgtactgcaccttccgttggtgctctagagatcattggaatcgatcgctcgttctcgaaccagtaagtagaaatctcactcaccgctacctccattggtgttcggacgatgattttacacgtttgctggtcctcgaaccagggtgtagcaatctctcgcaccacaacctcagatggtcgaggtacgactacagcaataacgcagcggtcctcgcaccacgacttcaaatgatcgagagacacctactcattggttctcaaccagtcaatcgtagcgatctctcgtacatttacttctagtggtcaagtttagactacatctggttctcgaccagcggtgtagcgattctcccactacccttacttctagtggtcgagtttagactacatctggttctcgaccatcggtgtagcgattctcccactacccttacttctagtggtcgagtttagactacatctggttctcgaccagcggtgtagcgattctcccactacccttacttctagtggtcgagtttagactacatctggttctcgaccagcggtgtagcgattctcccactgcccttacttctagtggtcgagttacgactattacctggttctcgaccagcggtgtagcgattctcccactacctttacttctagtggtcgagttacgactactacctggtcctcgacaagaggtgtagtgattctcccattacctttactacaacaaagttgatatcaggtacacaatatcgccaagtgttttacccgagagatcccttaccacgatgacacctagcgttgaaacctatcctactgtccctttacgccgtcttgacaaggcctccgaggaacctaagggaacttcagctggggacgcccagagccgataaggccttgtcggatcctttagagacgaaagaccatgtaagatctggtcgtgtaagagttctcgccgtgcgtattaaccaagctgtgtaatcggaaatggattttccaacttcacggctgggggctaggatcagtgcttattcaactaaggcaggtcaaaggtccaagagccttatcctccgagaacgattctccgacgacaaggctaggggctagggagagtgtataactcaacaaactaactgatcaaagtcggtaaaagagtagacgctcatatacaaaacattggtctgtaagtttaattcattttcggttttccatacatattataacatgttaccctttgagcgttcgctcgggggctatttctatctaatattcttttctgagtattgatttcaggaaaattctattcgacattatcgaagacaccatgtctctatggttctacaccaagatcgactaaggcaagtacgacaaatgttgacaaggctccgtcgcagactctatgcctactcgattactcgagaacggttggtggatctcgacaaggaatacggaatgaagagatggtgtacccgccgatataaaatttcttgacttcaatccaaattctcgattacagcaagacgggagattactcgtaagctctgtactttcttggttgacgtcggagattgactcagacaaactctttaggagtccgcacgaggctgataaaggaagtctaacgttatctctgaactcaccgagaacggttacgtgcgctcgataacagttcctccaaggtctgcggttgagaatatgaactcgttcatttggattgaagtcaggggctattgtcagggttatgggtaccacatacctaatagtagttgactaaatctcggcaggacccactacataccatgtcctatacgaaagcaacctttggatataggaggagttccggataaggaaagacaaccagagttctacatggaaacgataaggactactcggattgtatttatattggtttccctagttctacttggacaaggggacacctatggatataaatacaagtccccctaggaggagagggaggaggatcaacacccaacacaatcgacatagaagccacaacatataagcctacatacgccaagacacgccaccggatatcaacttcagggataagcatggctagtaccctacggtgtctccggatactgtcaggagagacgatagcgctatctctgatctcgccgggcacggattcgaggagaaaggctaccctgttgtcgactacgagtcagatcgtcagaccgccatgtcaacaatagttagataggctaccccaaatattgtactggtgtgattatcatgaataagagaaatactggcttcggccaacaggatgtagggttattacctaacaattcaggggcccgaacatatataaaaatccatgtctccatctcttttacctcagtctcgcgtataccctagtaccgacgatccccataccatgcaaataccggaatcacgacatcaaacgtcgacagatgcaatcttacattatggctgaggatcttgatattttgagaaaagtttctaatccttatgtgattccttatcaaattaatattgctgatttaaaaactgcatttaaaaataattgcaaagcttgcaatattcttttgagtgggatttctcgttcggattttgatcatgtttctcttcttcaaaccgcaaatgagatttggattgctttgagaaattttcatcaatgaactaccaatattaaagaactttgtcgagatgttttcaaaaaggagtacataaaatttgagatgaaacctggagaagctttggatgactatctttctaggtttaacaaaattttgagtgatcttagatatgttgattcttcttatgatataaattacacacaatctgaggtttcacgtcactttttgaatggtcttgacatgtctatttgggagatgaaagttacatcaattcaggagtctgttgatatgtttgctttgactttggattcgctttacacaaaactcaaaacacatgagatgaatattctttctcgtgaagttgattctaagtctagtgctttggtttcttcttcgacttctttggatattggtgcttcttcattgaattctactattcttgctttaattaatgccatgtccgatgagcaactcgaacaattcaaggaggagtacttggttttggttactttcaagtttgctcgagctatgaacaatgtcaagtagaggagaagaggtggtccaaaccgttgttttgaatgtggtgctcttgatcacattcgattgcattgtcctaagcttgggagaggaaaaaggaagacaatggtggagagaagaccaaggagaacaagcccaagagcacatttaaggggaagaagattaaggagaatctcaagaagatgtttgaaaaagtctatgccggttttaagccactaagcgatgtagatggagagagtgaagatgaagataagggaaagaacatctccagtatttgcttcatgccgcgtggtgaatcggattcaaagtgtgaaaaacaatgaagctttggtggcgaggaaggagaacgtgtggatcgtggattccggttgttcgtggcacatgaccggtgataaaaattggttctcttccctcaaacaggcatctaagactgaatcgattatctttgctgatgcttctactagtgtcgttctcgctacaggtttggtcaaggtaaatgataagtttgaattgaaaaacgtagctttggttgaggacttaaagtacaaattgctttcagtttcacaaattgttgatgaaaattttgatgttcactttaagaaaactggaagtaaagtatttgattcttgtggtgattctgtgttgaatatttctcgctatgaaagagtgtttaaagctgattttgaaaatcctgtttcacctgtgataacatgtttggttgctaagtttgataaggatgtaatgttttggcatcctagactaggacatgttggtt

SEQ ID NO: 65147 - DNA, 1932 bp, Oryza sativa
tattccatttctccactctagtttggtagtagttgagcaacatcccctgaagatcaacagatgataaccaaacagataatgatttaggatcacaaataactagattgctttccttgctatcaagtgatgtcaaactgacctggaaagtcagatcccaaaacttctgcattttttgctcaaagcaagtgcaagtttcagtaatcatcattttcttttgctcattccaaggaattatacttgcagcagaatcagtagtgcaacatttcccttctctaacttccagcaaacaaactaatggcagccaaggtggcatgacaaatagtctgagcttgtcaacatgttttcctttgaaggaaaagttcacagaaccaaattgcccagtactgctcagctccacaaccatcactcttgcaagaagtaagtgactccaacttaagtagcagttgccctttctttccatttcaacaaaagatagccccaaaagtaaatattcaggttcaccagcagcatagataccttccttgctagtggctgctataaggttgatcaaaaaggacaactcacttttcactccaacattgaatttcagcttattgctccacaaaatttacctccaatgaaaataatgttgtgggaaccaatcatccatccatattaatattttgcgaaggtggacctttccatcacctggatcccactctagtggcccaaacatgacatgtataatgttcagcgagtttaccaatgaaaattgcttgcccacaaagagttgaaaccatttcgcttcggttggagggggccaaggtggcagtatatgtactttacaacagctgcagttgaatgccagccatgacattaactgtgactccaatatgatcaactcttgatcccttgatgttatgggtggccatggatcaacctcaaagtgttgcaacagcagttgccatggaactaacaaatgtccttcaactgattccactaacactggggtgcttaagaaggacaaataagacacaacttgagagttgttagacccagaacatttcgctgaatacctggtgggcatcaatgtgtaatgcttgatgtcggcgatcatccttggtgagaaggcgctcaatgatgcaatggatgctggaacggtctcaagtacaaccgtcttggtcaggaacgcgatgtcggctttgttggcgtcccacttgacatcgaagcccaacatcgaacacttggcgtgcgtctccttggaatagtcagtggtgggaattttggtggtgctggttgcaccattatcagctaccaacttcatggaggccatggcagtggcggcacatttgaccatcgcaaccagtgtgagtttgggctcgatgtcgggactagagcatttcgtcaaacatgtggtgggcgtcacctttgactgctctttcttaattgacgctggcaagtcttttgccttcttcccaacttccggtgtgcatgcttcaaccacatctatgagagaccgtatatcagctctagttctccgatcagcctcctctcgcctcagctcgtactcctctatccgcctcaacagcaagtccaatttgtcttctattgccatggcaccctacttgatgagaactttctcaactagaccaagagctagatgggggaaaccaggctggctctgataccagattgttaggaacccactacttccagctcaacaactagcatccaccatagaagcaacaactgctttggggacaagagaagacgacggcgacattttggcaatcttcggcgaaggaaaaccgatggccgggcttcagcttggcgctgcgatgctgaggaagacgacggcgaaaaccgaccaccacggagtcatcgacagggctcgaccggaggtggagtagatcggcttcacgtcgatgaggggattccaatgggtttcagctt

SEQ ID NO: 65148 - DNA, 1137 bp, Oryza sativa
ttcagaaaaatttctccgaggccggtctgaccgaaggggtactgccggtctgaccgggggtcggtcggaccgccgctgcaccgccggtctgaccgctgcccagtagccggtccaactggtcgccggtccgaccgctggacccactgcagtctgaccggtttcctcgagggaaaaccaaatttttgccactttgaatttgcaaaatcaatctctctctccattttctttttatgagccaatctgaaacaaaaaccaacaatatatccatctttcccacaaaacgagcaagcatatttttcacgatgattagaaacattggtagactcagatggcttagcaacacaagcaacaacatgagattttgcatgcacaacattggattttgaagatgatgcactcaaggtagacatgatgccaacagatttaaacacagtgttattagtttcatgtttaaccaaaatgtcaccacttactagcactaatacctaacacagtaggaggatgtttagtatgatcagcataaggattaaaacctaaaccacggttatgtgtgctaaccttagattgatctagaatcatgttgaggttctttttaccatcagaaaatcttagcaaagaatttttcaaataagaaacctatttttccaaattagcacaattttcacaatctaccatgacacctttgcttttacgacacttggggcaagaaagcacttcattgtttttcacaacatcttccttgtactcaacatgacctaaagcgtcctttaacttcaacttattcaaagtacatgttgagcaatccaaaacactatgaggttgttttaactttttagcacaaatcatgttaaacatcaaactagcatgaaaagcaatttgttatttttacaacaactttttagtcaaaaacaactcatccaaagtgcgtgtgtgcaaagcaaatccaagagctagagaagatctatttttcaaaccatgtgcagcattaacatctctaaattttgaaatctcattcattaagacctcacaacttttgcaatcatcatcattgggaataagatattttaatctagcaaattcagaattaagagattcgataataaactcttgttttctatacatcttctcacacatcat

SEQ ID NO: 65149 - DNA, 999 bp, Oryza sativa
ctactttggtttgagggttatgacaggttgtcataagaaactcgtcaacccagggtaactttgcgatgcatcatatcgggagggcatagctgtcacgccctgaagtacccctcccttgctctaaattcataaaataaatcgttcgaagaaattgtttaatttaacctagagagaaaccctaaattaataaatgcaaataataatcggaatcggcatgtggaatttttcttgggttctacatgtcaaaatacgctaacaggatttttagtggaattttcagagcattggaaataattttaaccaattaaaataagcaaagtgcaatattaaatccctgggaaaatcctttttcctttttatccttcctttttccccctcttttcctcctttgggccgccggcccatctctcccgccccctcccgaagtccaggtcgcctccccctcactccctcgggcgctgacaggtggggcccacctgtcagcaccttccccaacctccagccggagggacggcctccctcctccctaccgccccgcgctccctgccgccccgggccacgtcgcccactcccccgcgcgcccgcactccccgcgcccacgccccactcccgctcaccccgcgcccgcgagatggccgggattcaaatttgaatcccgcctctctctctctcctcctccacctcctccactactccggcgaaattgcgccattcccggccacgactcgccgcctcccctcctatttaagcacgcccgcaccttcctctctctttttcctttctcggccgagccctcccgagccctccatcactcccgcaccgctacacccgccgccgccgccttttccactcctccggtcgccgctcgccgccgctggagccgccgccgagccaatctgccgccgccattagcttcgccgccgccaaagctaccccggccgccgcatccccatccaatcccgccgtcgggacccgcttctccccgcgcgccggtgagta

SEQ ID NO: 65150 - DNA, 600 bp, Oryza sativa
ttatctatgtaatatgtaacagatcatgacttgggtattacgtttccttgtatattacggaacggcctaaagttctggtttgataatattgtaaagtagatttaggaaaccgataccgtattggttaaggtttctatcttgtaatcctgccccccatcctatataaggtgggcaggaggccctctagggggcatataagacaactagatcgtcagatctatatacactcggcggattcaaatccccaaacaggtgtagggtattacctctcattgagagggcctgaatctgtctaaatcctttgtctcggcatccatccacttttaggtctcgtgcgctaccccttttattattgccgaatttatgtttcaacagttggcgcgccaggtagttgtacgccgagtttcctattgaggagtgcgatggaatcaattttatgagtcgccagcttcgcctttgcctcaggagctttgacttcctcgccatcgacaacttcaacaagcctcgctctttgactttgattcaaatcagtcggggaagatctaatctacctaaggaggataacaaccactctaccccggcgagtttaagattcgatct

SEQ ID NO: 65151 - DNA, 3064 bp, Oryza sativa
ccagactttaagaaatggcttggagccatgaaatccgaaatacaatgaatggatgacaatcaagtttggaacttggttgatccacctaatggtgtaaaagccattgagtgcaaatgggtctttaagaaaaagacagacgtagatggaaatgttcacatctacaaggcacgattggtggctgtcacaccctaaaaatcctgaatttataaattgttgtttaaatagaattattagaaatgatttaaaagcctagaagaaaagatctaattttaaataataaattccaatataaaagtgggccagataaaattttattaaatacttctatagttccaagatttttcaggaatttatttgagtcaaggaagtatttttaataaatggaattgcatttcatgaataatttaaaaaagaaaaaggttttaaaaatcctcttttcgctttgggccgaaagtcggcccaattctctccctctctctcctcggcctgcttgcacccggcccaaccagcccaccgagtcgagccgccgctcactctcctctctcccgctgacaggtggggccgtgatcttcctcgcgccgcccagccgcgccctagccgcgcaagccggcgccgcccccttccaaaattcgcccgcatctttccatctccgatcaaatcaatagaggggaaatgatcctcgggatcccctcttccttttctcttttggaatcttcggctaatttcgtttggaaatcgttggattcgagctcgattcggattcgttttttcctcctaaccctagaccttccatcgccgttgttggccgccgtgggcctacatcgccgctcctagcccctatataaggacactcgggacctcctcttttcgtcgccaccctcgcctcagctcgccgccgcttgtagcgccgcctccacgacaacccgtgcgccgctgtcgccgccgcgagtccagccgtgcgccgccgccgctctggtcgtcgtcgtcgctcgggaaggccactgttgggttcgccaagtcgtcgccgtcctcgtcctaccctccgtttccaccgaggatcgccggagcaccgccgtcgtcgtcgacccgaacgcctccgcagcttcgacctcgtcgccgtcgctgtccgttgccgtccgccgtcgtccaagccctcagtgagttcgccgcgtcgccctctacgtgtaggtgccctccgtttgcgccgccgcgccatcgttcgccggcgagcgtgagttgccgagccgccgccggtgatgacgtcatcgctgacgtcagcgccgtgtcatccgtagacccgtggtggattagatcgatctcggccgttcgttttgtctagattagatctcggccgttcgttccgtacaccgtccccgtgcacccggtccaccatgaacccgagcccgctgacgcaataaatcatttttccttttcaaaaataattctttattccgtcataattcaattaaaatctaaataattgatttaatccgatttaatctttaaaaactcataactaattcatcttagctcggatttagttggttcaagtctctaaatttttctaaaattgagatctacaggttaaaagtatccacatgtactgttcatgattgtttatgtgctgttttggtgattttgctcttttatgcttcgattccgacgttcctggagagtccgattttgcaggagaagactttgaagagttccaaggccaacaaggcaagtcacacatatcccaaacaatcctttgagcatgttgatcccgtttaaagctattgtttctattcaactactgcatttattttcgaatgtcattgggtgggaataacctattgcctttgttatactttgtcgtttgattaataattggattagctagaacattatatagttttagctaaaagtgcataggatgcttagccatgcttagagacattagctcatataaatgggataacttatgattcactattatttaatgatggcttaatgatagctcacgatggttaatcgtgattggttaattaattaatttgccaactaaaacttgataatggtgggttgtgagcgcatggttttgatggtcgtgctcatgacaattaaggaccggttcacgattttcggttgtgaaacattaaccgtgccaaccacaagccagcgtgggcaacggctttactttttatatagtatggttcattctggagcaccagactgtgaagtggcggagataagcacacgggggtttctggggagtctatgccttgtttataagggggtgattatgatccaggaatagtaaactgctttgaattgtgttatgcagagggtattgtcacaatctctattcgggtacttgttaagtatcgcgacgcatggttgacatgatgttgaggttgtgtcttgtgggtacagtggtacacctctgacctgtcacgtcctgataaattcatcccaaaataaaaatcattttataaaaggaataatagaattaattacaattcgaaaagaaattggcaaacactaaaatacgtataagaaaaattcgaatgtggcccagaaaatttttgttaaattctccttggtctaaaaggagctctcaaattttacttgaattttcagagcaccggaattatatattaagcaacaacaacaattaactaaaaagaaaaactaaaaataatcctcctccctcctttgggccgagtccagcccaaagtccttcaatcctccctctgttttccctgtttctcccgggccgcccctccctcctcccctcccttcggcccagctccctcctcttctcctcctgggccgcctcggctttgcccggcccaagccgagccgcgcctcccacccgtgccgcgcatgtgcgcgcgcgtgcgcgccgttgccgcgcgttgactgcgcgcctctcgcatgggtcccgcctgccaggcgcgtccccgacctccagccgccggcctccttcctctctctctctcccgtgaaccctagcgttgttcctcctccaaatccaccccattcaagccggctttttccaaattaaatagggggaattaat

SEQ ID NO: 65152 - DNA, 9058 bp, Oryza sativa
cttctttgatgtgccttgatctccgtctgagggcttacgtgcattcttgacgtattgcttcgcaaattgtttgtagacgaagtagtctttggccacgtggttggagttgggatgatgcggacattgggagttcattatcttgtcgaatgtgttgacgcggggacgttgtcgggaagatggagaggttgttgccacaagttcttcgggcttacgcttgcgatccttgcggttgttacttccactccctcctgcggtcggcgtgtctttccttggcttccaagtggtgcccgactgtttggacgcagtaatagcatcttcggctttggcatactcgttggttttttcaaacatctgcttaaccgtcttgggaggtttgcgtccgaatttgccgactaggtcgtcgtggcgaatgcctttagtaaaggcggcgatgatgatgtcgtcggtgatatcggagatcttgttgcgttgctcggagaagcgtcggatgtaatctcgaagggattctccagacttctgaatgatgttgtagagatcaaagtgtgtaccagggcgttcaaaagtgccttggaagttggcgatgaagtggtcgcgtagttctacccatgatccgattgtgccacggggtagcccgtgaagccaggaccgggcagaatccgccaaggccacgggcaggtagttcgccatggctttgctgtctcctcctgctgcgcggattgcaagaccgtagacggtgagccaggattccgggttggtggtgccgtcatacttctcgattccagtcggcttaaagtcagctggccaattcactcgacgcagatcatttgtgaaggcagcaactccgtccatgtcgtcgtcgtagcggtccggtgaatgatgtcctcttgccgcgcggcgctggttgatggtgtcacgaagatcgatggggcgtcttcgatgtgggaagtgtggtcgttcaactcggcgctccctatgttgttcaggaggcaaacgaacagatcgttcatcatgtcccttgctcttgcgactagatccggcgccggtaatgctgaggcttggttggtgatagtcttgagatcgaagatgagggactcggctaccagtcggggtgcgggtgcttgcggagttggctggaaccgaggcagcgatcatggtcttcgtctggttcaagatgttgacaacatgatcagcttggttgagtgcgtcttccttgaggagggtgtcaaggagagtgattgctgcaaccgcgttctgctggggggtgcgaaaaaccgttgtttcatcgacgtcttgttgcccgatgaggtctctcgctcgtcgcctggattccaaggcgcgttgccgtcgatcttcagcctcctttgcaactcgctcgcgatcttgttgctcacgctgtagtcgttctcgctcttgtcgttgtcgttcttcctccagtcggcgacgttcggtttcttgtcgtgtgcgctcttcctccacttctttggctcggcgttgttcctccgtttcgttgtcagccatgaatacgccgaaaaagagaggcgtgtacttatcctcatagctgtcgtcgaagtcgccgtggtcgtagtggtagccgaagtcgtcgcagtcgaggatctcggttggtcgagaactgacgtcagggaagctaaggtagccatccaactcttccgtcgagactgtcccaagaggttggagtataacgccaacctctctggatctagattggatcggggccgaagccggagttcgcctagatcttcgagtgggagatgtcttggctgtaaagacagcggccaaatcatcaggaagtctcatcaggattgagggataggacccgtcgtcttgatctggtcgcggaggagtagattggatctcgtccgagtggtttgaagccgacccgagagagatgatcttggagtaggcctcggccgagttcggaataccgaacggcgcggggacatggtctctccccgactggttcgaatccgagtcaaggagagagatcttgctgaggttgttggtgatgaagttgaggctatcgaaccggaacgcctgcccgggagggaaggcgaagtcgtcgatgccggagacggaacccatcgtacttagtcagcaaaaacttgatgctgcccctacctggcgcgccaactgtcgaaacaagatttcggcaataataaaaagggggtggctatcaagctaggaaagtggatgggtttgaagacaaggaattttatacaggttcaggccttcttattcaaaaagtaataccctactcctgtccggggatgattccgccgagtatgttattgattgtataaactggaaaaaagatcacgcccccgcacacagacccctccttatataggggaagaggtccgctttacaaaatatagtccatatcctaacggaatatgggattatagatgaaatacaatcgtaaccgactaagatcccgagtatttccttgacatacaagtttagaatctaacccgagtcctcatagagatattctatctatatttggtaccgtatatccgactaaattataatgtcatgtagatatgaggtatccataatctccacactcgtgttattgaatttgcatgtgccatggttgaacccgaaattttcaataaaattaattttactgcttcaaatttatgcctttttggaggtcatatacaaagaggacacagctgacagctggcttgttcaccagttattttcttgtttggacgagaatggtttaaacatttcaatcaaatttattttgaatgctattttctatgtcaatccttttcatgtgacttcatcagcttagaaaaatcatgcctagcgatacaataatggatgctttggatggattggaaaagtacttccttataattgggagtttgtacccataatttgtggacggagtaagtatgcaagtactatcaacatgtaattccatcggtcgtacagtaagtatttgatggtcttatttgtctgtgtctaggataagagttggttaaacatttcaaactttcaccatccattttgtattataaaatctaaaagtttataatattacttctagaggaaaatctactcatacaatctttttttttctttttaaatgcacaagtttgtcataatatgatattacttttgaaggcaaatctacacatacgaaaactatttatggtcaaagtttaagagataatccaagaataccattgacaagcgtcaaatccaaaaaatatcatcgtacaaacgattttgtcccaaaaatgtaatcgttgttagggttccgttcatcctatagcactaagcaatgcagaatggacggaaccctaacggcgataatatttttaagaaaagtcatttgtacgttgacatttcttaaaactcacacttatcaatgatatttattggatttgaatgtttgtcaatggcattttttagattatctcaagttttaaaggtttaactaaatcttacgctaaacgtcaaaatatttacgaatcttgtcaattcttctactaggcgaatataaatggtcatgagtacagacacggaatgaacagaaaccccggaaggccagaacaaagaatttgtaacccagaatttatccaaacaaacatgactatgtaaaacgagatggtattaacgtataattgattgagttttaatcattacaaatttaaaaaatagattaatatgatattttagagcaacttttatatagagagttttagcacgaaacgtaaagtagtttgaaaagcgtgcacggaaatcttaatcttgatctaactcttattggagaaaagaacggacctacgctcccagttgttaattggcatttgtcaatcgatctgaaccacgacagctaacaataacaaatatgaatttggaagtcatatatagagacattttcaaactagtaggccaactgttttctaggctacttttactaaattgataaaaaaagcaatgcaaagtgacgctttacactaaagacctactgaattctactttcagaattatagcaagctgtggtaattttcaggtgtcgttcctggtaaaactgcattataacaaaccagaggcttccctcttgcagctaacttttctcttcgggagaaacacatcagtcagcacagtcttagacttcagggaagcaaggagtatctccagtacctacatttgaacacaaaaatcatcaacagtgccaattaaaaaaaaacaaaaacgactgatttttttttctctttactcaaagtgagagatatgtacacagtagtacagtacagacctcttccttgccaatcttcacggtccgttcctgcagcgcgctcaagtccttgacaccacactgtgcaagtaagctgacgcttgacacactggacgctggagtcattgagagatcatccctgacagtgtatgtggctgtcccaaccacaaatccaacggttttgacatgtggaattgccctgtgcatttgagtggagcagacagggcatacagcgcctttgctaacagaaaaatatccacaaggaactttagtggtactgtagcttacgacggtcgatttcccttcacatgtgaagaagctggcattgacatttaactttgcatccagcagcagctgctgcaatggacagagcacggtgggggcaaccgtcgggctgaggaagcgttccttgctttggcttgagattacatacttggaatccagcttctccacgctgtcaagcacattgcccatgctaccaaccatacgctccttggtaagcatgttgatgatggtgctcattgggaggcaaaggaggcaggagataaactcaatgacatcactaccagcctcggcaaagcagactttctgagccttggtatcaatcaagagcttcatcgataatctgatggctgccatgattttcccccttctatcaaaattctataaatttcttgggagttgattggttgcttctacaatcaacaacaaaagaaaattatatgggttttcagttaactagcgttagagtccaaatgatcagaacgcgcagcacactgacacatagtggaaagctatgcaaacaattttccagagaaatttagagcagagtagcagacaaagcaaaaacacgttccagattgtaatccaatgaagcgtctagattggttggcagctgctcaaaagtaagcaaaaatggcatcctagtatacaggatacaacttctcctgtggacttgtggggtaaccgggtaaggtaacaatccgtgcagatgacacatttccaaataagaaatggcagagcagtatgttcatattttccacatagtgacacgggaaaatagattcagtgcaagtaatctgctttccttactatctcatttggcaatgccaacaaaaaaaaaataaataaacacgaccttataaatgttcttacaggcaaactcattggttgcagaagcagtgaagcacttgagacaaatattagcataacatatcaagtgtaaactagtactatgtactgcactaatgttcaggatcaggtttatcagttacgttttttctgtaagtcaaatcgaatgttcctaaaaaaaatcgatctaggaaaaccttgaaaagacgggtaaatgtttttatcctgaaccatagaaaaatatttcagcaagagtgctagattcatttcgacagcaagatcatgctagcagtctccattatactagaatattcaaactgaaaaataccattccgtttgcctcactagatctacggtccgatatcaatagaaccaaccaaaagtaagggagagaaatcaacgacgatgaggaaaaccaaatcaacgagagagagagagcaatctgcaaggtgagaggagaatgtatagcaccgggggacggagaggaactcgctcacacaatggatcgccgttgatgcccgccgctgccgctgccgccgtcctgcgacggcaaagaggagggaggcgacggcgaggagtcgaggacgatgatggatgagcacgggtagtagtagtagtagcctaatggtttgcttcctttggccatttacaaataccggcccgccccgatgccgccgtaatcggagttgccggaggtgctgcacgttgacgtttcctgacttcgtgtgctgtttcagggcccgcgtaattgtgcggttagcatcaaaataaaattacgttatgatatgattttatctatattttttcattgcatctttaaaatttgtggaaccgtagatttgttggctatgtttatatcaccaacatatcgtattgcatacatatagacatgtttcttggatagagagagtttataaatcagtgatatgttatttctgagtgagtgaaataaataaacaaagcaactaaacggtattacctctgtcccaaaaatataacaacttttgattatgttgtccagattcataactaaaaatgcttataatttaggaagaaggaagtagtaaattttctacttgactaagtatttccaagagactccttatcctactatgctaaaatttaaggattttatagaaaaaaatagccatctattattgtaatgtttagaaagtcccattagccactagcccactaccaacttctcctcgtttgcatgctgtccttgtccatactctttcgttgttgtcgctacccatccgttcgccctccagcgtccgtcagctttccttctcttctttgctgctctttattcacagcctgccgtgactcttaggctgtgttcagcagctgagttttccaactcacatttctctttttttcgtgcgcacgttttttaaactgctaacgatgcgtctttataaaatttttatacgaaagttgctttaaaaaaagtcatattaattcatttttcaaaaataaatttagctaatacttaattaatcatgcactaatgagttattgacatatgggtgacaaatagttaaatgttaaatctaaaagtggcaaatagttaaatgcccccatacaaagagtacacagctggcttgttcatagttattttcttgtttggaccataatggtttaaacatttcaatcgaatttattctgaatattattttgtacatcaatccttttcccgtgagacgtgactttatcagcttggaaatgatgacgtaatcatcttgcgaatggaactacaccttcgtcttattttaagtgtaactataagtttccatgttcaactttaatcgtatgtctttttaaatttttttgaaaaaaattaaaatagaagtcacgcgtaaaatattgttcatgttttatcatctaatagcaataaataatactaatcattaaaaaaaagaaggttgtctttatgattgatcgtgacatattggacccttgagtctttgatagttactacctctgtcccaatataagtgcagttgtggaatttcgtgtccaatgtttgattgtccatcatacttgaaaaaattaaaaaaataatcacatataaagtactacttgactagagtaaaagatcttgtactgaatattggcaaactattctaaactctcgagagaccgaggggatgctatcattatttacatatcacttaaatggttatcaagaaattaataagatagattaatatatgataaactaattatgaatccactctcctgaatattacttagatacccaattataaatacatacttcctccggtcattgtttgggataaaagttactactatacgaaaaatctatgtataatattacttttaaaggcaaatatacccatacatttctttaaactaagcatttgagaaaatattgatgtttaaagtttttaaaaccttgtccaaatcttatactaaacatgaaatatttataacccgagtactcatttgtcaatcctttcaatgagtaaatacaaatggtcaagactaaatacacggaaagatcagaaaccatatcgcgggataaagataaaggctctcacagtgagccccggaaggcctgaacaaagaacttggaacccagaactcatccaaacaaagatgactattttacactcccacttgttaattggcaatggatctggactatgacggctaacagtaaaatatctgaatttggaattcatatacacagatagcattggatcacttctgaaccaattctacaagaaccgaaatcacacccgtctcttttgcatgtagaaggcacacaggtacatttttttagataatgacacaaaaagaacacaaaaacatatttctagtgagacacccaaattgatagtagaaagatttcattgggtggatactgcataattgcatatcactaccaaactagtaagccaactatttgcaagactacttttgcttcttttttttttttgataaaaagaggccgcacctctcccgctttcattaacgaaaacgaaggaaatactacttttgctaaatggatacaataagaaatgcaaagtgacacttcacaataaagacctactgaaatctactgtcggcttaataacaagctgttgtaattttcacttgtgatgcctggtaaaactgctcatgcatcaatgcatcataactaagcagatacctccctcttgcaactttctttcttctttgggagaaaaacatcagtcagcacggtcttagacttcagggaagcaaggagtatctccagcgcctaaatttgaacacaaaaatcatcaaccatgccaattaataaaaaaaacgactaagatttttttttcttcactcaaagtgacagatatgtacaaagtagtatagtatacctcttccttgccaatcttcatggtcctttcctgcagcgtggtcaagtccttgacaccacactgtgcaagaaggctgatgcttgagacactggacgctggagtcattgagagatcatccttgatagtgtatgtgcctgtcccagccataacccttgaggtgttgacatgtggtattgccttgtgcattggagtgtaccaaagagggcatatgctgcctttcacaaccgaaaaatatccacaagcaaaacgagtggcattgtaactggagctg

SEQ ID NO: 65153 - DNA, 8181 bp, Oryza sativa
tggatcggggacgacgggcgggtgacgcaggagcgcgcccgcagcctggagcgcgccctggggcatgccgccatcgccatagacgaggcggcgacgcgccccgtctcgccgtcctccgtcgtcgcccgcgggtggcgatgtcgcggatcctccgacctccctgagcgcctccccccgcccaagatttcgacgagagggggacggtggggtgcgagcccgacggcgcgggttctgctccccgtcgtcaccgctagcgttcggagagaggctgtgcgccactgcccgttcggccattgggctgagcgggagaagcttggcgcacacgaaagaggacgagggcttcgaaagacacgcgcgccccctatctggcgcgccagatgacggagcgtggggctcctcaccgggagaccgcgcaggcccccctttgccggttcggccgggggcgctaagtgaggttcttcgccctcaatctgaggaacgtcagcgagaagaatcgcacaagacacgggcgacatagacaggtttgggccgctgagaagcgtaataccctactcctgtgttctggtggatctgtgtgtaaaggaatacagagagctcgagagcgagagagagttccagctctagcacccctcctccttttttttctctcccttctctcttaggcctgggcctcctttttatctgatcaggggtcaccacatgggcctctggctgcctaagaaaggaaacatgctttttacaatgagggctagtctacagccggaagtgacttctgacaagcagagcacgcgcctcctgctccgctcgcctgctttttccgtggacgcccatttcaaccttcatttaatggccagcgacttccttgccgcgcttgcgctgcagcctggaatgaatctgatcgggactgacataccaactccaggagtcagcacgccagctccggctagggacgagagccgggaagccctcatcattccgacgggacggggcgaggcgtgtgacaggccgcctgttgccacctaacccgcgatctgaccggtctatgaccggtcacacaccgcgactggtcacggaccggataagcgtgcgctgcgccgcattaaatgcggcgtggcgcgctcgtccaacctgctataaatgcggttaggtgagccccgctgtgctcacctaaccacacacgtggcgccaaaaccacagggggtcggggcgccccagccctcggggccgaaacgggagcggcccgacccctcggggagacagagggaggggtggccgtgtcaccctcgggcccgacccccccccaagggggtcaagccacgtgggtgaccgcggctgcccaagcctcagtcacgataccctcggccccatgtcaccgacagtagcccccggcgttacgccagggcgatcgcccccctcgagggaagcgctcgggcgtgacgccaccccttaggcctggtgacaggtggggccggtctctacaggcgggcagaaacccagcggtcgcaaatcgcgcgcatcggcaagggaaaaccgaccgacaataatgagcggcctctttaagaccgctacattactcgagcagcgcgcgaatcgagacgagccggttcgtttcgcctagagacatgatgatggcgcttttcgcggttggcgagcgcggttaatgcgcgcacgatctgccccatctcaaccgccacggccgcacatctgctgcgtgcgccgcaaacgggcgggtggggttagtggaggcgtgggagcgagaaacgagggggcaaggtagtgggcgcgggaagcgaggagccgggcatagcgttggcaagggaataaagacgccgaggaagggattcgtttccttcctctcgccattcttccccttgccttcgccacttgcgctctaactcttcgtttcctgtgccctacccttgccatactcgctcgctctcaagctcctcctccaccggcgtcatggcacggggctccgcaccgctcgacggtagcgtgctgccgccttcccgcatcgtgagcgagaggcaggccgggctgccgcgccgattcatgccggaatctgccaccggccgggaggtggtcacgctgggcgagggacgcccggcgccacactacccggggcggtccgtcttcttcctctctttcgcaatggcggggctggtcccgccattctctatttttttcatggatattctggagttttatgatctccagatggcgcacctcacccccaacgcgataatgacgttggccatcttcgcgcacctgtgcgagatgtttatcggggtgagcccatctctccggttgttccggtggttcttcaccgtacagccggtgtcgccgccgacggtagtcggtggctgctacttccagccgcgggggcaggtgttgaaccgctacattccctgcgtcctccgcaaaaagtgggacgactggaagagtgattggttctacacccccctcgtcgacgaagcgcgcctccgacttccgagccagcctccggcgcaggcctccagctggcaggcggcggtagatctgggagacggctacgacgccgttcttgaccgcctggtgggtctgcgatcccaggggctcacgggggccatggtgttcggtgactaccttcgccgccggatcgcgccgctccagcggcgtgcccggggcgcctgggagtacactgggcccgaggactacatgaggacccaccaggggcgcaaatgggactgggaccctgaggacttcaggatggtggtccaacgggtgctgaatctcagctccgtggaggcatccctcatcccccaaggggtcctccccctctgctgcgatccagagcgcgccaacatcctgaccatcatgcaggaggtcggggcgtcgggggagcgggccccccgaggccacgttggcgcgggcgggagccgcaggggagaacaatctaccccgggggggggtcgtgcttctgggccccgcgacggggacccgggggggagccgccctgccgacgcccgggggaagaggaagcaggagggtacccctcccccatctcctccccgagggggcggggcggtgcgtgccagcagcaggcgcccggagggtgccgtgccgacgccgcagcccgagggggagcgaaagaagaaacggctccgcaagatgggggggaccgagccatgccgggtgaacctcatctcgcccccgaggtggtcgtttagccgacctccccgcaggttcgtccccgcgcccaccgcggccgtgttcattatcccatctcccaaggcgagttttcactcacccgtttctttttgtcttctggtttttcttctgcctcagcgagatcccatcgcaccccccccccccccgccattccatgtccggccggtctgaagccgaggagacggcgaccgcggaagcccggaggcgggaagctgaccggcgagaagccgcggaccgcctccgggaagccgaggaggctgcccaggaggccgtccgggttcgccaggctgaggaggccgctcgggaggaggccagactccgccgggccggggagtccgtccgggaggcagaggcggcacgcgcacgccaggcggcctgccaagcccccgacccgactccacccgaggcgacgatgacttccgaggccacccacgacgaggccgcggacgcgccgctcgggcccgacccctcgggcgatgcttgggacgagccagcttcgggggacgcccccgggtccggcacgtcgatcggcgggccgagccgcgcggcacccacaccgaggcggctctcccctctgccttccgctgccccactgagcgcggagcccctcctgcaggccttagccgccgcgaacaccacggtgctggacgggttaagtgcccagatggaggtcctgcaggcagagagggcggagctcgacgcggcgtgggcgcgcgtagaggaggggcggcgctcggtggaggccatggtggaggcgggccgcaaggcacaccgccggcacgcctccgagctcgaggcccgtcgtagggacctggcggagatcgccagggaggtggaggaggagcgggagactgccctcatcgccaccgccgtgctcgacgaggtgcggaacgacctccgcctccaatacgggagccaggcggcggagctagagaagaagctcgacaccgcccggggagtccttgacgccgccgctgcccgggaacggcgggcggcggagatcgaggcggcgtcccggcagcgcgaagaggcccttgaggctcgcgccacggcgctggaggagcgcgcccgcgccctggacgcgaaggagaaggacctggcggaccgcgaggccgccgtcgccacccgggaggcaacactggcggcgcacgaggccgcctgcgccgaagaggagtccgcactccgcctccgcgaggacgcgctcaccgagcgggagcgagctcttgaggaggccgaggccgcggcgcagcggctagcggacagcctgttcctccgcgaagcagcgcgggaggagcaggcgcgccacaatctggaaggcgcccgtgccgagagggccgcactggatcagcgggccgctgagctcgaggcgcgggcgaaggagctggacgcgagagcgcacagcggcggaacggccgcgggcgacggcgacctgccgcccgcctcgcagccgccgaacacaccatcgccgggctgcagggcgcactggactcgttcgccggggaggtcaaggccctccgtttggcgagcgaggtaggacccggcatgcttcgggacgccgtctcccgtctagaccgcgccgggcggcaggcgggcctctggggcgggcggaccgcgaagtacgccgccaaccaggggggcctcgcccagcgcctctcagagatggccgggaccctccagcgactccccgaggagctcgaggagacgatcaagtcatcctcgagggacctcgcccggggggcggtggagctcgtactggcaagctaccaggccagggaccctgacttctccccgtgggcagcgctggacgagttccctcccggaaccgaggacggcgcgcgtgcgcaggtccgggacgccgccgaccacatcgtccacagcttcgagggtacggcccctcggctcgcgttcgccctcgactccgacgaggagggcggtgacgacggtgcggacgacagcgacgacgaggccggcgacccgggcgcgtcggagtgagcccccaggcccccgccaatcttaatagctttttcttctttttccgagaccttcgggcccccttcttgtatagactgatttaatctgtaatcaagtaaagaggaaatttctgcgtcagttctgtttgttgtgtgtatgagacgaggatggtctgtgccacggtccttctgtgtcttagcttgaacaagggctcatgcccaggtcccagcctcaagcggcgcgggtcggggctagtgcctggggagatccacgtgtcgagactggccaggctgggagcgcggtgaccgagggttatggatgacccgattgtgggcctttgccgattcccccccggagttcaccacgccccggggcacggctcggttctgggccccgtttggcgattttagccggcccgggccaccgagggcagggtcgagcacgagcgtgctaattcaagccaagattcttcaaaaggaaacgatggcacagacacggtcctcaggaaatcgaaaatgcttttattgaaatacggaagagaaaagagataagtatatgcatgtggtagcccccggccaaccctgcacgcccgggggggtgcggggttggcccgagcccgagacatgacacccgacccccactaggggtagaagcgacgaagctgtttgatgttccacgggttaggcagctctgtgccgtcgcccgtggccagccgaacgcagcccggccgggggacgccgatcactcgatacggaccctcccacattggtgagagcttactcagtccagcacgcgtttggacgcggcgtaggacgaggtcgtcgacgcagagtgatcgggcccggacgtggcgctgatggtagcgccgcaggctctgctggtagcgcgcggctcggagggccgcgcgccgccttcgctcttccaaatagtcgaggtcgtcttggcgaagctgatcttgatcagcctcgcaataaatggtgacccgaggggacctcagggtgagctcagatgggaggaccgcctccgcgccgtagacgaggaagaaaggcgtttccccggttgctcggcttggcgtggttcggttcgcccagagcaccgctggcagctcctcgatccacgagtcgctgtgcttcttgaggatgttgaaggtcttggttttgaggcccttgaggatttccgcgttggcacgctccacttggccattgcttctggggtgggcgggggaggcgaagcagagcttgatgctcatgtcttcgcagtagtcaccgaagagctcactagtgaactgggtgccgttatccgtaatgatacggttaggcaccccaaaccgagcagtaatgcccctgatgaatttaagcgcggagtgcttatcgatcttgatgaccggataagcctcaggccacttagtgaacttgtcgacagcgacatacagatactcgaacccgcccggggcccgcctgaacggacccaggatatcgagcccccagacagcaaacggctacgaaagaggtatggtctgcaaggcctgggccggctgatgggtttgcttggcgtggaactggcacaccttgcaccgccggaccaggtcgaccgcatcgttgagagccgtcggccaatagaaaccctggcgaaaggccttgccaaccaaggtgcgtgaggcggagtgggctccgcactctccttcatggacatcggcgagaagctcgacgccttgttcccgagggatgcatttcaggaggactccgttagccgcgcgccgatagagggtcccttccaccagcacgtagcgcttggagatgcgccggacgcgttcactcccttcgcggtcctcgggtagagtcttatctgcgaggtacgcctggatctcagtgatccaagcaatcaatctaggggagctgggagcgctcccctcgggtcccgaggcctggactccgacgggcctcgggggccgttcaggcgcgtccgtctcccctagggggtcgggtcgcgccgacggctgggcaagcctttcttcaaaggcgcccggtggggtctgggctcgcgaggaagcgagccttgaaagttcgtcggcgaccgcgttatcccgtctgggcatgtgccgaagctctatcccgtcgaaatggtgctccatacgccgcacctggcgcacgtaagcgtccatctgcgggtcagagcaccggtactccttacagacctggttaacgaccaactgggagttgcctaacaccaggaggcgtcggatccccagtccagccgccactctgagtcccgcaaggagtccctcgtactccgccatattgttggtcgcccgaaagtcgaggcggaccaggtatctgaggacgtctccgctcggcgaggtcaacgtgacccccgccccggcgccctgaagagacagggagccgtcgaactacatcacccagtaggcggtgtgaggcagctgcgaggggcccgaggtggcctcgggggcggagacgggctcgggagctggggtccattccgccacaaagtcggcgagggcctggctcttgatcgcgtggcgtggttcaaagcgcaaatcgaattcagagagttcgattgcccatttcaccacccgtccagtaccctctcggttatgcaagatttggcggggttgacgcttccgtcgtatttttcggtgatggtgggccggaaccttgggggccaacggacgttccgaaggctcgccacaaaggctcgatagccggcaccgccaaccggggacacggggggccggcccccgtgcccggaccgaagtggcgctccggacgaggaagcgccctccgttgcatgggcggcgcgacgaacgtcgcgccggcgctcgatatcgaggcgggcatccggccccccacgcacatcttcttgggtcggaggcgttaacgagggaatggcggacgaacggtgggcaacggccgacgctctccgcgccttccgcctcgactacatggagccggcggcggcattgccataggcctcagtggcgga

SEQ ID NO: 65154 - DNA, 3932 bp, Oryza sativa
aggaaaaaaaatgtggcgtagatgatgctagttatatatggactctgttcttttgaatatatttaaggtattacacatgtttttccatcttttattgtaagcaaatatttcacacgtgctagacaatgacatgctacagttatggtcacttttatgttcgacggtttcaaatgatataggttttactattttgcacattaaatagaaaaaataggacaatacatgtaacacgattacacgaatgcagattcgacaataacaccaacaaaagaacaactatatcaaaccataaaacgacaagggaatattccattcactgaaattctgttatatgttcagattaatctaaagatcaagcacataatagacatgtgaccatttttgtctaacctaccatctatcatcccaagtatgaattaagtcaataaatttataggatctcacgtgctatctaagtacaacaaactattcaatttatctacttgaaagtagtaccaccaacaaaagaataactactacagaccctaaaacaacagtagaatattccatccaccgaaattccgttacatgttcggattattattgatgaatctaaaacccaagcacataatatacacgtggccatttttctctaacctaccatctatcagcccaagtatgggtgaagttaataagtttatatgatctcacgtgctatccaatgtacaacgaaccattcaatatatctacttgcaaatagtaacgcctacaaaagaacaagtacaatggaccataaaacgacaacataatattccatccaccgaaattccgctatacatatgtttggattattgttgatgaatctaaagaccaagcacataatagacaaatggccatttttctctaacctactatctaccaacccaagtatgaatgaagtcaataattttacagaatatcaagtactattcaatgtacgacaaaccatttgatttatctacttatctacttggaagtagtaacgccaacaaaacaacaactataacggatcataaaacaacgacataatatccccactgaaattccgttacatgttcagattattattgatgaatgtgaagaccaagcacataatagacatgtgaccacttttctccaacctagtaccatctatcagcccaagtatgagtgtgaagtcaataaatatacaggatctcacgtggtatccaatgtataacaaacaaccattcaacagatctacttgaaagcaacacttcctacttctttagacatctacttccaagagaaaagggacaaataccaagaaagggaagccatgacatgcatgaaaaatggaaagttggtgtgaaggaaggggttttactgatgacggggagatccatctcaaggccgatgagctcgagaagcttgaagccgtccatgtccagcatgtgcacgtcgctaatcaccaggtcgaaatcccccggcctctcccggagcatccgtagcgctgtcgccgcgtccctcgtcatcgtcgctacatcccggccaccgcagaaatcaagcaaacaacaagaaaaaaatatatacaaaaaaaagatctaactaaacaactcggctaacaagccaagaactcacgttggtacttgcaccggcgaagcaacgcctccaggagcatgaggcaaacggggctatcgtcgacggcaagcacgcgcaaaccctctgggaattttctggcggccgtcgcctgcgtcgccgccatgttcgtcccttggatccccttggtaaaaaaaaaaacaaacacgatcagcaacaagaaaaccccaatctggacgaacgactgaccaccaaaatctccctccccctccgcacccccagcaagaacccaccaaaaccaatacaagaacaccaagaaaccctcctagaacccccacctttcagatcttttccgatgggttccctcgaatgctggctcaaaacagcacaagaagctgcaactcgaggtcagagagggatgggtgcaacagcgagggggagggcgtcatttatatcgacgaggagaggagaggatcaggacagtagatgggggtggaattcacgcgctccctcgcagagaaatttggaaggtattttggcctgtgtgcgtgcaaatccctagctttaaattcctgactattgttgcatgcatgtttcttcttccgctgccactaacacttcactggttgatgttctattggactgttcttcccacttttgcgagagccttgatgcgaggagtaaatgtgtgtgcaccgaatattggtaaatgtttaaatgccctttttctatgggctacagttgaaaaccacatctggttttgctggttttcataaatgatgaagctaggtgtataatataaaaatcatttattgtatttgttgaattatatatgttgttcatagcacgatggtaagatcccaacgagtgaggccgctgacgagggctcaatcactactggctcacgcaaaaaaaaaaggtccatcgctatgtgttttccgtggtcgtggcatgtagctaaggtgatagggtgcatctaaccggcttttagggattttttttttatcttaaagcaatgtatttagaacgtctcttcccttgggtttaatttttttatatacattttactagtgtggttttatgtttctctttggtgaattttgggtttaagcaaaattactttctgtcggtcccaataacatgtcactttctttgactttcaatagtttgtcgttattagatatgattgccaaataatggtaaatagttaaatgctcttactccatgtgtgctatagttgaaaaccatctctagtgtggctggctttcaattaattcattggtgacaatgatggtactagtgtatattatttgaaacttttgttgtatttgttacgctataaatacagcaaaatgatgatactagcactatgatactaacaaaatgattatttaaagcttccgttgtatttgttggataataaatgttactcacactagcacggtggcaaggtctatgataagtaattccgcttgaatcagagatttgttaaatacaagtagaagcatgttgttataatttaatgttctcgtgtttgcattgctgtagaataaagagtaaatgtggtcaatacatttttcaatagcatgccattattatttgattattttgaatgttctatttagtgaatctatgattcgagaggaatcaatttccatagaagtaggagcatgtggttgatatttaatgatttttcgatgagcttattgtataataaacaatgctaatgtagttttagatttatctattagattatgagtgttacataagtttttgttcatttatttagcaaatacaggttccaagttgaatgactttagctagtatttagaggttttgtgatatagagattaagggcatgtttggttataacctaaccttgtcataactcatttttttacaagtgtgacttgccacacaaactcacgaagtgtgaccattgttttattagccataagggtgagaatgttttgctatgaattttgtgtgtatgacatttgaagtaacaaaatgtggcttgccataattacaataataaatcaaacactaacccaataaattgtaacacacctaaggcttagggaatgtgtggcatacaaccaaagaagccctcaaagaatgatattcttctactataaaaaaaatatagatatcactgtggcatggcatgaagccgtgaatacgtcaataaataaacgattttcgtgctaaactgaacacgagatgtttatttgtattccaataaaagcacgtagatttcaattggtgagcacacagtttcacatagaagagttcaaataaatgacttgtttttttacttctcaagtcttgcatatattatttaatgcaattaaatc

SEQ ID NO: 65155 - DNA, 2014 bp, Oryza sativa
tgagcgcatgattttgatggtcgtgctcatgacaattaaggaccggttcacgattttcagttgttaaacattaacggtgccaaccacaagccaacgtggacaacggctttactttttgtatagtatggttcattgtggagcaccagattgtgaagtggcggagataagcccacgggggtcactggggagtccatgccttgtttataagggagtgattatgatccaggaacggtgcactactttgaattgtgttatgcaaagggtattgtcacaatctctattcgggtacttgttaagtatcgcgacgcatggttgacatgatgttgaggttgtgtcttgtgagtacagtggtacacctctggccagagtaaaactattcgaatagccgtgcccgcagttatgggtgggtctaacaatgtctttcgtgattagtttcatgcctcttaccatattaaatgacgatgataataatttgtttagctcctggtttagaatggtatattcctggtttggaggtagaactgtgcagccgggtttggttgttcagaatggttgggcctatgcaacgggtatgttgtatagcgttggattaatattgtttaattaaatactttgcaattttattaaattctggagtatttattaaatgccatttatgcaaatgagactatattatgccattctttgttattccctgcatttgcatatttgctgcgtggcttgttgggtatgtcatatactcaccttttaattattcatcaaaggaagagttctacagtgatgctgaaggtgtgaaggattaggcgtagccctggtcaagctgcttgtgggatagagtcgtctgcgccgttcatcttatttttccactgcttggatttttattgtttgagaggaactatctacctctgtaatgactttatattcgcttattaattagagtaatgattgcactctattatcaatttgttattgtgtgcctcggctgattcctggacgagggtttacacacatgtaagcgtttggaattttggatagaaattccgggcgtgacaagttggtatcagagcctccttgaccctaggttatgccaaacggttacctatagaagccctctaaaaatattgaaaaagtagaactgttctcctctctttctcttttaattaaaccaagctaatggcatatgcagtttatagtccctttatttgttctcattcaaaatttactcattattttgtgttgttagtactgtacatctattactgtactaatggcccattttttatctttcttttcagcagaaattttacaacctttctttttatcatgttgcaacataatttagcatgttgattttataactctctcttttattttattttgaaacctgttattcagaagtgcaaaaaaaaatttgtgatcccgttttatactgtttcaacttatcttgcaaagattggtttactttatttatttaccttttactttgattgtctagctttattcaaattaatccaaaaacttgtgctattaattggataaatgtcttaactccctcctttcacttgtctttagatgccgcgcttcaagcctgagtacttgttcggtactgagggatttgtccaggaattgcgtacgatgtccttcgccataggatttgggactgcccctttgatgcccagattcctcacgatcgtgatgaagagaagtgccgtgtcatggtcaccttgaacagtaatcgtgaagacatcccatcggtgatgttcgaggctggagagggaaactatcctcatgcttgtcaggagatggcaaggatcgctacagtgatcagttggccgacactgagtatcgctaccatcctcgccaaccccaaggaagtgaccgtggcagctatcttgaacctgcatggattgacaatgatgctaccacatggcatttggatgagatgctgtgcgccatggatgagtcccgcgctgaggtcgtattacctgctcaagatcgtgaagactggaatcgt

SEQ ID NO: 65156 - DNA, 1948 bp, Oryza sativa
agggtgctcaagaacatatcatctagtatcattgcccttgtcacggagaaaggtaaacaagattctgaagataacgtgtaaagtcaaaatattttcagacagacttatgctgataccatttgtacaggagctcatcatttggacttcagatcagcaactaaagatgatccagattgggttgtagaacaacgaagacaagaagttaagatcatacagggatggatagatcagtacaacgaggaccttgcacagatatcaaaatgagaagatgcagttactgcgacagacaatcgaaacatgagactgtctacacagtaatcaactgtttttggctacatggaaaaaataaggaaaaggaatttttctttcttgcaggctgttagacagaaaattaaattaaggtaacatacagtggaaactcaataagtcactcagaaaggttgtaagcggctaacccgcgaaacccacttataggccaaaataagccacaaactcgtttattttgacctataagtgggttcgcggcttacccacttacacccagtcagaatcagaaattgtgacacccaaatattccatggttccatttatctcccagtaaataattggttctatatctgcacagtaaatggtcatgcatgtaaaacaagcgttatctctataattctaagaaaggaacagtattgccagatgtattcccgaaaaaaaaaaagtattgccagataaaaactggataaagcgcaccatttcgaataattcatgaaaattattccatttaaccatctaacacatcaatcagaacacgttcaacctgacaaaacttcaatgtgtttttttatgatctcaaaaaccacgacgaagctaaaatcttttgttgagctgactactctagatggaaatggggctttttctgaagatgacctgcttctaactagcctattacaattggcacaattttgcacacacaatgtgcaacagccatggattaaatcagcagctagcctatgcagatacagaacatatctcacatagtcaggactaaggaacaaaatcctggtctccatctacgacagcatcataaccttccatgaaatcctgcagtgagaaaataagttccattcagatgcacttctcagcgaattccaagtgtaaagtgcaagccgaaacgaaatatacttcaaagatgcccaatgtttcaatattataagcatgaaccaacggtatgaatcaagcagtgtagtgaatactggctacaggtatgtgaagaaaatcgaaaccagagagaaaagaagaataaaacgagctgccgatctgcaggaaaaaggagagtatcttacatcattaaacagctcagcaacaatgtcatccaaggtgtctgtcccttctggaccatttgttcctgtgatgaaaccattgttttcatctttttttttagataatggattataaaaaacccggcctctacaccttgtgagggtgtacacagcctaaaagtcacaaacacgagtacataagactctcccgttacatgggtaaagcataaataagttttaaagatggataacaagcaagaggaactaaaagctaagcttcaatccttcttctaaagttccacccaaaagtagagaagagctccatcatacgcttctctaaaagcttgcacttcgcgattacttcaatgccttcgtcttctttaagaagcaaagaccaaagccttgacaactgagttgctttgaaaattacctacaaaaaagatacgtggttgtagccattaaagactaagtcatttctactgagccacaaagcccaacaactcgccgctatgcctacccaagtttgtcttttaagcttaggttcaaaacctcttaaccaatttccaaacaagtgtgaactattacggggttgcttgactccaaaagtaagatagatcgcattccaaatgtatcta

SEQ ID NO: 65157 - DNA, 1821 bp, Oryza sativa
gatatggatgataaataatgacagaatatttagctttgttggcatatctgtattttcctttttctcatactcatggtttctgtattttgcttagtgtgataaatactttgtcagatatttgtcatgtcatgctcctcatacttgagtctatgatttcggttagctgtgctagccttggtacttttattccttccataaaggtgtgatcatgaatagtaatttcaagtcttggaatgttttgtgctagaatattaggggtatgaatgctgagaataaactgttgtctttaaggcagaaaatcggtgagagtggttgccagattttctgtatacaagaaaccaagaaggaacactttgagctctctgatatcaagaaatttgcccccaagcgttttgattcatttgcttttgccccctccgtgggtgctttaggtggtattctaattgtttgggtctcaagagtcttcttagggactccaaaagaagttaaccccttttttgtgaccgtggaattaacttctagattcacctctcaagtttggtccttgacatgtgtgtatggaccatgcaatggccctgaaagatcagattttgtggcctggtttaaaaaatattcagattgatgctcaacagaactagctgttcttagaggattttaatttttacatatctgtgcaggaccgaaataaaataggagctgatatgaatgatatctttattttcaatgttgtaattagttccctaggtttgcttgaaatccctttaaaagggagaaggttcacatggagtaatatgcaacaagatcctttactggaaagactgtattgggtatttacatctgcatcttggactttatctttcgccaacacaactgtcctccctttgaccaggaatatctctgatcatgttccatgtgtggtcaagattgacaaaaatccttaagtccccaatcttcagatttgaaaatttctgggtggaagctgaaggtttctttgatattgtccagcaagtttgaatgttggatcctggctttgatgctcctgcaaaatgcaattccttcaaacttaaaattctcaggaagaaactgatcctttggagtaagaacttgtccagactcatgcttctcttgacaaattgtaataaagtcgttgattttcttgatcttctagaggaagaaagatgcctttctttacttgaatagaatttcggggaggcagttaagcaccacatcttaaaacttctgggagaaagttggtattcaggaaaatttattggaaaaaaagatgtactaatataaatggatgatgctgggagaagaaaacaccaaattctttcaatccattgccacaaaaagatacaaaataaacacagtttctcaagttatggatcaaaatggtcagatagtttatttgcatgatcaaaaagcaagtcttttctatcaaagtttcgaaaacagtatgggtatctcttgctccccaagaatggtctttgatttgaatgatctctttcttcctagggcagacttggaatacttgactgatatgttttccactcaagagattgatagtctcataactttaatcccagctgataagtaccaggcccagatggtttcaatggttttttcatgacaaaatgctggcacatcattgctcattttcatgcagaagctacagacttgcaggttctcaataattcttacatcactctggtgccaaagaaacctttctccagagacagttaatgatttcaggccaatttctctaatgggttttagtcttaagtttcttaccaagttgatggctgatagattacaaggtgt

SEQ ID NO: 65158 - DNA, 3222 bp, Oryza sativa
ttgttgttagaagtatatatacttgttttgcagtattagtatatcctttttttttaagtagtagtagtacataacttcttttttcatttagtaccactatacttaggctgcttgttgttagaagtatatatacttgttttgcagtattagtatatccttttttttaagtagtagtagtacataacttcttttttcatttagtaccactacataccactttttaatttaatgtcagtacatgtatacctttttttccggatatattatgatatcttggaatgggtatatactgattttttcttggatgaagtatatatactgatatcctccctgaatgagtatgtactgatcttcccttggaggaagtatatatactgatctctttttgagtgagtacatacttatctcttctaagagtgagtacatacggatctcctctgagaatgagtatatactgatcttttagattagtagtggtttatatttctttttaattagtaagtggtatatgcctcttcttagtcagtataatttttttttaatcagtatatactacattcctgagaagtttatatacttctgtttgatctgtatttactgcgtttctcattgaaggagtatatgctagaacgttttttagtcggtatatgctagtattttttttgtttggtcagtacgtacatactatttttacctggtagtatcaacgatcaaagaacagtacgtatataccactaagcagtgcatgctgtttaaacaaacgagcagtgtgtaatcatactgattacaataacgagtggtatgtaagatataatcgattaagaagtacagaaggttaagttataatcaactaagaagacggtaacagtacatagatacaactgagattaagaaaaagaaatcatagctacagaggaaaaactgcatcactgcatcgccatcgtcgtcagactataatcttaagctaagctaattgttacatctctaccagaaaccaaatcacaatgggagatgtgcgtacatgttcgtatctgcggtcttccaccgttgccgcgtgattcattagctgggaataactctacaaactggcatcatcgtgcatggtcgatctgtggcagccgccggccgaatcgttcgattcgtttgcctcgaccagccgtactgattttagttggaggagagttcgcgtttcttgctgcggtagtggaactgtggaagccgccgccgaccctgatactgttgccatgggaatcctgcgaaaggggagtaatggatgtaaacaaccatcaatgataattcaagcattgaaaggacgtaaatctagtcgatcggcaccatcgacggggagcacaacccaactacctgatgtcgttgctaatcccatccgtctgaggactgtatgaggaagcgggtggtcgaactggttgatggagcgcgccgtccacccgtccgtggctgccgtggcaagattgctccagttcttccaccgccggcggacttcgcgacctccaaccaagctaccgtcaaggaaccgtcgccgcctccgcctcgcgtcaaaccgcaaatgtcgcgagagctgttcgatctgttgagtactaaccggtgcgatttatataattaagcgctaattaaggatcatggattattatttacaaaaggaaaatcaaaacgggtccgttcggtgatccgctaaggagcttcatcgagatggctgtgatggacggtagatggaaccgggtgtacgtactcccgggagtacatatcattttcatatatatatatatatatatatatatatatatatatgacatatattaataatatgtatttatacatatatctatgcatatgtacatgtacaaaatagacatatatgtatatacttaacattttatgtgcatatataatatatttacactaaagtaaatgtgtacatatataaatatagatatgtattacaattcattatgtcctagctacgacttcgacgtagtcgttatctcagaagttaacgacttatgaattgtagatccgtcgtagtagaattcaccctcgggatcaaggacttgttcattgatgaatcccatgagttgttcttgaacagccgtgataaagtcctcgtgtgtgaggttgtccctcatgtgaataacctatgaatgtatgaagttaattagtaaacaagaaatcgatacatacgcaatgaaattttgaatggtttatttatacgtacatcgagttctcttgtggtgatgatttgggttgtaacgcagtggcaatactcgcatatgtagtagccgcacaagttagttccctcttcctgttttgcacactatatacatgacaaacgacgagagattttatatttgaattagagattcgatataaattttgatcatgtactcactacaaatttgaacctccggcgaagtttttctttccaagtgccacggaccaaatgacggaaccgataccaagccctacatgaagtttaaaactatatatgattcgtactagcaatagcaaaattcgtaataattaataacactggaacatatgacattacctgtttataagttcaaaaatctggtcaaaagtagactcatctttattcattgagtcatagacattgactctacattccttcaagtcgaagagtaaaaggacccagtggaatatgcaatttgtgtgagatgatatatgaaacactgtgcatctatatgtacgggaacgaaatttgttcggtagatagtaaaaactaactctgtgttgtacggcagtagtatgaacgtcttgaaatgctgctccttgaggagatggacgagattgacctctgtgggttgcggatacttggtgaccatttcgacgtttactttccgagggtcgatgaatccagtattgaaaaacccccgctgtcgagccctttgaatctccattctacaacgatgaaggaattgttatatatggtgtacatatatacaaggagctaattaaaggaacgtaagaaatataactcaatgatatgtacaaaatccatgcgctcagaatagagacgtcgagggcatctagttggtatagttcgtagatatccttgaaattgatccagagaacatcttctccttgtaagaagtcggagttcttgattctcgctccaataatctccctaccgctggcgctcatctccatgtaccattcatggaattggtacatctgtgtgggtaggga

SEQ ID NO: 65159 - DNA, 701 bp, Oryza sativa
tgtgtcactgccattttcattgccgtccatagctgaaagtgactgaatttgtctgtcccaaatttcctgacatttctctttagtttgctgctgaagctgcagaaaagacatcctttgtccccgtgcaaacttactaactggaatttcatccattgtaacacccgatgcagcttgttcacttgaaagcttcctcaccatcgcgatccgatgccaccttgttaacttgtcaatttgctcttctggaacgccaaatttgagtagcaactatttacaacaatatcagtgtcaaatctcagtgaataaagtgtaaaagaacataaaaacagcatggctgaaatgcaagcatggggtatattcttccatgccaacaaaaaaaaaatacaggtatctaaattatgaccgagtgtgtcaatggcatgtgcagactcgcagtaggtcccacttgtaattctcgcggcagttggtattttgacaaaatgtgtttgttttacatggtatgaaggcaattaatattttgttattacagggatccatgtgattcttcatcataccccagttaataaaataaacatctgagataattatatgttcacactaaagcatgttccatgatgatactaaggcatctcagtgccttgaaccccaggaaatgtatttttgtgcatcatactgctaagattgggagggctgatggtacctct

SEQ ID NO: 65160 - DNA, 20953 bp, Oryza sativa
tgtaaaaaaaattgtgtccatatatcatagtacaaagaatattatataggatatatttcatcctccgaattatatcctttcctctcttgatgggttattaattgattctctcctgattttattctataaatactccctctattttataaaaaatcaaccaagttctagatgtgacatatttttaatactggctatattcggctgtcattattttcactgtggtgcagccaacaaacacagtatattgtttctcggctgtgacagtgcggcggtacaaaacagccgacccactatgaatctggatatatctttatccagattcgttgtaagattagatagacatcgagccgatgcgctcgtgttccgtgattaatctgattatatatcgtattgagctatacacgctttcaatgcacactcaccgaagtcaacgaccttcgctgcttaaaggcaccgcaaatgcacataccatttccgtccattcatcacacacaaccagactccgatcgacctcgtctcgtcgagcgccaagtccggctccggcgacgcagcgccgccgccacacgtcgtggaggacttcttcggcgtcatccagctcctcagcgacggctccgtcgtgcgcgccgacgacgccgccctcctcgccatgcccgaactccaggacgtccccggcgttcagtggaaggacgccgtgtacgacgccacgcacggcctcagggtgcgcgtattcaagctggccgccgccgccgccggtgacgatggaggtaagctccccgtgctcgtctacttccacggcggtggctactgcatcggcgccctcgaccagtcccccttccacaccttctgcctccgcgccgccgacgagctccccgccgtcgtgctctccgtccagtaccgcctcgccccggaacaccgtctccccacggccatcgacgacggcgcagctttcttctcctggctgcgcggcgccggcagtgcggatccatggctcgcggagtcggccgaactcgcgcggacgttcatctccggcgtgtcggccggcgccaacctggcccaccacgtcgccgtccgcgtcgcctcggggcgccaacccgtggttgacgacgtcgacccggtggtgcgcgtcgccgggtacgtcctcctcgacgcgttcttcggcggggtggagcgcacggcggcggaggccaacccaccggccgacgtgtccctgctgaccgtcgagatggccgaccagttctggcgcctggcgctgccggcgggggcgaccagggaccacccggtggcgaacccgttcggcccggagagccccagcctggaggcggtggcgctgccgccggcgctcgtcgtggcgtccggcggcgacgtgctctacgaccgcgtggtgggctacgcggcgaggttgaaggagatgggcaaggcggtggagctcgtcgagttcgagggagcgcagcatggcttctcggtgatacaaccatggagcccagaaaccagcgaggtcatccaagtcctgaagcgatttgttcacaaggcgatacgcccagctgagggttgaaaaggacaaggcaaaattgagtgggatactttcaatttcaacatttgtgttttgtttgggttataaaagtgtttgttaaatatccattatctaaaaataaaaaatataaaagtgtttgtttaagactacggtgtgcacggttgccttgttcacttctccaagttattttcttgtttgaatggggatggtttgaacatttcatccaatttcctttttattgtgcttatatagctgggtggacctcatatccaggaatactttttccggcagaaagtagccattgaatgcctctctgtgtgtaacagatgtcctgaatcctgatagcatttttgtgtatgactgtatggtactagtttcatcgtttgacctaataagttttaaaacaatttattaattagaaaaaaaattgtctttcatatatatgtgcatgtgaaaaatgataaaaagcctcaaaatctattctaaattcactttaaaattcaaattttgattgcggctaataaccaataacaaacaatgtggttttagtattgtttaggacatccattttacatgcgacaatattttagtaattcgctacaattttctttcttttttcgagacatctattttttcaaactgctaggtataaaatcacttaaatttgaagtttggattagttatggcaatgtatgcgataagattagctcaagcctgttggtgtagcacagttacaccccttcataatccattagctagattgaacttgcgaaacaataatatgtacaccttgatgcttggtccatttggaacgaaaggaacaaccgtgtattcaacaattgcatacggttatggcctaaggttgttggttttgttgcagccatggtgcaagaaaccaccctttggcggcatgcccatcccttgtcgctcacactccctcagggtagtatactcggtcgctaggtcgtcacattgttagcgagagaatagcctcaagtattttttttaaccaagggcacgcgtaggacactagcttgcttgtgtgggtaagcagagtccaacacccagttattcaagagacatgtagatcgatctagccttcaagcttgcctacctaggaagcaggcttcaggccaatgaaaacgtcagtcaggacagtcttggattgcagggaagccttaagaatcgccagaccctgcagagaatcaacaaatacatgcataccgcctaaaaccaactgatattaagttccaacaatcaagtagagtcatgtgtacggttacgaatgtaatcacctcagtgtagccgagctgcacggtcttctccttgagcgcgcccaagtccttgaccgcgaacctgttgagcagcgtgatgctggagatggacgacatgggcgccacggtgagatcgtccatcaccgtgtacgtcacgatgccctgcacgaaccctcctcctttcgccccttcggcggcggcgttctgcgtgttctgatcttggccgccggcaacataggtgcatgccgttgccatctggttgccgcagttaggacacttcgtgccgctcgcgttcgtcacgaagcttctgcaggcgttgctgctgtagctgcatctgaagaagctcttgcttgactgcgcagaagacggcgccggcaagcggaggacggaggtgttggagctggccgccggcgagagcacgacggggctgagcagcgagtccttggcggtgtcggcctggacgaaggcgtcgtcgagcttctcgaaactggcgtagaggttgccgacgcagccgaccatggagcccttcccgagcagcttgatgcccgaggcgatcggcagcgcgaggagggagaggaggaagtcgacgacgtccttgcgtgcctcggcgtacagcacgcgctgcgccttggtgtcgatcaggagtgtcatgctcatcagatcgctacttgccttttggctggttgtttcagaagccatttttgcagtagttgcagtgtgcagtggcctgcgtctgaactctgaagtcgaagtctcgttttgcctgctgcattctggaatttacagcgtaacagacgagagcatcgaggttcacggggaagaagagagtaatttatttgcaaattaaccgctcattgtgaactttaattcctaatcaatcaatgccgtttactccattgccatgcatcgatcgcactgcttgaggccttgatgctgatcggttcagctccatcatgcacaataccaatcggttcagctccgtaaaattgaacctgaaacacaatgcaggccggatacaccagtccgtccatcatccatgcgcctaaccggctgctatacaagcaagcaagcatattcacgcggacccaaaatataatgatttttagtgtttaaaaacatctctaaaaaatcatccatcatttaatttttatccaattttaccactaaggaaagtacagtaaaccaatatccttcttgtataataaggattgccatgttggatttggatttgagctacgatttgtgaattttcatagctaactattggctataatatcaaacttcttgtaaccatccttataaaatgagggtcattaaattatttttctttataattagttacataaaaaaacaaagattcttattttagcccctccattcaagtttagaaacgtgtttcccttttgcacaaagactaagaacgtagcaaagtggactgaatagcactcaattagttagtgtcttaattagtcatacggtgaatactggtagtacgacgtgcatggatagattctcaatgcaatgagctgttaggaaacgctaagcgaataaacgataaaaaataatagatcaatcgtagaagacacgagatttaacgtgaaaaatccttttaaaataggagagaaaaaaccacgggcgccagccagcaaaatatattcactatatctgaggtgagattacatcgccgcacggcggcttacaagaggtacatatattgtggaaccctgaaagggatcaagcctcccggcgacgggcctccgctccactacggtagaaactggcctttattaaatgcaaatgaatttgtatcaacatgagcaaatgaccgtggtgccaaagcgatcgcgtgaatgtgagatacgatcaactgcactggtagcgataaagagaagattgaacgcactgattctagtcgtccgttcagcgaaaagcccatctggtttaccagttggcacagcctaaattaaatcacaacccattgatagcaattacgggccaggcccatctctccatcaaaagctcaaggccatctgtgattttgttctataactcgtacagaagacatcacataatcaacaccaatgtatcttgcctaactaggtaataagtagcagggctaagtagtaggtctttataaagtgggtcccacgagaaaaaaaatattgctttttaattgctttttgtccaactcagcatgcagtagtagcacatcttgtgttggaaggagagagtgaaagagattttaatgtttttttattcttatgagtgggtcataagcttactacctagcattagttactacccactttcacaatgcttattactaggtcataggaatattatattgcctaatacctgctttttcctaacattgtggatgccctaagagtttcaaatcgactggtcacgcttgcggcttgccagcaagcaaaataaacaacaagagaaggaccaacacaaatggccatttcttccgcttcttgccaaggaaaacatctgtaagcaccgtcttcgactgcagcgacgccttcagcatagccaaaccctgcagtacagtgtaaaacaaaatggttaataaaacacaaatcaaaatgtaccaaaacttcatatgataacaacctcagtgtagccgatctgcacggtcttctcctggagcgacttgatgtgagtgacaccggatttgaccagcgcgatggtggacatgggcgcgaccttgaggtcatccatgacggcgtatgtcaccaacccctgcacaaaccccgtgcctgcgattgcagacggcgcactcgcggtcgccggcacctcgccgccggtggatccagcaatggtggtgctcgacaccatcacatgcttcaccggcaaactcatcttgccgctgcactgcggcaactgacaaggcaagccactcaccgtggagacgtagttgcagcaatcaccgaacctactcgcgctgccccggtaaagctccgtggaggccggcggcggcgccgccgcattgatctccggcaggtggagaaaattatgaaaaaaattaaaaagacaagtcgcgcataaagtattaattatgttttatcatctaacaacaataaaaatactaattataaaaaaatttcatataagacggacagtcaaacgttggcacggaaacctagggtttgctttttttttgggacggagagagtaaagtgctaatgctaacatttcgtcatagataggtgttgttctgagacaaattttttgaacgaacaacgaattttacaaccacacgaggagaacgtccatgtatgtgcacatttctactagtgacacgtgctaaatactgtttctagtatttaaaattagatgcgcagattaacactctcattattatttagtttgttttcattaggaatttactgtttccaataggaaaattaattcgtgagacttgcatatctcttaaacatgtgttgaagggggccaaaaaacttcaaatttttaagacgaatactactggtgcgttacaaaattcgcgtgaagtacgacgttggctactttgctgatctgatcaaattggcctcgattcctcaaaccagcataggaccagcggtgtgcagtccgcctcgcgccgaggaagacatcggtgagcactgtcatagaccgcaacgacgccttcagccacacttaagccaaaatctctaataccgattgcagggttagaacccttgctattgattgggccacgtggcatcacgcatagctcacgaccagattctcggctggagaacatgccacgcattcgaactgtcccatagccgtccgattacatacgaacggtgagaaaaggcctagcggacctaaatataaattgcaagttttaagaagggtttttaacaaaatgcacaatcttatctagaacagtccagagtatatgaaaaaagacccagaatcagaaaaaaaaaaatccagcaagaacaatatacagtattcccctttcctaatcaccatgccgtcgcgtagatggcaaatacggggacgatgagctcgagctcgattgacctggtgctccttggccccgccctgccttgatccgtgcgaggcgacgatgcgcctagacgatacgggggaagcgaaggatccgacgacggagttgtagacgacattggagggagcccgctgagatagagagcgccataggggatacctccgcgctggtcctggagcttgacggcccgcgcggggccttgatacgcgcctgctcaccagctagcgctgcctcatatagacgagtagggacggcggcggaggtccacgccgtcgctacatccgcggggatcagctcggctcaacgccaccctgcttgtcgccggcttcctttaccgcctctgcgatcaaccgctcgcatcgtctcctcgatatcctccttgccgcttctgccaccatggccggtcgcaccgccccctcgacccttccgccaccaccgcgacctcacctcatcgccgagccgctcgtcgccggagatcggaggcggagacaacggagttggtggtggcaggacggccggcagtcaacccgatggcggggcctccggctcactcttaacccgctgccgttcgaccacgccacctccgctgcctccgtgatgcatgcagagctggccagcttgaagccttgaacccagtgaccaaagaagccagttacctcttgcatttgcaagcggcctcacccatcagttctttctcagcgcaaatccatgctggaaagtggaaactgaaaagcacaagccacaacaatagtagcgcagtaggtgcagtacagtggagtacgagagaagaagagtgaactgggattgaaagcagaggtgggttctcaaaaaaaaagaaagcagaggtggacgacggggcatatgcatgcatggagcacgtcactgctcccaattcccaatggccacctgctaacttacacgtgccatcaactcctaacaaattttctttttcacccctaataatatttttttattctatacttcactaaatacaaaatattttaaaaaatgcccctaggttagtactcatgtatttatgtttaggaccttagaagttttgacttttcaagacttgtttgtctgtctgagtctgaatcgtctgatgtacaaagagtaacataaacatattatgactctatattgagttgatgataggagtcatttacttaaaaaaatatgcattctaaattttgtaattttcatgtaatttgataaattttgtaaatcctactaatttaaaagacatatcttccaaagtagtatttgttaaaggcatacagatacacttaaagaagttaattatccgttacaaatcttttttaaaaagttgaaatataattattcaccggacaagtactgctagctaaatacgacacataagaattagccaggcataaactaaccatatttactcttattgttgacaatattgttataattgtattctattttatctatgattagctaatcaacctgacaatctctatattgtgagataaatataggtggagggtatatcatatactgaccatataggtaagtaggtggcactaatagtaaacaaccttaagctttcagtcctctaaccatatctaatcataccaattataaatatatgttatttactctgtctaatggaagagaaaaaaggtttgaaagtaaataggcaagtattacaaataaaataaaataaagttttttaaattttttttccgtagtaatgctttaacaaagcttaaaatctttatatgaatagggttactacaggttaattgttcctcaaccttttcaaaagtcattaaatagtttcttctaaatgaacaagtgtatatatttttttctaaaaaaagtaaaatattgcatttgaaactcttaacagcaacaacaataactattataaatatgtaaatatgtactagctataagttggttttccaacgggcacgctgattttcttgaataggaaagcagggaattggaaaagactatagaaggaggatttggggaatgtttaagtttgttgccactttcaatcttaccgaattttggcattgccaaattttggtagtaaacacacttcaactattacgatgttacccaattttggcagttccagaagctctctcttaaaggcatcaaaatgtagtaaaggcatcaaaccaaacaaagcgaatgttaccaaaatttgataataccaaaatgtgttaaaattcgacattactaaaatttgatatggtcaatttttcaaacaaagtgtacaaaccatttatatctatttccgattctaatttttagggtgttcaatgaaaaatgttggactacttattatcgaaaccattcctaagccattatgcattattgggtaagttgaatgtaaaattttgtgattatgtagccttttttatatatatacaaatttagttatgatcaattcgtaattaccaggcttcataattaacagtgtactgggttcatgtaattgagctggcctatgtatactaaggcgtggcaaagccgcggttattttctagtgtatatcagaaattaatctctattgcaaatatctaaaattaagtcgatcacctgtaagtagccgacctcgacggtcttctcctacaattccctgatgtccatcacgccaagcgccacgagggcggcgatggcggagacggtggacgacggcgcgacggtgaggtcatccatcactgtgtacgtcaccttgccggggttaagccgaatagtactagttagagcaaataatagtatagtccactactagctccaatttatctatagtcaatctaatagctaattcatacaatagttgcttactatattattaatatattgtcccacctgtcatacacacattacattttggagttcgtgctgcagctggctacagatctatagcccgctgctcttctctctcatcgtttatctcattaaaatatgtttacagctggctaatagtctgctattgtacctgctcttaagcgggcctgacctatctctccctggataccccaaggcccatatgttcctattcaggccccctttgattcaaaggaaattcataggaattttaaaggattttattcctgtaggaatttttcctatatagccctttgaatcaaaggaatgaatactatggaatcctatgaaattcctatggaataccttttcccatgcaagttttggaggaaatttagcatgaggtagaacctcatattaagaatcctttgagtctttatctctccttaaattcctgtgtttttcttacggttcaatcaaacggtcattcctatgtttttcctgtgttttgtaatcctctgttttacacttatattcctgtgagaatcctatgtttttactattcctctgatttttcattcctgtgattcaaagggtcgattttgttccggaaccggtacagatgattgaagaacatacgatatcaatacgtgacaaactgacaatagaacggcaataattcatagagttcggaactctcactccccggcacataaaacaaagtagcgtttagtgcgtgattaattatggtttagctatttttttcatacatggagtataattttataagtaactttcgtatagaaactttttgtaaaaaaaaaagtaccgtttagcagtttgaaaaagtgcacatgaaaaacgaggaagaagagttgtgaacggctgggaacgaacgcatcctagatcgactgacaaaagcaccaccaacacataagatagctcaatggccggacaaggaacatgaacgttccaacaaaagcaaacgaggctcccgcgcaggcgatcacatcacatcaggccttcctcttcttgccaaggaagacatctgtgagcaccgtcttcgactgcagcgacgccttcagcatcgccaagccctgcaatagtgttgtacaaaattgacaaacagatcggaacagagagatgagagtacgcactgcaagcaatacacattgctcgtagagaaatagtagcactttacctcagtgtagccaatctgcacggtcttctcctggagcgaggtgatgtcagtaacaccgaaggtggtgagcagcgtgatgccggagatggtggacatgggcgcgaccctgaggtcatccatgatcgtgtacgtcaccaccccctgcacaaatcccgtgccggcaacagcatatgctggttgcgccgcctcgccgccgctggccgatccggtagctgtagtgctcgtgctcgacaccacaagcttcattgccaccgtcatcttgccagggcatcgagcgatctgacaacgcaagccactcaccgtggaaacatagtcatagcactcgttgtagtcgcacgagctgcagcggtaaagtttcgtggccagcggcgccgccgtctccggcagctggaggagcttgccggtgtcgaagccaccggccggcgcgagcagcacgttcctggcgtcggcggagcggacgtaggtggcgtcgaggtcctcgacgctggcgtacagctcgccgatggagccgaccatggagtccttggagagaaccttgacgacggtgccgacggggagggtgaggagggagaagaggaagtcgacgacgtccttgccggcctccgcgtacagcacgcgctgcgccttgctgtccaccagcagcttcatgctcagcgccttcgagctggttgtctccgtcgccatcgtagcaactagcaagtgcttgtggctagcttggattggcttgctgtgtgagcagtagaatttatagcgagcagagacgagcaggaaggattacggacgagaggagagtaattagccgcccactgtaaattttcttgatcgatcaagcttttttgcatgcaaaaattgcagtcccaatatatgcgcgcatgtagacggtcaaattaataccgatcggttcagctccgccgcacgtagtatcagcacttgaatgaatcacccatttatgcgaggcaaccgaagcatcatgaatgcgactaccggtgcgtagaggaggttaatttgaaaagaaccaataatttgttttttttttgcgagatgtagaagttgaatttaaacttgcatgtttatgaagtgatatatcacatgttaatacgtcttcttttttttttcaaatttatttaagtgacatgcaaataacgagatgatatcctctcgagggataaaaatccactccccgaattatgaaatcacttttcctaataaaaactttaatgactatttaggtgtcacgcccggaatttctatccaaaattccaaacgcttacatgtgtgtgaacccttgtccaggaatcagccgaggcacacaataacaaattgataatagagtacaattattactctaattaataagcgaataaaatgtcattacagaggtagatagttcctctcaatcaataaagatctaagcagcggaaaataagataaacggcgcagacggctccactccacaggcagcttgaccaaggctacacctaatcctccacaccatcagcatcattgtagaactcttcctctaatgaatgattgcaaggtgagtatatgacatactcagcaagccacgcagcaaatatgtaagtgcacatgataacaaaggatggcatagtagggtttcatttgcaaaagcagcatttagcaaacatttgagaatttaataaaacagttaagtattaaacaatatttgtcggtgatatgggaccaggagtatcatgaccagaggcttgaggcagacgcaatcgcccacgtggcctggcaccttcggggacgtcgggcccgagggtgaggtgtccgccctcctcctgatttcccccgagggggggtcgggttacgcttgccccggccccgagggccgaggcaccccgaccccttaaagaagtctgcgccacatgtatgggataagtgagcacagctgtgctcacctaacagcatttattacagtctggtcaagcgtgtcacgctgcatgtaacgcagtacagcacgctcttttatccggtctgtgaccagtcacagaccggtcagatcaagggttaggtggcgactggcggtctgacgcgcgccttgccccatcccgtcaagacgaaagcctctaggcaactcgtctcaagccggagctagcgtgttatctcttagagatggcacgttagccctggttagatttataccaggcttcatcctaaccattacaggcaaggtgttacacgaagaagggcaaacatgcatcttgttaaactgacacatggtggacaaaagtgaccagtctgacactggtcgcgtcagcaacgggcagccacgatcccacgttgtgcccgtctccgccgggagtggaggtaggtgtgggctgtcccatcgaagtgtcattcgaacagcaaccataccaatctccgtccataaagagaagaaaagtccagtttggaaggaggagggtgcatgtggtatccccttgaagtataaaaggaggaccttgcccatagagaagggggttggttgattcttttccagatttagagcttagaacgggggagaagttggctgacacttggtagctcattcatacaccaatccacaaaaacacaggagtagggtattacgcttcccagcggcccgaacctgtatacatcgccgtgtctcgtgtttcttcctggcacgcgatctttccacacacagcgagagcttgagatctcaccctaagcccccggccgaactggcaaaggggggcctgcgcggtctcccggtgaggagccacgagctccgtcatctggcgcgccaggtagggggctcagtgtgtgttttctgagctctcatactcttccgtgtgcgccaagtttcccttgttctgcctaatggccgagcaagcaaaggcgcacgacctctctccgagtgtgagcggcgacgacggggagccaaacccgcgccgtcgagctcgtactcccccacctcctccacgccaaagtcctaagcagggggaggcgctcgagagggttgataaatccgcagcatcaccggtcgtgggtgatgcaggagaacggcgagatggggagcgtcgcctcctcgtctacggcgacggcagcacgcctcagggcgcgcttcaggctgctagcgcgctcctacgtcacccacccgtcgtccatgaccctgagtctccagctcagcgatggctggacgacgtggccaacttggtcgtgacggcccagcagcgcctgggtgctggtggacggtccgccaccaccaagacttccggcgccgccaccaccggttccgtgtcatcaaggcggagggcgcggcgagcggcggcggctgcacgtcattcggctgccactccctcgtcgacaccttcgactcgggaggatcagcatgaggagccggatgcccgcctcaacatcgagcgccggcgtaatagccggcgtactccccgtgcaacggagggcgcctcctcgtccagagtgtcacctcgacatggacgtgaggaccagccctccgtgcccccggctggtggtgtcggctgtagagcctttgtggcgagtcttcggaatgtccgttggcccccaaggttccggcccaccatcaccgagaagtatgatgggagcgtcaaccccaccgagtttctccaggtctatacgaccgggatcgaggccgctgggggagacgacagggtcatggcgaatttctttcccatggccctgaagggacaggcacggggttggctaatgaacctgccacccgcgtcggtccactcctgggaggatctgtgccagcagttcaccatgaactttcaaggcacttatccacgcccaggtgaagaagcggacttgcacgcagtacagcggggggatgatgaatcccttcgctcgtacattcagcgtttctgccaagtccgcaatactataccttgtatccctgcacacgcggtgatctacgcgttcagggggggtgtgcggcacaaccgcatgctcgaaaagattgcctccaaagagccccagactaccgcagagctttttcagctcgcggaccgagtggctcgtaaggaggaggcctggacctggaacccctccggttccggtgtggcagcttcggccgcccccggatccgccgctcagacagggcggcgtgacaggaggaggaagaaaaggtcggtccattccggcgacgagggtcacgtcctcgccgtcgagggcgctccgcgggccactcgaaaggggaggcctgcgtgcgacaaaaagaaagaggctggtactcccagcagggagcgccccgccggcaggtggtgctccgtccacaacacctccctccacgatctcgcggactgtcgcgcagtcaaaaacttggctgagcgaacgaggaagtgggaggaggacaggaggcaggaacgccgtgaggacaagtccgcggcagttccctccggtaaacggcgaagtgaggccagacagaaggcccccgccgttgaccccgatgacggtgatgatgacctaggtttccaagaacctggggccaccatcgccactgtcgacgggggagcgtgtgctcacgtttctcgccggagcttcaaggctatgaagcgagagcttctggccgcggcccctactcatgaggcgacgcgtcgggcgcggtggtcggaggtggccctcacctttgatcagaccgaccacccaccgtgcgttgcccggggagggcagattgcgatggtggtttcccccactatctgcaatgtgaagttggggcgtgtcctcatagatggaggagcggctctcaacatcctttcccccgcggcctttgatgctatcaaggccctggggatggtgctccgaccgtcccagccaattatcggtgtgacgccggggcacacgtggccattaggtcacatcgacctaccggtcaccttcggtggacccgccaacttccgcacggagcgggtgagcttcgatgtggcggacctcagtctgccctacaacgcggtcctagggaggcccgcgttggtgaagttcatggcggcggtccactacgcctacctccagatgaagatgccgggccccggtggccccatctctgtccgtggcgaccttaaagtcgcgctcgcttgcatggagcagcgcgcggaccacctcgctgctgcgaccaagcccgagggtggtgacgagaggcttggcacctccgcccccaccgccccgaggcagcggattgccacatgcgacgaggtcccggtcaaggaggttgccttgggcgacggcccatccaagaccacacggatcggtggtcttctggatggcaaatagggagacgcgctcgtctccttcctgcgggcaaacgctgacgtcttcgcatggagaccagcggacatgcccggggtccccagggaggtgattgagcaccgtctcgccgtgcggccgggcgcaaggccggtccggcagaaagtgcggcggcaggccccagaacgtcaagccttcatccgcgaggaggtggcgagacttctggaggccggattcatccgtgaagtcatccatccggagtggctggcgaacccggtggtcgttcccaaggcgaacggcaagcttcggatgtgcatcgactacaccgaccttaacaagattaagttgatctatacaaaagaggcatgaaggccttagaagaaagaaaaagaaaaaatcaaagattgacgggggctcgggggctcattccgacgcgcccgggtcgccggcctcgtcgccaccgtcgtcctcaccactggcatcgccctcctcgtcggagctaggggcgaacgcgagccgaggggccgagccctcgaaaccgttgacgatgtggtcggcggcatcccggacgcgcgcgcgcgcgtcgtcctcggtcccgggagggaactcctccagcgccatccatggagagaagttggggtcccgggcctggtagctcgccagcacgagttcgaccgctccctgcgcgaggtccctcgaggatgacttgatggtcttctcaagctcctcggggagttgttcgagaacccaggccatcctgttgaggtgcggagcgaggccttccagattggtggggggcaccgacgtctggcctctccagaggcccgcttgccgaccggcgcgcttcatgcgggagaccgcatcccaaagcatgtcgggcccaatctcgcccgccaagcgaagggcctcggcctccccggtggaggagtccagcgctcgctgcatttccgcgacggtgtgttcggcagctgcgaggcgggcggctaagtcgctttcgcccgcggccgccccgccgataggcgccctcgcgtccagctccttttcccgcgcctcgaggtcagcagcccgctgttccagtgcggctctctcggcgcggacgcattcaagattgcggcgcgcctgctcctcctgcgccgcctcgcgaagggacaggctgtccgccagccgtttggtcgtggcctcagcctcctcgagagcccgctcccgctcagcgagtgcgtcctcgcggaggcggagcgcgcactcctcctcggcgcaggcggcctcgtgcgccgccagcgtcgcctcccggagagcagcggcggcctcgcggtccatcaagcccctcaccacggtgccggcgtgttcttccagcgccatggcacgggactcaagggcctcctcgcgccgccgagacgtcgcttcagtctccgttacccgccgctctcgggcagcggcggagtcaaggaccccttgggcggcgtcgagctttttcttcagctccgcctcccagattgcgtgttgaaggcggagggtgtcttgcgcctcgatcatcgcggtggtggcgataagggcggcctctcgctcctcctccacctctcgggcgatctccgccagcgccgccttgcgggcttcaagctccgagatgtggcggcggtgagccttacggcccacctccaccatggcgtccaccgagcgccgcccctcctcaacgcgcgcccatgcggcctcgagctccgctcgttccgcacgcagggcctccacttgggcgttgaacccatccagcactgcggtgtttgcggcggccagggcctgcagaaggggctcggcgctcagcggggcgacagaagatgaggaaaagagccgccttggagaaaatgcgacgcggcttggccccccggaggatgcgctgggctcggggatgtcccccgggcccgtttggtcctgggcgtcgcccggtgaggtaggcccaggcgatgcgccagcggcctcgtcgcgagccgcctcggaggatgtcgcctgagggccgcccgagggagtgggcccaagtgacgcgccagcagcagctgtcgcctcagcctggcgagcccgggcggcctcctcccgggcagcttcttcggcttggcgagcccgggcggcctcccgggcggcctcttcagcttcccgaaggcgatctgcggcttcacgccggtcagcttctcgcctccgctcctctgcggccgccggatcttcggcctcggactggccggacttggggtggcgggaggaatgtgacggggcatcgctgaagcagaataaaaaaccagaagacaaacaagatgggtaagagaaaacttgcttaatgggatagaagaaagacggtcgcaataagaatggggcgaacctgcgagggggtcggttaaatgaccactttggaggggaaatcaggtttccccgggatggttccgtctcccccatcttgcggagccgcttcttcttgcgctccccctcgggctgcgacgtcggcgcggccccctccgggcgccgactgctggcacgcgccgccccgccccctcggggaggagatgtgggaggtgttcctcccagcttcctcttcccctgggcgtcggcagggcggctgctccccgagcccccgacgcggggcccagaagcacgaccccctcctggggcagattgttccccccggcggcgctcgcccgcgccgtcgtggcccttaggggctctctcctctgaggccccgacccccatcataatggttagaatggaggcgcggtcgggatcgctgtagagggggaggatctcctgaggaatgcgagacgcctccgcggagctaagattcagcaccctttgaaccacgatcttgaagtcctcgggagcccaatcccatctggctccctgatgggtccgcatgtagtcttcaggcccagtgtactcccaggcgctccgggcgcgccgttggagcggcgcaatccggcggcggaggtaatcgccgtacaccatggccccggtgagcccctgggatcgcaggcccgccaggcggtcgaggacggcgtcgtagtcctcccccagatctaccggcgcccgccagctggagacctgcgccgggggctggcttggaagtcggaggcgcgtttcgttggcgaggggggtgtagaaccagtcgctcttccagtcgtcccacttcttgcggaggacgcaggggatgtagcggttcaacaccggcccccgcggctggaagtagcagccgccgaccaccgacggcggtgacaccgactgcacggtgaagaaccaccggaacagctgaagagaggggcgcaccccaatgaacatctcgcacaggtgcgcgaagatggccaatgtcatcaccgcattgggggtgaggtgcgccatctggagatcgtagaactccaggacatccatgaagaaatgagaaaatggcgggaccagcccagccattgcgaaggggaggaagaagatggaccgccccgggtagtctggtgccgggcgcccctcgcccagcatcactatctcccgaccggtggcggactcaggcatgaagcggcgcggcagtccggcgtgcctctcgttcacgatgcgggaaggcggtagtacactgccgtcgagcagagcagagccccgtgccatggcggtggaggaagagatgattgagaacgagcgcgtgtggcgaaagtagggcgtagcagagaaagagttagagctcaggcggcgaaggcaagaggagcaatggcgaaaggaaggaagcaaatccttttctcgatgcttttatacccttgccatcgctgggcctggctcctcgtttctcgcgcccactacctcgctccttcgtatctcgctatctcgctccctcgtttcccgtccccacgcttccactaatcccattcgcccgcttacggcgcatgaagtggatatgcggttgaggcgatcgaaacggattgtatcgtgcgcgcgttaattacgctcgccgaccgaagcggcgttgccgtatctccgggcgagacgaatctgctcgcccagattcgcgcgctgctcaagtggtgtggcagtcttgaatagaccgcccattatggacaaccaaagttaccaataccaatgtgcatggattgagaccgttgggtattttgcccaactacggagaccggtcccacctgtcaccaggctttaggggtggtgtcggtgatatgggaccaggagtatcatgaccagaggcttgaggcagacgcaatcgcccacgtggcctggcaccttcggggacgtcgggcccgagggtgaggtgtccgccctcctcctgatttcccccgagggggggtcgggttacgcttgccccggccccgagggccgaggcaccccgaccccttaaagaagtctgcgccacatgtatgggataagtgagcacagctgtgctcacctaacagcatttattacagtctggtcaagcgtgtcacgctgcatgtaacgcagtacagcacgctcttttatccggtctgtgaccagtcacagaccggtcagatcaagggttaggtggagactgtcggtcttacgcgcgccttgccccatcccgtcaagtcgaaagcctgtaggcaaatcgtctcaagccgcagctagcgtgttatcttttagagatggcacgttagccctggttagatttacccccccccccccccctcaccacctccactgccccgacctccatggcttcagtccccagtggtctggtctctcgaccagattttggtagctgcatggtggcggtgacaagcgagatgaaagattgaagcaactcttcacggcaagatcagtggtggcttggtcagatgagggccagaaggtggaaatcggcacctttgccgatgacagggctgcaggaa

SEQ ID NO: 65161 - DNA, 6042 bp, Oryza sativa
cagtacccgtctcatttgctctctcctatcatggacaagctgcggggatcggagctgctcaccacccatgacgtccgggccatcatggacctacttcttgcacgccagtgcctgcctgccaacatggacttcttgtgctgcccaaatggcgatgcttgtgctcatcgagccaccaaccatggcaccctgcaggttgccacctgcattgggggaggtgcttttgctcgaatctcgaccgaaatcgtaaccccagatcacatccgacctcagcaactccaatacatctccaacctgacatttgatgatagctcagccatggagatgaagctttccaagtgcagtagtggtggttgtcaactggactatgatttttcctcgccatgcgagtacatactgtccctgaaaatgtgcctccttgatgccatccatggcttctacatccgggcactcgccgtgctgcccacgggtgacgactccatgcgccttggccgccttctccgtgccctccttgtgtccggacactgctatggccccttggatcctgtgtcaaacataatcctgaatgctgtcttgtatgatgccgcataccctccgcaaccacacgaaggtgatggcaaggctgagttaccacatgatatctttgacacccgcgccatgcgggacatggcgtcctgttccctcgatggcctcgttgccctcctctgcaccatcaccaccaccaccactggcaccccgctctcaaagcatgaggctgtggagtacctttggtcctggcagtgtgacctcaccgagaagctgcagcagaccgtgatggcaaagaacccctacgccgctgcagccatggcttccaagcacccacagcacaccatgctcggcgcgctgctcgtgtccttctccagcgagaagctcgaccgcctgcgctactttctgagatccattagtgatggctctgggtgtgttatctccggtgatgattgggagcagctaaacaaaatgatcaaaacacagctaaccacaattatcacgacaagagaagtgctaccattcaatccacaagccttgtcagcatcattgagagtgtcagcctatgtgaactcgcatagttttgctcgcagcaagctggaagagttgctactgagatattctaggcaacatccctgggtaaattcagagtagaaacttattttgattgattgttggacctgcttctcttcaagtgtgctaaaattccatccaccctcttgtgtttgttattgcaggaaccaaggtataagcttgatctcatctgcggagtagaggaacccagatcagcccgatgtggatgctaccatgctaacttcttggcaagcgcccatggcagtgtgctcaagttcaatggtgagacaaccgtagcacaaaccactgtgcgcagactcttcttcgctgaattctgggactcacaacctggtcgattttatgaatcacatgcaaaacccatgtgctgccctgttcaagatagtagcccttgttttggtgagtcactgaacccttgttgtgatgttcctactcattttatttccgtcaagtagtagacacactgtggcatgtgattgcaattttcatgcatgttaatgccctggattggtgtaatatatttattgttttgccttatgtcttggctttgttgtgaacaggtcgttgtatcttctgtggtgaagcaagcacgattgtgcatccaccatgtgcagctagaagtcatcttgatgatgatgattatgcccccatccttgactatgatgtccaggccgccattcgtatgtatgtttctgtttcacctatttgtatctatggttctgttatccaagcttagcaaaaacggggcctgttaagagtccaacatcacttattgatcatgaaaggggatcaaaacagaaacaagggcttgtttttgtttcacccattcgtatctaccgttcttgtcaaacttaaaaaaaatttgttttggacaaagagtttaaagaaaaaatcacaatcaactaagaatccagattggaagtcacaatctgtaaataggactgtagatacaatgagtgtgttctcagggatgtggggattattaatgaaacaccaatgaacatgggagattgtttgaggaaaagaggtgtgataaataccgggttatggctttgtggctgacgaggaatgatttagtattttgataatgtgttggtgtcatctccattgcaggtggtttccaaaagccaaatcaggtaagaggaagaactaaggaaaaggctaaaggaagctggtagtgtggatgatatacctgatgctatatagttatataggggtcgacctatgttttgtttcagaagtttggttagatggagtccgcttagatggttttgaaacttatgaactcttttgaggtgtaatcaggggatgttgctaacttgggggaagctggcttatgagtctcttaggctttctcaacttgttgtcaattatgttggaattcaggtggatgatatacctgatgctatatagttatatagggtcgacctgtattttgtttcagaagttcggttagatgaagtcttcttagatggttttgaacttatgaactcttttaaggtctaatcaggggacgttgctaacttttggggaagctcaatgcttatgagtctctcaggctttctcaacttgtcaattatgttggaattcaggtggttttccttctgattataactgaatgaaagtcacaaaggatgtttaatgtttgttaagattttactatctctttggtttgttggttcggatccagatcctccgacattacggagtaatgtcacagtgtgacattccttccatccggcacgttcattctaaagcaacggctgtggattatttagtctataataaataaaattaatcagcagattatttcttaaatagccctgcaattgctagtggtgagagcgggagataatttctgtttactcctctgttggtgccaaaataatccctccatcttcgttaccattaacccactgacaaaagtgtcgtacttataagaaaacagattgattatagactgaggattgcatcgtctcctcatagttctgatgatggaggatggtaccgtacaaatgagaatgatgcacatcattcttcacttcctcaacggcccgatattgtgccaattgcagcatctaactaacaggtaagtaaaacctaaatatcgtattgtgctaagttgtccgcttattctcttatgatttattagtgattgttgcctcctgtaaaaatgcaccatctagtctttcatatgtcaatctctttctctctaactctaccctcttcacttttgttctagtaatatgcccatactaacgctacagcgatagttagtactgcgaattgaacaatcaaatgcttaaagatttgtaatacattaatcatctaaaaataatttcatattcctgtaaattctcgtacatgtagtaacatgatacaatttaccaaatctaggctaaacttttcaaacaaaatagttattaatcagcacttaatgctacattaccattaacatgatcatacatttattttacaatcatcgttctgtacaaacatgtatttcatcacgggacaaaatatcttaatgggaaaattgcaccagcgctactggtgaactttcatccgtagttcctaatattttcattgaactatcatccatgacagagcgctgatgccctttcaacaatgggacactgcaagcaagaaaagcatgaagatagtacaattggtcatagcacaaatagagcaggatgacgaaaaatatttatttgctccgaaccagagtggtgaaagaaaagatctaagtcatctattcggatccaacttatatgttgccgaatagtaaatgcaagtcatctaaaaatgataaatggtacaatataaattttgcactctcttggaacaaatttaatctgtatgaacaaaaataagtgcacaaggcattttaacttttagcaagctgacatgaaaatctcaagaatgttagcttaacaatttccgtataacaatgagcttaagcttcagcttaaacctaaccttctctctacagactgagagaaccaagagagaaaagggacaatttaaaattttgtgtgtttcataagtatactaacaagcaaaaaagcaaccttcgattaagtacacagttttgtaactacttcaagacacaattctgatgacatcccaccattttaatttcttaaaccatgtgctacaggcatatttaggacaataattgcaaacataaatgcagagcatgatacatagaggataaacaattcatgaaaaaatattagttggtgcctacttcaaattagagttctgaatttggaattaaacctactcgaaagtcagctattcaggcattctgcaatcatgcggaacagccatatcatgcatgcatttctgaaacacaaaacaggctttctcttgcaatatgcaagatctcaaagacaaaatgagatcagaggatttgtttttcgctttttctttttagacaaaatgatttatacagaagttgggaacagttgcaaaggggaaaaatatcaaaaaaaaaaaaaatctatacctcatctgacaaatgcagtgaactgaggatgcaaagacgtccacattggaagtaacataaaaaagaaacatacacaaggaatgcagtaacacgttgaatacacaggtgtttattcgtacctagtgcagatcaatgttacgtgacaagtgtttgatgtcagtcagggacactgttgaggcttgcaaacaagtcatcgcttatattggaatttagaaaatctagatcagattcaaattcatttgccaattagtatcttcttcctacaaaatgaagcccagaaactatggcatactgtatatagctattgtatgtaatcttcaaaataaatatagacggttccaatgctagtggtttttagagcatgattaaaaataaatatagacggttccacatggcgaaggcaaaccgcagcgtggagcacggcacgatgaggtcgtcgtcgacggagaagatggcgtcggaagggccagatccagcggcagcggcggcggatcccaggcacacgccgcgccgccgcgaggccttcccggcacgctgtgccgcctcctcgcaccggagacgggccgccgctggggtttttggccccgccaccgccatcccagcgtccacgcggttttcggcggcggcgaggcggtgagaggaggggagggtggcagcggccgggggctagggttcgcccccggtcgcccgcgcgtggatgacttctttggtgttccctcatacaagaatgtgtcggtcgtcttctttgcctgcaggctgcaggtgtcggcgtcggcctccttgttcttcatcttcctcctcgggctcctttgcgtcagcagtaggggtctcgacgcgaggagaggagatcgtggcgatattggggtgggggtgaggtaggcgcggatgcggtgcgggagaggcgggggatcctgagtggcaggggcggtggcgcgggggttagggttgggaatcgcgagggaatcggcgggggccggaacctgaaagagggggagggcgtaggcgcaatgggggcgtggtggagagcgatgggggtgcggggaggagaggagggggagatgtggagtaatctgaggcgttggattggatgattttggaccattggatgtgtaacatgatgaatgatgaatgagtaaaaggatttgttgaactatagggtagatagatagaagaagaaaactatacctagctaggtaccccagatgcgcatgacatttagcactgtagatgaggctcaaaactattggaattactatggaggtcaaattggctttgacattagaaaacgattatgtcatgtggggacaccactaccaccacaggagcaagccggaggcgcaaatgcagcaagcagcatgagtcaagggtgcaaattagaaagaatcatgcaaggaaagtattaattaggagaaaataaa

SEQ ID NO: 65162 - DNA, 8878 bp, Oryza sativa
tgtcgacaaccacaatgcacacatgtaatgtgcatgtaatgaaaaagtgaagagtaaattttacaaaactatagatattctagttaaattattataaaaccacagatttaaagcgatgtatcacaaaactccatatttaactaaatttatcacaaaactacaaagatttatggtgaagtgttatatttgagttataaaagtctaagttttgtgattgacttgacaaaaaaaactgtagttttatgataattttgatgctaaatctgtagttttacagtactccaccttaaatctgtagttatctgaaaaaattagtgttaaaatgtagtttttggtacatcaccttagatttatagttttgtgataatttgaccataatatctgtagttttgtgaaatttacttaaaagtaaacttacagatggtatactaaagtatgtgatgttttctgtcttaagagatatcttttgtctaggggtctcatcggatggcttatttggttgaggcttgggccaaggcttttcagccaaacaagtgggacccacaagtggtggataattatgtgaactctccagtgaccatacacaaaaaataaaaatccaaataccaccagccacagaaaaatccttcaacagccatataagcaaaataagccaaacaatggctgaattgaacttggcagatttggctgatcagccaaagcttcatgccatccgataaggccctaggttatacacttctttgtaaaatatagcaactaataatctaagatcagattggacactctgtaatactatgaatctgggtaggctctatccaaatcactactccagtatagtatgtgtctaatctagttatagcttggtatatttcgaaacggatgtaatattctagtaagttgtgcatgtggttggccaacagataaacatattttttttttggatttgtaaggaaatacaaaaaatagcactattatggtatgtactttctccggtttcatcggtttcataattcttagtgttttggataagattgaggtcatacttttatacctttaactatcaatattttaaaagtatttagtttaaagacactagatttatttacaaattactataataatagtaaaaaagacatttatttattgtatgtattgtaatagaaaagatatagtcaaacatatcattgttcaaaacataaaaaattatgaaaccggacggagtacaataccaatataagtttgctgatgtggaagaaatagggaaaagagagataaatatgataattacttatgataatggtttaacatcgacttagaatttataaagaaaactttttctgcatatgaatggagacaaggaaagcgagctaacaaaaaaattgatttgttgtattacctgtgagtcttttatcatctcagttgttataggagagatcatatcatgatctacctttgaacatctccttatattttcagtcatcctgtgatccaatcctagcatgatcatgaaaatatcccatctctatgtgtttttgctcctattttattggaatggacaatactatcgaagccaaaaaggttatgcttatatgttgagctttgaattgctctaatttgtaagtgatatagtatagttatatttaagttttaatatgtactactcctatattactacggagaagattctgcctccggtgaggacacgtgtcgacgcgcgaacataccctttctcatccctctacttctacccaataccttaatttaattttttctcgaataaaccttatcttctcactaagctttacatgtttagtgagttgtcacagatctagcgttctttatttaccgtcttctaaagtgttttgatttaaaacaatttaatcgagttacttcctccgttccaaaatacgagagattacttcctccgttccaaaatacgagagattttttatcggatgtggcatatatattttgtaatgaaaatccctagtattttgaaacggagataatatttcataatgggctgcctgggcctcagggctccctgagcacgcggccttgttactcgatcttcctccacgtcgacacaataccacacccatccccctgcccttcgccgtctcccacctccacctcacctgcgagcagcggtgcctcctctcctcctctgctgcctccgccgcgcgcatcctcctcccatccatctcttctcggcctcggcgcccgtttcctcgctacttcgccgcctgcgccgatctccattaatccatccatcccgcgagggggagcagcggggtaggggtgccgtcgtcctgccgcttccgcctccggtgagcgcccgtgccgacgcgcgcgcgcaaaccctttctcatccctcccccttgtacccaatacctttatttttttttctctcgaatttgccttagccttatcttgtcatgtactccagaatatattaggagtagatctatctggaagctaggttttctctctgtcttaataaccctttataggactgacaagtaataacagtttttgctaccccgtctaaaagaaatatgttaggttgcttaatttcctaagcatgggttgcagtggatatcttaatcaactcacaaatgataaaatgatgtgtaattagtagtagtaatttgttaagagggattttgaggtcttgacatgtcatagattgattcattcggaggtggccactacagttacagtggctcagcatcagaagatactgatatgcgcgccttttgtggtgtttagagctacctctctttgatggcatggcatcttgagaagttgtcccttgattgcccgccttctgtctgggctcgatgaccacatgattgttgcttaaagttcaccttttgtgtgtgcttgtgttacatttgataggataaagttaccctttggtaccacatatggtaactatgagtgccgacatttgcgtttagtgtttagaatgtgacgtcatttacaattaaaccttttcaaagttttgggaaaaattaatattttttatggctattatccatttccattacgataaaagattacgaaaagtaaaataagtacattgaccaacatataatttgaacataacttcctctgaaggataacttagatttcagctacaacttaggaaactatttactcacctaagagctaggtagctaaacatgccatacgctcagacctgctacttctagaacctttagatccccaaacagggccttaagccattataaggatttgcaacaggtttcagtcaaaactagtgctaaatgtttggggccatttgccaggtgaggaaggagggtgggaatggaactaggaagtgaatggaaccacaaggaactattctctcatattgtcattctccaccctaaactgtgctggcggtgagcactgggaattggaaatcattaaactccacattgattgatttatttcttaaacggaccatgcttgttccgatgccattgaattgattttgattgttatgtagtcatgtggtactggtataccattattcttttcccttatattttccacaacaacacccccatgctccgcacaagtcagccatggatgttaaccatcaatttgtaaatactgccttcacacttctagcatctagagtcacttctgccaaaattatgcagtgccatggttcacagggacaatacttgagcagatttttttttaaaaaaattctggtctgatttggagagttatgggattggaatgggattcctctagtttccccagtgcccttatccctattggttaccggtggtgcatttctcttttttttggggttaaaatggaagtactgattgcatgctggttctttggattgttaattattttctgaatgagcaagttgcggactgcttttataggaactcatataatgttttggtagataggtcttccagtgttgaattatatcttgtggcataccttgtgccaaccaatggtattatttttcggtctgtcagaaggtattgctgacatttcttaggcaaatcagttggagagtctccctctgtgttataatgccttgttagcattattttattttatttcatatccatccttgcggtgctgtttaattaatacatattgttttttcataccgttagtgatgaacctaatcatttacttttgtcgcttccaggactagggatcatgtcaggaagagatcgtctgccacgtcgctttatagaggatggcaggggctaccctgacatccgtgtagttgatgaacgtaggggctatcctgacatccgtgtagttgaggatcgtaggggctaccatggtattcgtgccattgaggatcataggggctatcctgacatccatgaaggccttgtcatgagggttgcacctcgctctcacacggctatgccggaggaagaaattgagattcagggggccgaattcaggaggcttatggcagatcaccgtgctcttgctgaagaacgtttggccttacaccgggaattacaagctggaaaagatgaggtccgtcacttgaacacgatcattgcagacatcagtgccaagaaggaaacttatatcggtgagcttgttgacaaaaggaggaaacttgaagctgaacttagagcaaatgagtctttaagagatgagattgtgcagcttcggggtgaaattgataagcaccttgtagtcaggaaagagctctctgcgaagtctgcatctatcatgcatgaactaaccagggaacaatctaataaacagcagattcctatgttgaaagcagagattgatgcccttcgacaggaacttgttcatgcaaggtgtgcctcttttgctagctctgattctcagatacctttgtaagttattcagaggctttaagttttaagattgatttgactttttgcaggtctgcatgtgaattagagcagaaaggaaattttcagttggttgaacagaagaaagcaatggagaagaatatgatttcgatggcacaagaaattgaacaaatgcgagcagaattagctaattccgaagggagaccatgggccccaggtatgcttgggtattttacagcatttgtttgttgacctctcatttctcttccatgcgtgcttcatttatttgacagtaatcgtaaatgctatccctctgttaagagaaaccaatcagagttttagataaaaaattgcagtaggcttgtgtgtatggctaaaatcatgatgcattcactttacattttaacctcgaaggactgcatgaacttctgcatattgttgcatttctattgactatgcatctgccatctccagtaggatgttagatattgacttgtttttgctgtttcatggggacagcacttgtgattatattgtctgaattttgtctgtatgggaaatacttgcattgtccccaactccacattgagccttaggtgcctttacttttgacctgtagatttcttgcttgaaggtaattatcaggtgcgctcaagtcatcatgaagtggattttggcatttgggtaattgcacaattaggggccatatatttccaatatagtgaaggaaccaatactatattatgttttgtcccatctttgctgcaacctatggagtctgattcattttgtctaagcatagcatataatcatgtctctacatcttttttccccacttcttttatcctcatctgtttaaagggtcatcaaaatcctccaagatttacctagttccattgcttcccaccaaaaatcctgaaaagaagattgtgcatatcagtgatgaaaatttagtgatcttgatttcttgctggagaagtcataccaattcttgtttattgagatcaattatcaatagggcagtgaacagctgcgttcgttgtaagccacatctactgagatgtgggctgtctctgtctagtgaaagccgcaagctgttatagtgtcatatatactttttttttctgtgtgtggccggtaagtgaggtccagcaaattgttaacactaacattggcagtttggcccatatttattcatcaactgggttatgaaggagagttgacttagctttagctgttccatatatttctatttattgcaggacgcctggacctagtgctaagctatttaaaacatttagcaatgtacatatggtacatcaaaatatattaagcttgctttttttttttgaaaagttatgagcaagctttttttcccttgaaaagtcataagtaagcttatttttttctgaaagaaggaaacagtctggtgtcaactaaatcataagtttgagattaataattgaccatttattttccagtatcctaacatttaatttttggcctcctatatgcccgcacgtttagcatagtttaacagtccaatggggcaaattcaggactattccttatcaatgatgagttcttcaatcacgcagacttgtagtaacaatgttctgaaaagcactaagtgaatggcacctgctcactgatcagtcagactgggcatcctcctaggcatgctatacagcaataggcacaaggcaggatacctaggaggtctagacagctgccttagcctggagggtggttttctcctaagtagattcactggaacagtttatattgctttagcattgacacattacatttctatggaacaatgtagaacttttttcatggttgtttacctgatgtttaaggtgcgacatatgggatgaagctgggcagccctgaagtgaccttccctacttcatatggagataactacaatatccatgtggtacgataataagaaatatagcagatatgatacttcctttgttaggctgaaatgactcctacttacttttttctaaaattactattttgttaccagggaggttccgagaaaggtcattcacatcttcctgaatcaagctcatggggtacatatgacaacaatcgccttcagtaccgttaagatcgcagctgctatgaaaaaagtccgtgaagacttctgggtcccatggtcatatcacatggtttagattatcgtatctacctccttttttgtggtacaatcaatagttatctttcttaattaaaattgaaatgcctctaatcattttcttctctgtgtgtcatataaaatatgttccaatggtaactactgcttatactttggctcgatacctatatccaagtttccttggttatatggatccatgacacagttattttaatatgacttgggtatatatatgatatagtttagttaatgactcagtcatgccacatatggagcatgaagtctgaattctatgtggagatataattaagcatatcagagaaatgttccttccatcatgtattacatgtcattctgaaaaaaaaccagtgagctttttatgaaatgaatacacattgttgcttgtgtttactagtatgggtctataccctagattttactcttgacaataactaatttattgtttctctcacttttagttttgcaatggtatctatgttaagggcgttagtctctttatgctagattatttcaagcgtttattacttgttactagatttcatcaaacatggtcacatgggcagcaagctgttttttgtcgagctctcttgccaaattcccaaacggcattttcttcagataccatacttttcttatctaggttgacgtaggtcaatgcttttaccaatagtgaattgcgataagatgatggctagattaatgtcaaccgctgcatatttcaaagtataatgtatcagtgaaccaaagactgttatcagcagaaggggatgcaaaatagaagtgatgtttgttgtgttagaagttatttgcctcagtcaatctttaaggccatcatacctcgaagaagtctatatttaggatcatggttgccttccctttttggggggttttggctcaacttatatgatgtagtttacctacctaagttgttcatctgaatttgtttgcctttggacacatgaatgatgagtatttcacatttcctatccttgtgaactgttcatgtggaagtggaacttgttcttacataccttttgtgagcttgattagaaagtgcttctcacttatggggtttaaattttaattattaagtctgatattattctgaccgctcctaaaatattttgggactgcgtgtcctgagaccatagtttcaatctcatgtcgtattatagagagtgagcttagtcacagacttggcaggtactaggttttcaccattgtacatctcaatagatctagtggtcagtcaggaacatatttggccattttagaagtctacaggtaatattaacctgtatagctttacatatgcatgagcatatcaccttgtgctccctgaggtcagattaccacggtggctgcaactctgatccacgtgccactttgctacctgaggtcagattaccagagtggccacttcgctacttgtcaagttggccttgtcctgtactggattgtctactgggacatccaacttcaacatgtattagcagttctgctttctggaagtggagttttgataccagcagtttgtgtactaccaaaacctgaggttaatatttgagttgctgctactagcctttttcggggttcatggtggaacgttctaggtgatgttaagctgtacatagtgaagcatcactgttgctaaatttgccctttaccttgtactcttggaatgatgacgggcaaaataaattcttgcaaagtgtaggtggaactatgcatgactatcatcaaccaggtgttagagatgcataaagtggttccttctgagttacatgcctaaattgcaactagatgaacctgcctcctgttctaaatgtgatat

SEQ ID NO: 65163 - DNA, 12204 bp, Oryza sativa
aggaaagtattaattaggagaaaataaatgtcatttccttgtattagagaccaagtgcctataaggcatgtaatcagcaacatttgcaagcaagcaatatgaaaccaaatttcctaatctccctccttccctaatcctcctctttccaccattgagcgtgcatggaagaaccctgccgccgcacctgatcctggctacgaactccgtagctgtggtccggctatcctcaacggtaacgcgcttgacaacgcttccaggcgttcctcttcccactccaacacgccctcaccaccagccgacgcaccaccatcgccaacgccctacatttcttcggccatgtccgagcccaccgccgccgagcttgccgcgctcatcaaggcgctctcggcaaccgtcgacaagctccaggcgtccgtcaccacactccagcaggcatcctcttccaccaccaagtccatcggcgagcaccacaacaaccggccaccgcgattccaaaaaatggattttcccaaatacgacggcaagtctgatcctctcgccttcatcaaccgttgtgaatcttactttcaccagcagcagatcgcggaggaggagaaggtttggatggcctcatacaatttagaagacggcgcacagctatagtacatccaagttcagcaaaacgagggcaccccgccatggcatcacttcaccgagctgcttcatctccgtttcggccctccactgcgttccaacccccccgacgagctcatggcctacaagcgcaccggctccgtcgtcgactaccaagacaggtttgaggtgctccttccgtgcacgggcaagctgacgaaggaacaacgcgtccaaatcttcacggtcagactgcaaccgccactcagcctcgacgtggagatccacagcccgtagtcactcgccttcaccatgagtctcggccgcaagctcgagttgcgcgaccagtgcgccgctaccgccgcgccccagcaccacaaccggtgtggcctcctgcccgcgccgccacagcggctggctcttccggcgccggcgccgccgactgcaccggcccaagcgacagtgaccgtcgagggccgcacggtcaactgcctctcccaggcagagatggaagaacgatgccgcctcgggctgtgcttcaattgcaatgacaagttctcacgcaagcataaccacgtatgctagcaccttttcctcctcaacttggccacgccagatgacaacaacgacgacgacagcacacccgaggagacaggaggaactaacacacacgtctcgctccacgcgatcgccggcgtccgcttcaacgacaccatgcaagtgcacatcaacatgggcggcaccaacctcctcgcattgctcgactcgggtttcacacacaacttcgtctccacggctgctgcgagtctcaccaagctcaagctccttcctaacggcaagatgcaggtcatggtcgccaatggagaatacgtatcgtgcccgggcctctaccgcaacacagctttcaccaccgacactgagacgttccagataatgttgagattcaagaggatttgacttatgtgaagaagcctacgtgtattttggagaccaatgagagaactagaaataaggtgatcaagttttacagagtttagtagagccatcattcggaggatgaagcaacttgggagagagaagatgagttgaaagccgcccatccccatctcttcgccagttcgttcgaatctcggggacgagattccgtttaaggggggtaagtttgtcacacccggagttttccctttccttagatttcaattcactaataaatggtctatagaaatcactttggttaaccaggagaaaactctaattaacaatatatttaataaccggaattgtcagggagaatttttttcgaattgtcgtcgtgcggctggcgaggtgcggagctagaggaacccggcgcaggagagatgcgctggagggcaaggttaagcgcacgaacctgctccgaatatttgaacgcagacgcctggacttgagtcacgtggtccggcaatgcatcaagctttgttgcgagcggcaccaatggctccagcgcactcatcttgcgagcgagatcagaaatttgggcagccatggaggtgaggttttttgctatctcatctaactggttttgtgtgaaggccatggaatcagagccagaggaatctgataccaagatgtcatgagctagagtggatgaaggaatatgtcgaaggttatacttgaaggaagtggagggacgtggccctggacctcgtcggcacagcggtgccgtgatcggcgacgcaccagcgaggcagggcaagaactgatataatcacaaattgcttgattgattattactctgcatctgccgcaatactctaacaaacctcggaagataaaataacaaatcctaacaaacttaatctaaccgaatacctattcgtattgcaccgttactcgtcacgcgtgttgtcgccgatcaagattcctgccgtgacgccgggcatactgcagtgcccacatgacatctctcccccctagagaagcagctcgtccttgagctgaaaactgggataaagagcgcagaactcatcgaagggcatccacgaagcttcagccgctggacgtcctttccattgcaccaacagttcacgaacatcccgagcaagacgactctgaagaactttgtccagctccaaacatgcacggccatgcacgacgtgaggcaatggcggaatgtgatcaggaacagtcctccgaaacagtttgagcaagcccacatgaaacacatcatgcaacttagtagaaggaggaagacgcagccgataggccacagcacagatgcgctccagaacttcatacggcccataaaatttcggttcaagtttgccacgccccttgacattgagagaagcgaccggctgatgaagtaatctgagccacacccaatccccgactgcgtactccacctcacgatgcctatgatcgtaaacggacttgtattgctgctgagattgctccaacctttcacggatagctgccaggaattcatcacgctcttgcaaggactgctgaactgccggcaatcgagctgaacccggttcataagagcgaagaacagggggtgtgtggccatataccactcggaatggagaagttcgaagtgaagcatgatatgaagtgttgtaacagaactccgcccacggtagccaacgcaaccactgccgaggacgatccccggaaagacatctgatatacatggcaataatcttgttggtgacttctgattgtccgtctgattgtgacgaaaagcagatgtgaaattcagttgaacacctgagagatgaaagagttccccaaaaaaattgctggtgaagatggggtctcgatcgctcacaatggacgtcggaatcctgtgcaaacgcacgatctcagcaaagaaggatgctaccaccgtagttgcgtgtaaggacgtgccaacagaataaaatgggcgaacttagaaaatctgtccacaactatgagaatgactgtcttgccgtgcactcggggcaatccttcgatgaaatccatagcaatgtcagcccacacagccgacagaaccggaagagactggagcagacccgccggctgtagctgctccgttttgttgcgttggcaaactaggcaggcacgcacaaactcctggacggtggtgtggtcacgagcaatgtggaagtcggcgcgcaggcgagccaacatcttctgggtgccctcatggccgatgtcgtgggcaagctccaaaatcactggaagcagtggcgacgaggatgacacaaagacacgtcccgcaaaggtgatgaggccttccgtcagtgaccattgtggcggcttgaggcccttgcggatgtcctcggtgaggctgatcagtgccggcgtcgtggccacctcacggcgaaggtcgtcgaatagcccgaaagtcggcgaagaaagcaggaacgcttctgtggtgtgctcgtcgcaacgtgacagtgcgtctgccacgacatttgttgaccccggcttgtactccaccgcgaagtcgaagccgagaagcttgctagcccactgatgttgcggcactattgataggcgctgatcaaggaagaaacggaggctgtagtgatctgtacggacgatgaatcatctgccccagagatagggtcttcaatgcctgaccgcctgtactaagctaatgagctcgcgttcgtatgcagcgagcttcgcatggcggcgcacgatgggtttgctgaagaacgctaccggcccgccaccttgatgaagcaccgcgccaaactcagatcttgatgcgtcacattcgacgatgaaattggtggtgaagtccggcaactggagcaccggtgcggccgtcagggcgtgttgcagctcgctgaatgccgtcgccaccgcctcattccagtgaaagccctccttgcggagcagggccatcaagggcgccgcgatggtgccgaagttgcggatgaaacggcggtagtagcccgccaagccgaggaagctgaggacggcctagatcttgtgctggtccatggcgacaccatcgctagagatcaggtggcccaggtaggatacggcggtcagcccgaactcacatttggagcgcttcaaatggaggtgatcatcctgcaacgtctggaagacagtgcgcacgtgccgcaggtgttccgcccatgtcgagctgtagataagtatatcgtcaaagaaaacgagcatgaaccggtggaggaagggtaggagcatgttgttcattagtgcttgaaacgtcgccggggcgttggtgaggccgaacagcatgacgaggaactcgaacagcccttggtgagtgcagaacgccgtcttgtggacgtcatctggatgcatgcgtacttagtgatagccggagcgcatgtcgagcttggtgaagaacctggcgccgcgcagctcgttgaacaactcctccgccaccgggataggaaatttatccttgattgtcttgtcgttgagagcccggtagtcaacgcagaatcgccacgagccatccttctttttgatcaacaatgccggagatgagaacaccgacgaacttggccggatgacgccttagcgaagcatctcatcacactgtcgctcaagctcatccttttggatgtgggcatagcggtagggccggacggctacggcggacacccaagtggcgctccggtggtagaccgtgcgggtcgttgaagagaatgcggaagtcgtcgagcacctcagccatcagttcgtctggcgcaccgtcgagagcgatgacatgtgttaagggtgacggagcgtcaacgctaacccatgtcactttgttgtcacctgtgccgaacgaaaacgattggtcagcaaagtcccacagcgtcggaccgagcgtgccgagccaatgtgcgcccaggacgatgtcataccctcccaacagaagggagtagaaatcaacgtcgaaagcggacgtgccgatgacgacgtgctatgccgggcagcgtcccagcgaggcgacgcggtcgccattcgcgacggtgacacggaggccggggcacggctagaggatgatattcgcacgtgtgctaccgtctcgctgaggaagttgtgcatggagccggagtcgaggagagcgaggtagtccaccgtcccgacgcatgcacacaccttgatggtgttgaacatgagtgcgcggataccggccagggcgtgtaaggagatgagcagcttgccagcgtcagccaagattgtgttggccgccggtggcgggtcgtcctcgccctccgtgtcgtcggggaagctgatgacctcgatgatgaaggatttctcgcagtgttgcccggaaacgtacttttcatgacagttgtagcagaggccctcggtgcgtcgttgtgccatctctaccggtgacaggtgcttgcgtggaagtgctgccaccaggggctgcttgccggatgcggtcgtcgacgcagcgtcagttgatggcgttgaagacgccgtggatggtgcaggcagcaccatgcgcagtgcgcggacagctcgctcgggaatagggtcggtggcgcccaagtggaggcgttgttcgtatgcctgggcgagcatgatcgcgtcgtcgagagtggatggtcggcgaagcgcgacgtccgtcttgagggggttgacgaggctcgccatgaagagttgaatctgctggggctcggagagctcgacgtcgcggcacaccagggcgaggaaactgttgacctagtcctcgaccgtgccggtgcgccgcagcgccgttagttcgccaagtagactgtccgtcatgggcggtccaaaccgcgtatgcaccaaccggacaaaacgccgccacgacggctcgctggaatcgagctcgagcctgtaataccataagtgagcgtctcctattagatgcaaagacgcgtaccaaaccttgcgggagtccggagttttctggccgcggaagaaggtctcgcagtgatttagccatggtagcagatcgcccttgccatcgtacgtgggaaactcgagcttggtgcgaggcaggaagttgttgtcgaccgccatgtcgtcgccgtggcgttcgcgtcacgcgtcggtgtcgtcgaatggcttgtcgtcgtgcggctggcgaggcgcggagctagaggaacccggtgctggacggcgaggtgaagcgcacggacctgctccgaatattcaaatgcagacgcctggacttgagtcacctggtccggcaatgcatcaagctttgctgcgagcggcaccaatggctccagcgcactcatcttgcgagcgagatcagaaatttgggcagccatggaggtgaggttttttgctatctcatctaactggttttgtgtggaggccatggaatcggaaccagaggaatatgataccaagatgtcacgagctagattggatgaaggaatatgtcgaaggttatacttgaaggaagtggagggacgtggccttgcacctcgtcggcgcggcggtgccgtgatcggcgacgcaccagcgaggcagggcaagaactgatatgatcacaaattgcttgattgattattactctgcatctgccgcaatacttatagtggggatgtcttacaaatcagaaacaaactctaacaaaccttggaagataaaatgacaaatcctaacaaactgataaaatgacaaatcctaacaaacttaatctaaccgaattcctattcgtattgcactgttactcgtcacgcgtgttgtcgccgatcaggattcctgtcacgacgccgggcatactgcaatccccacatcacattcttatttcccacataatcactaaaccctagccacctccaccaagccaccgtcccctgccgcctatcgtttgccgtaccgaggctctaccgtgaatcgcgtctagcctaccgttttagtcatagccatccgtctttccgttaactgttcgttcgaacgaagtgtcgtcccgtgctttgttcgttcggttgttttgaatcattccctagttgaaaccgttcagagccgccggttccgttcgccggtttcagttgatcatttggatggtcccgtgtcacgtagaattgactcgttgagtctcatgaggcttgcttaccaatgttatatttccgttgatcctattcctttttggcattaatatatgataaatgaataaggtttttcggttaatagtaataacacatttcatcttgtaaaattcatatataattcattcgagctccgttttaatccattcaaattgccgtaaattcgttaaaatgtctagaatccattaaaattggtttcttttgctgtttcagtagctttatagcttgtatttattgtgtgccttgtttgtcgtttagaatccagcagttccaatgctccagtttattttgaagtggttgccaaggttctgtcagctcaagagcaaggaaagtcatacgaatatcattgatcatattgtacccatttgcaaagtccctgcttttctcttaaaattgcattattttcataatgtcatgtgggatggaatttacccgtactcagccttttgaataccttaattgaattaatagcctgggatattaatttgactagatgattggtttagaaatgcttagccatgcttagatcaattagctcacaatgggattcattataatttagtccttaattattattattattatgatattataccaccatggtatataattaattaactaaaacatgttatattggtgggtcgtgggtgcatggttttgcaagtggcacccatgacaattaaggaccggttctcgggaatccctagaagataaactcgtactatccacaagcctgatgggctccgggtttgatctaagtataatcttttctagctaacacaccgttggcaagggtgggcatgatggagtatggatggaactgtatattggtctatgctgctttcggatttacctaggcacgagcggggactgcccatcgcctatatagggatggggtgaaaccggaggtggatgtgttggttagaggaggatatatggagggttatgtcacgatttccccctttgcagtatcgtagcggtacttcggggaatggtaacatgtgtggaatcatgtcttgtgggtaaagttgtacacctcttatcagagtaaaactattcgaatagccgtgcccgcggttattgggcagtcaaccagctcaccgtgattagtctcaccttaataatttgacttattgaactggtgtagttcaggtggtttggttgggcctgtttcaatctggacttagcgttgtatagtgatgatggttaatactgctgcttaattatatctattgttttactgctttcaacttctgatttataaatgttgctttcattcaaaatatcctatagcctattccttcgtgatatcattgcatcataccttccccttggtatgacttgttgagtacggtggttgtactcagtcttgctttatttttcccaatcccccagaagcagagaatatatcagatggtgagttctatgaggattaagcttgtgccagatgtcgaggttttgcctgtggatttggaggaagctacgcttttgtcgtgaagattaagtttagatagtctttagtttttccaatgcgtttgtgagtttattttatatttttgtaagtcgtggaactgtatcaaattgtcgttcgtgtactctggttgatgcctggacagaggttaaatgtgcagatagccggtgattcgggatgtcgaatctctgggcgtgacacctccccacccagcggtgcctctacccctcccctcccctctcaggaccggggcaccgctcctcctcctccccctccccctccccctcccctccccttttgacggtgcctctcagtgcggcggcttcccgcgggtagatccggcggcactgaaggtgttggccgcttcccacggcccagtctggcggtggcggcagcttcccgcggtggatccgatggcaatgatggtgctagcgacttcccacggcccgatccacctgcagcgacgactcccgcgttgaatctgacggcgacggcggcagccgcagatttggtggcaccgactgcgccgatggctacacgcgtggcggtggcgctggcttcccgcatcggatttgacagctacgacggtggcggtggcttccggtgatgatttttttcctctttcgcttggttgtcctattggattttgtgtctatgtttgcgatgaattttcacagaatccatcatgcatttggttgttgatgcgaactctggatgattttttttttgtcttggagtctcatctcagatgttgcggacgagggattttttttaaggggggggacggacgaaaaattaacgtgttgagggacaaggtgacgatcggaaattttaattagttctattaagaggtgccttttttaaaaaaaaactaacgcttataaaatattataggtgtccgttagtttaaaaccgacacctataatatcttataggtgctggtaaaaaaccggtacctatgaaaaccgagccgagtcttatccaaccatccacagcgccaaagccgagccgccagggcccaccgaggagataaggcaccgagatccatctaatttttttactctctcattttcctctcctctctctcttggtcttctctctcgctctcctctctccgaggcggcagtgcaagaggggaggcggcggttgacgggcggcagcggcgggtggagacggtgcggcccagcggcggcggcgacggcgatggctgcgccctcccctccgcggtgtacagcgggaggagcggcggatgcccggaggcaccctcccttagccagatctggcgggaggaagggctacggagccgcgccgcctcaccgtcctccgtgccgcccgcctagaaagcagcgcaaggattgatgccgtcattgccgccgtcccacgtcaagctcgtccacaaggcctacgactgcaccaagcacttccgccaccgcacgtcgcctgcaacccgacgtgcctcctgctacctttgtaccgcagcctcggattctatcatttctacattgtcacttagatggatcggatttgggagggaggtaatacatgggtattaggtttcttgtggggaacaaattcacgaggtcgagattaaatttggtatttgcgtgttgtttttggttgtctagttgattgattgatttggagatctagcttgtggattatttttttttaagacagactcggactcaaacgattgggaggaacgaattgcacggatgagtgaaaaatcacgcataccgacaaaaattaggtgacggttggaagattatgaatcttttaattagttaagttatagattttgttggtttgagctatacctggaaatctttgtcgttccggatattcaggccggtgaatatcacagaaggcgaaacccaccacgtgcattacgagcagactggatctggaaaaggccgagtaaacaaacttagctggcatcattttcctttagttatatatatatatatatatatatatatatatatatatatatatatatatatatatatatatatatatatatatatatatatataatgcatgattagaacaataaaatacataattaaaagagtggcgcgaatatataagacaaataatttgttcttcaagataatcaagcatacagtcacacacttacttagtagtcacacaacataacattcataaacccccccagacatagacatagtttctcaaactaataatcaagcgatacagtcatacacttgatagtcacacaacatcaaacatttatgttgtgctaaatacaaaccccatacacttggtagagtcacgcaacatcaacattcatgctgggctaaatacaaaccccagacatcagtaacgtcagatgaccacacaatgaagtctccaccaaactctctcttctgataatgagaatgagcttttatcccgtgagaatttctaaccttgtaaaatgtttctgttttgttgccattagaccctactccacatccgatcaaagcaactgcatgagcatcactagtgttctcacatgttggggcacaataatactgaccatcacttaagtaattaaataggaaaccgtgacgaatccctgctactaatgggaagcctcctgccaacaatctagttatataaagaacatccttagggtcaacacgaaaataactttgaatcttaaggcgtgggactggagttgttgtaacatcagaagctccaatcaatatagcaatcccatcactttttagaacttccatgacaattggacaattatcataagtctcatataacttatcttgaggttcatttcctagtttaaaaccagtccttttgttatatgtctcaaccatctcatttatatcaaatggagcagaaaacacaaatcccttttgtgctccttccagtctacgggtacaatcaattaccgcagtaattgcatatagagtacaatgtgctgaaatgaaaatacagggaaaattttaaaaggtattcgtgttaaagagacaggaaatgtagtaggataagtgtatccaaaagaaaagtaaaaataaatgaaataatgataataaaaattagatgaaacaaataaaa

SEQ ID NO: 65164 - DNA, 693 bp, Oryza sativa
tgtgttgttgtgtatcatctttaattcttaggctgctatcacttaagcaattgatgcacttatgttgattttagtattgaattatcgatcaaccttagcctagtaatgattactgagcaaatatcaggccaatagaatttgttgatctgaaaaaggctgctatttctgctatgattttaagatgttctaaagctatgtaatgatcttattgctataccatataaacaatcaggtagacaaaacaaacttatgttgtaacaccccttaggtatgcacccgctactcaactttggcgtggacggctccatgtgatgggtggtggaaaagaagatcgccatgaacctggattagagcactggagcttagctgtcaaggatggcaaagcattggagaatgagtggcgaactgagatagccataccccgtggtggacctcataggtttgtacgagtgtacttgttgtcaggtgtgccgtttatgcagtttgctaattgatgtgcagattttattagtgagaacacatgcaactgattagaatattgacagtacttcatttttgtcttaactttttacagggcatgcattgttgctaatgataaactctttgtcattggcggtcaagagggagactttatggcaaaaccaggctcgccgatatttaaatgtgtacggaggcatgaggtatgtatgctta

SEQ ID NO: 65165 - DNA, 668 bp, Oryza sativa
atggagaaaggttccctttttgtagaaaaaagaaggggggaaattgccggctttttttaatattatgcaattagaaagtattgaagaaataagaaacatgaggttagtattagtcacctggaagtatggttcttctttaagaggttccaacccaagctcatttagaactcttctgtttcagtcaatgctgtttgaatgtgcccaggattcctggcactgatgtctacccgaacctatcacccagcataatagagaatgaatcttgatgcccatttaacccatgttacagaaaaaaaaatgattaatgaacacttactggtgaaaataagtagcccaatgaggagacctcaattaaatgagtaccagctggcacattgtggcttaagcatatcatgtcaaggaggaacaaaaagcaacatagtatgctcttctaacattgtggcattgctgcccacaaggaaacattggaaaaaaaataacaaacaagaatactacaacaacagagctagatttatttctattagcaacccagaggctatatctaattttcaggaataaggctacccataacagataggaaatgtaagatatgagacatccaacaatagagcaggctaattaaatttaatgaaaaatgtctaatttccctaatccgggaactcaaaatg

SEQ ID NO: 65166 - DNA, 651 bp, Oryza sativa
ttaagtatctcagtaagtgtacaggaaggattgtaattctcagggataaccggcggtttcaccggtttgaggatggggtatgctcttgtggggatttctggtgatatatcttctgatgtacctcattctcattcatcatgtttttctggtcaggcattttagattatatttcttcaggaaatagatctttacaggttcagtggctggtatgaaacacaaatctattgccatgctgttttggcacagaaaaaaacatgccataaccttcaagctgaaacagctggactcagccatgggtctattaataaaacaagacatcggtcatgatatgttaaggctagattaataatctggataacaggttcactgcaccataagttgagactggtctgagcttccgtggtgcttgaagaaggaatggtggttctgagaaggtacatacaagtttcataccccacttgagagggccccataaacatcagcatgggtccggtaagcccggtacacttcaacatataaacctttcttttttattttgggattccttagtttatcaatttaaaaggatattctttgggctaaggcaaactttcctttttatgttgggcgtccttggttatcaatataaaaggataattgcttggcccaggg

SEQ ID NO: 65167 - DNA, 634 bp, Oryza sativa
ttcgctgagccattctaccgctgacttacgcatagatcgaagtgggttggggcaggggaggtgcacaccagatggcttcataacgtcgtgtgacagtcctatcataaccttctttctgcacatagtgctattgtgaaagaacataatcgcagacgcaaatctgctctttatcagtagcattgtaaaaggagcacttgctgtctgacttagtgtgacaacttaacattaaagcaaatcccttgacttagtatgaacatcttacattaagcaaatccggtgtccctcgtggttgccgacttgccgtcatctgcactcaagaaaaaagggaacacctttgctctcaatgcacatgatatttcttcacttcagagcaataccataatctcgcaatgaaacgatgtttgcacatgcacttttccgcatcacaagattttcttctataaacatatatcaagaaaatgttactgtctacagtttgacactgaaatttagtacttcgtttgcactagtacagaagcactcatcgcccgtaatgttcctcatgatcaatgttagtctgatgatctcaaacctgcttcacatgaatggataatatgctccgcgaacaacctataccattgttagcattgccaaa

SEQ ID NO: 65168 - DNA, 645 bp, Oryza sativa
aaatgaaaatttcccttctagcgaagagaaggagaagcacgcacgcagcacgtgaacttccagctctaaacccttccccctctcttggtccaagcccctcctccccttacccccccgacgacgccgccgtcggcgtcttatcacccgaaaccctagccccattcgccgcggtcgccgcctcacccgaaaccctagccccattcgccgccggggtcgcggcctcaggagcggaggccatggaggacgtctgcgaggggaaggacttctccttccccgcggaggaggagcgcgtgctcaagctgtggtcggagctcgacgccttccacgagcagctccgccgcacgaagggcggcgaggagttcatcttctacgacgggcccccgttcgccaccggcctcccgcactatgggcacatcctcgcgggcacaatcaaggacgtggtcacccgccaccagtcgatgcgcggccgccacgtctcccgccgcttcgggtgggactgccatggcctccccgtcgagttcgagatcgacaagcagctcggcatcaccaaccggcagcaggtgttcgacctcggtatcggcaagtacaacgagacctgccgcggcatcgtcaccaaatatgtcgccgaatgggaggccgtcgtac

SEQ ID NO: 65169 - DNA, 1332 bp, Oryza sativa
aaaacgcgtgaccgctccaaaacgcatgaccgacgatcctacaaaacggttgcgcgggacctcgacggtcccgcaggttcaaaattcgggagcgaggcagccagtgatttttaacgttgtttagcactatggacactgtgtagccctgtttgacacagttttgtaaggcggtaccgcaggttcaatgtgcggaactggccataaacaggtctaaacagtgatgtaaagtggcaaacagtacccgaaacattgtcaaacagtgccgactcagtaaataaatcgctggccagttcgctcccgcgttttgggaccatcgcggtcccgcgcgaccgttccgtgggacatcggtcccgtgttttagaactgcgggaccatcgcggtcccacgtttccgttcctcgaagcgggtatatttttgcaaatctcgtgcaggtatataaacgtaaattattgaaaaaatatgtatatttgtgtttttttcactttttcaaagtacataattagatatagaagtattaattatataatttgtcatgtgaatattgccgttgattttacagctaaaatatgccactcttactatagaagtcaagacttagttgaagttgttttgggaatctgcacgtcaatataccaaatgagaaacattggagggagtaattgcccatgctacaaagaactattttcatgaacaacccctatattttaataggcggcctaagtaaagacctacatatgaaaaagcgtaggctctccgatcaaggctctactgtgagagtcaattttcataggcaagcttcctaggaggcgcgtctaaaaataggattattcttttaggtgcccgtcttaaagacccggtcgataaaatcgtatttttcatagaaaatacccaaaattgtctataaaaacaatcctagttggcctcataataggaccacgtgtgaaaaggcgaagccaaaataaatacgcccatcaatctgcccgacctctagtcactctttatgtcgcatcattccgtccttattccttaattatgtcatctcatattgattgcgatgatgcttgtattggatatcaagatagggtttctagaattttattattttggatttttttttgttttttgagcaaaaatcttatgcactcgagcatcttaacgtgtcagccagtgaaaaccagttttttgtgtgtggttttgatgcctatctgggaaaattcggatcttcgtaaacaagttgcctgcgtggcctaggcagccggagcgtgtttgacgttaaacatgtgccggtattagtcccaccatttttgtttattgctcactattgaccatgca

SEQ ID NO: 65170 - DNA, 1498 bp, Oryza sativa
acaaaccaagccccgcaaaggtcatcgcattgatttgaacaagatccaataagggagatatgcctacctaataagggccccgatggtgccctccccataaagtggtgttagtctaatcgatgatgataccaggcgagacacttgaatatgttcgttgataattttattcctattttcgggagttcattacaatgatggcttcttccatttacctagtagcgctttgtcccaacgtgctacaaatcatcactgcttggtctgtgttgttggtgatcaggcattggttgctactacgtacgcaggtagcgacttctattttgataaggaagattcgtggttgctaaaatcagttcaacagctacgatcaattgtgagcagatcgtgctcacccagagtcgtcattagtactctgggtgaaaaccctaatatggtttatctagattcgacagcgtcgatgcttgtttattattttctttattgaaggtgttatctcaagctcccaataaaaaaaatctagtcctgtttttttatggctgtgatagacaagcattaggtccttcttgaaatcattgtttcagagtagatgtgtatcactttatattcttgtctagattattgtgttttgtatgagttgatgtaaacaatatgatacgttcatagttgcttagattgttttccttttcttttctagctgtgtgtgcatttcgggttgatgtagagaccgggcgtagttatatttttaatgaaattattcttattatattaaaaaatcgacaatcacctagttactatgactatcacctgtcttgagccagtttgcatcgataaaccacttagtaagcctgccaaattaagaaaaacaaatttaagtgcgaaatttctataatttttttctaagtttatgataaccaacacgaaaacgctagggagcggatttcggtgggcaaacggttttataaaacctggttagaatacacatggatttagggccattaattctcattcaaaaagactcgctcgtgcagaggcgcagagctgacaagaatcagccagctattgagctgcaacagcaaaccaaatgaaagcattaatttaaactccatttctgagatacatgcatgtgaagctttgatttgatccaagctagccctccagccatgaatattctgagatgcatgaattttgaatcttgcttctcctgctgttcatcctccccttcactggtggagaaaccatctttaatcgatccggcaaaatccacaatagtcccggatccaaaaagaaccgggagtaaagattgtttttagtcccggttataaaaattatgatctttagtcccggttggttctttactcccggttcatcccctgtcagatgtatgtcgggggccaaggatctttagtcccgatcggtaactcaccactttaatcacggttggtactaccaaccaggactaaagatcaagatgatctttagtccaggttgatagtaccaaccg

SEQ ID NO: 65171 - DNA, 6382 bp, Oryza sativa
cattttaattggccaacaatttgaaacaagtaattgatagaaagaacaaaatttaatttgacgcaaggagataaaatgcatagatggacagtgaacgatcaaaagcaaaagtggtttattcggctagattgcaacatccaggacagaggaatataaaaagatcacacattggattgcttattggtctgttctagcctaataggctctgtcacctaggattgatcactgcatctgatccaaaacctgcatacagagaacatatatatcaaattagtaatgtagtatagtgctgaaatggaattaggcccgagtgtgatttggcaacacagctgagcagtgaaacgtgtaggaactaggaagggaggcggagatgcaggagcatggcggcagggccgtgggctgcgcgcgcggtgtagacgtaggcgctggggaggcaaaaccgcactagcggtgcagcgcacagccaccgggcatgaggcgtcgccgcgtggccctcagcggccgtgggggagctcgcctactcagggttgttggtcggcggggaggcgtaggtgcagaggatggcagccaacacagattgggagaggtgtggacacgcggagcggctggccagcaaatcaccatggtgccttaccttcagattggtgcctggcttaggcctgaggggaggagcagtgcagagagaagaagagaggggatagagtttcgttggagaagaaaacccacccacgagctctttgttggagaatggagagagaggagatagagtttttcacgggcagttagattttcttggagggataaaatggagggaataaatggcgcgacaacgaaagacgtgagaaaaaaaatattgagaccgaaaatactggagggagagcaaaataatttaagctcatttttttcgaaggaaagatttggaaaataacgtgagactgaaaaaaaaaaagagggaaagaacggagcgagagcaaacgttctgtcggagataaaaataatgttaaattctgactgagtagatttaagctcaatttttcggagggaatgatttggaataagactgaaaaaagagggaaagaatggagggagagcaaaataatttgcgcaaatacacaaaatgttaaattcacatcaagtaaatttaagctcgatttttttagggcagatttaacctccagttatctaatctagttcagctaatttatttttgtgcggatcaataagaactagttataaaacttcataaatgcactagtaaaaattattttctactaatacaaaccgcgtcgttgccgactcggtcctgagagaccggataaaatccaaaagtaacatattgttttcttaaaatagtagttagttaatttatcttagcacgaccgaaaaatcacgtgttttttcattgtagacccggtctagaaagactggatgaaatccagacgtaacatattgctgtcttaataaaaaagtagttagttaatttatcctagtacgaaaaaaaaccactttattttacattgttgactcggcccagaacatatttttgtcttaaaatagtagttattcaatttatcttagcacgaccgaaaaaacgtttttttttgtcaatctggtccggacagaccggatgaaatcaagacgtaacaattttttgtcctaaaataatcattatttaatttatcttagcacgaccgaaaaagcatgcgttttttcgtcatcgacctggtccggacatacctcatgaaaaacagacgtaatatacttttggtcttaaaaatatagttatttaaattatgttagcacgaccaaacaatcacctattttttcattgtcgacccggtccggacagaccggataaattccggatgtaacataattttttgtcttaaaattatagttatttaaattatgttagcactaccaaacaatcacctgttttttcattgtcaatccggtccggacattccgaataaattccggacgtaatatatttttttgtcttaaaattatagttatttaaattatgttagcgctaccgaaaaaacacttgtggtccagacaccgcggattaaatctagacgtaacatattttttgtcttaaaataatagttatttaaattatgttagcaccacaaaaaagccacgtgttatttcgttgtcgacccgattaggatagaccgcgtgaaatttggacgtaacatattttttttcttaatagttatttaaattatgttaggacgagcgaaaaaccacatattctaaaaatatatttttgaatggtttattttaaaatttagaaataaaaaagttcaagaaatttaaaaaaatctgagcagacagaatttaaaaagttttaggaatcgccactagagaagaaatgaaaaaaaatatgcatttgctagtatttgaactggagtcctcaattcagtagaaacagccaagtaccactaggctatgtccacttcacattggagaagtctgttttatttatttattcacgttaggtgccattgacaatgtaaatagttttctcgaggaatttgtataagatggaaatagaataacacaacacagatagatgcaaaaaatatagtcggccattccattttctcatcatataaacaatatgatatcttatatattgaaaaataagatctaaccaccaattctgtatataactaatgtacaacattattacacaaagcatatatgcaaataaaaaaaatgcatccatctggctcaatcacttggacaatccaatgaaatctacgaacgacacagtaaagctattgtggtgaagaagcctcgatcccagtaaatctccatccaaaattactgccataaaaataaagagctcgccaagtgaggatatcaacgatataaggaaatcagtgataatggacagatagacagagaacaaccttcataacctcacctttaattagttaccatgttatcgacagttgttccttctatatctcttcggacccatgtctgaccatcatgtgcattgtcaaatagctccccaagattattgacatgatatggttcacattccacatcattccattcttcgcccagttcaaatacatctctgggtttcatcttccttacaatagaccaccctggatttaaatggtcttcaatgtaaaacacttggtcgacttgatttgcaaatacaaagggctcatgctcaatcttttcaccggtatgaattttatttgagaaattcacaagtatgcagccaaacttatctgttttcactctttttcctttagttacatcgacccattcacatttaaacaacacaactgagaaatttccatagtagtctaactcaattatatcaagtatctttccgtaatacatgatatcaccaaggacagggttggtatcactcgcagacgtgtagctcgatgtttttgcagtcacaacaactccactattttgagtcaccctgtcataacgctttgatctgaacctgtacccacgggtattgaatgctctatgtcgttttgctacctcaattggtccacgtgccaaccatctaatatcctcatcaatgctatcaatacctctttgattctccaactgcaaagatctacaccacaccaaaagatacattagttttactcatatttgaaaagaaaaatctaaattttgatacttacatgatctctgaaccaattaggaaattgttcattttgcatgttgtcggtgatatgggaccgggagtatcatgaccagaggcttgaggcagacgcaatcgcccacgtggcctggcaccttcggggacgtcgggcccgagggtgaggtgtccgccctcctcctgatttcccccgagggggggtcgggttgcgcttgccccggccccgagggccgaggcaccccgaccccttaaggaagtctgcgccacatatatgggataagtgagcacagctgtgctcacctaacagcatttattgcagtctggtcaaagcgtgtcacgctgcatgcaacgcagtacagcgcgttcctttatccggtctgtgaccagtcacagaccggtcagatcacgggttaggtggcgactggcggtctgacgcacgccttgccccatcccgtcaagacgaaagcctctaggcactcgtctcaagccggagctagcgtgttatctcttagagatggcacgttagccctggtcagatttataccaggcttcatcctaaccattacaggcaaggtgttacacgaagaagggcaaacatgcacgttgttaagctgacgcgtggtggacaagaatgaccggtctggcactggtcgcgtcatcgacagacagccacggtcccgcgtcatctctgtcttcgggggaggtgggggtaggtgtgggctgtcccatcagaagggctcccggatggaaaccgtaccgatctccgcccattaaagagaaaaagaacagtccagtttggaaagagaaaggtgcatgtggtatccccttgagatataaaaggaggaccttgcccatttagagaggggacttttcccttttggaaggctgaggggaaaggaagttaatcctttgtaactggtccatacacaaatccacaaaaacacaggagtagggtattacgcttcgcagcggcccgaacctgtatacatcgccgtgtctcgtgtgtcttgcgggcgggtgatctttccacatacagagagagagagagagcttgggattgcaccctaagcccctggtcgaaccggcaaaggggggcttgcgcagtctcccggtgaggggcaacgagctccgtcatctggcgcgccaggtaaggggctcagcgtgtgttttctgagctctcatactcttccgtgtgcaccaagtttcccttgttcagcctaatggccgagcaagcaaaggcgcacgacctctctccgagtgtgagcggcgacgacggggagccaaacccgcgccgtcgagctcgtactcccccacctcctccacgccaaagtcccaagcggggggaggcgctcgagagagtcgaaaaatccgcagcatcgccagtcgcgggtggtgcaggagaacggcgagatggggagcgtcgcctcctcgtctacggcgacggcagcacgcctcaaggcgcgcttcaggctgttggcgcgctcctacgtcacccgcctgtcgtccctgacccggagtctccagcccagcgatggctggacgacgtggccaacttggtcatgacggcacagcaacgcctgggtgctggcggacggtccgccaccaccaagacctccggcgccgccactaccggttccgcgtcgtcaagacggagagcgcggcgagcggcggccgctgcacgccattcggctaccactccctcgtcggcgcctccgactcgggaggatcagcatgaagagccggatgcccgcctcgacattgagcgccgacgtagtgatcggcgtactccccgcgcaacggagggtgcctcttcgtccagggtgtcacctcgacatggacgtgaggatcagccctccgtgcccccggttggtggtgttggctgtagagcctttgtggcgagtcttcggaatgtccgttggcccccaaggttccggcccaccatcaccgagaagtatgatgggagcgtcaaccccaccgagtttctccaggtctatacgaccgggatcgaggccgctgggggagacgacagggtcaaggcgaatttctttcccatggccctgaagggacaggcgcggggttggctaatgaacctgccacccgcgtcggtccactcctgggaggatctgtgccagcagttcaccatgaactttcaaggcacctatccacgcccaggtgaagaagcggacttgcacgcagtacagcgaggggatgatgaatcccttcgctcgtacattcagcgtttctgccaagtccgcaatactataccttgcatccctgcacacgcggtgatctacgcgttcagggggggtgtgcggcacaaccgcatgctcgaaaagattccctccaaagagccccagactaccgcagagctttttcagctcgcggaccgagtggctcgtaaggaggaggcctggacctggaaccccttcagttccggtgtggcagcttcggccgcccccggatccgccgctcagacagggcggcgtgacaggaggaggaagaaaaggtcggtccattccggcgacgagggtcacgtcctcgccgtcgagggcgctccgcgggccacccgaaaggggaggcctgcgagcgacaaaaagaaagaggctggtactcccagcagggagcgcccagccagcaagtggtgctccgtccacaacacctccctccacgatctcgcggactgtcgcgcagtcaaaaacttggctgagcgaacgaagaagtgggaggaggaca

SEQ ID NO: 65172 - DNA, 24812 bp, Oryza sativa
  unsure (1)..(24812): unsure at all n locations
tttgaaaagagaaatggaactagcactatctaaatgaggaggtttcattctccaacaaccatataagtttctttatgatgaaaagcaacagttgaaacatgatctaatttacaaataaaattgaaacacatttcatgataagactgaatgtagaatattatcgagggggcatttgcccccactcacttaaaattaactgggggcattggccccaacttgccattagatcaacggatcatcctcatttgcccccactcacagtaaaattgatcggggggtttggccccaacttgccattagatcaagggatcatccaaagatttatgtgattttaatgtaaagggagaaattacacatcacacaagctatatagactacatggttttattatcaacacttctactgaagatcttttttacacctattatctggatatgccacgggactatccaatgagttttggtattcaaattgtgaaggcataaattactcagcagacaacatatacaagcgaaacatgcactttttataaaggacactgccacataatgtctcctccaccccggatttttttggtaggatcatggccaacagagcaaaagatgagatgtatgcggttggatggtgtcatgctgatattgataatactacatgcaagagttgtgttaccgatgcactaaggaaagttaaggtggtttgtgcttcaaagatggaggctatcatcttttatgacttttgtggcattagaatttctagtcacattattagtttcagtagttctaaagacatagaccatatagcatcacattgcgacccatctttcattcagaaccaattatatgttaatgttgtcctatcacttatttctgctgtgacaaataaggcaactaacttgcctacaaggttcgccacaggacaggaaaatctcatagcaaaggctaagactacaccatatatgcccttgcagagtgctcatccgagttgacaagtttagaatgacagaagtgtttcaatgatattggttatgcaccaaactgtaagctgggatcaaaaggtgcaagagcatcaataatttggtgcaatttccgctaccagttgtatccattcttcatgggccttccaatgctgaacatgtccatagatcaatctacattctaggttgaagataagtggagcaaaagacgaatatttttattagataataacttttctttagtaagtcatagattttgtttggcttataccccagttgagctgcatgtgggggtggagttgaagcttcgctagattttgttttccgctgcagtttttctttatggtgaggactaagtgcctcttatgtaagtatttatcactttggttattttgatgaatctgtatattaaattgttagtttgtgtaactcggttgattcctgggcgaggattttaatgcacaaattagttcggaaattacttgtaaatttctgggcgtgacatatatgcaggagcacatcatacaaaacatagagctgctctcatagcggcaatagtaggccgagtgttgtggtcatcatagtagtcctaacactaagttttttttgggggaagaaacgtgtgtcaagaaaacacacaaagctctcaagtaagcacttaattataaaatattgaacaataatacgtagtgcatatacttcattctaagatagacttttatggagattgtttctaaacatttagatgcagaactagttaagggtgaaaatattattgaaggctctaatgatttaggaggtgaaaataaaaggattattgaaggctcaggtgattcagggtgtgaaaatgatacttgcaaggtatattttctgcttattactcatgttctaatattgtagtctccatagtttgaatcactagcttttagctatccaatgaatgctgttttgaagaattttcgcatgtctatttataacagacacaatgtacttctaccttggtttcatttgatgaaatcacatccaatgctcaaggcaagaagattgccctattcttggattatgatggcacactttcgccaatcgtaaataatcctgagatggcatttatgtcccctgaggtaagtcaaataagaatatttggcaattaaatacttgtaaatgcatgtaacaattatttatgtttaattctaattactgttagatgcgtgagaccgtgagggatgcagcgaagatttttccaactgcaatagtcaccgggagatcccgcagaaaggtaggaacgatcaacccctttgattgacgagctatactcaaattattactatatgtggtagatcaataattgtgagttttgtctttctgactcaggtgtttgaatttgtaaaactagtagaacgctactatgctgggtgtcacgggttggatatcatggtatcaaagggctgattttggaagtactagtgaaatagtaagtacttgcaacattttagaacaaaattttcatagtactcttacaatctcttacaatttattatacttgaaggattttcaaatcagctttaagaaacgagttctatcatctagggaccttttccttgatataccctgtagattgtcaaaatgtgtgtactctagagacattttagaagcaactttgagtcatttttagatatctgtgctaattatttggtatacacatttttaaggcaccctaattcaccaaatgtggaagacattttcttgaaaacgtgtttgcctctctagaggcatttttagatgtttaattaatttgagtaataagtgaatataaataacgaaagacagaggtacaaaccatgatgtgaggttaagatgcttagtgtattgaatataaggttggccttaattttccaaaaggactttagattgaggaaagatcatagcaaaaaaaagcacataattaactattggctttttcacccagtttgctagtcgtagaaattaacctcactatgatgtttgtgttgtagtgtaacttcatgcttagtttttaaaatttctgtttctaacttctacacagtgaagaagccaatcccttctagcctgggagaaagtttgtccctatgattagtcaggtataatctatatttctaataaatgcaaaacgatgacttgtgcaattttatatgaatgtataatacaatattgttacaattttactataaaacatgttttgaagtctataattgtgcctattggaaaaattgagggggcaatgatcgaagacaaagaatgttgaggagaagtaaaatatggatctacttttagtttttttttcttcttttatcaatttaggtcaagtttaacaaatgatgcttgtcttaactataggattgggagttggttaaagaaatagttattaatgcactgaaagatgtcctagtcttgagatgaaacccgggaaaatggtacgaagattcaatacccggtatttaacttatagtccatttcaacgatgttttacataacttatataaaaataaaatttttaggttctggaagttcgacctgaagatgttgcagacaaaggtaaagtgatcaaatatcttatagggacacttgggctaaatgactctaatgttctcccaatttacattggagatgacgagacagatgaatatgcctttaaggttctattcattctcaaacataaatcatgacgaatcttagattttaaggtttcagttgtatttaggtgctccgtgagcagaaaaatgggtatggtatcgatgcaatatttgtattggtaatcatcaatgtgccatcgaagttggtgtcattagatcaggggcggaacaggaagtagcatgagtagagtccaagatctaccgcttaagtcgacaaacaaagtaaatattatcgagtgggcatttgcccccactcactataaaattgactgggggccttggccccaacttgccaatattatcaagttgtatttgcccccactcacttaaaattaactggggcattggccccaacttgccattagatcaacggatcatccgcatttgcccccactcactgtaaaaatgaccgggggctttggccccaacttaccattagatcaagggatcatccaaagatttatgtgattttgatgtaaagggagaaattacacatcacacaagttatatagactacatgattttattgtcaacacttctactgatgatctcttctacacgtataagagttgcgttacccaagtattatagaatgagtactataggatgtgtgttgctagcataaaagttatcatctattatgatttatgcacccttgagatttctaacgagaagatagagacttgcattcatcatggtcaaattcgatcattgtgcaaatcgttaagtctcatgtcaaaagtcagcaagaaaatgcttgacaagatcgtagtttactaatcacttcgatgataagcaaggtgaccaatttgtcttcaagatttgcaacagggagttgcaaaagggcaggagctgctcatagtagataattacaagtacactaactatggccttgcaatggttatcaattttgtttggaagaactcagctttatactcgtttttttgatttacgggtggtacaaaattagtgatctgctgtagttactggtaccagttgtaacatttctttaccgattatccaatgttgaatttatacattgtttagtctacactcaaaattggcacacccattagaaattactatatatctaacatttagatattagattcgtgtttaaaatttggacatcagattcgtgaagccatcagaattattgtgcggctcatccctactttggaagttccatgagaaggtattaataaactaccactcttaccttaaaatttggacatcagatttgtgaagccgtcagaaatattgtgcggctcatccctacttctattgttagtggaagttccgtgagaaaacaaactaccactcaaatattgtgcggctcatccctacttctattcttagtggaaggtccgtgagaaggtattaacaaactaccagtgttaccttatttacttttttaatgcttatgaaattatttctccatttctaaaatgcatgctataataaattcgtgagatttgagttaaaatttattagcaccattttccctcaaaatttttgttactaacagcccaatttatattgctgtaatttcagttgtaattttccttcgaaattttctgaagctgtaatttcagttgtctcgtattcacatttaataagcctttaatttatgtagtctatgtaatctatttggtatattatgtcagatttagttatttgtattgatcctcaatttatatttcaatctttaaaagtctttattacaagttttaatgtaaagtgataggtatttatattacacatagagctagtatgtgtattccaagataattcaaatttaaatttcatttcgaacaacaaccaagtatgataaaaggtgcattcatgcttagataaagctctgtttagagcactgacaaacattgaaggacacatatcttccccttctggactgactaataagaattttatctagttttataaacaaattgttgtcgaacggaatagcgtttgttgaaaggacatgcttcactctaaaaggtggaaagtaaataggtaaccctaaggattctatataaaggggaatttacatggctacccttataatagggacaattgacccatatagctggccttcagccctaagacctattccaagtgggccttcttgaggggttgacccacttggggcttggtccgcctcgcctgctggcaaaggcctttctcttcatctccctttggtcgaggatccttcgcttcacccttggtgcttcgcctagcaatattgctccaaggcttcggtcttcgctctagtaggtgcttcgccctcttgatgctccgccaagagcttgacgaggtgtttcgacaggctcgaccgaaggccctcgtgacatgcctccaacacaaacaaacccaattccatgaggttacgactagtatatcttctataaggaaaatccaattccatgaggttgacattctgaacaatagcattgaaactgtcatgcacaagcccaactagggtcttttctgtcctatgatatgcagccccacatagaccacaataagattccatttatacccatcatgttttttccttcaaagttaaaagcatcttatcataatcgtactccccttggccaagttcaccaacataaaaaaccttagcattgacttccatatgaatccttccatatcaaggttctcctccttgagaaacattttgagtgtaccatgttgattgtgttgcctcttacactccatggatttgaatcgaaagaaataatttttttgtcagaaaatttacaatgggccctaaacaattagcattcctggtaaggagtatagttcagtaaggtataccaacatgtaaataaatatatatttttttccagaaacaccatctccaaaattttgggtctactgagtattgatagtatcccattttagcaagtgatatttctttttgttatataggccaatagaatctatacgtctaatagtatccatttttgtgaatgattcctaggagcttttgaatccatagtacgtacttacacaaggacactagaaaccatagtctataatatttattaaaatctttccctcttcatagttgtgtgtccactctccaagtctccaacctcctttttttgtacttctgaacaatcactggtaggtcattttcccaattttatcataactcatacgtatacttacatctgaagtctgttcataacaactctaattggactcatttgtttgcttgttcaatacaatttttctttcaaagatattaggtcttaaatccctctgctatttttttatcttgccgtgccggcccggcccaccatgccgagggagcagcccaagcatggcccggctgtcgggccatgccatgcttgggctgggccaaattggcgtgccttgggccgggccgcaggcatcgggccatatggccatctatagtgctactgctgttcaagggaaagaattgaaggaagcagggagggagagagggagaaggaagaagaggaaaatttagggtttcgtggcttggtcaatttggttatattccagaataaaattcagaatttagttcctaaattatcaaactttaaccttgaccggtaggccaaaacattctttccaaatcttgtattaatccataaggaatcaaattttgtgttctaaatagaagttgttctccttgtgagaatctttccggcagtgcccaattttaattaggttaaacagtttaggataaattgcaaaaatagtaccaacttggttcgcaaccagtacattatttagttttcttcaaactgggcatgatagaagaataatcaggatttccacacatcatgtaagttctatataattttcttgtttcaagatttctttaggttagtcctagcacctggacagaaggtttaagcactaaggaatataagatcatctggaggcagataaactcccccaaattgtggagattatgggtaccccatatccacacgacatggttatccaactggctatagaggatatcttatatctatgaaatatgtaacagatcatgacttgggtattacgtttccttatatattacggaactgtctaaagttctggttcgataatattgtaaattagatttaggaaaccgacaccatattggttaaggtttctatcttgtaatcctgccccaattcacacaacctgatcgtcagatcaatactacactcagtggattcaaatccccaacatgagtaggatattacctctcatcgagagggcctgaacctgtctaaatccttgtctccgcatccatccacttttaggtctcgtgcactacccctttatattgccgaaattttgtttcgacagttggtgcgctagtgttgatgaaaaaatcgaacacactggcctgggagatctgcttagctcctgtgcaagtccaaagattgatgagatgcgggcatgccagtcagtttgatcctacaactgacaagatatgtaaacagtagataaatcagccgatcggctgacaagccgatgtagtagttccagccgatgccgataccaaccgatagcgatagggtttaagcaatcggctatatgtccaatgtagatgatgatataaaggcaatcgactgatgtaataaaataacaatataatcgaatagaaaccaatcggctagaaacaatatataataagcactgatccgaaggttaaagcatacatcggctggaggtccgatgtcataaaatccacaagattatattaaacaattaaatcttcattgcgatcggctaaatccaatatgtatgcaatccttgtaagccgatgcaacgtccagataactcatcggctgaaaccccgatggaacccttattggcaatcaagaagcaggctggagattatggttctaagcacgacttagtagatcaaacttaactgatgcagcactaagtatgaaaagaaacataatatctagacaatcaagccgttgattgattttttagggtagtagatgcctaggctaatctaatctagcaaggcgatttagccgataccggcagaaaccctaaagcgagagatggccgatagagctaaattgagatgctaggactagattaacatagacatatgataaatagtcaggcaaatatattatccaaaccagagtaatccaagatctcgaatgtcctgatgcagccttgaacgacgccgacgtagacgatacaattgcctggaccggcggaacattggacttatcccttcgccggagatcgaagacgatgcagccccgcgtcgggtgcctagttccgccggaacgtaaaaacaaaagtagaagtaaaaagggtggcgatgcgccgaattgtattgatcgtagcgatagattacatagaccccgggtgtacatatttatacccataggttgatacaagtccttgtcggacaagaaagaaacattcctaaagataaaaggaaaagataaagtccttatatgacactaaacacactttcctaaagataaaaggaaactaacaaactattcttaattaatagataacttgccatgccgcattctctttgaaatcggtctcttctggataagcttcctctagtagatcaattttcttaaccgactatagcaagaatccgacaactgacgacttgacaactttcatcagctaatctcaggacttcaaagccgatgctgactctaagccgatgactactccgggcttaccaaatttcattgttaacagctaggtaggggttgcgttgagtttacctgtcaggaagtgcgatggaatcaactgggattaatctcaacaatttcgacgacttcaatctttgacatcgaccggtttgccgtttcaataaagtattattagattgatttttaatctagattggtctgctattcgatttttgtttgtatgcatgaactggtggttgatgagctctgccgactacttccaatgacggcatcataccggagggccatccaggggtgtgcacatgcatgcggcatgcaaacagagagaccaatatctagtggctattttttttaatcgctcacgatgcaagccacgctgcacgatccggttcatcggtctaatctaatttctgttagattaatttctaatcagagattgatattgtctttttggttcctattttgcttgtccgcatatatactaccggcggctgagttgctccgatgggtgccaacaacctgacaagccgctgcagcgctgccatgcaagacaagtcgtaagccggccgcgtcttcatgggaaccatgcgacatgctgaagctggcaggcatgcctgtgatttaatatgcatatgtgctctcgccatgcctacaccgtgcacaggaaagctcaagctaggaaatcacggttcccaggaaacatgcctgacgtgctgatctaatcaacacgcatggattaaatatttaatatgccatgcaatagatgttttcctgtatatgatatgcatccatattttcatgtttactaacagaatctatatgcttgctttgtttttgcatatacgatggattcattgcatgatgagatcgatctggccgactctagcgctactaatgggcaactcgccttaacgccacctcatctgccgttgattggtcctcgcctacacggttggatggtcacaccaccattgttggcgtccatgtcttcaccgtcagcctgccttcgccgccgtcgactggtgtcctcgcctacacggtttgatggtcacgccaccgttgttgggcgtctgcgtcttcaccgactagccgcctcgtcgccgccgactggtgtcctcgcctacatggttggttggtcacaccaccgctgttgggagtctccgtcttcactgaccgaccgcctcgttgccgccgactggtgtcctcgcctatacggttggttgatcacaccactgttgttgggcgtccacgtcttcaccgcaggcctgccttcgccgccgtcaactagtgacctcgcctacatgataggttgatcacaccactgctgttgggtgtccacgtcttcaccgctggccttccttcgccgccgttgactggtgtcctcgcctacacggttggatggtcacaccaccgttgttgggtattcacgtcttcaccaccagcttgccttcgccgccgccgactggtgtcctcacctacacggttggttggtcacaccaccgttgttgggcgtctgcgtcttcactggccggccgccttgttgccgccgactggtaccctcacctatatggttagttggtcacaccactgttgttgggcgtctacgtcttcaccaatggccacctcgtctgccgccgactggtatcctcgccttcacggttggttggtcacaacaccgttgatgagcgtctagtcttcaccaccggcttgccttcgccgccgccaactagtgtcctcgcctacacagttggctgctcacagccccgttgttgggcgtctatgttttcactgccggcctgccttcgccgccattgattggtgtttttgcccatacggatggtggattccgccgtcgttgatgcgcacttttatctccacaccgaccacctttgccgtcaccaaggagataaaaaagctaagtcatcattaattgtgttttttatatgatatttttcctttacttctgcctcactacatcatctggttcgccattgactagtgagtccggagctacagatgttatatcatatttttcaactttttttatcttgattgcttgcgaaataatccgagtaaaaaatgtgcctatcgagttatggagctctatttccctatactttccatttggtttgttgatggatagttgcctttgggccaattcttatcacccgggggctcgttggatggagtgtataatgcaaggtgctaaatattactcggataaaatcaaaagcatagagataagataatttgctttctactcttaacaattgccaaagtgcccgagtagtaaattctgatccgtgaaacttgttccattaatgacgaactcatgtcactcatatgaacgtttgggaagtgcctatgccgattaccggtgtttgtgggcaatgattagtcgggcaaaatatttaaacgtaaggaatcatttgctcggggaaattaaaattgataagaggagaaatacatattttaaacatattttaaatgcttgaattttcctcaagtcctatatttaaattagatactactcattctacatgtttattctgcaggatccaaatccagatgtgcatagtagggattcattgctataagcttatctcctacgcttcaggaatgtatcagtcagaacatcaccatcggcttgacttcgccgccgccaactggtgtctccgcctgcacggctggtctattataccgtcgttgttgggcgtctacgtctttaccgaccggcttgccttcaccgccaccgactgatgttttcgcctgcacggctggcctattatgccaccattgataggcgcctacgtcttcaccactagcttgccttcaccgttgccgactagtgtcctcgcctacacagttgtttggtcacgtcaccgttgatggcgtctatgtcttcatcgaccggctgcctcatcgccgcctactagtaccttcgcctacacggctggttggtcacaccgccatcgatgggcacatacatcttcaacgtcggcttgcctccgtcaccgccgactggtgtcatcgcattcacgattggttggtcacaccaccgttgatgggcctctatgtcttcaccccggctagccttcgccgctatccatggagtcttcgctttcatggttggcctattatgccgctgctcaaggacgtcttcgttttcatcatcattctgcttcttctattgccaactaattatctcgccgccatggatgcacaactctgtcatcactgattcactattgggcaccttcgtcttcatcgctggctgccttgcctgacgccgactagtttcttcgcctccatggctgcacgtcttcgtcaccattgactggcgtaatctttaacaccaacttgccttcaccgccactaattggtgtctctgctttgatggtcggcctattatgctgccgctcatggacgtctttgttttcaccatctgcttcttctatcatcgactggtgtttctatattcacgactgtgcgtcttcgccaccagtttacttttgttgctgccgacttgtgtctacgtcatcacgatagtgcaaatctatcaccattgaaaagcgacttcatcttcgttgtcttcggcactgacaaactctattgtctctacatcgcaagctttactacttcaccaaccacgacgtctacaagagccttgacatcttggcatgcgtcacgaaataagatgtcgtgttattttactataacaagtggtgttccaatactcaagatttctacccagacatcctcaatgcatatcttcactcaagtgatggctactcgacgacaagctacagttctcgactctatgttcagttgtttcccatctaaccaaagagtcgagggctacacaaatacaaggctcaaaattcgacaagttttatgtcaatataaagcaatcaattaatcagccaatgagtcaactctgagagtcgttatcttcgtctttgctttagagccagagttctacttcagcaattattttaccggcaattttggcttctggacttcccaagtacgggcctaaggagtttggagttatcaaccaatcaactcagattcgatgagttggacaacagcatctacttttccccaagtgaagcatctgcaacagcatctactgccatctttataaatcaaggggcgttgcatcaatcttcattatgcacacgctcgcatcaaggaaactactcgagcttcgatatcttctcaacagtttgatggattattttcactaacatcatcacctgcacctctacttcatcggcccagacgtctcagccgttgctaatgggtgacaacgttttcacctccggttgcttccgtcattgccgacttgttatttcaccttcacggttgacctactacgcaaacgctgatgagcgtcttcgtcattatcatcggctgctacactactattgattggatcatcgacattgtcatcttcgtcaacattctgtaaagcctcttcaacatagcctactctactgctattgattggcaacttcatcatcgtagtcgatcatctctgttgctgctaatcgtcattatcgttggttgcgtttgccgtcgctgactattttcttcatcttcatgattggtggatttcgccatcgccattgatgcaattctgaaagaagctcacgacactttatactctatccaccctggtagtactaagatgtaccaagacctcaaggaaatattttggtgggtaagtatgaagcgtgagatagcggaatatgtagccgtgtgtaatgtttgtcagcgagtcaaggcagaacatcagaaacctgcaggtttgttgcagcctttgaagataccagaatggaagtgggaggaaatcggtatggatttcatcactggtctacccagaacgtcatcgggccacgactccatttgggtgatagtcgacagactcaccaaagtggctcatttcatcccggtgaggacaacatattccggaagtcgcttggcggaattgtatatgacaagcattgtgtgtttgcacggtgtgcctaagaagatagtatccgatcgaggtagccagtttacttcaaaattttggaagaagcttcaggaagagatgggttccaagctgaacttcagtaccgcttatcatccgcagacagatggacaaactgaaagggtaaatcagattttggaagacatgttgagagcttgtgctttagacttcggtggaagttgggataagaatctgccttatgcggaattctcatacaacaacagttatcaagctagtcttcagatggctccttatgaagcactgtatggtcggaaatgccgcactccgcttttgtgggatcaaacgggagaacgccaggttttcgggaccgatattctgagggaagcagaagaaaaagtaaagatcattcaagagagattgcgtgtggctcagtctcgtcataagagttatgccgacaatcgccgtagagatctaagttttgaagagggagatcatgtgtatcttcgtgtcacacctcttcgaggggttcatcgtttccacaacaaaggaaaattggcaccgcgttttgtgggaccttataagattgtcagtagaagaggagatgttgcttatcagttggagttaccgcaatctttggcaggagtccataatgtgttccatgtgtcacagtagaaaaagtgtttaagggtacctactgaagaagctaatcttgaacagatagaagtccaagaggatctgacatatgttgagagacccatccgtatcctggaaacagatgagagaagaaccaggaatcgagttatccgtttttgcaaggttcaatggagtaatcactcagaggaagaatcaactagggaacgagaagatgaattaaagtcagctcatccgcatctattcgctagttcatccgaatctcgaggacgagattccgtttaaggggggtaggtttgtcacaccctaaaaatcccaaatatataaattgttgtttaattcgaattattagaaataattttaaaagcctagaagagaagatctaattttaaaataataaattccaatataaaagtgggccagataaaattttattaaatactttacttgattctatagttcctagatttttctaggatttatttgagccaaggaagtatttttaataaatagaattgcatttcatgaataatttaaattgaaaaaaaggtttttaaaatcctcttttggctttgggccgaaagtcggcccaaaaccctttctctctctctccctcggcccagtcggcccagtcagcccgcagccgagctgccgctcgcgcgcgcgcgaccgcccgttgacaggtggggcccacctgttagtcttcgtctacctccagccgccgccgcgcccgaaccctaaccgagctgcgccgccgccgcccttccaattcggccgtgcttttccttcttcggtgaaattaatagaggggaaatgatccccgagatctcctctaccttttcccttttggaatcgatcgctaatttggtttggaaattgccggattcgagtttggttcggattcgtttttccgctccaaaccctaaagtttccttcccgtcgccggccgtcgtgggccttcgtcgccgccccctagccgctataaaaggacccccggtgtctcctctacccgccgccaccctcgccttagcccaccgccgtctgtagcgccctagccccgtgaagcctagcgccgccgtcgccgcagttcgtccagtcgtgcgccgccgtcgctccggtcgtcgtcgtcgcgtgggaaggccaccgccgtgttcgccgagttgccgccgacctcgtctgtccctctgtcgtcgccgtagatcaccggagcaccgccgtcgtcatcaagccgaaggtcgccgccgcttcttcctcgtcgccgtcgtcgtccggtcaccgtccaccgccgttcgtgcctcagtaagtttcgtcgcgtcgcccgcaacacgtagatgccctccgtttgcgccgccgcgccgtcgttcgccggcgagcatgcgaggctgagccgccaccggtggtgacatcactgctgacgtcatcgtcgccgtttcccgtgagccgctgtagaccgattagatctcggccgttcgttttggataggatagatctcggccgttcgtttccgtagaccgtcgccgtgcacccggtccaccgtgaacccgagccgctgatgcaataaatccccttttacttttcaaaaataattcattattgcgtcataattcaattaaaatctatataaatgatttaatccgatttaatctttgaaatttcataactaattcatcttagctcggatttagttggttcaagtctctaaatttttctaaaattgagatctacatgttaaaaatatccacatgtactgttcatacttgtttatgtgctgttttggtgattttgctcttttctatttagattccgacgttcccggagagtccgattttgcagaagactttgaagagttccaaggccagcaaggcaagtcacacagatcgcaaacaaccctttgagtatgttgatcccgtttaaagctattgtttctattcaactattgcatttatttttgaatgtcatttggtggaaatacctattgccttgttatagcccttttgctattgatcccctattctttgtcatctggttaataaattgattagctagaacattatatggttttagttaaagtgaataggatgcttagccatgcttagagacaatagctcatataaatgggataacttatgattcactattatttaaggatggcttaatgatagctcacgatgattaatcgtgattggttaattaattaatttgacaactaaaaacctgataatggtggggtgtgagcacatggttttgatggtcgtgctcatgacaattaaggaccggttcacgattttcggttgtgaaacatttaccgtgccaaccacaagccagcgtgggcaacggctttactttatgtatagtatggttcattgtagagcaccagactgtgaagtggcggagataagaccacaggggtcgctggggagtccatgccttatttaagggggtgattatgatccgggaacggtgcactgctttgaattgtattatatagagggtattgtcacaatctctattcgggtacttgttaagtatcacgacgcatggttgacatgatgttgaggttgtgtcttgtgggtacagtggtacacctctggccagagtttaaactgttcgaatagccgtgcccgtggttatgggcgggtctaacaatgtctttcgtgattagttccacacttctcaccataataaatgatgctgtaattggtaataacttgtttagctcctggtttggaatggtatattcctggtttggagatagaactgtgcagcctgaattggttgttccgaatggttgggcctatgcaacagggtatgttgtatagtgttggagtaatattgtttaattaatactttactgttttatgaaattctgaaatgtttattaaatgctatttatgcaaatgagcctatattatgccttcctttattatcctgtgcacttgcatatttgctgcgtggcttgctgagtatgtcatatactcaccttgcaatcattcatcagaggagttctacagtgatgctgaaggtgtggatgattaggcgtagccctggtcaagctgcctgtggaatggagtcgtctgcgctgtttatcttattttccactgcttagaactttgttgtttgagagggactatctaactctgtaatgacattttattcgcttattaattagagtaataattgtactctattatcaatttgttattgtgtgtctcggctgattcctagacgagggttcacacacatgtaagcgtttggaattttggatagaaattccgggcgtgacatgtcgctaactattttcttcatcttcatgattggtggatttcgccatcgtcgttgatgtgcatctacggcttcatcattggcttgctttcattgccaccgactcgtatctttgccttcatggctggcttattatgccgccgctaatgagcgtattcatcttcttcaccagctgcctcgtctgtcaccgactaattattttgccccccatggctacacaactctatcaatattgctaggcgctttcatcttctctgttggctgacctgactgctgtcgactgatttcttcgactccacggctgtgcgacttcatcacctttgattagtgtcattgtctttaccaccaccaataatcttcgtcacctctgatgggcgatgtcatccctatgttggtcatctcgtttccatgccgactgcataaactaccgtcaatagacaattacgactacaacataagtataggctacatgcttagggggctcatcaacacaaacgcaaggatcatatcttcaacttggacttgtttcagatacatgcaacatgaatttatggtcatgagtcgatttcttatgctcaacgactagactattcattattccccacgagggccatcagctgagtatttgagccagactggatttgattatcatatctactttggtacaatccgtgagggatagccacttggattagaagctactcagatgagatgaagttgatctacatcacccaggagatttgtcactcgggagcatattgataggcgtgttatatacgtcatattctaagggtatcggtaggcatattttgggtctaggcctaagatgtttgcagcctatattttcaggtgcagcatgtcacgttcttttagggacttaggcattttttgtttaggcaaaagtgcgcatgatcaagtgcctaataccttaaaatctttttataccgctgttactcaactttttaggagttggtacaatgcattttaaaaggtgccaaacagtgaaactttatatagctgccccgttgacttctttatatagtcaaggcactatttgggtatataaagcgatcgattggatacaatatcgttgcttttctaccatgtaagtgtgcatttttactaaccaatattatggctcaggctgattatatattttggtcatttttcaggcagttggtaaatcttttatgagtttatttactcagattttacactacatatgccatatattttcaggtgtgatgaaaccatgtgtcttttagggatttaagtacatttgttaaagcaatgtgcgcatggtgtgtgtgcccgatactttggaaatttgtttattcacagcatacaagcctctttgtagctgttttgttatgtgaattttcaatgatgtagtcaactttgggttgcacgcattatattttataaagcagacggtatatcactcggatcatgttattcggggattcacaccgcatatgctatatattaatattaagtcacttggttgactacaattatcaaagccactcagttgattagattatttactccttgactatatgtttagtttgttcaactaaccacagtcgggggctacacctattaggtgcatctagtcgatgcacctaagtcctaagtttatatttaattattttttaggcctccacagtcttcagatttggtaaaagtactcaggagaccatggcgaagatgattgaagcactcggctttggagtcatctagttcgagagaagattatcttttcgactttaaaggtctcgagggctactgtggagattatgggtactccatacccacacgaaatggttatctgactggttataggggatatcttatatctatgtaatatgtaacggatcatgacttaggtattacgtttccttgtatattacggaatggcctaaagtcctgatttgataatattgtaaagtagatttaggaaaccgataccgtattagttaaggcttgtatcttgtaatcctgccccctatcctatataaggtgggcagaaggtcctctagggggcatattgacacaacctgaacgtcagatcaatactagacccggcggattcaaatgcccaacaggagtagggtatttgaaagtgtgataggctcaacacgatagattagattatcacatatggtagagtacatataggcacatgccttccatatctagcaaccgatatatagaaacaatatcggagaagattaaggaaggacacccccccaccccctccccctccccgcagtcggaacgtcggtggaacggacattcagactggaccaaaactccaagaagatgacactgggtagccctttagtaaagatatcggcgaactatgatgtagtaggtacatgcaacacgcgaacagatccggcagcgacgcgatctcgaacgaagtgtagatcgatctccacatgcttggtacgttgatgttgcactgggttagaggagagatatacagcactcacattgtcacagtaaaccagtgtggatcggctcggaggggtatggagctcatggagaagctgtcgaagccagcaagtttcagccactgcattggccactgccccatattctgccttggcactagagcacgatacagtaagctgacgtttggaggaccaggagaccaagttgtcgccaaggaacacagcataatccgaggtggatttcctggtgtccggacaacctgcccagtcggcgtcagagtatgcactcaagtcaacagtggaagagcagcggatgtgaagaccataatcaaccgttccacggacatatgtggctcccgtggatcgtgcatgtgaaggcaaacctgctaaacagcataggagatgtctggcctggtgaaagtcaagtactggagagcgccagcttgactccaatagtccgtggggtcacgaaccggggcaccatcggtggcagacagcttggcgttggtgtcaacaggagtagcacacggcttgcaatctgccatgccagcatgttccaaaacctcgagatagtactggcgttgactgagatgtaggccagaggattgccgagaaacagagatgcccaacaagtgatgcaagctgccaagatccttcatcgaggattccgactgcagagcacggatggtccaccgaagaggtctcgagttcgaatcctggctggcacgcaattaaataaaaattgtagcccacttctattccacgatagaggcttgagggggtcgcgcgtgagggggagtgttggaatataaagtgaattgcccgcctttcctcatcagcttaagcttttgggttgaactggtcggtgcatgcaactcagtattacctctcatcgagagggtctgaacctgtctacatccttgtctccacatccatccacttttaggtctcgtgcgctatccctttatattgccgaaatcttgtttcgacacaaatacaacaacttctagtttaaagatgtgtgtggcaccaaaaagaaaaaaaaatgtagggtcaaatgcgaacaccaagcctaccagagtggataaaggaaaaaattataagatcaaatattctactaagcttatcataaaaaaaaaccaaatcatttttgcgtaggcagacgatggacatggcttgggccggcctgagatgactcgggctggcctgggccgagattaggaactggccatcatttactgccatgctcaacttatcttttttttttcctttatgtaaaactgatggttaattcaatgtacctagaattacgtggattttgtaaaagaaaaatatttgattttcacaagatggatgtatctattttaaatatgacagtattaattaatcttttttctcagggcaagtagtgacaatattgatcttattctatgataaacatttcaaagaggtgctttgcaggtaataaatatgaagagaggattttgatcttattctatgataaaccagcatcgtcgtctccgccttctcagtctgccgcgccgcgccatggttgatctgacgccgaggcctccatcgtcctccgccgctccgcgcacatgcatcttgctgtcttgccggcggccgatctcatgatctcatcggcgactgtccgccgcgccgccttctcagcgcgccggcggcctacgtgaggcggtaacgtccgaggagttcccggcgcctctcgaggtagccctcgtcgccgcgggcggggacgtcgtcgtcatcgtcttcctcctccgtcgtcgtcacgaccttgggacgccgncgcacggcgagcctcggcttgttgcagccggagctcctcgtagaaccgggtcctttcgaactccttgccaagctccttgtcaagatcgacgacgacgacgaccggcgaagccggacttcctctctgctggtgccgtttggtctccttctcgatgcggcgcttctcctcggcgatccaccgctgcttctcggcctccctcgccacctgctccggcgtccattgccgccgtttttgcagctcgtacgccgccgcaggggcgatgtcccacagccgcctctccagctccagcatctcctccttagtcgccgccgggacgacggcggaagagcggcggcggcggaagaagccgggcagaatccgcgaggccatctcgtgctctcgataatgcactgatgagtgatggcctaatgctaatgacctatatagccagccatgtacgtgtccgcagtggcgaagccaagatttagagatggagggtgccatctacgagacatggcaactcacttaaggtttagtgaacagtgattttgtagcgttgatgtatgatcggtaactcgatatcatacatattacagcgattagctacaagagagaataagaacccatatatcatgatttgccaatttaaaattcagtaatatttttaatatatggatgattgaacagtttgtttcattaattggagtcttgcaatcacttctaaaatgattgataaatcatttagctaagtcatttcataagtcctatatatatatagctaggcagttgtcctgtcctatatagttagtctcatctgcaactaatgatataattaatagctagattataagtgctaatcatccttgggagaagagaggggaggggaggtcacatagaggttaggggggtgttggccctccctggcccctacgatggcttcgccactgcgtgtccgacacggagtccgaatcaaaagcgaagtcgaatcggagaagggcgcgaacgcgtgagtgcatgacacggtttccaatccgaatacttgtcgctgttggatttatattaatcttgccgctaatcagaatcttgctacaaatctttccaaggcgcctacaaatcgagcgttgtttcaccaagtaaaatgaacgtgtctcactaagtagatcgaaaatgtttcaatcttgtaaaaagctggaacacaaccaaatcacctcatgaaacattttgctacaacatatgatataacggcttccaaaaaatcgggcgttgtctcaccctatataaaacaatgttttatcaaatagtgaaagaatgtttcaattcttaaaaaaagtgaaacacagtaagattactagatgaaataatttggttcaacgtatacaacaaacgatttaaagctattgcaacgcttaaaccccgtgtacatcaacaaaccacgtgtccattaagatgaaattatgtaacagtattaaaatctactgcaatatttcatccatacatagtgaaacattgttggtgaaaaaaaaataaaacaaatccccctaatagagcgtttccgttatatctgatagttgttgcaacggagcacgagtggtgaggacacgtggtactggtagagccggcgcgtgtgcgtgagaggcgaggcggaggcgcacgtggggggcaccccatttttttgcgccgcatcgggcgctccattttgatcatttgtgaaatctttcgtgctttgaggaattctttcccctctccaaacagccaagattttttttttaatcatatccttgtctccatccttggaaagttcacaacttcacatacgcatacggtgttttttttaccagtaaaacttgaataaaacaattgcacctttccagatgctaataagtatgaaaaagaaattttataatctaaataggcataaggcgcatgatacgtagagagacgtaaaacaaaataaactgtcaaaggtacagtaaaggcaaagtaaagtggcaatttcatatgttgtaaaatgttcactgattgacaaaaaaaaaacaactagcgaatagctaaatgatagcatcaacattcattttgaaagcttaaagaagttgaaagttacagcctttcaccctttcattttgtactaccaactttcaacaaaatttgttggataatttgctcaaaagatgtaaaagaaatctgaacattgtaccttacatcccaatgatgcaagattgtgattcctcattcccctgcatcacagatgcttttgatcaagcattattacaagaaatgccttctgattattaaagttggaaacatct

SEQ ID NO: 65173 - DNA, 658 bp, Oryza sativa
ccaaacaaatcgagaaacttaaccacatgtgcatgcatctcctgatcaactcatcccccctttacttaatcatctaaaccttctttcagaacttttgccacggtataaagggtatgatattttcatgcccacaaagatgcagcttaatttaacatacactcacctccaccacaggcagcgcatcagtccaactccctgacttaataatctaaccttcttccgctgcctgatgcttgccctcgctgacccagccgccgccatcagctggcgcacgtggccaggagttaggcggagggggacggcgacagcggcgcataagttgatgagacctgaggtagggcaattgtaggtgagcgagccgacggcgtggaggagaggtgattctagtccaatggagacgagatggggagaagggaaatcacggccagagaaaggcgaaccgtcctgctcgatgactccgctcaccctaactgagccttctcacaatgcgcctggagccgagcggcctgaaccggatcccgactccatccacgcgtcgggcatccgactcgggattgcagggattggggtttgcagctggtatccacaacgtgcgcaggcgtgaggagacgtgcggagtggtgggtcccacgcagagtgggagagtgctaattggatg

SEQ ID NO: 65174 - DNA, 658 bp, Oryza sativa
acgtcggcgtgagcgccaccgcggtggcgccgcacacgatccacgactgctgcacgtagaggccgagcacgtccagccgcccggcgcccaccgcctgcccgcacagcgtgtccagcgcgcaccccatgccaaactgccatggacgcgcatctcacgtcatcggtaccgtccgcgacggctagcggcggcggccggccggaatgaacaatgccgaaagaaagctcgaggctacgtaccaggacgccgtaggcgaagccctccaggatgctctcgacggcggtgaccgcggcgagctcgaccacgccgaggtggccgacgaagctggccgtgacgaagccgatggagaactggagcaactcgacgagcacggccgggaaggcgacgcgccacagcagcttcgactcctgccagctccggctcacaagaccttgcccctccatgctcaccgtaccacgtataccaccactattatttacagctttaccaccatctgcatcttgcaacaaacaaggagagcatgtgatgagtttgttgggaaatggccgtggtcctagctagcttcctcatcctaattattgtcagataatggatataatatcataggaagattatcataaccagtaagaggtgtgcaggtcatcttccagcagagcatatt

SEQ ID NO: 65175 - DNA, 673 bp, Oryza sativa
ttgaatccaactcgtaatatggaacaatgttagattaagagatcctatggataggaaacatctgtgtacatttttctacgagatgaaactggtatattttatattagtgtagatatagaaataagagaatagatgtatggggagtgagttcagtcaatgacaagtgggttgagatgagaccttgttaatcttaccattttgcagctagctcacattgtccaatagaaaacatacagtaactatatacgtctggttcagcactgaacccaacgaaccactgaccaacttggtgatgggtcgaccaccggtccagtttttttcactatggtgtccacgaaacactcgtccgcgtcaacaaaggtgggtgcatgtataaatagtcaaatgggccaccagacacgtcctggcccgagcatgactcgaggaccgaccaacttgtcatgacgtgccgtgcccgcccaccgactacacctacggcccaggcgcggcccaataaagcacaggttgtgccatgccagcacaaaggcacgatcagcccactgtgctcgtccttcaataaagtctattgtacctcactcatttctttggtccatgcctcatatggctggaataagtttattttacctccctcatctctttggacagtaccttatatggctggaataagtatatt

SEQ ID NO: 65176 - DNA, 14146 bp, Oryza sativa
ttagctagcatgaaacgaccggcataagatagatagatagatagatagattgcaaaggggaaaaatatgttgggaaacctctggaatctggatgatgtgccttttgtttgcttcttggtatttctttcatagggatattctctacatttatatcaaagtggatagataattgggaagtctctataaattggatttatctttttcttttattttgcctatttcttatgcttaattttcttagatttatctcaaaatttaatatcgccatgtggctcaataagatggctcgagatacaagctagttttagaaagatagaaattccgtgcgtcttttgacgcgctcatgttatagcctgtccgcattgtttctgtgattagaaagtagaaattttgaaattttttaaaagtataattttcttttgttaaattttgaaaatcttttaagtttactctattttttgtctgaactatttagggttcctttgtagagtaaaattataattgtattgtctattaattgacaaaataggtgataatattttactccctccattccataatataaggtacaaccactttttttaatgttccataatataacgcatgcatgcatgtaagcaattaactatgatcttttctccattaaattattactttttttaaatcctctactctcatgttctctaattctattggatacatgtattatatttattaggatgatccaaactacaagataataataattatttcttggtctttgggttagaggtggttatgccttatattttggaatggagggagtaaaaggcatttgtttgcaaatatatatatatattttatgagctaaaggatttaatataagtatctatgttggaaaaaattatacttgttgataaaaattaaagtctaaccggaccccactgatctatacctgatattttgctccttagtaaaattcttttaagccccatcaatccttctagatccttccccacttctcctttgcattttctcttttctctctgtgtaaactatagtatctaggtctattttttttcttagtcatgtttgattctctttttgcctatggatgtttatttcctttttctatcgagccatgtaggactcaggagatggttcagcacttcagcactgttaccatatttttgcgcttatttttttctctcgtataatttcaagatttatttgtagtgtgaaaggtgccacgtggcccaatcatcgtttgcatgcacagccagcattaaaagataatactagaaaatagacgcgccagttggcgcatcctctgattatataacatgcgtgtgctatttagtgcttcttccaagtgaggacacatgagctggcgttttccgcggattatacatgcccatattcttcctagcaaggactatttaaaggtttctaaatttgaaaactaaatcaagtaaaagagtaatgcatttggtcataattcctccgtttcacaatgtaagtcattctagcattttctacattcatattgatgttaatgaatctagctagatatatatgtctagattcattaacattaatacgaatgtgagagaggctagaatgacttacattgtgaaacagagggagcatcatttaactttaatgaataaataaatgtagcctaagagaaaatattttgaatattaaataatatttaattttgcattgaacatgcataaatactgattatgtatttttattttattttacttattattcatgtctagttgactttgatctaacttggtcagttggtctcatggtccatcggcccaatcggcatatatttggcacaattagtcagtccaggagtaaggagaccaccagacgtcttctcgtgtttctcaatggatcgatggacctctatctctctagcttaattctttttctctctcaaataagttgtttgggatttatctgttaattcagaggtgacacgtggtccaatcaatactgccgccagcattagatagattgattaataactcgccaaatttcataaatcggaaggaatccgcgtgcttttcggatacccgcttcaaatcggactccgactccgactcgctatataaccctaaatcccctccctattagccctaatcccctattagccctaaacttcacaaatcacaaccgcatcgatcgactcgactcgactcgagccatgtcgtcttggattctccccagctgcttcttcccccgccgctctgccgccgccatcgccgccgccgtcgtcccggtggcgactaaggaggagttgctcgagctggagaggcggctgtgggacatcgcccccgcggcggcgtacgagctgcagaagcggcggcactggacgccggagcaggtggcgcgggaggccgagaagaatcggtggatcgccgagaagaagcgccggatcgagaaggaatccaagcggcagcagcggaggaggaactccggcgactccgccgccgccaccaccaccgtcctcctcgacggcgctggcgtcaatcttgacaaggtgctcggcgaggacttcgagaggaagcggttctacgaggagatccggctgcaagccgagacccgccgccgtgccacgccggaggaagagccctccaccgccgcggtcgtcgtgacggaggaggacgacgaggagagcgacgacgacgacgtccccgcccgcggcgaggagggctacctcgagaggcgccgggaaatcctgggacgctactgcctcacgccggcgcacgatcccgcgggcagccgagcagacatcaagatcggcgaggaggatggaggcagctggtcgccgtttttgatcgctcgcaacctcggccgccggatcaccctccgggcggcggactgacgctgacaaggcggagacgacgacgacgacgcggccagccaacgaggcaccgagataagatagctgcagggcttctagttggatgaactactagtcatgtaatctattgatcccaagttgtgatcaacatggttttgcacgaatttgtgctatgtaaatgctaagaatgtatacagtaatgttctttttgtaaaaacacaggggattcatcaaaatcccctgttcaattcaatttataataaaattaggtgaaaattacattgcaactcaaaacgaatcttgtgctttgatgattggttctgcaattttactgcaaatctgaaattctgaagagtgaagatggaagttgtctgatgtattcagcagagaaacctgactaaaaacctgacattaagtcatggactaagacattattatggtaaaactttttttgtgaagtttgttttctttgaggtagtaggagaactttctaaaattgttgtatgttgttcagaaatttaactctgagatgtaattcaagtttgattaactttgtactaacaacatatgttcttaaccatgttactttttttacatcttgaatgtaattacatgttaatctctccagggaatatggcacacaaaaaattatcttatgcgcgtacatttgaactgaatttttaaccacatcgtcctcttccccaacatatcgagcccacgagcagagcaaagcagaggcacatagatgcaccttccatcaacgtcatcagggacttcaccaagatcttgattactcgtgaaggccggaaccacgaacactggtgccctgtcagcaaccgagcagattttttttttactgaaaaaggtagagagactctaccttataaccattgtattaatggtagtcaaggtgttgcataaagagttacaaaagaaccggatgaagagggaggaatagaagaagaagagaaaataagaaggaaaaaaggaaccgagcagattttggttcagaacaagtgagattcagataatcggactagtggctaactaactaggaaccttaacacagcaaaatagtaaagtaattgatgaaatcgagctggatttgacaacatatagagtgcagcgcaagaacaagaaatgaggaataaaaacttttcgcatagtttgtttgtgactgcttcgtggctttatatcgagtccagactccagagctacgcgataaagaatgatgactacagtacggcaaacaaagcaatctgtagtccgtcgcggcgctttgtagcccttggatctccataaccatcccagcgaaccgttatcctttaatcccaaccgttcatccactctcccgtgtataacacacagccgcgttctgatttctgaatcttcaagtttcttcagttatgcaatcttcagagtctcacgcgcgtggcgcagcggaggcatccgccgttttgtgccaagcattatacatgttgttactagatcctactcacccagatatatcgtcttttccttaaccctctttatcccacactcttatccgtcctgcacatccatcttatagagcaggtttataggagcttgtgccagtgcttgttcttcgctaagcacctgctcctctctatccctctatcttttcctattatacttgctcttaagaccacaagcctctatagcagggttgtcatcactatgacttcggcgcaactatgccatgttgactttaaaagtcaactccttttgacttacaagcaagccaagtaaatactcctaataaggccgagttcgccacaataaattgtctgagatagtatcgttctccccaaacatattttcgaaaatgctaaatgatacgttttataaaaagtagttaaatataaaaatttctttagaaaaccaaataaattcatttttaatttataatttttaatatttaattaatcctatgtgctaatagtgatctattccgttttaatcagcattcggccacactacgttggctccccgacacgtgccagccacactgaccaaatgtagctgccagctgggccccactgccactaggacgacgacaccacagaagctgcttacacgttccctttcatccgttcgtcaaatttttttaaagtttaaatttcgcaggtaagcacggtttccagagttattttgattctgtttcgaaggacccatggattgaaatttgaaaactcctggtgtttttcgagtcggagaacagagtagaatttccaggtccaaaacatctttaattgtaaattttacagctcaacatggcttctagagtttttattcgattcggaacgtggattgaaatttgagagttctgatgcttttcaactcaaacgaattatgttcttttgcaaacagagaggattgatcaagatcccctgttcgaattatgaggaaatcaggggaaattgcataggcaactcaaacgaatcttgtgctttttgatggttggttttgcaattctagtgcaagtctctgaaattctgaagatggaactccaaacacatgtgttcctgcatgcttgtgtttgtttttgacggtctgatgcatctgaaatttcacttgggatcatccacagcactgaattattcctaatgaattattcagcggagatatgatttgctgaatcgttgcatttgcacccgcctgaataaaaaccctgaaatttagtactcgaccaaaagaggagtcctcaaatcaaatggagcacaagattcagaaatttcagatgtttatttcggacctgttcactttgatgcaattttcaaccttaccaaattttggtaaagttgtcaaaaaatggctacatttagtttgctaccaaattttggtaactatataagaaatcctgccaaaattttagcaatgccaaattttgataaggttttttttggcatcaaagtgaacaggcccttcgtgtccaaaatcctgtccccaaacagcgcattctgttgtaccgtcactcatccgaacaagggacccatttgcataattttaacccgcggccaacttgtaccatcagatgataagcttgcggaccggattaaagcacacgggaaactaaaagtgatagtaatacgatccaaactatctttgtgtttaactttttttcacgcagttttgttgttgttgttgttgttgttgttgttgttgttgtaatacacaaaaactacaacgctcgcagctaatggtagcgagtagcgacccaaacgtggagggactcatctgcataattccagcacgaggccatctgagagccgttagatgacgagcgtgcggtccagatcctacggcgtctctctctcgcctcacctccggtgatttcaacggtagccgttagctgtacccccaaaatgtacaatcacgcactaaattcgaatccaaaattttcgccataaattttgcacgtatttgcccccacgtacacgccgcccgcattcactgcgtgctgctcgcatttgaactgaatttcaaaaccacctcgtcgtcttcttccccccaaatctagcgagctcgctcacgagcagagcgaggcagaggcagatgcacgtgtgcttccatggcggcggcggcggcggcggcggcaggctcgccaagtcattcaacgtcatcagcgacttcaccaagatcttgattggtcgtcgaggtggagaccacgcgctggcgcggcggcggcggatgcggcaatgcaaggatgccgcgccggccgcggcggcggcggcggtggcgtccgcgtccgccaagatcgcgccggaagaggagggggaggggggtggaggaggtaaggaagaagagttctgcgacaagtgctgctcggctctgtcgggaggcggtggcgcggaggatgaggcggcggcaggaggtgagccgggattggtggccgaacccggacccgggggtggttgctgacgctggcgccgcgcgccgacggcgtcagcaaccggctacggaggatccgtcaagggaggaggtgttcaacccgtggcggccgcagtgctggtgggcggacaaccacgaccgcatcgccgagttctactgcctcgtcaagcccgacgacgacgacgacgaggaggaggcgatagccgcggcggatgccgccatgttgccggccaccccatgccaatccgaggcggaggacgacgacgacgacgacggagcagagtcgtcgtcacggtcgccgtcgacgtccaccttctccggtggcccttccagcggcagcggcggcgggtcaaccggcacgttgggctcgccgatactgggcctcgtcaccgcgcccaacaccaccggaggcggcgagcacgacgccgtccgcgaccagcaccagccgacggcggcgacgtggagggagtgggtggaggagtacgagcccggcgtgttcatcaccgtcggagcctatcccggccaccgcctccagctccggtgcgtcgagctcaggtacgccgcactttctatcgcagctccggcgtgttcattcatccatggcgtgtgtgactgattgcgtcatgctgacgtgtacgggtcgttgacttgtgccgtgctgacgtgtgcgcgatcgttgacttttgtcgcagccgcgagaagtttggcgaggtgaaggcgagagtttggtgggaggagaacaaggccaggctgcaccacctctactctttctgaagccttaattttcgaggctatttatgataaattttgtacaaattacaagtgaaatgaggaggttcaatgattttgcaattcccgtgcttaaccctgcttgctttcttggaggaattttgcaggaaacaggcatggattctataggatatattcacttgaatcagataatttcttttaaaattaccgtagaagatatattcactggaatttgttaatttcttttaaaattacagtagaagttttccatcccaaatgaggcttaaacagatttccgtgaaaaccatgtaaatttcgaaaacaatagtaatcatacgatgcatatgtcatttatagcgggaatacatattactcgtcttattgctatagtgaaacagtgatcatactactcgcactggcttaattattttctgtttctattgttcatgcaaaatacaaagggtttaaaattaaatattagggcacagctagcttagccgatcttgggaggtctggcgaccttgtcgtccgagtcgacgaagaccctgacacggccggcgttgtagtccgtggtgacgaaggcgtcggcggggaccacctgcacgtccaactccggcctctcctctccgatcttcgtcttcgccgcctccgacgacacgccgaccaactccggccacgaatccttcgccgccgacggcgacaccaccacgccaccgccggcagccgccgccgctccgcctctctccatttgttggcacggtgtttgtgtagttgcgagttggagaatgcacaagggattttatagatgaggcctgaggcacgggacgatttgagtgttagaggcgacgatatggacaaacacatggcaactcgatgcaataatctcttatattttcagtgcaacactggagagtaaaaaaaagcaaatgactttggccggccggcaggatacactagtctaagatgcatggttaacacctaacctagggttctgaaatcactactaggtaccaagaaaacaagtacaaataatgagtaccaaaagaaaacgatggaaaccgttcgtgcaatttgataatgaaattctcatggtcatatcggcaaaaacatcgaacggcagttctttcatttctgggaagcaagacgaagcgtctgtttgtataatcaagatgcatcgcaggtgaacgtttgctaatttacttggcacgactttggctgtgtttagttcacataaaaattgtaagtttggttgaaattgaaacgatgtgacagaaaagttggaagtttgtgtatgtagaaaagttttaatgtgatgaaaaagttgaaagtttgaggaattattttggaactaaacacgatgaaactgatctaagtcagtacgtcacccagaaaaaagaaaactcactcgaatggaaactcgaccatacctcaacccatcataaaatgagggaaagccgtaggattaccaacactctactgttcactcagcctcaccgatcaaaacattcacacaaacctcctactactaggaaccatatgcaatatgcaatgcaaataccagtccatcagtatgcccacaagaatcctcatcaacggcttgttctggcaatcatccatcaaccacaattgtgcagtcgattcaggaaacaaacagtcattgaatggagtccacataccggaatcaaccccagaaacatgtcagattgcatgtgatgcagggagggacaaacaacgcatggaaagtggtatctgcagtcctggggctggggaactcttggtttcctttggatgaagaatgtcacgtgcctgtggtttacgatgggttttgaaccttatacatcagtgagatgttggacttgagccactaggtaggtgtaggcccatcttgtcatagtcagattccttccacctcgaactcttgtttttcctccaatctgtttattctgcttgggcatgatgctgacaattgttcggttcaggacacaagtccatttcagttatatatacaagcttcagagaagatgtgatatcacatggggacctgggagatcttcatttcaagcaacactcttaaccaaaatgaagcaggtacagtatccgcttgttatcaagaaggttgatggaacttgtcctagtctcttcgttttccataagaaccatcatcatcaataccgctacacaacatggcctcgatcaaacagagttaagaaaggctttcagttcaaccttataatagttcctgcctcacatctttcctgaatgcagcacacgatgagagcaacttgttataatcttgacaagctggcagctgaaagtttctacagctccgtagtacataatcaatatctactatcctttctcccaaaagaacaatgcctgcttatgaatcaatcatccgaaggtgtcacattcatctccatcaagcattaatactgtagatgcttatgcattctcctggttgatttaacattttgctcgtgtctccagttgatggaacattttcgtgtcttgagatcagaaagtttagatatgccgatctgttgcttgtccaaagagcacatgcctagaagcataactgatctgctagagaagattcggcatcagcagctccccgtattactgttttcttcaagcagatgtccctgtcttctcattaatgcaatatatcttcagtcagagggacagaccaactaatgatttcaacctgcatggtcaaaaacagcgttagacatttattggaaaacagaaaggcataagcagttgtgtaaatagtaaacaagaagctattgtaataggagaaaagcagcacatactacagaaattatactttgattactcatgaatataacagaaaccacttaatcacttaacataaacatgtcaataggcatcaatctgataataaacagaagggagacgagtagggtaaaaacaaactggaactcatatgcagctaaaatgttcaggaagaaaacaatgtgcaatttatacatgcaaaaaaagagtttgtattaagttgatcctctccatggatttagatcaaaggttacatgctagattatagtctcaatttcatcaaagctgttccgcttccatttcctaactgcactgtaccatgtacccaggtttatcacataacaagataaatcggtacactgagatttcatgttatccaatgtagttccagtagaagttttggagatgcagcaaggatatcactccagtttttaagccagcagaaatttgaaattagaagaataattctcgagatacagattagtaatcttcaaacaaaacattgcaggaaatttggtcttatacccttagttgattcaattgttgtatctattatctagaatttgaataaaataaatctaagctacatatacatccaaatcataatattcttgagatcatggactaacatttcaaaaaccctaccacgaattcaacaaaactctgcttcaataaaggatgctgctttctaacagtacattttttaaaaagtccaaccatgtgtgaaattataacaaacatgtgactaccattttcatgacaagtttaacagcattttttttcccaaagaagtgccatgttttcttcagtagttctgtttagcaacacagttcacacagatgtagagtaccataatgtttctctcaaactagtgaaacaaaacaagcaacagcattaaccatgaaaagttagctgctttctattctattcccataattgtttgcaaacaaaaaggggaaaccatagtcaatttttcctgtcacgtaaaaagaaaggctttacacgacatctatctcttctgagcaacctcttttggattcttaggagcacccttgcatactgtctacattgggttctttattatattatctcatttgagggacttttaggaacgttcagactatatttagtctattttggaatttactgtctcctttttattagggaggcggttaaggacttgagaagatagaggagagtgccatgcaccgatttccggaataacattcatcactcaaagccccatgccctcacgaggtttacaagcatcatcgacactatggacaccgcacaccacagtgagcatgtttccaaatctatcgtgtcaaactgcattctcaaacaccctctagcttttacgtaatcaaatatgatcatgcccacaggaatgtcatgccactaccatcttctcaattccagcagacggcttcgccttgtcatcatcttctacctagtgagtccaattacttgcatcaaactgcattctcgaacgccgctatattgttgtcattccttcaatcatactttctctttcataggaatgcgacaccactaaatttttcctcagctccagcagatagcactgtgtggccatcatctttctccctagctaagtctccaatcatctttatccctccctccccactgccaatgcatggctctatcgtttggatatcacagtacaaatctattgaagtttgtgtcatcatctcttagtggtttgctgtcctggaatttgatttttcaaacacctgccttttccaatgatggtagaaccggatccaacactttcaggatatctccccatgctacgctcagcatgtcccaccatcagaactaacctaatgtaatctaacctatcttcagtacggacaacacttaatatcttgcagtggaatacatctaccagattacgctctgcaaagctcctcactcagcacacaatctatatccaagtccccatcgcactccacaagtttgggacgacccctttcttaagggcaccttaacaaaaggcttccctactaaaccagtacattaggtacgggatgactgctcaagatttgttgtcctcgagaacacaatcaacaatgcctcccatacattgtatgacgaaatgactcctcactatccaaggcaagtgcatggtctatcacccatcacttacatctaagcactgcggcactcgcatggtgccttactttgccccttctatgatgccatcaccagcaaggcgactgataaaaccaccccttcactaactcattccattatttggggctcccgcatgttcactagacaagagcacaattatctcactgcttctctcccttccacccagcacccctagctcgtagggccatatgttgggtatgttaccactagctcaaaacccaccagatcattattctaatgtggcaaccttgttaacacatggaaaaaccatcaacctattacctatcacaccacttaagcaatacaaaatgtcagatgagtggttttatagttggaagtgttgggtagactaggggtcatatggacatatttcttgccaaaacattaatcatatgttacctaaaggcacaaatgccgcattcagctaagcttattcatggcaataaatcaacatatatggggataaccatctgaaggagaagcctcatcaccaacaaggtttcttggaatatggcatattaactgcttcactaagttccaaaaggtatcaaccagaagaacagttaagtataggcttggttctaaatttccaatggtacaggatctaaaatcaccaattctcagaaggaaaatgatatctagcatacgatatgggttactctagagcagcagagctgactcaaatatcctaagagcatgcaagctaacattttactagaggttaaggaagctgcattataagaatagaacagataaaaacttagtgcaacttctgctgtggatgaagaaactacttgcctcatggttgccaagtcatcaccagcttgtctgtgtcatttgaaaacatcagaacggtctctgtaattcgatcaattttattatcatttcctgttctccacaaaagctataccccatgaaccaccaacacaacttaatatccataagctctttacatggaccttgtatgttaaagggtgcacccatgtagcccaaaaattggaaggtaacctcttcagccaccttgtattcagatctgcagcatgctttaagaagtctattgcagacaggcagagcacaccaaatttccattggctgcaaccatacagaaccactgatatcatttccccttattgaggcagcgttccagagctaaagagttcatacagttcaggcatgatacactattttgtagatatatggtctttccaggcttaggcaaatgacactccgcaaatttgaaccaaacatggttatgcagacctttccggtagtcgatcagcaatgcccaggttccaaaatacagaaaatggaccaaaatgccaatcagcgtccatagtgctcatcttgaagatatcacatttagaacaggaggcaggttcatctagttgcaatttaggcatgtaactcagaaggaaccactttatgcatctctaacacctggttgatgatagtcatgcatagttccacctacactttgcaagaatttattttgcccgtcatcattccaagagtacaaggtaaagggcaaatttagcaacagtgatgcttcactatgtacagcttaacatcacctagaacgttccaccatgaaccccgaaaaggctagtagcagcaactcaaatattaacctcaggttttggtagtacacaa

SEQ ID NO: 65177 - DNA, 13628 bp, Oryza sativa
caatatccgttgtgcgagtactttcgacgataggccaactacggtataacgctggggctcactctgttttcttctatataaatcatgcttgtttacggtttacataatgcctgataattacatctgctcgttatatcctgataatgctagaagatccatgcagttttttgagtacatactcgatattctctgctatatattttgccttctagaaaatatttttcaggaacaattgagcactcgattaggttatggtcgagtacactccattatcgagaacattctcgacaaatgcggagttatcgcacccaacctaccaacaaagaccaatgacctatctcatagcaccggccatggctggactactcaagaaaaggttgttaatggataattcctcgcgaacatcgtcggcttgatcacccgacatgattgcgaacggacatccggatatgctataagttgggtacgtgagtcatgctgaccacatgagatacacttgcaataaaccaactctagcgcttccatcggtgttcgagagataattctgctcgctcactggttctcgcgccagtacgtagcaatctctcgcaccgcagcttccatcggtgttcgagagataattctgctcgctcactggttctcgcgccagtacgtagcaatctctcgcaccgcagcttctatcggtgttcgagagataattctgctcgctcactggttctcgcgccagtacgtagcaatctctcgcaccgcagcttccatcggtgttcaagagataattctgctcgctcactggttctcgccccagtacgtagcaatctctcgcaccgtagcttccattggtgttcgagagataattctgctcgctcactggttctcgcaccagtacgtagcaatctctcgcaccttaacttcagatggtcgaggtacgactacggcagcgtagcggtcctcgcaccatggcttcagatggttgaggaacagctacgactggtcttcgaccggcagcgtagcggccctcgtaccacgactccaaatgatcgagggacacctactcaccggttctcaaccagttgatcatagtgatctctcatacatttgcttctagtggtcgagttacgactactgcctcgtcctcgaccagcgatgtagcgtctctcctactacttccactttaagtggtcgagttacgactactgcctggtcctcgaccagcgatgtagcgtttctcccactactttcactttaagtggtcgagttacgactactgcctggtcctcgaccagcgatgtagcgtttctcccactacttccactttaagtggtcgagttacgactactgcctggtcctcgaccagcgatgtagcgactctcctactacctctatttcaacaaagttgatagcaggtacacaatatcgccaagtgttttacccagagatcccttgccacgacgacacctagcgttgaaacctatcctactgtccctttacgccgtcttgacaaggcctccgaggaacctaagggatcttcggctggggacgcccagagccaataaggccttgtcggatcctgtagagacaaaagaccatgtaagatctggtcatgtaagagttctcgccgtgcgtattaaccaagccgtgtaatcggaaattgagctttccaacttcacggctgggggctaggatcaatgcttgttcaactaaggcaggtcaagggtccaagagccttatcctccaagaacgattctccgacgacaaggctgggggctagggagagtgtatgactctacaaactgactgatcgaagtcggtaagagagaagacgctcatacacaaaacattggtcggtaaatttaattcattttcaatttaccatacatattataacattgtcaccctttgagcgttcgctcaggggctagttctatttgatattcttttctgagcattgatttagggaaaattctattcgacattgcggaagactccatgtctctttggttctacaccaagatcgactaaggcgagtacgaccaatgttgacaaggctccgtcgcagactctacgccttctcgatcgctcgagaacagttgctggatctcgacaaggaacatggagtgaagagatggtgtaccagccgagatagaatttcttgacttcaatccaaattctcgattacagcaagacgggagacttagtcgtctgctctgtacttccttggttgacatcggagattgacttagacaaaccctttcggtgctcgcacgaggctgacaaaagaagtctaacgttatctctgaactcaccgagaacggtcacttgagctcgataacagttactccatggtcagcggtcgagaatatgaattcgttcatttgcattgaagtcggggactactgtcagggttatggataccacatacctaatagtagtctactacatctcggtaggacccaccacataccatgtcctacacggaaaccgacttcagatatggagggagttccggataaggaaagacaaccagagttctacatggaaatgacaaggactatttggactgtatccatattggtttccctagttctacttggacaaggggacacctatgggtataaatacaagaccccctaggaggagtggggacacaagacaatcgacagacgatcgacacgatcaacacgatcaccacgatcgagacccacctcaatcaacaaccaccacaatatacggaacaacagaagccaataaaagccaacatacgccaagacatgccgccggatatcgatttcagggataggcatggctattcccctacggtgtctctggataccataaggagagacgaaagcgctatctctgatctcgccggacacggattcgaggagcaaggctaccctgttgtcgactacgagtcagaccttcagaccgacatgtcaacaacagttagataggctacccacatattgtactggtgttattatggtgaataaaagcaactccggttccggccaacaggatgtagggttattacctgacacctcaggggcccgaacctgtataaaaatcctcgtctccatctcttttacctcagtctcgcatatatcctagcaccgacgatccccatactatgcaaataccataattgcgacatcaaacgtcgacacttataaactttgggtctataaactttaggtgtataaacttgagatgtatagaaatattacatataaaaaatatttgaattcaaattcaaatttgaattgggtatataaacttttgacttataaacattcgctctacaaactttaggtggataaactttagatgtgtaaactttaggtgtataaacttaataaaagaggaaaagaaaaaaaaaagaaaaaaacgatcgccgccagcgatcaatcgctcattatgacttttcttttgaatgtaagggggtgtttagattccggaaaagctaacgcgcgtgtacgcgttggtggcgagcgattccggaaaggttagcctaactaactaagttattagtagataatgacgataattaattaagataagatttcttttttttggaagattttttttctactaacagattgaaaactttcaggttagatttgaaaacttttgaagtcaaattttaaaaactttcaacttaatttgaaattttttaactcgaattttaaatgtgtaagacaaattttgaaaactttcaacccagatttcaaaactttcaacttgagattcgaaaactttcaacttgagatttgaaaacattcaagtacagatttgaaaaattttaagttaagatttgaaaaaatatgaaaactttcgactcagatttaaaaactttcaactcgagatttgaaaactttcgactccgattcaaaaactttcaactcagattcgaaaactttcaactcgagatttgaatactttcaaatcagatttaaaaattttcaagtcaagatttaaaaactttcacccaaaatatttggaaaaaaataagtgtactaaagattaaaaaaaagtaatcagaaaaaaaggaaaaaaaagcgaaaaaaatcgcaaaaaaaacagtgaaaaaacaaatcgcgaaaaaaaagaaaaaaaagggctaatgggctttttgcgccgggagctgctggtgcgcacgcgccaactagcaacaccctttagattcaggggtgtaaagttttcgcgtgtcatatcgggtattatatagggtgtcgtatggggtgttcaggcactaataaaaaaactaattacagaatccgtcagtaaaccgcaagatgaatttattaagcctaattaatccgtcattgtcaaatgtttacggtagcaccacattgtcaaatcatggagcaattaggcttaaaagattcgtgtagcaaattagccacaatctatgtaattagttatcttttagcctgcaggtaaacgttcgatgtgacagggtgtaaagttttgggatgggatctaaacagggccacctaagtgcagtggatcttaaggtgtccccactatcatgtagctactctcataatttataaacagacggctatttctctgttgacaaattcctttgggctaaaccttcccccttttttttgggagggggggttgctacaccactgccggctgaatttttttttgtcagctggatacaggagcgtcagattctctggtagactacccacacaattatatcgacacaaatgtaaagtaagagcggtactcatactaagaatagtaccgagaatataagaagaagattatttcattaatttcgaaagtattgtagaagagaatagaaaagctactagagccataccgaaactcttccgaagactccgagggctccgagtactattctattctactccacttagcactaaaactactaaaataaagtatgaagaggaatcttgagcttgcttaagtgtgttgagagtgaaatgagctcctccttttatagggtcggtatgacggttgtagagaaggggaaataaccttcctaccccttaaccgtcattgagagtgcatcctggacgtccacgtgaagggccaagctaatccgtcaccactagggttcggccgaacctgggccggcccagcaggcctccagctttggcagtgtggctgacaggtgggtcccattgtcggttatggccgttaaggtgatttccggacggttacacctgacatgtgggccctcattatcctttagtttacttagaagtgagttttcctcatttcttcattattttatttgctcaatccctgcaacaaattattctcctagtacaagtggaactatattattctaaagcaaatatgctttataagcatagctaatcctcttttattatggttatattgacggtcgaaattggtctataacgaccgtcaacagacaaccgctgatgtgctgaactccttctcttccaagccttgatgaatttgcattggttgcatatgaccatacatcggcggcagtgccccccatggcatgaagtaagaaaaagaaaaacctggcggcggcattggacaaggcccccatggcatgagttgaggattgtatggaaaaggtggctccaatggtcttggtgatggaccaaatctctcgctaggaggagatcttggtctttttcctttattaggatattgttcggcactctttcttctcatacttgttcaaaaccatatcaaaagacacctttggctttcacggtgttctagagtttgaagcctcacccttattttccttccaatcactaacttctgtattctttgacacaaccatcttgtgtctaggctctccaactactacttctttcccattggtaaatacggcttgctccggccgaatcaacacctttttatcattgaagtcaatagtattcacaggaaaaagatcatgatctagcttcttcttagaaccctcagtaaatttcaatcgtccttcctctatggccgattgaacctgtcgttgaaacacattgcaattgttagtagtatgagaatgagaatcatgccacttacaataagcacgacgtttctgttgacgtttgatgtcgcaattctggtatttgcatagtatggggatcgtcggtgctaggatatatgcgagactgaggtaaaatagacggagacgaggatttttatacaggttcgggctcctgagctgtcaggtaataaccctacatcctgttagctggagccggagttgcttttattcaccataatcacaccaatacaatatgtggggtagcctgtctaactgttgtcgacatggcggtttgaaggtctgactcatagtcgacaacagggtagccttcctcctcgaatccgtgtccggcgagatcagagatagcgctttcgtttctcctgacggtatccggagacaccgtaggggaatagccatgcttatccctgaaatcgatatccggcggcgtgtcttggcgtttgttggcttgtatgttgtgacttctgttgtttcgtatattgtggtggttgttgattgtggtgggtctcgatcgtggtgaccgtgttgatcgtgtcgatcgtctgtcgattctcttgggtcccctcctagggggcctcgtatttatacccataggtatccccttgtccaagtagaactagggaagtcaatatggatacaatccgagtagtcctggttgtttccatgtagaactctggttgtctttctttatccggaactccctccatatctgaagtcagtttccgtataagacatggtatgtggtggatcctgccgagatgtagtcaactactattaggtatgtggtatccataaccctgacagtttcaattcttctggagatggaatgacatggcctttaggtaatctaattttttttttttttacaaaagataatcaaagattttatcacacttggccacatcaaagctatacttaatctgactttgccgatctttacaaggagtcagcattaagttagaacaaacaaatggcttattagtccatgaccactcagcaacatatatatcaggatcaccatcatcattatcagaatcactatcatcagggcaatccacaatactaacattgggttttttttgtcattggacctaacaaacttcttactttccctaacccggctttcttgagccagagctttatgcataagttgactaacatcaagaaattgttggccaactaatctttatttaataggagcaagcaaactactagaagcaagatcaaccaaacctctttcagttatattcaaactaaaacatcggtttgtagcatccatagacctcttaatgtaatcagtcacagattcattatacttttgcctaaccgatgttaaatcgcataacctaagctcagtttcaccagtgtaaaagtaatcatggaattttgttataattgagcccaagtatgaatataaattgccggtaaagaagtaaaccatgtaaaagcagtaccagacaaagataaagaaaacaaatacaatttaaaagtatccgtgttgctagcctcaccgcattgtgctaagaattggcctatattttcccatgtggttctactatcctcaccattaaacttagtaaacttagggaccctaaaaccacgaggatatgtgatattatcaaaataattaggatacgactttccgtaaaccctatcacgattccttggctcaattccaaaagcgcttccctagtaatgttcctcacacgttcctccatatttttaggccttggtgggtttggtggcctaaagggtggttgcggcggcacaatattgttatattggccatatatagcatcttgaggatatccaatagcaggatcattataggaattaggtatataaggaggaatctgagggttaacagtagctacaggaggattaggtactggataatggtataaaacaaaattattagtggttggatctacctcctacacaagaactattgcaccggtctgaccggccatatggccggtcacaccaaaggtcggtgcgatctgaccggctagagaaccgccggtggtcggaccggcctaatggtcggtcaaaaccggtatagtgggctccggtcagaccggccgcagctgtacgatcaaggaggccaactagaggggggtgaataggcggttttaaaacttttggctaaaaccgagttttgtatgcggaagcgtaaatcaaaacggttttgtacaattcaaaacctaaatcaactagtctcaagtaagtgcacaaagaagctagcctatgttaaagtttgcaagcctagggtgataatagcacaaataagctctagtatgtaaacttgctcaaatgtaaatgcaacaaataaatgagacaagagacaaggaatttttcaccgaggttcggaaactcaccggtttcctaatcctcattgaggcgagcctaactccactgctcaaccacgaagccaccgcacgcccccttcgtcaaggagtgggcaaggtgggaaccggcccacggagaggactacccaagcctcgatcactagggtagttcttccttcactccgaaggtggtgaactccaaaccactcacaaccagcgccgggcctcctccacaatctcctcggagaggtcaccggtctacacctccacaagccgtctaggaggcggcaacctccaagagtaacaagtctaggatgcttgccgaggatgatcaagtgccacactagctctaacaatgaagcaatgcacttggattggcttaactcactctctaacacctcactagataaactaagtgcacaagggtgtgagagctcttgcaagggttcaagataatgcaatggagtgccaaaaccttaccttgctactggggagtgggtatatatacccccaaccaccaaaactagtcgttagggtcgaaatccccaactctgtgctctgccggtcagaccgccatagtgtggccggtcagatcggactactttgtaacggctagaaaactagccattacagggcaatcattgagcccactcaacctggccggtctgacctcagtgtagaggccggtcagaccgtccacggctcggtcagaccgctaggggctcggtttgaccgactgcggctctggcggctctggatcgccaagacgagacctccttcaaaatcaggatgagcggtcagaccgccatgggatcggcggtcagaccgcagaacatactttggtcagaccgccataagggtggcggtcagaccgcaggtcacttttcagctcaatcgaccgttagtaaaacggcgatatctcttgactcgggtctcagaatttagcgttcttggactctatggaaagcttattcaaagggttatccaacccatgaacaatccatacaataaaaacaacttttctcagggagaaatggctcacactccaaaggatactccaccggacataaccacatgaggctacccaaacctataggatttgcccacttctctctttgtttaggacttgagaaaactcaccacacttggctagacaagcccaccaaatatacctacatgcatatgaactaatatggtacaagatcatccacatgctcgcttcatagacccctcttgatagtacggcgtctatctagcaaatccggtctataccaaacaccaagaccgggaaaagtctaagaaaacattcttagctccattatacctttgccttgcaccatccaacttgaggtcaatgcttgagccaagatcaacacttgtgaccatccggttgaaccatgtttatgccgaggtcttgtccatcctttttcaagactttcttctcatcacaagctttcattcttatcaacatggcgatgtctttggtttggtgaccatcaactaatggtgtcatccatttgcctcatcacaattagacctatttctttgcacatctcaaagcagaacattagtcccaataaatcagttgtcatcctccacttgatgaccaaccggttgcatatgaaagatatggatatgtatgttgagtattcattaacaccacaagcgtcatatactcatatgcaagcttaagtgtaaagatccaatataaataataggtgaacaacatgaatctagaacatgcacaataaatgtataggatttgctccccctaaatatatgcatacaaagaaatatacaagagaggcaagtgtatgcataaataaagaaaaaccaatggggtttatcctatatacatggagaaggcatgtagcaatgataaagataaacaaaaacacataccttcatgatctccatgttctcaaagtaaaggagactatcaacaagtatgagataagaagtgatacatatcgctttatctccatgcatttcatccttgtcatgattaaggtccatcagcaaagaatgcatatctaccacatctcgttatcgagaattaacctagttgacaacttatttaaaagatatgttaatcccataaacatcggtttatcatctatcaccaaagcaacaattacacaaattgtttaatccaagatctttcaatcttttctctcttttgtgatagataataacccgatataaacaatatagagagatgagatgaaagatgattccaaatcaaggtagagatcttataataaataaaatatagaataagctctccctcaagatgtgcatacatatggatatgaaggaacgcatatgcacataatcaataaagatcaaagaggaagctcacactatattttggatccacaagagagaccaaattagaatatgtgaagtttaatacatacctctcatcatttttactttcatatccaaatgagactagtcaaagaaagactcataaaaacattagtctcatatagttagatttgtcattaatcaccaaaaccaaattaagtcacttgaacatacagcagcgctagggttttcactcccagcatgttgcatggttgccccatcatttttactaaatatgtggtgaacaggaggttgactagtacttgcaacagaagtagatgtcaaatcggtcataagagaactgaatttggaattcataaaagattaaatccacttataaaaataacaactcatagcatgttcaagcttattgttaaaagtagcattaacagtctcatttatggaacttgctacgagcttttgaaccagaagagcaatatcatcaccacttacctcgttgacggtgacttttggtgtagaaccgggcttacgaacaattccttgacgagtcttgatgaagcaacccgccaaaagtgcttcttgtgtcgcctttagatgttgttcaatctcccgaggttgctcctcatccaaatcctccaatgagatggggaggatattggtaggatctatctccggcttggtcataatgtagatgaagacgtcccaagcggagtggcaaaaaatcatgttggcaacttttttggcaagaagacaatcacgatcgagacacctaaacgccttgccgtgatatagaatcgccaaccaccccaatctagcaaaactagaccaagatgggttttgatagattaaaccggctctcggagccgatttagacaaaacaatagataactacccgtctcatgggcaaacggaaggtttatgggacaaacctacaaaggatttcgcactctcgcagcaaaggcgaacgatttatggcgcaaatcgacaacgatggacaaactagactagaactagattgaaatattgaaaaagcgattcaattggcaaaattggattgtgtgtagattgtcctccagttgaaccggccgccagatccggcaggggcgggaggggaggcgcgacgacagacgacggatctggagccgtggtgcagtggcggctgaggcccgacggcggcagtggtctccacctccaccgcctctgccagcgacacctctagccgcgcttccgcctccgcccgcgctagccggccgccacctacgcctccaccttcgctggtgcctccccccgcctcccggccgccaacgccaccgacgcctcctcacctccgccaccgaccgcgctagccgccggatccggcctccacgaggccggggatgcgctgatctgaacgccaggtaccgcctcctccatccccacccaccggccacctcggtgaggtttcttcttgttgttgttttttttttacttaaatcttcttgttgttgttgttgttgatttgaggtgtttggtttgagaatgtgggctctaatggtggtttcttgtttcttgatttttgtttggtggtgcagcagcagaggagtgcctctttgagatcctccgccgtctccccggccgctgcgagcgcggcgcctccacctgcgtctcccgtcgctggtccatcatggaggatgacgaactgtcggccagtgtgccccttttgtgaatgatatgatattgttgtatgataaattcttgccatccctttttgtgaatgattgctatatgagatggtgatgcggtgatggaggacgatgaactgtcggtcagtttgaagtttttgtgatggtgatgcggtgacagcaagcaccaccatggcagtgtgcgccaattttcttgctagggttttttcacacatgtgacaggttgcaatctatttttcttttttttttctggattatagacatcactgacggctcacaaactaatgggccgtttgagataatagttacctgtgacgggttctatacatagcccgtcataggggctggtcaccactgacgacccttcacctgtcaaaggtgaagagagtcatcactgaccactaatctctgacgaggggccgaatccgtcagagatgatggtttaggcccgtcacagctagcatggtttggcatagtgtaagtgagttggtatgtgaacccacttatagatcccacttatagatcgaaataagtgagttcgcgggtcaatccacttataaccttactcctgagtgacgagtgatgacataaagacagctatgaaaacaaaccaaaacagtgaatgtccgcaagggatagatcgatccctccaaagggtaacggtttggaagagggatcagtcatcagaggcagactggcggcgattggaggcactcagatggtagtgtgctgtgtgcggaggagtaggcggcgaagcatgatgggtggtggccttcttgatatcgatcccatctgtcccgttcaacatgctcccagtccccttgatcccacaaaatactaacttttggaatgaatcaggtcaatcactccagatacatccagtccatcaccggtccctaaacttatatcgttgtgttatctcagtccctaaactcgcaaatcgaccattcaagttctcaaacttgttcgactgtgtcatcccggtccctaaacttacagatcactcgtttagatcctccaacttgttcagttgtgtcacccaggtccctaaacttggatttgaatatcatctgggtcaaatagtacagtctaaaaactttatatttaaaaacaattcataactttttcatgtgaactctaatgaagacaaactttatatcaaacttgtagccctcgacgcgatctacaactttgtaattgattttttttttattttaagtcattttttgtctcaaaatg

SEQ ID NO: 65178 - DNA, 600 bp, Oryza sativa
caggaaaaagtgtcttcaatagaatatgtcaagcggaacatacatgagcgtgcagcagcttccagctcaagaaaagcagcaacaggtgcacttctcgacaactcaatgtcagaaagtagcttttgcatccactcctccaaagcgttccttctctgcaaacaaaacatttcaagaaccaccggtcaaaaaggctaagcacaactgaatgtagtatttgacatcgaacaaagcaaaaattaatcaatatacataacggctaacctcttctagaagcaccctgcttgaatttattcttgaaaaggcatgcttcggtggagcaggggggattccttttctgggaaattcctgcttaagctgcagtacgggagaatcttagaatgaagaaatgatattggattagaggtcgaatggaaagtaataatctttttttctcagaatcatatccaagatgagacttccaaaatgtccacattcattatagaaaccataaaatttccaaaggtgaagttctcattatgaagtcaccagccgaagatgccaaaatctgtaaaactaatttggcccaggtagcataccgtatacactaagtcaagtttataa

SEQ ID NO: 65179 - DNA, 2000 bp, Oryza sativa
ggcggcgacaaagagctagggattgggctagcggcgggctatggtttctgccggtggcaggctagggctcagggatgaatcgaggagctaggggtttcaaatttgatttttggaatttttgttttttggctaaaattattttcgcatgaaaatcttatttttgcatgcggttgttttgctcatatataaattttgattttcgcagacaccaaggtgcatcgagccacccagctgactacggaaatcggtttttggccatatgcaaaaatcgtcttttactagtgaattccctattaatttaagcaacttataaataaaaatattaatcaatatatttaaaatatgattagaacttaatatttataatatcaataactatcacccatgaaacgtacatattgacgattttttatatttaggtatcaattttttttggaaattgcggacatgtctagatgtctagatagcttttgctcaaaggggagccatttttgctctctctgaggggcaaggattttctaggctaggtagactaatttgctaaggaaagttagtttttaaagtagtttaccaaatgcccaatctagcctgtaaggagaggaagttactagcctagaatccaaacgtgctcgcatcttgcgattgtattctaagaattagaggttgaaaatatgaagcccttagtttattttattccttttcacttatccttttgttaaacaagaggcaccagcgtgaataaggtccttttttttaggcttctaagctaacttgtgaactgaaaaatttaagcccaggtagctttttcatttggcgtttttaaaaccataagctattcttacacgattaagaaaaactagattgaaaaaactttttatccttatgtgagatgacaatatgatttcaccattaaacttatgatattagatccgccaattcataaatcatgaaagtcaaaagaccgacttaaaagcttaaaccaataaatctaaacctagaaaatgagagtgctaagtctataagcaacgacggccggccaggagtgccttatatatagtttaacagtcgatcgagtagccggctagcccgtcgataaatttgtgatcttttgacaaagtagtgagctttgacggaatttgtttaacattattgtgtatatatgtcgctcttttatgcatgccgtaagtttggaaccttggacttctactagatttcttccgatcgagctcacatcacgtttgtttgcagcttttgcgggctttgactaattaatatgtgcattttgggtcaactgatttggacaagtagtggcatatgcagcttagccaggaccgaacagatcgctatatacattatgttaacatacagttttaccatgctctagtggtatagataatctaatactaatttattacattaattaaattagagatccagctacagtagttagtctgatcttatctgaaaaaaataaatgccagctgctactactacaaatttcttattctacatatatacaatttgtaacatgcaatcttatagaagccacatgcacagatgacatattatcattaaaaaaaatctgcaaagcgatttttgtgctgatgagatgatatggcactatcaccaccgttacaacagattaaatatgatatagtaaatactcccttcgtttgtaaatatttaacatttaggataatatttttattaaattgtacagagtggccaccaatggtttgtcaagtgtttaattgaaaaagggaaaatggtatatatggcatagatttgttttcaagtactttatatattgtatctactagcaaatatgcgcgtgtgttgcatgggatctagtaagaggggttaaatgttccgttccactctattatactccctccgtcacatgatataagggattttgattttttgcttgcactgtttgaccattcgtcttatttaaaaaattttagaattattatttattttatttgtgacttacttta

SEQ ID NO: 65180 - DNA, 669 bp, Oryza sativa
gcgatccatagtgccacgagctattccacaaaagtcgccgtgatttgcgggtttgtctccgagaccaaatctccgatccagtcatcgtttttcttcttggagattgcatagaggcatgacgtcttttgggcctgcggccgtccagctagcttgctcctagctaagcgtacgtagtcggagactcggagtccggcgtcgtgctgaacaccggcttgtccttgtccacaaccaccgccgccgccggagtgggggcttgggcggcggctggtcgccatagcttcttcacggcgatcacggcgcgcgtgcgggggagctgatcggcctttttagactacaccggtggcgcccatgcccaccatggagcacaacccgaagcacggcgggagcacgccgccgcacagcccggcattgccgtcgagctcgtcggggttgatcgacagtgggcagtagctgctgctgttactgctcccttctgacaaggggattattggttctttgtttggcacatgtccccagtagaatgtcactgctattaccacatcagattgaagacaacaaaagcaagtaattaaatgggttaatacaactaaggctgccaaaactgtcaagaggataaactgctagtggttagcgattagaagtaaatttggactgctgggttgccatatg

SEQ ID NO: 65181 - DNA, 660 bp, Oryza sativa
ccaccaaccgggagtaaagaggaaaatctttggtcccggttggtgaggctagcgccacgtctctggttcctatcctttttttttttcattattctttgcatattgatttcacaccaatctcaccaaaatcataaaatcatcacacatttcaaatctcctctctccaggcgcaacgaccaatggcggcagggagaaggatggtgaccggcggggagaaggggcggcggatggaggagatccagctggcgctagaggccaccgtgcgcccgatccgtgcgaatgtcttccgagcccacgcacgtatggcgctggcggctgattcagtccaccggtggcaacgacgacactagcagctcgtgttccatctcgatcgaaacttgatgacagattcagacacaaaacatgttgattacacgatggttgccgctttgtaacacgaactaggtgaacagatgctgaattcagaatatccaaagaacatgacaagattttcggcattgccaactcatgatatggtattaatcacctggaataaactcatatattcagtgcatcctattcagacgtttttattcaactattcctttgagttcaaatttcgcatcggccaagaacaggcaccaactctgaatctctaatactcaaacgcattcatcgaga

SEQ ID NO: 65182 - DNA, 803 bp, Oryza sativa
gtccttgttgtctatattgttgtgcatccacatttcctagatgaatttcttgccatgttcttctaaatggccagaatataatatattaacacaatcattttgccacttcttgctgccttatgtaagatagtcaccttgttggtcgtaccatggactgtatctgcagagttcgaactgaagtttctgttgcgtgttctgaatgttgacgttcctcctgattttgatgctgtctacttgtgttctgaatgataacttgtgtcctgattttaatgctgtttacctgcttgtcttcattctcacgtttggaatcggaataccagaatctaggcatatctccaaacaacccaaatgaacttctgtaacagtattttatagatccaatccatttccaaccttttttgagggtagcagcagtcaaggaatcaatatagatctactgtatcgaaattggattgtcgtcctctgctttggcattctgttaagctatataagtatatggtttacttatgcagcaaccatttttgtcatgttgcatggctgtttgcacctttgacaatttggtatgttaactggcttcaattcaaggggctaattgactgtgaaacgtgaaccattctgcgctaatattcttttcttcctacgttgcttgtgacgaatattctgctagattgagttgcggctgatttagctactatgtttctttcaagtttcattgcacgtagcagctttagcagataagctttaatatattttatgactatgcttcaatctattttttgcctaccttttcttcttctaccata

SEQ ID NO: 65183 - DNA, 60937 bp, Oryza sativa
tgactggatcctcatcccacatgagacttgcaatcataaaaaaaaggggctttgtttctgtttcacccattcgtatctattagtcttgtcaaacttagaaacttttgttttggacgaagagttgaaggacaaattcacaatcatctataagaatttagttttccaacgtcgaaatctataaatggtattgtaaatacaaagagtgtgttctcagggatgtggggattattaatgaaacaccaatgaacataggagattgtttgaggagaagaggtgtactaaatacagggttatggatgtcttttgtgctagtttttgttggctagtgtccttaacttgcatgtggtttccaaaggaatctcaacatgaagagatgaagagacctacagcaagaggaataaccaagcagaaagactaatggaactgaagccggtggtgtaaatgatctacctgatgctatatagttatagtggtcgatacaaaagcaaaaagactacaatgcccctgctttatcaaatctcaatacaactattcctcaatttatctactcccaatacaattattccttactttcacaaactccgatgcaatagtgaacttattttgggacaaatggaaaaagctaaaaatgggacagagaggaagcataaagattctacctttttcttgtttcctgctggtctacagtctagaagcattcttcctctctagcactgcagtccactatatttatggttttccaggatgctgcaaagcacacttcattttcattcttcaaagacaaagggctggttagaaacaacaaaaataagaaaaacagtatgacctgaattgcagtacacaaaaaggacagcatctcaccacttgaactggcgttcaacttaacttgtcggtcatcgctgttcatcattcaaatgcttgctctctgttcactctctcctctcattgatcctctctcttgtgcattctcgtcaacaaaatcttagcaacttgtttccggttagagaatagctcggacacttttatcaagtgaagtcaatgggttcaactgttcaagccttccaaaccgcatctttctttcacaagtagtcaccactggtcagggtcattagaaggataattccaaggtgcacctccaaaaatcaagccagcaccaggatgatgtgtggcaaataagctactcagcgcagattttgcagtttctatgtcacgtctgtcagcaccataatcccggtttatgtgaatttctcttaggcatgctggcaggtgatcaatgccaacaggtaagcaagtgccgctgcatttctaccatcccgttgcatcaagccatagctcaagcttctgtaacctgggcatagaacaagctttgaagtccaggaatggcttatgacacctgaacagcaagtgcttgagagctcggaatgccatgcccgtaccggagaagatgactctttcttctgggcacactagaagcctcaagtcgaggtgaacaagggaaggtaaacatgcaagaatagtaacaccatcatccatgggcaatgccttcctaatcgtaagcttcaagctgtgaaggtcacgaagctgtacgatccatgagggtatcctggaaaacaagcaacgttccagatggagcttccagagatggcgcggtggaggggacagtgtgctcaagccatcaacctgcaaccatgaaggaaaatgtttcagcagaacgatgttcctgaggctgccggaagatcgcgagagtcgttcaagggaacagcgcagggcttcaatacggctagtcacatcctccaagggctcactactgctgcagtcaagtttaagatctcttaagttggtcagctcaccaaggcattcaatattgctcattgagttttttattaaatcaaaccactctaggttacgcaaggatttcaggtcgccaatcccattgggcagaactgtatttgctggaataaacagctgtgacaaatggggcaaactaacaatatctgatggaatgctcaattcttctgatgtatgcagctcaattgtctccaaatgccacatcccaccaagttggctaggtagcaccaacttgacatcatgtgaaatctttaaatatctcagcagagaaaatccacagatacctgtaaggtccactctttttcccctccatctccgaggaaattcaagaagtagaactcgcacatatttgaactccaaggatgaaggcctaaaactgtttttgaaaaatgcagctgaacgaacttgtgacagtgatctattgtttgatgctggtatcacaccgtcctcttcatcagcatagtggaaagaaactcgacggatcttcgtgtgcagtcctggtgccacagtacgatcatctattacagaaaagaagttctcctcggcagacttcgacctgataatttccagcattatatcatgtattctgcaggataacacctcatcattgtaatctgtatatatgggttgaaccatgctcctattgataagctcattgaagtagctacctgcaacatcatccacatctagaccactgattttactcacgaagccttcagctatccattgtcttaccaaatcattcttctttattatgtagtcctctggatacatactgacatatagaaggcatgtcttaagatggtgaggaaggttattgtagctcagttccagtatctgcctcattccacccaaggtaggatttccttcaaacatggacctcatagaattatttacatattcccaggtgatatatggttgaccagatagaaggctagctatactgatgattgcaagtggcaagccatcacacttttttagaatattagttgtaacctcttcaaatttattagggaaagcttcatgggatccaaatattctactataaaagagatttcgtgaattttggtcagtaagtgatttcatcttatatatatacgcttgactgttggagcaacaggtggtagcaacagacaaaattcgtgtagttgttaataccctgctgccatacttgttctctggaaaagcacatctaataatgttccactcaaaggaatcccataaatcatctaccacaatgaagtacctgccaaaaaatttcatggatttctctacacagtatcaacgtaatgtagtacatagatgaaattgtgcaaagtgtcttacatatatctatttagaggaatagcttttcggcaagtgaaataaaatgaattactaattatctcacggggtcaatagaaaaaaggaacattgaaattcatctaacttcatgctttctttataaatagaacataagaattcccggccaatgaatcatcccaatgtactccctccgtttcaggttacaagacattttgactttagttaaagtcaaactgcttcaagtttaactaagtgtatagaaaaaataataacattttcaacccaagacaaatttattatgaaaatatattcgattattgatttaatgaaactaatttggtattataaatattactatatttgtctataaactttgtcaaatttgaagtagtttgactttgaccaaagtcaaaacgtcttttaacctgaaacagagggagtataaggctcccatcggatggcccattaagccaaagaaaaagccaaattttaaattttcaaacttaattttgagattgattttgagatattttcaacgtagtttctttttcagcattggcttttaagttaccaagaacacatatataaaagttttacctacaaatttatttttatttcctaataagtcattttggcttattagaaaaaaagcaaaatgatggggccctaatttaatgaacttaagggaactttggaatgtagcactttaaagtagtgatagtagaatttttatccatttatactcaccttattttgcatatgacattcaaagtttgaagcgcattcattacttaacctttgtacattagtattgaaaaatcagtttcatattctgagtgtcagaaatctttgtattgccgcctgaacttgcaaattgaatttcaacacttaaagcttttaaattcgaagtacttataattcaagttattatgagcacaatctacaagaattggaacgaacgtaaaagtaggaatcagaattttcatgcatttaccctttcaagttatagctttgtaggcctgataattttataggacttcacctagaatttagatggtttttttagataatgaacaatttaaatctacttatgtaatttcattttttgacaaaaacaaaagcttatgactgcaaacatagtatgatacatgagaatcattacctcttatcccgcagactatttatgatatcattgagaatcccatccaaattggtgttgtgcacagagcactgccccctaacttccaataatattctattgagaagttttggtatgtcaggtttttgagataccgacacaaacgcgccgcagtcaaatttcctttcaagcttgcggtacacttcctttgcaagcgtggttttgcctacacctccaaaacctacaatagaagccaccttcagcccttgctcttcacccatcagcaatttgaggagctcatctcttggcgcatcaattccaacaaggccagccgcctccgaatagattgcgaccactcgcgggtcaaccggaacatgtctggaattgggggtatactcatcaatcttgtacctcatgcggcgctcgctcacctctttcacaaggttcttgatctcctgaatactgttaccaatctgatggcgtgcccttatctccttcagaaatttaaccgtcttgtgaacaaatccattgcttccattgttcttgtcaagctgatgcaagaaatcatcgatgcaatcctcaatgtcataggacatctccctcacttggtctctccactccttggcctgaccatcaagctcatccatggcggcgagcttctcaagaagggccctcatgcttctcaactcgtcctccaaggaagccacctccttccggacgcctctcagcttgccgtactcttcccccatcagcgcggcgagcttggataggagggagttgatcgcaccactggaggcgctcgccatggttacggccaaagatatctttgttgcttagtcagtacgcactcacttggagttggaagaagccgtggatgcagcgccgcgcaggagccgagccgcgcgtcgcctgacggagcaaccggaggtggcctccacggcgactcgccggtgctcaccgggctggtcgattgcaggatgtgaaatccggcgagtggcagtccggcacggaagagacgtgaaatggggaatttcaggtagagcaggtcaaaaaatcagaggggaatttaactgatacgccgttgacttcttaatatgttgaccattcttcttatctattattccctcagtttcgttttatttgacaccgttaattttttagcatatgtttgaccgttcgtcttattcaaaaacttttgtgaaatatgtaaaactatacatatgcataaaaatatatttaacaatgaatcaaatgataggaaaaaaattaataattatttaaattttttgaatgagacgagcggtcaaacatgtgctaaaaaatcaacggtatcaaataaaacgaaacggagggagtatatactaaaagtacattaaacttcctacaaactctctcaagctgccacgtgacgctctaataaattagagaaaatcttagaaattctaagaaaaagcaaaacatctacctttaatcacttaaattggtgggtccaacattacacaccgttagatgaaattgatcttaaaacaaaccaaatactatgggtcctacctctccttctcccgtgcatgtgtacgtggggatatataggtacttaccatgtacgtacgcccttcttttcttttttttttctttttttcttctttttccatttatataatatggctatatacttttttaaataatcataaatttacaacacaaagaatctactaaattagctctacaatttttagaaataaaatttaaaccattatatgtgaccattaaattaataatacaatatagtttccacttaaacatgggtactcattattttgtactattatttttaaataatgcactattttaaaataaattttacacaattatattgtgtacctatcaaataaacaatttaagatctatattaattgatttatacgtgcacttaaaccgatggatctattatttaaatcatcggaactattttttattacattggactattattctcaaataatgcatggtttcaaaataaagtctacaccattatattatgtacccattaaatcaacaatttaaaatctatattaactaatgtagacttacactataaccggtggacccattatttaaatcatcttatatattatttgctaataaataaagcgtccgaagttctcttttttgcccgctgcacaaggcacatatgcacctttgccttttgcacgtgtgccaaagcgtcttgtctaaggtatctaaggtgatcacgactaccgcagcactaccgttttgcaacatatcaaatcatatatggagatgattaattttgttaataacatgaaaagaaatttaaaggtgtgatgcagcgagagaggaattaagcaccgtgggttgtgttttttctaatacttagctctgtttaagctgaaaccgagagttaattacagaataattataatgtattgtgttatatatgtcgtatttgcatttggtactatttgttcgtataggtgaaataaatcattatgttataaatgtgagcacaattttaacgaatattaatagcactcttacaaagactagggtgttataagggagtttaagatccgctttttttcccgatttcatagttggattttcgtttgcacgctttccaagtttttaaatggtgtctttttaaacaacattttaactttttagaagtcaattcattcatttataccctaaaatagctatcacataaatcagataattcatcaatttcagttgtcctaaaccctaagtagtacatatttttttatgtgagtcatggtgatcagtaaattgtggatcaacggataatcaaagtcgtaagatgaatatataagagctactatgaacaactataaatacgtgtcaaaattaattgctactaattagacatctaatggcttgctagccacataattaatttctctcgacatgtatataaacatgcacgaagctggaacaaatattattatatgccctatacatatatattaagcggctaatattctaattacatgtgttaagtcctttaaaatttcttaaaacgctctcaagctgccacgtggtgctccaataaattagagcaaatattagaaattctaagggaagaaaaagagcaaagtatccattacttgatttttcatttaatcagtacgtccaatattataaaccgttaaattaaattgatctttgaaaaaactaaatactataaggtctcacctcttgtcccgtggcataggtatgcacctacgtacatgggtacgtacgcttcccctcccttttttcatttttccctttcttctttttttccatgcatacacttccctccctttcttactatatcatacgccttcttgagatgatttaatcacaagaattttgagtatcatgctctcacatttttcatttgttgccatactacatggtatgcatatagatggacggtatgataattaactagcaatagtttcttatttactcgagaaaaaaatgattcaaaagtcatcccttaagaaaaagtttgtgaatggttttttaagatactttgaaaaaaatagaacccttaaattattataaaataacattatccaactttagtttgcccttaatctatgagacaatttttgaacaaacaataattttacctttcaataatataagtgcccgcgcatgcgcgcgggccaccttcctagttaataaaattatacaattaatatttaagtatgatttaaatatttttatatatacacaaaatattcaaaataagacggatgatcaaacattaacaaaaaaaaagtcaacggcgtcgtacatttaagatagtcctagaaaaaggtcccgcacattgccgtaggatcgcgcaagattatcaaatgctcaacttagattaaagcagtgatatatgtatattattatatttattgtatgtgctattatatgtatattttttattggaaaatagatatgttcaattataaagggcacaaccatttgagggttttactgtaatggacaaatgatttttctcatttgtatcataggaatttttagtaagaacttacaatgaagattaagtgtttcacgcaaaacgaggtggtaataacgtgtagttttgattattacaaacttgaaaaatggattaatctgatatttttagagcaacttttatatagaaaggtttcgtatgaaaagtaccgtttagtagtttaaaaagcgtgctacgagtatccaaaatttcatcccacctttgttggagaaatgaacgcagcctaagtattcatttctgtatgatttttcagcagcttgaaaaacccaacattaacctaatatgtcattttattaatttaaaaatagcataattcatcaaactcatcagaataatcaccctcacattattttttgggttaataggatccatgccattaaaaatatgttggttttgaaatatgccactagtatttgcgtatctggaaccatgccattataattttacacatattcgagatatgccactactgtctacttatcctttggatgcattttaaaagaaatatctggaccaaacgaccctttttccccttattccttctcccttcttcccctttcatcttccgcctctcttctatggcttcacctgaccggtgatggtggccaccacagttacatctcctccctctctgacactccttcgtctgcatctccctccaccttggcccgctgccagcctccttccacgtgtcatctccctccacctcggcccgccgccggcctccttttgtgcttcagcgcatcccagatccagtcacctctctttgccgcgaggagctctgggcagtggcgacgaccaaggaaagagcggccacttctctccggtgagctcctgcaccttcctccctccctcactgcacccgtagctcctctggtccagcagctgcctccaccacctcgtcgccgatgtccgcctcgacgcctgatgcagcgaggacggccttcgtgaagagccttggcggatggcagacctgcggtgttctgtccggtgctccgagctcctgtggcaaacgtcgctgccgacaaagagaggtagaagatgagggtagagggaggtagaagatgagggtattttcgtccaatacatacaaaataagtatcttagtggcaccactgagattacaacagaagtggcatcgttacaaatacttttttttttgtcttttcatttatacgttttcacatgagacgtacttggtttgacaccatccccaatacctcaccagcctgcttcaaaacttcctgtactagttgatacctcacgcgttactgtgggagttcaatataataacaataggtaaaaataatacgtaaaatagttagacaacatagacttacataagttgatgtggattataataatttaaatttaaataatacatagaatgatgattcgaagataaaagtaaggtgatgtatatgagagaagaaaatgaggaagatagtttgtactatagattaatcatctaagactaaaaataattggtgtgatatgacttaatgagagaagagagaaataatgctaagtgagaatgaactatatataagtatataagataatataaaaatgttgaatagatatattgaaatattatatgaattatatgggacgatgatttaacatgcttgtattttaaaccctaaaatttaataaatgataaaattgtagataatatagaatgcttgtatgatgtttaaatgtaataattgttagtggatgataatgtgatatttttgcatgttaagctttaggatttagtgggctataagtttatagtgtgataggatttaggtgccactttataaaatctgtttttcaagttctcccatagtatctcacctttttccttagatttcatatacggtttctttaatttacttcattcctttgcataagtttatttattatataaaatataacctatttggaacattttccttattactgaatggaaatggatagttttataattaacaacagtactaatttgagctgctaagtccaaacctggaatgcaagaatttaaagtcaaacatcacattgaccagaaatatccctcaaatttttgtgtttgtaaccttcttattttaagtatgttgttattatattccaaataaggtgtaagttttccttataaaatataattaatagattaattatagtagattttataggtgatttacgagatacgataatttgaaatatgtcaggatgtgtaaacaggatatatatctaggtgctcatttctcctctagcgctgaactgatggcctagctttagttacgaactacacttcattgcattttgccttaggccccgtttagatctcaccctaaaattttacaccctgtcatatcgaacgtttaacacctgtataaagtattaaatataagctaaaaaataactaattgcacaaattacgactactttgcgagacgaatcttttaaacctaattgctccatgatttgataatgtggtgctacagtaaacatgtgctaatgatggattaattaggcttaataaatttatctcgtggtttactagaggatactgtaattagttttttattagtacccgaacaccccatgcgacacccaatataatacccgatgtgacacgcgcaaactttacacccctggatctaaacacctcgtatagtgatggtcttgccttgcctgcatttcagtgatggttggatcctactacgtttggtgcatagaacccctggggcagagtgtaggcctgatgttttaccgtgtgcgttgcagcagttaaatagagtacaataaaaccatcggaggttaccaattgtaaacagtgaaatagtaaaacatgcgacgtggatgaatgttgtatttcatgccatacctctctaggaatatagttatgtgtagtgatggttggatcctacgtttggtagatctcatagtgcagactgcagagtgtaggttgaatgttttactgggtgcgttgtaatagtcgaatagaatacaacaaagccatcggaggctaccaattgtgaacagtgcaatagtacaacatgccatgtggacgaatgttggttaaatcctatactatagatcccatggtgcagagtgtaggatggatgttttaccaggtgcgctgcaacagtcaaaatgagtacaacagagctatcggaggttaccaattgtgaacagtgcaacggtaaaacatgcgatgtggacaaagggagaggaaggttgctaagtgtgagaaagaagacgagccggaggcagttaggaaggggaagtacccacattgcacccagtagaacaaattcaatttccccaagttgcatgtctacgatcgtttaaacccttctgtagtcgaatcaattgaggagatgccgaacctatcgagcaaatttgtttccaatgcaccggaaccaatttatgttttatccatgtcaatgtttgtacaagtgttgatttcaaaagcgctggaaccaatttatgttatatccatgtattcaatattcgtacaattgttgattccaaatcatcggaaccaatttatgttttatccatgtattcaatgttcatacaattgttgatttcattgtgaaaatctataaagttgcttccctccgcggaatttgggaaaaaaaacaagacaaaaatcttagctgatgtgtaagaggatctcagtgccagaaagaatcgcgctaacagtacaaagctcagcactagcatatttggcactgaattttgggacttaccagcgcgcgacccgcccaaccaaacaaaactcctatgttgggtggccatgaggcgctgagctggcaagcctcagcgccaaaaattggcactgacattgaatacctcaacgtcaatctttggcgctgacctttgggacttaggcgcgcacggccgtcccacccaaacatagctcctgcgtttggtgatcatgaggtgctgagtcggcaagcctcggcaccatatagaatggcgctgaccatatagaagggctcggctacagcggcggccaagcttttaatctgctacctcaatgccaacgcggttggcgctgaggccttgccacatcagtgaggggatcagctctggctccacgtggacccggggggggaggggggtcaatgccaacgtctctggcgctgaaccgttcaacaacctcagcgctaacgtcccttgcattgagtctatggcttaaatactgtctaaagtcatttaaatggtaccatcaaatatatttagtacatggaagattgtttggtgctcttggattatttgagcacatttcagaaatttcacaaagtaattggattgtttcctctaactgacgtcaattcatttttcgatcaatttgcaaataaagatgtaaaagttataattgttgtggtagctagagttgaaagctgacctaaaccaaatatgtcattcttggtatgtattggcagcgaaagcataaagtaaatatcgattctgcctataaagagtccgaggggtattgtatgtatgtatgtatgtatgtatgtatgtatgtatgtatgtatgtatgtacgtacgtacgtatgcacgcacccgaccagccacaccattcgccttcattcacatcctctcccctcctattgcctctcatgttatcatcctatattagttaggaagcataatttattataatattttaaaataaatagctattttttatcagcttatgacattggacccatattaactatatttcaacttctaaaataaatatgttattttgggttatattctgacttttttcatatcatttaaacaattattaaaaaaaatatgaaaaatccaatgatatatattttaccggctaaaaatatttttcatgaattttcttcacctctatgtatatcatgtagtcctatcactattgaaatacaaaccaaataatttagaaaaattccaaaatgatttgagaatgctaatctcacacaaattaaagtttaaattagatctactttgaaaaaacacaactaaattctgttgtttgtattttacatatgtagattcaaattgccgttgtatatctgttaagtaatatttgatatgatagaatattatgatgtgattttttttgaaaaattgttatggaattaattaatacatgtcaagatcatctgtccgaatgtattttgcactaaaatatagccaacataagtcattagtataaaatcataataattacatcaatagcataaaaaaaataaacgggatgaataggaagggaaaaggagaatggaggtatgtacgtttatacattacctgtacatacgtacatgcggggagggatgcatatgtacgcgcagggtaggggggaggactaaaatcagtttttaatctaatatgacggtgcaaaataatggacctaccagaaaatcgagggctagatgtttctaatatattaaaacgccatgtggcgacttaggagcgtttataggagtgccacatgacgatatgagagcgtttataggatgtttaatggatttttagtatataataatagatacttgtaacgctccgcttttcgtgagacgttaaaaactaattcggcaaaatcctaattgcgaaaatttcgttctttgagtgttgagtctaagttgtgccaaagatctcaatttaaatccctccctcgtctcgataccctgttatcaaagatcgtctcctcaaaattaccatcccaatgtagtcccgaagctcgattccttctattcgaaatcccctcctggaaccccatccgtgaactttgtcgaatgcccgaaccctaactccgtccaaggattcaccttcgcgtcatatgctctctcattggttccttcaaaccgattctcaaattcgaattcaacctctcaggttttgattcatctatctttctccctgtattggttcatcaatatacccttgttttctttctcgaacttctgacccaagtctgaatatgcaaatcgagatcacttccacccttgaactcaaaatcccaagattcaatcccttttgccctgagttctccccaaaatgatttccgttccgaaataatctcgaagtccgaacccttctattcagacttctctccaaaatccttacccacatatcttgttgagtagtcaaactcaaactgccaagttacactctctttctctaaattatccatccccttttgactcgtctccgaatattgttcccttccttgactccttcctattctcccgagaccgagtatcaacctcgaaattcgaatccagactccaactctaaaacctcccaattaaatctctctgtgaaagtctatttaacctccctcataggttggattccttcatcctttttccggtccacctcttccttttcttccatcccatctctctctgagtctcgatctatctatctatcgatcgatccatctatctatctactatacctatctatctgtttatctatccatctgtcaatccatctgtctatccgtccctctacctatcaacctacctttctgtctatctatctatccatggcattctaccgctatctcccttgttccatttttgaataatgatcttccctttttgaaatcctctgaaataatccttcgtgccgccaaatataaatccatcccaaaaataccaaaattcccgcttttgaagcccttccttgacccctcccttggatccaccttgaaccctcgtgtacaaatatacaaattgaattcaaattcaatctccacatcaaacttctctccaaatcaaaccttccggtaaaagtctattttacctccctcgtgatgatttgggccgaaacctgccgctggcccatctctccccaactccctccatctccacgtgcgccgcacatgaccaccgagagagagagcgctgtctctctcccttccctctctcgaacgttctctctctctctccctcgccgcgcccaaaccgctcgccgccgtttgaatccgctcgccgtttcccgtgcgctcgcgcgcgtggccgaccgtctgggagacgccatcgccaccctcggtcgtcgcctgctccgacgaccaccgcgtgtccgtgctcacctccaaacagtccccgtccttttgcagtcgtcgccggcgtcatcctgtcgagccctgcgccccacgccgcgtgcgtccaaagccgcgaggcacagctcgtgctcccgcccccctctcctcccaaaaacggaagggacatgcctcccttttcaccgtccccctcccctttttcccttctgggctgggtctctctctctcccgcccatgtctccttgcgcccggaggcagagcaccatgacgcagacgccagcggccagctcgccacccccaccttgaccgctccacgctgccagcccgcgctcgcgtttcaaatttcgccgtccgatccaccgccttcgccgcccaacgcatccacgccgtcgccgctttcgcactgcccacgaaaccgccgctgccgcccgtgaacaccagccgagctcccttgaccgccaatgtcggtttccctcctccaaaccgacctctcctcctcgcctataaagcccgcgccctcccctctcgtttcgtcttcgcctcgctcgaaacacccgcgccattgttgccggccgccagctgctcgcccccgtctcgccgtcgcacggtccgtcctctgccgcctcctccctcaacctcggtcgccgtcgcgtggccaaccccggagcatcgccgccttcttggtcgccgcggccaagaacgccaccgccgcgaccaagggcgccaatgcacgcctccgttcccttccccggcacgcccgctgtgacacgatgccgcctcggcatcgcgttcgtcgccgtgcgccgctgctcgtccatgcgccgccatcggccttcccatcctcaactcgccgtcgacgccgttacctcccgtcggtgagctccccacctctcttttcctctgtcctagcactcgcgtagctcgcgtcacgcgtgctctgtttccgccgccgtgcgcaatcaagagccgccgttggcctccctttcggcgactcctctagccaccgccgttcttgagttcgctctctacctccccaagcagctgtttcagccgccggcctcccctctcgccctcgcgtcgcgtcgcccgattcgccgctgccgcgctcggccacttccgctgtgcctcccctgccgtcggcctccctcctctccttgattcccggcgccgccaccttcctcgggccccccctcgacctccccaacccctccccctggccgccgaccttcctccttgctcccgcgccgtgccgtccctcccgccgccgcaaagcgccgccgcgagccacagcccggcgaccatcgggtcccgcgtcaccgcgtgtgcgccgcaaccccataccgcgtccactaagcccgagcgcgcgagccgcatcccttcccatcgcgcatccacgtcggcatcccggcgagcttcgccgccgccgccggccgtcgtcacgcgtcgtctccccaatccgagccatggaatcggttcgccttgacctcctctagccaccggtgttcgtcgctcgcttcggctcgccgccgttcgccggattccgccgcgcgccgtgagccgtccgatgccattcccgcccccccttttctctccccatccgacgtggctgcccacgtggcgttgaccgggcccgcccctgcccagtcagccggtcagccgtccccctccccctctctcccctggctcgtgggcttggcccattggccagccttcctcctcggcctaacaaaacaaaggaagtttacttttactccctcttccgagtccggtgctcacacaccgaagagctaaaggtccgcaattgctccctccaattgctcctctctctctctcaccttcttattggccccactcgtcaatgagtcaaagataatcttgagaatgtctttccaatattccacaaatatttctctcttctataaattcagtaaatcattttatcttatttcatgggttaataaatctttttcccttgatcccataaatcaattctctattccaaaatttcatgaatcattttccttataaatcatttcctttggtcccgcacgtcagagacggtcaataatattcttgagaatattatttctataaatttcatgaatcaatctccccttgttccacaaatatcttccttcgccagaaattctaattaaacttccaaaattcgtatctctcgatccaatcgtccgattgaccccgttccacttccagtaattccataaaattgagatctatttaatggcactattatttagtctaaatagggtctttttcttggtctcttgtttaggtttttgtttgtttgcgcatagttgcggttaccggattttcatcgatcgtggatatcttgaagattcgtgaagcttcgtgaagaccctgagcaaggcaagccacctttgaacatattgagcctatatttgaacttaattatattgcttgcaaaatattatgcattgataggattacacttaatttgtttgccccgtctgaaaggcagaccggtgggcctacccaactcgttgcatctaatccttccattgttaattgttatatcatgttcccttgtaaccatctagttgcgcctcgatattcgtgcactctgtgcgagtatcgacggtcgccttcaaacttaaaatctgagtaacttcttgggtaaaacttggtttacaaaagctttggaaaacccgatgcctgggtcggtgccttgtgaaagaaaatgagttttaaaaataaaactcgcgacacaaggccattcctgggcggaatacttgtgcggtcgcatctaaggaccgattcctttggaattacatccgagcatacaatagtgcgaccacacgggtggaatgggacgcccctggctgagtaaattgctaatcgggggagccttgatgccgagagacatgtggattcgccggggtggtgtcggggaggatccctgggcttcctggcacagtatggtctgggacctaacctgttgttggtctgggacccctctcgtcggcatatggcaatcctgtgtctgctctcgaaatgccttgtcatgaaagcccttaggtcaccagacgtggccgttctacacgggctaggtgatttgggttagtaatgtcgtatgggtaaagtgtaccccctctgcagaggttaacaaactgttcgaacagccgtgcccacggtcatgggcggatgtgaggtgattccttagcgtagtttttgttttaccctgttttatgaaaaggtgttaaggtttgggaaacctaatgcttgggaagcatttagctgtccgggggacagcgggaccgggtgtccctggaagtgattggtcgtttggggacctctattatcgggaagtttggaaaattggtttggtttgggaaaaaccagatttgaagccaactctgggagttgtgcaaatcgtgataaataaatttgttacttctcacctcccgaccgagctgagacttgtctcgctctggttgtagaaagcacacacttagattgttgaaaacttgaaaacaaaactgtttgcaaaataacagccttcccttgaagcctgcattaaccacctaagttcccctggcttgctgagtacgtaagtactcacccttgctctctatataaatatagttcagtcagctccgaagatgaagttgaagtgaagtaaagattagggtttcgtcctagttccctgctgctgcctgtggtgttgggtgttagaccgttggttccgctgctgctgctgttgttggtgttcgcctcgtccgtgtcgtcggttgcattctcgggctgtctgagctgcaacctaagttaaggtaaataagtcctctatttattttaaggattgcaatgattcatatttatcaccgtgggtaccagcgctatgtcctgggactggtactgagatcgcggtttcgtaggaagcggttcgcgccatttttcccacgacacgctcctgtcaggtaccgttgtacggcggtgccagattaaaggaaaatcgagggctagatgtttctaatatattaaaacaccgtgtggcgacttaggagcgtttataggagtgccacatgacgatatgagagcgtttataggatgtttaatggatttttagtatataataatagatactgaagcgtccttatccccttaatgtgtgtgttaagtttacacaattttctggagtggtatacacatgctatatgaatgttctcaaatatttcaaatgctatatgaatggtatacacaattttctcaaatactgtttgcaaggtatatggtgaaacgatgggacatcatttgcatattctcccactagaatgcaagcaagcatgtactgttcatcaaacccatacattggataaacatttataccacattattgcatagctttgttagcagcttcttggctcgtagtcatcgcttcaagaaattgtccacctgtgccaagcaaagacctcaaaagtgaaagatcaagtcggcgctaggttgatgcacttcaaacgttctccgcaacacagacttagcagatattacatcctggctccccgaatctgtaaaaacatttactagatggatcttgagaccagatgatggcaagttctcgatcccaacaggtaggcaagtgccaccttgttgctcccaaccattcacataaaaccgtaggtcgagcctctggagcctcggcatggcccccactagaaaggccaggcgaggcttagggcagctgaatgtaaggtccctaagagctcgaaatgccgtgccggcgccagagacgacgatcctctcttttggacattctcgaataccaaggtcaagttggacaagggagggcaactttgcaagaatacaaattccatcatcgccttcaaattcaataggcaccacgcctccctaaccaaaagtaccaagctgtagaggttatgtagctgagaaatccatctggggatcctgggtagccggcaaccatacagattgagtctgcgaagatggcggggtgaagggcacaagtcgctcaagcgatcgaatgacactagaataaaatggctgtccaggtcaaggctcctgaggcagctggaagaacgagatagactttcaagagaagagcacaatgcatccaggcgcctggccacatccgcatccgccaatagaccaatatcgcccaaatggactccgagatgtctcatgttggttagctcaccgaggcactcgatattgttcaccgagtttagtgccaaatccaacgaggtcaaggtgcgtagagatttcaagcttccaatcccatcaggcaacgttgtaccgcaaggaataaccaggtgcaacaaacagggcaagtgaacaatatctgatggaatggctatccttggtacaaatgattcacctagatcaaatgtctccaaatgtagaagctgcctaattttcatacctagcttgaaacatgcgtagtagccacggatctttaagtatcgtagtagagacaatccacatatgccggtcaggtccatcacttctctcatcggaagttcaagatgaagaactcgtaaatgcttcaactccaatagagaaggcctgaaagagcttctgaacactgcgattgatcgaacttgcgatagtgacccaaggattgttgtcgatataatgccatgctcttcatcagcatcgtattggacagaaactctgtggatctttttgtgtgcccctaccacgacttgtggatgatctagtacaacaataaaattctcctctgcagactttgatctgataaaatcaagcattatatcatgaactctgcaggacaacacctcatcattgtagtccacctgcacaggttggatcatgctcctgttgatgagctcgttgaagtagctttgtgcaacatcttctgaatctaacccatgggttctactgacaaaaccttcagccatccattgcctcaccaaatcattcctctctatcgtgtggtcctctggataaatactaagatatagcaggcatgtcttcagatgttgaggaagatttctgtagctaaagtccagtatatgtttcatgtcttctaaagtaggatttctttcgaacatggatcccaatgaattccttacatactcccatttcgtctttgattgaccagctagaagactggatatgctcataatggcaagaggcaaacctccacatctttttagaatatcacctgaaatctcttcaaatacttcagagcaagcttctccagtgccaaatattctactgaataataatcttcttgagtctacctcaccaagtggactcatgttataaacatattctttcttattagagcaacaactaatagcaacagagtaaatcctcgtagttgtaagtactctactgccgtgattattttcaggaaaagcacatctaataacattccatgcggatgaatcccataaatcatcaattacgatgaagtatctacaaacatgtgatagtgtaggggtaggttagcaggtattttcagtagaattaatattttcatgagtatctatctaaagaataactaccatccttcattctagaccaaacttcatagtaggtattaacgataagtacaataacatcatttcgtatcaattaaaaatattcattttgtatcagctaaaaatatccattttgtatcagttaaattaaattgtggggtaaagatttctatatcatgcatacaattgttaagtgtaaatgggtggcccagcccgagccagtcccttctccagatttgtagacctattagcctcatttcggtacatccgaaaacctggtaaattctactaaataattaagaaaaataattttgtatttgttgttgtcaaaaatcatcttgacacatcgacgaggcagggccacccaatgaaactccaattggatgagcctcatccaccttttttatatggcttttcaacaactccaatgaatgttatcttcacccataaaaatattttactagtagttgtttctgatgatattggctttacaaacccatcgctacacacatatcctctcaagttaaaagccaatgcactcatcatctcaatggatcctgtttctctgcctgtccaactaaaatgacactaataactcttattatgtagtcggaaaaaaaatattagatggacttatgtgtagaatcaatttctgaacaacctataagaacagtgattttcatagtaaaatacgaaatctgcacagattattaaaaatatacaaaattaggagactagcagcaggaggaaagtacatggtagatcttttttttttcataaatgcacataaaccataatcacaatattattagtactccatccatttcaaattgtagtcatttctatccacgaatagcaatactccctacattctgtccagattcatatatagaaataatacattttgatagggagggactagggagtatgggtaaaatataaaatcggaactttgtagcataccgacacatgaaaaggtacctcttgtcttgtagatattctcggataaccttcagaaggttatctaactcgccaatgtgaagattgtactgccctgtaagttctgataatactttactcataagccttgttatatcagacctctgagagactgacacaaatgctcggcaatgaaaatgcccatccaatttgcggtacacttcattggcgagtgtggttttacctagacccccaaatccctgttgagattatgggcatataatgatttaatttattccataaataaatcatgacattacagatgaaaactagcatgaacgcatcattagatctacacatgtaaactacgcagaataacatgaacagatcaaatatgcgcaacatattgaacacgtaccgaggtgacgaaaagaccggcttcttggtcgaaacttttcgcaggtgtctacgaaggcacgaaacacgcgagcgaagaggaaggcgagccgtcgcgaacgaacagggagcagtcgcgcgaagcgcttcccaaaaaccttattgccgccttctcccggtgcaggacgtcaaaggcagaggttccggagacctgctctcccgatcgctggtgcacgccggcgagcgggatggagtagtctacgagcgacggcgcagtacagagtaggaggcaaaccctagattgattttcgcatatattgcgtgaagacagcgggtcggtttatatagagaagggtcacttgatcagggcgcccgcacgatctctactgcgcgtaaccgaaccggataagtcgcgcgtaacttatccggactccacgccgtgtgaatttgcagcaaaacaaaactgcaaaaggaggctgcatctgcgcaagggtgaggagctacgtcgtgcacgcgcgccgcctgccctgccaggcgaggcgagcgcgcgcgtgtttcccctcttctctccaccacacatgcttcaagtggctaggagggcatcctcccttttaaggaggtccccctctcctagaataagcaaggtggtactaaactccacatgcatgccatcccatgaggtgggctttttgtgattttccaaagaattaatcttcgagtgggctaaggcccattcattaattccaacaatcccacaatagaagccaccttcagctgttgctcatcatcacccatcaacaatttgacaacgtcatctcttgggatgtcaattcccacaagatcagctgtgtttgcataaatagtgaccactcgtggatcaattggctcacaactagacttggaagtgtactcatcaagtttgtacctcattcgccgctcgttcacctccttgacatgattcttgatctcttcaatcttcttagcaatttgatgacgtgcccttagcttcctcggaagttcagtagttttcttgataagcccagatctcacatcatacttgccaaggcggtgaacgaaatcatcgatgcaatcttcaatgtcataggacatctccctcacctggtccctccactctttaacctgaacatcaagctcatccatgcatgcgagcttctcaagcagagcctccatgcttctcaactcaccctcaagagacaccacctcgtttcggacccctttgagcttgctgtagcactcctcccttatcagtgtagcgagcttggtgaggagtgagttcatcacgccactggaggaactagccattatggccaactctctctttgctcaggttctctcttggcaaactatatgctcaggaaatgtgagagtagcacagataatgcttgcaggctcgtcttgattgtccagaaggttaattaacttaataatatatttcctcaagatccacgccgtctaaaataatcttacttggagcagcaaagagagcagagtacatgggactaagtaaaaatcaacccactctacttattttagaagcactgggtgttgacttattgccctgaatcaatgtactccctccgttttttaatagatgacgccgttgacgttttctcatatgtttgaccattcgtcttattcaaaaattttatacaaatgcataagatataaatcacacttaaagtactatgagtgataaaacaactcataacaaaataaattataattacgtaaattttttgaataagacgaatggtcaaacatgtgaaaaaaagtcaacgtcgtcatctattaaaaaacagaggtagtatttaggtcattaggttgtaattgttattttatagataactagcatggtggcccgcgcatattacgcggctagcattgttagatttttttctcatataatagcttaaatattttcacattttattattaaaatatattaaaatgataacataattttaaattctgggttgaactaacaaatgcgtgatattttattgtattgtatatacgtgatagttgttaattttgaattaacaaattatattataaattatatttctatatggactcaagagtcagcttttaatattccttatttttaaaatttcgaatttcctttattcatacattctattccaatatagattctagactactcttccaatattcatttttcttaactctaaattttagttatttataaattgtatttttatatggactctagactcttctttcaatatttcttatttttaatatttaatttcaattattggtaaattgtattccaatattgactctagacttctttttcaatatttcttatttttttttaatttcagttatttctaaattgtattcctatatggacgctagacgactcttctcccaatcttttttatttttaattttgattttttgtaattctaaattgtatttctatatggactctaatttctacttttagtttttctattttttaattccgaattttaattaattctaaaatggatactagtctactctttcaatatttcttatttttaattccgaatttcatctatttttaaattgtattcctttatgaactctactttttctttttcttcaattagtgtgaaaatttctaaacggtgagagcaaacgtggtggcttctttttttattactttaataagataatagatagatagatgaatataaatccgacatctatattcgcatgtgggtatacgcaaacaaaggttataagaatgcttagagtccaaatctcataactgagataaacaaatggaaaacaacaaaatagaaaacacgaagcctaaactttgatctttccctgtcgtgcttcaatcttgccccttcgctctgtagcaacagagatgtgtcacactacttagaaactttggtgtcagaattatcttgccaggtacagtgattttccgctgcctgacgaatcctgcaatagaaaattgcacttaggcaatctcgtggagcagccgccctcatgaagctccccaacttataggcggccaaatatgagaatggggagatgcggaactagcccgccgccgatctgtcgtgcctattccatcccattgtcactttggccctgtttagttccaaagtttttttccaaacttccaactttctgtcacattaaatctttcatacacacgcaacttttcagtcacaccgttctaatttcaaccaaacttccaaacttcagtatgaactaaacacagcctttattcttttctaatgccgccagcggcaaagacatttctacaatgatgcacacaaacatcaaattttgagtttaaaaataagaaacttgaaatagaaattagaataaacctctcacgatgaaattgtaggatcgaacaataagagctaagcttaaaaaaaaaaagggtgaatggtggtaacacgaataactgaaaacttttagcgagattaaaagttaactcgaagttaattgatatccttgacacaactgccctgctgcgcctgatagaagcccccttgcttaatttgcacagctgagatagcaacgctgctagcgcatgatgagtctaaatagactcgcatcagaagacgtcgccgatccgcccccaagcgcgaacaccttccgtcgtctgccgtccatcccaacgcgagaagatgcgtcgccgttcctcacaagagtagcaagccagtaagactgtaagagcaagtgagcacgttcgattgttgcttgcttgctttgtgtgattccttgttgctggataatggaaccaattacagtaaatctaattggagagtactctccaattagtcttaaccagagacacccacgtgctaatactttaggagttttggttgctattaatccattgagcaagtagggaaaatattcctatcatctatgcttcaaatataattttctcttaaattactcatccgatttacaatccgattacaccgttgtgttcgtaataattaaatctttacaacaagatctcacataattatattttaatgaaaaatcacaaattacttttatgatatgtctaaattacttttagattttactaagttacttcttagacatataaaagtaaattcagtaaagcctaaaagtaatttacatatattgtagaagtaacttataacaaaaagtaagttacttttagatttgattaaaatacttcctatacattcataatgctatgaggtgattacttttattatttttgtagttaattccataatttatgctgattaatttaatttctagatagagtcatgtttttatctctacaacggattcacttcaaatgacatgctaaagttacctttgttctaagttacttctataatatatgtaaattacttttaggttttactgaatttacttttatatatctaagaagtaacttagtgaaatctaaaagtaatttagacatatcataaaagtaatttgtgatttttcatcaaaatataatcatgtgagatcttgttgtaaagatttaattattacgaacacaacggtgtaatcggatcgtaaatcgaatgagtagtttaagagaaaattgtatttgaagtataggtggatggtacctcttatagatggagtggtagctggtttagacaaactagctaacactagttgtctagttacgtccaaccaattaacctatgatcgatgtgtgtcttcattattcaccggaggtccctcaatttaatagtgagattttttaatcccttaaccacaaaattagaaatatatgcccctagtcagcaaaaaaaatttaaaaagtacgtggagcccacatgtcagttacacaacttttttttcttttcttttcttctccttctcttctctttctcttcttcagtgagtgaggccggcggcggagagggcggagcggcgatgggcgggcggcgggtccgcgcggcggcgggcggcggcaggcgagcacggcctgtggacagaacggaggcgggcggagcggcgccgggatgcaggcagagcagcgatgggcggcggcaggcaaccggatgagcacggcgggcggaggagggggtcgcaacggcggaggtggccgaaaccacgtcagtgaaaccacttttttaaattttttttgctgactaagatgctacgtcagtgaaaccacccacatatactgccatgggacctcctttgaacggtttgtgtgagtttaggggtaacatttctggttttatggttaaggggcctcaaaaaatctcgctgttaagctgagggaccttcggtgaacttattccaattgtgagcaactcgcttgttcttttgaggggctgtgcgcatcaggggcaggcccaggaaccaagccggatgggctgatgcaatctgggcccaaaattcccccagaagaaacgggtattttgaagcccagcccaaaaaatatgaatggatcagcccaaggcttggcctgatagcaattatctgttctgaattatgacggtcttcacgtatgccaaaagaacccagattggaaatgtgtgcatacaaaatatctaatgatcattgaaaagtgaggagtttaattatttattactttagaaaatagccactcttcaaatgttttttatggacacaactacaccaagagagtgctagctggatagtgttaaagagagacatcatttttttcaaaaaaaagctactattacactcaatatctatgtattttttttcttcttagagaagtttctcttaaattactcatccgatttataatccgattacaccgttgtgtttgtaacaattaaatctttacaacaagatctcacatgattatattttgatgaaaaatcacaagttacttttatgatatgtctaaattacttctagatttcactaagttacttcttagacatataaaagtaaattcagtaaaacttaaaagtaatttacatatattataaaagtaacttataacaaaaaagaaagtaactttaatttagaactatacctagattcattaacatctatataaatatggacaatgctaaaatgacttacattatgaaacggggggagtaactctctgtagtagaaataattatattgtgagtgagctaaaataagaaactatgtagagtaaatttgcaagtaaagtgtagagaagatttataaagtccaaaaaaatatagaattaactaaaaataataataaaaataatcaacttagagcattatgaatgtatagaagtaatttagtcaaatctaaaagtaacttttatatatatatgataaaagtaacttgtatataataaaagtaatttacaaatataaatgttttttcatcgtaatataatcgtgtaagatcttgttgtgaagatttaattgtaacgaacacaatggtgtaattggattgtaaatcggataagtaatttgagagaaaactttataagaaggaagaaaaagatacatatgtctaagagaaaaaacagcacgcacatcagcacgtgtagcagtaattcttctcacaattggttcgtcgctggttaacactaaatcgagaggcttcttggtttagattttaccgttttttatacagttgttcataccattttatcatcggagaaagaagattgcttaaacattttcgtctacgtggcacaacacattgacgtgctagagtggacgctgggcagctgcctccataattttcttgccgtgccaaaaaaaaaaaggaaagcgccatatatttctctccggtaagaaaaacatagggaccatacaaaagctggtactaacttccaaaaacaaaggtatctatccacccacctgtgcgccaacaacttagattcagaaaaatacataaaaggaaacgaaatagcaacagatgaaaacaaaaataaatgcagcgcacgagcgctgacccagcatttgcaggttgcagctggatctgtagctgtccttttgttgccatcggtgaagatcgagtgatcgacatatatatacttcattcacacttccagacagttaacttttaagcacatatttaacttttaagcatatattgatgattcgtcttatttaaaaaaatttatacaaatataaaatttataaattatttttaaaatactttaagtggtgaaacaactcacaacaagataaattataattacataattttttaaataagataaatgatcaaacatatgaaaaaaattaaaggggttacctatttaaaaatggaggttgtatattatttttgcagttgcgattggagctggcatgaagagagagacagtgcgacacaagcgcgtcgacccgtgttgtgttggtcacatgtaccaccaacgggcaacagcctttgcacatgcacaaacacacacaccaccccgctggcgcacatgcactgcaccctgttgccgttcctaacatgcacccccattttcatacaatatccgtcacataatttggtactaatacgttttctctatcacttgaaggaacatgtggatctaatttgctataattattatgcattttggggttggggttgtggtcgtgattctttgttgtctcactttcgacagtcaacttatgcttatatacatatgtacgtagtcaccctagttaattgacatgctgaaattcagcacgccgaaatattttatgaatgcctttattttctttttgaatgattgtagttcttgtgaagctacaacttaattagccttttgttttctcaaactaaaggttaaagtatcgatcgcataatgctatcacatttttctcaagtagattataatattagtataattgaatttaatgatacaagcttgctagtggaattaattggtgttggagatatttgcccccaattcttcttttttaaaatttttatgcttcaattttaactcatacgaagagaggctcaaatgtatacgattgaactcgcgagactacattggatagtcttaaatcatgtatacattggttttatctggatgggcgcaagtggaagtatccaaagcatttcttgacagccactgtttctgattaaagatacactagattttatctaagaatttttattaagctttgtaagatgaaatcttatatatgtaagtcactgtggaatagtttggtttggtgccctactaattcattggcaattttcaattgtgttttagttatttggattggtgccaaattttaacaacacatctcttcgataataaaaattttgcctatccaaatttggtggtgctaaaagttgcccaaactttggcactaccaagattttacggcaccaaaccaaactggctctataaacccttttttaaatttgaaataattaaattttaattaattatgtgctaatgattttctcctttttgcgtgtcctgccaccctccctcgaacgatctaacggccagcattcgatcgatctacctcattggggtaacccaaaatgaagcttaaatccaatcctagccgttgaaaatccgaattgttgttgccgttataaatagtagtagctccccctaatttgacttttctctcccccgttttccttctccatttatccgcttccgcctcccctctctccctgatgcacagatgaaccgcgtgccctaatcctctccgagattagtacctatccgaggaaatcgagggttggagcttgggattaagattccgcctgtacgaatcgaagtgcgcggctggatcggtgggggtttcctttttgatttgttcgcttctctttgcgtgtttgatgtggcgattcttgtacggattggcgtcttgatctggtttggttttgggaagattggaatctgatgattccgctgtttgttcatcagatttcccattatcttgtctgtttgatggattttttttttacgttcctggagcaaaatctgatttgaattagatttttgttttcatgcccgtttttagttggtctatcttgagcatttcttctgagtattcaatgtttcgtccccacgaaaattgtcgtgtttattgggaattttttgccctaataattcgatttttgcacatttgcggtgcttcccagatgagatctgtgcctggcgcctcaaaattttcgcaattctgtttgacgttttgtttcattttgtttccgcgcagaggttgagcacgccatgatggcgaacgcgaggtttcagaagcaggcattgctgccgccgcggagcccgttcccggcggcggtgggggcggcgccgtcgccgtcgccgcacgccgagctgggcccgatcgcgcggccgcgggacgcgccccaccggcacggccaccagcgcacgtcgtcggagagcgtcctcatcgacgagcagccgtcgtggctggacgacctgctcgccgagcccgaggcgccggcgcggccgcacggccgccccggccaccgcaggtcgtccagcgactccttcacgctgttcgacggcggtgcctccgccgccgcggctggcatgtacgacaatgtgttcgatggaatgaggggaagaggtggaggaggacagcaggttggttcttggggtgccgcaccggagttcttcccggaacaaagctcgtttgggcggccgcaagggcaggggggccggccatgggattcgagactgatgctccgacaaggtggtggtggtggcggcggcatgccggtgccgatgaatggtggccatcatggtccaccaagcgcatttggtgatcatgggcatggttctttgccgaatggggtggacaggaaaggccctggagattcagctcatgatcagaggatgggagcagagaggaaagagggtgcacacctaaggcactcccaatcggaggcagacaccaagcgagctaaacagtgagttcgattttattccatgctcattgctaatttgctatcactttgataatcaaagtttgattgaccagttgtcgaattccatgctcatgaaacaccaattctgataatgaagcttgcatcatgaatccgtgattggaatagcagaatgagcctttgatacactgctatcaaatcacctctagcccctggttgaagcctacactgttaacaacactgttgtggttcaatgttttgtgactctgcagggcgtatctagtggcgatcacaacatggttggagattgaattaatgccgaagatattagcttgcactctatttaagtaaaagtgacctgtaaactttatatttctagtcatgatgcatatgtaacacacattaactcttgataaaagcccattttctacacccaccagtagagtgcactatctttctaatttatgaaagttttttcaaaattttaatagataaaaaaaatcgaagatctttaaggaatatcatcgaattactttcagtaaattctttattttcattttaaagtatgcataacttaatacagggaatctatttgctatttaattccaaaaggtatccccgccaatcttacagtatgataaaatcttctttggagaaaattttacaagtattttcacttggagtttttattgactaactacaaaaggttcttcagagaaatctgatacatgttttatctacaatagagtatgaagaacacaattccgcatcatgatttctgttgatatgcttggaaatagctactttgggccgtctttgattgtgttactcacctgtgatagtaggtttaatgttaaaggtagaattccctgtaaacatatggaagccacagaaacaacattttttaacctacaatagaaatgagtaatttatcatcaaattagaaattttcttgtgtagttgcgtagataaacgacatcaagaaacaataataaaaagcatactgctgttttatatgtcctggtgatcacatgctgtctcaatctacgtgaaaacgcaatggtaatacttaccttagtaattagcctctgttttcaaggcaaatcatatatatgttagaatttcaatggttactctcattgagaagaggatggcactcgagatggggcgattttctggttttcttcattcactaaacacaaaagccatgcctacccgagggaggttggatacatatatatagccatagctggctgctagcctattgctgcaccctcctagtctaaaattcgaaatttgaatgggatgttgtcctagagggcatccaaactgaataaagcataaaggaggcataaaggagatgctaactgctgctgtcctactaaccgcagctgtcctagcaactgaaaaatatgctaaagggtagatgctgtcctgaaaaaggtgaaactacccaaaagcaaaaagaagaatcatgaccaaggaccacaaagacttatccaacattctccccctaagtcttgtgcgtcgtcttgtggggaagttgggccatcccgatcctggagcagagctcgaggaacttgatcctcccaagaggcttggtgagcaagtccgcaagctggtccttggtgttgatgtagctcgccttgatgctcccttcctccaagtagcttcggatgaagtggtacctcactcggatgtgcttgctccgttcgtgaaaaacggggttcattgccagggccagagcggacttgctatccaccctgagctccaccgttccagtgtctctgccgaggagatcactaagcagtcgagcaagccagagcgcctgggtcgaagcggcggaggccgccatgtactcggcctcgcagctggacagggccaccacctgctgcttgaccgactgccaactaacgaggcacttgccgaggaagaagagaatcccgctcgtgctcttgctggtgtcgatgtcgccggcgtggtcgctgtcgctgtacccgacaaagtgtgccttgccaggacacctcgggtagtagagaccgtggtcgagagtccccgcaacgtagcggatgatcctcttcacagcctgctggtgctccgtcgtcggtcgctgcatgaaccgactgacgtagccgacggagaaggccaagtccggccgtgtgtgggtgaggtagcgaaggctccccacaagacgtcggtactgtgtagcatccacctcctccgccgtgctgtcgcggctcagcttcagtctctcctccatcggagtgagagctgggttgcaatcggtgagcccagccagctcaacgacgcgcttggcgtaggcggtctgttgaagcatgatcccggagttgtcctggtgcacttcgatccccaggtagaaggagagaggccccagatcactcatctggaaggtggccttcatctcctccttgaacgccgcgacctccgcatccttggtgccagtgatcaccaagtcgtcgacgtagacacccaccagcaaggcatttcctccattgccccgccggtagatggccgcctcgtgcgggctttgctcgaagcccatccccttgagcgtggaatccaacttggcattccacgccctcggtgcctgccgcaagccgtagagggccttgtgcaggcgtagcaccttgccctccttgccggggatcacaaatcccggcggctggtgcacgtagacctcctccttcaagtcgccgtttagaaacgccgacttgacgtctatgtgatggacgccccagccttcctgagcagccagcgcaagaaggagtcgcacggactccatccgtgccacgggagcgaaggcatcgtcgtagtcgatcccctcctgctgcacgaaaccgcgtgccaccaagcgagccttgtgcttgacgatggcttcggcttcatccctcttcagcttgaacacccacttaagggtgatcgcgcggtgaccatgagggaggtcagcaagctcccaggtgcggttctcctgaaccgcgtccatctccgactgcatcgcggcacgccatgccgcgtgtttctcggcctctacaaaagaccgaggctcaccgtcgtcgcacgcaaggtgcaactgcgcctctaggtcgcgaggcaccagtcccggcaccggctggtcgccgagaagatcctccatcgtacggtaccgtagctgctcgccgtcgtggtacgcgtcgatgcgctccccgtcgtgggagagcggagtagcgaactccaccgggctgcgctcaacacgagctggcatcggagtagacgtgcttggaggagtggctgttggtgctggagcatgtggagtcactggctggggtggtgtcgacgaagagctcgtcgtagtcgaagtcgtggcccgagggtgtgttggtgttggagtcggtggagattcgggggctggggtagacacgctaggtgaagaagagctgcctactcccccagctccctcgaagtggacgtactcgacggtgaagtcgtcgtacgtcggagtcgaaccatcgtccaccgccttgtcccatacccaccccctcgcccttcatcgaacacaacgtcgcgcgcagtgcgcacacgctgtgtctccgggtcgaggatgcggtaggccttcgagccctccgcgtagccgatgaacacccctggggtgctcctgtcatcgagcttgccaatgtggccaagctccttggcgaacgcgaggcagccgaagacccgcaggtgggagaccgccggcttgcgcccatgccaagcctcgtacggtgtcctgccatcgagggccttggtaggcgagcggttgaggatgtaggcggccgtcaccaccgcctccccccagaagatggccggcatccccctctgcttgaggagggcccgagccatccccacaaccgtctggttgcgccgctcaacgacgccgttctgctgcgggctgtacggcgtggtgtagtggcgctgaatgccctcatcagcgcagtacgacgcaaattcagccgctgtgaattcgccgctgttgtcggtgcgcagcacgtgcagcttgcggccgcactctgcctctgcagcagcctgcgcatgcctgatggcgtccgcagcctctcccttgctgccgaggaccatcacccacatgtagcgggagaggtcgtcgacgagcagtaagaagtaacgtcgccctcctggtgtggccggtgtcactgggccacacaagtccccgtgcacgagctcgagccgctccttggctcggaagctcgtctgctggggaaaggggagccgccactgcttcgtcaccacgcaaacgtcgcagagctgctccatgtggtcaaggcacggcatgcctcgcaccatctccttggcaccgagctgcttcagggcctcgaagtggaggtgcccgaagcgctcatgccactgccacgcctcgtcgtcccgacgagcggtgaggcaaactggttgtgcgacctgtgcgctgaggatgtagagtcgattagtgtccgtcctcgaccaacacgcgtgagccgttctcatccagctgtcccacgctgatgatagaattcctcaacgcggggatgtagtagactccggtgagcagcctgtgctcaccggacttggcggtgaaggtgacggagccaacacccttgatctccacgccggaggcgtccccgaacttgacggagcctcggacgctggagtcgaactcgatgaagaactcccgtcggccggtcatgtgatgggtggcgccggtgtcgaggtaccacccatcagccttgtcgttgctggagccgttgcagagggagacgagtaccttcggctcatcaaggtggaggaaagccgttgcggccggtgccgctggaggtagctcgatgcttgcgtgagccaggagcagagccggctcttcctccacccgtgcgacgtgggcctggccacgtcgtggctgtcgacagtctttggcccaatggccaagcttgccacagttgcggcaggcgtcgtctcgtgccggcttgtggttgccggtggcaacgccctgggcgcctctgcgggcgccaccctcggcacgtcttcgcacccaccgtagctggacacctccccgcgccttgcgcggcttacagccgcctgtcggggaagatgactcccccttccttccgtcaccttgagaggcctcccactgctcccgagtgagatggagcttcccgccgatggtgatgggccccgagagaggctgtggctcatcactatcgacgaccttgaggcgacctaacgcctcctcgatcgtcatcgtggagaggtccagcagagattcgatcgagcgagcgatctgcctgtacttctcagggacgcagcggaagagcttctcgacagctctctcctcgtcgtaggtgtcgtcgccgtactgcaccattttctgcaagagagtgttgagacggagagcaaagtcatcaacatcctcacctggcttgaaggccaggttctcccactccttgcggagtgcctgcagtgtggacttgcgggcgcggtcgctgccgatgcgtgccgcagcgatggcgtcccaggcctccttggcagtccgcttttgggaaagcgagaactgcatctcgggcgggattgcagcgatgagggcatccagtgcccgccgatcctcatcgtagtcgacgtcaccgtaccggactgcctcccacatgtgccgcacctggagcctcaccctcatcaccgcggcctactcgatgtatttggttttggtgagggtaggccacccaccgccgggaccaaagtccctgaccaccgtctggacgccgtggtgaccatggcgccggtcaggggagagagagccgtgctgcctgcgagggccacgtgcgggctccgggctgccgccggcacgcccgcgcccgtctgggttcccgtcggcgggcgcgcggtcccttgggccgccgccgccgccgtggaggtgggctgctgcccaccgctctgctcgctcccgtgcccttcctcttgccagctcctcaagttccctgtcggcggtgatgtcgccggcgatggagccgttgatgctgctgcgcaaggtctcaacctctacctccgccgcacgtgccgcatcttccgccgcctccgcctccgccctggctgccgccaactccgctgccgccagtctagccgccctcgctgctgctgcagcggtctgagccgttgctcgcctgcgctcttctgctgcggctagctcggcgtcttgctgacgccgagtgctcgaggcgaccaaacgccgagactgagcgtcggacatggcgcacctccggggggctgctgcgtggagagggggaagggaaaggggaaggaggagcaaccggtgctgctgctgctgctggctgagagctcaaccgagcttgggaaggggtggaacaagagatgtttagcctacaggaaagtgtggctctgataccagatgttagaatttcaatggttactctcattgagaagaggatggcactcgagatggggcgattttctggttttcttcattcactaaacacaaaagccatgcctacccgagggaggttggatacatatatatagccatagctggctgctagcctattgctgcacccttctagtctaaaattcgaaatttgaatgggatgctgtcctagagggcatccaaactgaataaagcataaatgaggcataaaggagatgctaactgctgttgtcctactaaccgcagctgtcctagcaactgaaaaatatgctaaagggtagatgctgtcctgaaaaaggtgaaactacccaaaagcaaaaagaagaatcacgaccaaggaccacaaagacttatccaacaatatagataacgagaacccagtactgtaacagtagtagtatagtagatccttgctgtgaaattatcctgtgacaaaacaatacatgctagaaaaattgatcaatgttttaaaaaggagtaagtggttttatgcggtcactaagggtgcaagcgggcaggcccgcgaacccaattatagtacaaataagcggttaccgcgtatttgttctattagtggcagaaatgtagtagcagcgactgcagcaaagatctgctgcattctgcacttgagggattaggatgctcccgaaggcaacttgaccctgcgtactgtgttcaatgcccggaattgtctgaagacatattaagaaattcgtatggcaattagagcaaactaataaggaaagtaagagccgaattaaatcataggagtaacgaagctcaacaccgtcgtgtgaacaaatttaagttttttcaatggaaattaaatgaacaccatgatggtaacgattatgttatatcataattcatacagcagaaactttccattcataataaaaacattaagcagtgctttatatatgggtagaaataaatattaagagcaaactaattgctcaggagggatttaggggtaactcttaatgtgagccatgtgatcaaataaaagtgatggtcaggatagtagtatcaacctaatagttaatgcaccaattcaaaactcgtgctttttatatgttgaatgctcaattgcatatggccaatctaaagtttgtttgaaatctttatcagattgaatttaccctgctacacagttgcctttacttgcaatttgtaagtctagtacatccatcaatccctgaatgcacacaagctgcatatctgcatgttcaccaaactctctggtgtcaaaacatcttatgttgacagctccattgaaaggatgaactatttgaatcaattcttgacattatgcagagtttactggtatatcttgaacatcatgtcatatgcatttaacaaattgctcccaactacccatttcaggcagtatgctcagaggtctcgtgttagaaagctccagtacattgcagagctcgagagaagagttcaagctttacaggtgaccttattgcaaggaactgttttaatgctttcttgtacaagttcgctttgccttaatgtttaaaaatggttgtttcaaatgtttgcagacagagggtgtagaagtttctgctgagatggattttcttggtcaacaaaatatcatgttagatttggagaataaagccttgaaacaacggcttgagagtctatctcaggaacacctaattaaacgctgtaagtatgatatctcccttctatattctttcacacgagtaattttattgcaatgctttcttttgccaatcgatgtttttagttctctttctattatattagagtgaattatgatgttttcttctgatttttttaaggcctatttggtttggaaaaaaaaataaatttgtgcatgtgtagttaatgttgtttcctctctctctcacgtattgattttattatctttctgagcattcccgtgtgactaatcacagaaaaagaatctatctcatcttaccaaagaacttaatagaagggtactccacgctttagtcattctctttggtaataatactttatatcttataactttctaaatctatgtgctggtcctgccggatcagaatgcacactatgtaaatcgatggagggagtatgtgacaaccaaaaatcctctatgccatcttacaatcggtgcatgtatcatatcaaaggctcataacctgagcatgatgtttcaacagaaaattacaatatttccaccgtagcaagaaacattgagattatctggatattttcttttgaatgatagtaaaccagttgcattgtatttcttcatcaagttttaattttgaaattgttctgattaaatgactgatcatctgaactcctttctacagttcaacaggagatgtttgaacgggaaattggccgtctcagatcattgtttcagcaacagcaacagcagcagcacataccacagcagcagggtcctacccacagtcgtagtaacagcagagacctcgattcgcaatttgcaaacatgtctctaaaacacggcgatcccaactcagggcgtgatgctgttccaggccttcgcatttaggattcttttcccccagcttatgattctgtgagtttcacatagcttcgctatccctgtcataccactatttgtggtcattagttgcatcaggaggggagcagcgacgatgaacctggaatcacatccaatgatgaatagagctggaaaggcttagtaactatggatccaatccttatttcattctgaatgtgcacctgacggtcatcctcatctcatatccattgttttgatgctagaccagtcggaggtgtttagggtctatttgcagcttgaagcttttcttgcttcctagtcagtttgaaacaaggttctaattcattcattcagtctttgtttcatttgttatttcaaatccgcattattacacaccatgtgttgcttctaatagttcggcagccggcacacaaggacatgagcagaatgtgagaagtgttgagattaattgtcacgtcttggagaactgtatgcagcacatccaataaaagcttagtgctgttgaagcatgttgtagttctctcatgtctttgaactgtgtattgactcctgtaataccaagttaatcggaacgcagtgtcatatctgataaggcacgccgtgttcatatgaaaaataagctgttatatatctttttgggcctggaagtatgctatcacttaatttactttagattgtccccttctatctgcttgtattctgtgtcacgttgggtgataatgttaatcgccgatctactatattaatagtattgtgcgacatttcgtctagattggtcccatttcactgctgacttttttaaactgctcatgattcaagttaaacatcagttagattatttgaaacatctgtggtttgatgaagtttttcgcatatcggagtagaatgcttagttcaaattaactgaatttagaaccacagaacaaaagagagagaaatgatctaagctgcaactattggttgttccagctattggtataaaaccttgaacttcaaatactagcaaatggttgttgctatgaacgcaaactagtattaagataataaataaaaattatactggagacagtgaaacaataggttcttggcagtcctgtcgcttttatccgtagttgattttaattcaatgttcatttgtaaaaaaaatgttatccaggcaacatacatcgctaaacaggataaatgaccgagatgtccattgaccatgaaaactgaagtatgaatgcaagtcccgttgtgttataatagcatttcttacaatggatacagggagcattcatatcaaatagaccaactaattggtcgattacatagaaaatgtctgggcaaattgttgccatgcagcgaagaccacccagaagctacttctttttgttctgatcgatgttcatgcctgtaggattgttctgccgaaattgagtcactgcagtgtcaaatgtcccccttacatgctggcacatcaccatcaaatcctgcaaagagtctttcagaacatcctttgctgggtctcctgccaacatatacatcatacatcaggaaggcatcaaagatcaaacatttgtcgaaggcaatggtgcagaagagttttaaattgtaaaatgacagggaagaacaatagccatcccttcgatatttggaatatctgctaataatttggagggaaactactaatacaacaacattattcattaataagattagatgtgctacacattcaaccataagaacagaagctgtactatttagttataattgctctccacaataatataataaatatgtacacaccagctgatacacatgactgagtagtcaaaaaaagaaaaaaaaaactgtttggaattcttgcagcttcatgcgatgaatatatattccattatacaaagaaagtgaatattgatataatcatataaggcccattcaatatgcattgacaatcaaaagaaatgggacaattttgatcacccactatatgatagtacctgtagtctgaactcttatgttgactttgttgtcagcaggatgagggatactgtatccacagaatgctacccttgggctgtaacaacataaagaagagataattacaatgagaagatcttatacatcaggtttatacccaattcattgaaaaacacaagttaattttgaagattgcaatgattactatcgttgtctgaagcctgaaccattacctaaaaccttatttactattttacttattgagagctgatccaactacacataatgcaatacctaattaacattccaagttgttatttgttaaatatgcatgaccagcagatattatatcatttcctatggtacctcaggagttgttgtttgctgctattattatcaaatcaacaaggaacatgaactgttgcatgccaaagattaagctatcaatcaccatcatacaccagaaaatatgcctagttatgataaaccatgagaaatatgtttaatttactgatgatagcctctaagaaacatcatttcatacaaaaacatatcagggatgccccaaagaactaagtttcctaatcagtcaaaactcacaagctgccacaaaacatatccacggaatgctacccttgggctgtagcaacataaagaagggacagtcacaaagagaagttcttatacatcaaggcttactcaattcatagaaaaactcaagttgattttgaaaacagcaatgattactatagttgtcttaaaaaaaaaacttatttacttattgagagctgatccaactatacataaatcagtacctccttaacattccaagttgttatttgttaaatacacaggagcaacagatatcatatcatttcctaggaagcccaggagttgcttgcctgctgccattattatcaaatcagtaaggaacatgaattattgcatgcgaaagcttagctatcagtcaccatcatacaagggaaaatatgcccaagttataataaaccacgaataacttattttacttcctgagctatctctaagacacagtgaaataccatttcatacgattttgctaatgagtcgcatgcacccagatttttgccatggattatttgatcaatgctaaaatatgatttctcaaaaaaaaaaaatcttctactgcattgtttagaccacttgttctaagctatttatgaagtttatttttcaaaatattaacttattgcattaatcaagcaaacaatccacgtcaataatccgctcaaaaaactgtctccaacaggacctaaaacggatcagcaattccccaaagaagaatcgattttcctaaccagtcacaagcagccacaaatattggcgagaacaaatagttctttacgtctattttgtgttatattaattaagttgtagttgcgagggaatacaagcaactcaacatataattctgcactcataggaggtaattcttattctagttctgagtgttccaatctggatttaaactaaacaatggtgtggatttttggttattacattacacaaaccccagttgctccaatctaacaactcagcaaccgcatcaaaatatctaaatttctacagtacgaacaacttcgactgcacttcaagtggcaaccacaatctcttgatgtcaacaccacaaaatctaaaagagtcttgcttggttaacacaaacacatctattaaaggaggaacttgtacgcactcctgattaagaacaaatctaacggagttggcgagcgtgtgatcctcctccacgatggagaacgtcgaggccgtcgagtccgtcaccgacccatgctccatgatggcttctccttgcctacaagaagcaaccaaaaaaaaaaagaaggttcatgagagctaatccaatccaaggaagcccttcaccaagaaaccaggacaagaggctagcgctagatttcgataaaaaagaggatggatcccccaccggtgggtgccgcactgcgccggcgggtcggtggcggcgccggtggtttggggagggaaagaagcggaggggaaggagggaggggaaggagcgatctggggaagggatggagtgggctcggatctgggccgttcgattgtagggtgataaatatgagccgtttgatttgtaagatgtaatagtgtaagaacgagagatgaggtggtgagcgtgcagagccctcgcagaaccctcactctctcatgccgcaatcaccatgagcgccgccacccccgactccgccgccgccgccaagcgccccatcgacccctcccacgccgacccgtcgccggcggcgaagctccagaggtcgtccccgccggatccctcgccgccggctgaggcgcagggcgacgccactgacggcggcggcgaagtggctggggtgagaagcggggagatggccggcgcgcggaaccctcaggcgcagcggtacctggtcgccgtggagtacgtcggcacccggttctccggctcccagcagcagctcaaccagcgcaccgtcgtcggcgtcctcgaggtgaaatgcttctaatctgagctgtggattcgaaatggcgaccgtaatctgcactgctacggatgtccctggtactaggtagctacacaaattttctgaaatcggtaggggcttggggcagatttacgaaggatgaaagtccatgagaatatgaagcatgtatactcgtcttttgctggtctaactgaatcgttacacttacgcggatggcctgctaaagttttagaaattttttttttgcatcaggagatttgacttatttgttgatgactagtacccaatccgtactgcaatttgaggttaatcattcccaaatagcaagtacattcagtagtaactgatatatatgcctgtccttgggtaagcccttggatctaacatatgtttggaatgcataggactaatttgtgaaagtaaaattggagccacgttatttttgacctctcgggttttgagctagctagtagcttcgcttctgttttgctctataatggatgaagttagactcagtgcaacagtaggaaattctatgacatttgtaaatctacacttgtcatgttatatgatcctatacataagaacaactgggtgatgcttggttttagtcttgtaatgggcccaagtgtagtagtcaggatgcaaatggacctcatgtgctctggtgatttgtcagctttgggttatcaagtgggtggtaaatggcaggggaaacgttgtgcagagtacgtcatgactgtggcgacacttttaactttggtgttctggagccgttcgttatgaaaccaaaatttcctaacaagcctcaaccataatattgatacaatcaaaacattggcaacattttgctttaaataaaagaaggcattgttattttcttccgtttctgaagtgtgatcaaagttaagccggtgaaagactatgtcttttatagcttagcaacttttagtggtttgtatgctgagggacactaaagcgagcaacaacagaaatatacccttgaagaatttccagggtgcaggagttacaggtagataacacttgctgctttttaagagcacttgcactgattgaccactttgtcacaactcacaaatgaatcaaatattttccttggaagtcaaatagataccttgaataaaagtatgagtttgtgctatccagggtctctagtgaactagaagatatactccctccgtttcacaatgtaagatcttttgactttttccaaagttaaacttctttaagtatgactaagtttatagagaaaaataacaacactttcaacataaaacaaatacaatatcaaaatattgtatttaatgaaactagttttgtgttgtaaatattgttacatttttctataaacttggtcaaaattaaagaagtttgactttgaagaaaaagtcaaaacatcttaacattgtgaaatggagggagtattaggattagtgttgttatcctgcatcttaaattgtttgcgtttagtctcctttgtgtgttatctatttgagatattggccttttggcttacagtggcaatgcatcagttacttttcctacatctttcacatggtattagagctgaattctaaaccgttgaatgatcgtccaacagcaacccacggctactaggagctgtagctcccacggtagtaccaaatctgttgctttttctgatctgtttcttgtcatgaaaatcactttgagatctgtagtggaggctacatggcattgttttccccaagtctgtggctatcaacagatttgtgacctggcgttgctgccataatcagcagtgtgtttgtgttggctctgcttggggtttagcatcttaggtgttagctctgataccttgtgagagatttagagacttggctgttgcgttacattgtagcccagtaggccaacatgtctatgtaaagggggaattgatatcttgacattccacaaaataaattggcttcgattgtttgcaatcctggcccacatgccattgactcagttccgcatgtcattgtcacagtctcacagcgtaacaagtaacaacataatcaaagtggcaaatcaccaatttttacacacaagggattaaagtagaccagcatgtcagtgttagcaaaaggaacataggtttggagctagttctttatttccatttgccacactcttaacatggctggttgggatacatatatcaactagtggcttacaccataaggcaaagcaaatagcttacatcctaaggtagctactagtgggcttacatcctaaggaaactactagtggcttacatcctaaggcagctaactattattccaaaatagatgttaaaacatatggtaaaaacaagacttaatctgtcattatccccctaagtcttgtgtggcaccttctggggaatttgaaccattccaatcctggcgcgaagctcttggaacttgacccgcccaagagacttggtgagaaggtcagcgagctgatcctgggtgttgatgtagctggccttgatgctcccctcgtccaagcagctccgaatgaaatggtacttgatgcggatgtgcttgctgcgctcatggaagacgggattcttcgccaaggccaaccttccagatgagcgacttgggccttctctccttctacctggggatctcccttcgtcagaccgcctacgccaagcgcatcgtcgagttgggtgggctcaccggctgcaacccagcctacactctcatggaggaaaggctgaagctgagccgtgacagcacggccaaggaggttgatgccacgcagtaccggcgcattgtgggcagccttcgctacctcgttcacacgcggccggacttggcgtttgctgttggctatgttagccggttcatgcagcgaccgatgacagagcaccagcgggctgccaagaggatccgccgttacgtcgagggcaccagtgactacggcgatgtaagccactagtagtttccttaggatgtaagccactagtagctaccttaggatgtaagctatttgctttgtcttatggtgtaagccactagtctatatatgtatcccaaccagccatgttagagtgtggcaaatggaaataaagaactagctccaaacctgtgttccttttgctaactgtcagggccaccagccataattttactttaataacatgccagtttcgcctacatcttgtgtttcagtcgtagactcgtagtagcagagcaatttacagaacaacatttagggagttgcctattggctgttgcagtgagacaaatggattatttctatgattccaggctttcttttaattcagatgatcggactgcaagatgaaataatctgcctttgtctaggtggttgtacacagatttaattaaggtctagtatttaagacaaaggaatggcccagtatttttctcctagaaatggaaatatacatttttagttttgtttgttaggatcatattgaaggcaagtggctactaaagaacggatgctgaattggctgcagttaaataatatgaactctagtgatttttcacaaagaaaatatgtgacatcaagattagttccatactcttgttttcgcttggtctcctttgtgtccaatgtattctagatatgccttttggcctacaatagcaatgcatcagttacgtttcctacatagttacatggtatcagagctgaaatcctaaaccaatgaatgtttatccagcaccaatcccctgctgctaggagctgtagctctcggggcagtacctaatccgctgctgatctgtttctagtcatgaaaagcactgtgatctgtaagtgcttgctgcatgccatggttttgcccaattctatggccatcgttggattcgtgacctgacagtgatgcaataatcagtgatggatttgtgttggctctacttggggttgaggatcttagctgttagctctgataccatgttaactgtttagagacttggctgatgcattacttttggaaaccatgtaaagagtacatgtgtacacataagagactaaagcaaaccaatgtgttactaaccctaatttattttgtagtagcatgcacgtctcatttgcatggggaattgcctataggctgttccagcagtacagatggattacttttgtgattcctgggtttcttttaaagttgagttgatagggcactggcaatattttgcacatgaccaaacagccccttgttattttctcccgttcctgaagggtgatcaaagttaagccggtgaaagactaatgtcttttttagaggttagcagcttttagtggtttatgaataccatgctgagagacactggagtgaacaataatagaaatatgtcctttaaatattgtgagggtgcagcatgaaattgctgcttcttaagagcacttgcactggtttgccacttttaccacaactcataaggaatcaaatgtttcccttggaaatcaaatagacaccttcaagtatgagtttgtgccatccaggagctctggcaagtggcaaacccgaagagccttatgttgtatcatgtgttaattatatatgaggatcagtcctgtacttccaagttattttcttttagtttcctttgtatctatgtgttcttgttggccttgtggcctacaatagcaatgcattggctatgtttcctatgtccaccatttggtattagagctgaaatcctaaacctttgattgtttgtccacaccaatccactgctgctaggagttttagctccaatggcagtacctaatctggtactgatctgtttcttttcatgaaaagaactttgtgatctgcatgccatggtattccccaagtctgtcgccttcaacggatttgtgacttgacattaatgccataatcagcagtatgtttgtgttggctctgattggggtttaggatgttagttgttagctctgataccaattgttggacctagagacttggctgacgcattactattggagcccaacatgtctatgtaaagggtacatgctacaacatcagaaactaaagaaaaccaatgtgtcagtgtcgctaatcctaatttaccttttatcacatgcacattccacctacatggatgcgtttgagttctagctagcagagcaatttacagaacaacatctgcggtagttgcctatatgctgttcactagatggacagatggattagttttgtcattccaggctttcttttagttgagaagatagaattgcaagatgaaataaactaccttttgtttttttcttgagataaacataaactacctttgttgctgtacacactacacaaaggtttaatgttgttctagtatttaagatggcttagtattttgtcctaacaatgaaaatatacatgttcagtttctttttgttaggatcatattgaagtcaagtgactactgaagaatggatgctgacttggctgctgttgaataatatgaaatctagttttcttataaaaatatgcgatatcaggattagttccatattcccatgttgtttacccttagtctcctatgtgtcctatgtattctagatattggccttttgtcctacaatagcaatgcatcagttatgtttcctggatcattaaatcattgaatgtttatctagcaccaatctgctgctgatctgtttgtagtcatgaaaagcactttatgatctgaaagtgctggctgtatgccatggttttccccattctatggttattattgcaatcgtgacttaatagtgatgcaataatcagtagtggattcgtgttggctctacttcgggtttaggatcatagttattagctctgataccatgttattgatttagaaacttggctgatgcattacttttggagaccaacatgtcgatgtaaagggtacatgtgtacacataagaggctaaagcagaccaatgtgtcactaaccctaatctattttgaataacatgcatgttttatctgcatggatgtgtttcagtcctgggtagcagagcattttacagaacagcacatggggattggctaatacaaaattacaaatggattactttgtcatttcagtctttctttgtataggactctaggatatttacggaaggatttaattacagttattaagatcaagtgacccagtattttttgtcctagctgcaacaacatacatgttttgttttgtttgttagtatcagattgaaggcaagtggctgctgaaaaatggatgttgacttgttgactgcagttgaataatacgaagtccagtgctttgttaaaagataatattatcataaacattgtcatttgcaaaatgctcctcttattgttggaatgactagtcaaataccacttgatagattacttctacagcctcaacttattactagttgtgaaatgttaattgatgctaaatgtagttcacacgtcacacccatgcttttgaattatttcaggaggcatttcacaaattcattggtcagccagtctcaatcttctgttctagtcgaacggtatgtgaacttgttttattgcaatttcttctttttccttctaggtcagtatttgccttcagtacagcatgttttcttttactatttgaatatccattatcttgtgatagaaattacttgtggtctcttgctgactgtcactagtgagttttttactacgtaaacatggatacctggtatagttgtaccaacaatcgattatgtaatatgtatgtcagactggaggaattttggatcaatattgcatagcataatagatgtaaatagtggttaagatagaatagaattaccaggatcaatccaggttatggtcatagaagtatgatcaaattagtggagaggttatgccttctattaaatcaatgaatttatttctcacatctttgcaacatgctatgatactcttagtttcctgcaatgttatggcatactcatatgtattgattagtgaatgacttatattctggttcaggacacaggtgttcatgctttatcaaatgtttgtcatgttgacgtggagcggataagtaaaagaaagcctggtgaaatggtatgtgtccacaaactttctttccttactgggtttactcccaatactttttttctgcattttttggtactcaaaaacttattttgagtcttcaaatgcaactttgacccccccccccccagtcttctattggaatatatttttaaaacccattagaattataatattatgaaagtatttttttgagacaactctacattatgatttgtgtatattctaaatctatattgattctcaaatgttaggtggcccttggatgcttatctaaaacaagcacatatgtgactggactacatgataatttaggttgactgctgtaacatccatgttagaatctcactatatgcccccaaaccgatttcataaatgaactgtttttccctcttgacttgtacctctttatttgtgtaaacaaaaatatgttatgtagaacatctgtagccctgatgaccttcttgtccccatttgcagttgccacctcatgagcctggagttgtaaaacgtgcagtgaaccattttctacaggcaagtttttgacccaatcttgttatagtttcattcacctacaaattgtcagtccactttctctatagaagttatcatactgtaccttcgttctttgttttggtgatggcacacattcatatggttgatttgcttctcagtaatttgtctatgtactttacatctttacccgtttattgatggtgttatttccttatctgccattgtatatttatttttgcttcaccattttcctcgcagaagaatgaaggtgacataatggtgactgatgtccgttgtgttgcaccagacttccatgctagatacaaagccctagagcgcacgtaggtagcaaaatatacaatacaataaagggattttctcatttgctcttgttgttatacttgttccattcttatgtccaaattattttatcacaagcagcaataacccaaaatattaacatgctgtagtttttttgaagtaaatgagagaaaaatgaagcctgcttaaagaccagcctttctgaaatattggaaatgcttatatttttacttatgttcttgaaggtaccactatcgtttgctttctggatctgagccactatcagtttttgagaaaacctctgcttggcacatacccgaggatttaaatgtacaggcaatgaaggtgaagttttcttccatcattatttcctgatacaaaaattatattactgggtttactgatgattcatgttcagaaagcgtgcagcatacttgttgggcatcatgatttcagttcatttcgagcaactggatgtcaggtggtgtacttacttcttaactgctactcatttaaacagagctttttgaagaaatgcaagtatagtaagtcaggagataatcatagagttggagcattacatttggacagttgaacacagatttccctaccataagtgcatttaatttttcccctgcaatttgatcgagaacaaagtggactctgcagaatgcaaactatgaatcaagttaatttaattatttgctgaactatataacccatatttagaattttataattgatactttaacggaaacaataaacatttttcctgttttctagcgttttttggattttagcgtccaccttgtttacatgaaatttgattttctcttggcaattattgtttacaggcaaactctcccatgagaactttggatgagcttagtgttacagaagtatttccttccatgttttttccttcaagcatggagcgatcagagatggagtcattagatgggcatcttgtttattcaagaacgtcagttgtggaatcttctggaaaaggatctgatgcttctagtacaagtgagcaatcaagatttgagaatggagaagaatttggaaagaggctaaggcatcgttgcttcgttgttactgcacgggcacgttcatttctttaccaccaggttaattcatcttccatgaaggctaacttcagagcctagggatttacctggttgattgctgacttgctaaatcattttttgactgcctgtgtgggtgcccttgattgattgcaagttactctaatgatgttcggttcttaattcccatagtgttaattaagaacatatttcgtggtaatttgggaagtacttgtgttttggagcggagttcaacgcaatgttcctgggaaataaaaaaaaagtgtctatttctctcttttatcttcaaagttcaaactgttcatgttgtggagccttaaacctctgaaaaatgttttgatattagctgtaacgttaggcatcatccactttaactctattttcttgttggttgtagataaatgtgtttgagcaatgagcatgtaagcatttgctattactaggcaactttatgtcaccattgttggcttgttgccattaattgattattggatgatgctacccttcctcttctttttggtcatttggtatgttttttatgtcttctctgatggtgcaggtaaggttaatggttggtcttctaaaatctgttggtactggagatctaacaactgaagatggtctgttttgattcctttaataaaattttcactgagtatcttttgtgttttgccttttgctccatagattgtgaaatgatgtgaacgtttatggtctttgatgcagttgagagaattctgaatttaaaggcagtgactgcggcacctcctatggcacctgcttgtggtctctaccttgccaacgtgaaatatgacctgagcgtttgaaggcagatttctgaaatgaccacaagttatgtcatgttttgtctttcagaggtatgtctaatgtactagtagctttttatgactcgtactgttgtatgtctgtataatctctactcactgcattttgattcagaattatttgccatgacacagcaagctatgatctctattgagtctattcaaacactgcccagttttatcagtaattatgcgctgttgcacaccacatcaagattttggcattgcatgatccttgtgttgatctttctatgtattgcagtattggtaatttgagcttctctgaggtacatctgttcagttagttcaggtcttcagtctaacagtggatatcctggcagtacttttctctttggtgaaccactaattagaaatggttaaataaaatacacggtctgacaagctaactgttgacccagtgcttccacctgggtcaatggtcgatccagggtgtgataagtgataacactacctacaagctacagtagtgttcctatgtgctgcaatgggaattagtttctttgtattggagtgtattgaataattttttaactaacatgacttttgaatttggccaaatcagtgatccatagtgaggataaagggtgcacgtgttggtctggaattttatgtgatgggctgtggtaggagaggtttggtgtgggaccaaattagaactaaccgtcgactgccagccaaataaatatgaatcttttggtgatctatagttgatagtggtacttgggaaattggatttatccctccttggttctttcttgtcacctactggctctgtaatctaattaactgtcatcaactacttgtaaaaggtgttgtattgattgtgtttcctttaaatttgtcaatttttctaagtagttctcttctttagctaattacattgagtttgagacctttacttaagttagaaatcaggatgtttttccagttatgaacttatgttaaacagcatgtgagaagtaataccttttcttcctttccaggcccatgtgtttgaattattgaaatactgagtagagaggtccagacgcaccttggaaaggaaaatgctttctcatggtccgaattttgtgcaaatctggaaaattttccccgatatttataagatacttttgtgcacatgatggaaggacatgtatttccatgttctcattagtttcgactcctatgtattcagattatcagatgtcaagtcgcataacattctctattgaatgtatgcacaaagttctagatcctaggacaaattaaactgtatatgtaaactagagtggcagctgacccttccttgattatgccttatattgtttcatcttcatttcacacagcacatacattatgcaaactgcattgcatggaatacatttcaccttcaattcatacatttgatctgaatggctttagtacaatctgcatcattgatttgctttcttgatcagtttgctttatcccatcatcccatgccccacgaaaccattacacattgcactcgtcattcatgtgcatcctcctttgcggcttgatctgatgtaatgcccgaaagaatgctttcatctttggacctttatttgtgacgtgctgatgaaagtttgctctgtaaagagagaacaagggcactctcccttggatgtaaattttatgcttgacatgaagagctatgatgatctgtgaatctatctggctatgcctttgggaggcaacggtacaatgtaaatccacaagtttctattctgtctcagctagagattgtcatttgtgcagatggtaggattgctgcattggacagcatgaccatgtctagagcctacgcttgtgctggctgcccacttctttgcagtcccaattcaaaggttgcaatgatagattgattccgtcatcatcttttcctttcatttcctttgtggtcgtatgcatcaaaacattatcagcttagagaaacggacatttggttgttggttgagagctaggttgttgctcttctctgcatgccttttcttttgcctacttatgtacactttgttctttacaaagccagattaacttgtcagcagtttcaatctacacgtcaaatgtggtttctctaacagttctatcccaacattttccatgctattcaacatgaaaatatgttgcctccgtttcaataagttcatattttatccattccgtatgtatcaatacaaaaccaaaaaactactatacccctattttttctattttattgaatacaactgtaattatttctctttttatttactctcaaaacagttatcctatattttcataaactccgatgtaatgattgcttgaaaatgaacttattttgagacaaatagaaggagtaaaaaataattttattttgggataggattttgagacgaatggagcaccatctttagaccagaaaatggatagccaaatgagttgctgatgagcacaggcatccatagtccatagatgattgtcatccatggatgatcgtcatatacaattttcaagggatacttttctaaagtaactttttaacgttgtacttaaatagctatcataaaaatcagataatccatcaattccagctatctcaaatacagtatatcaaatctaggatatttacttttaaaaaatggataatcaaaatgtgttaagttgcagaagaacacaggcatccatggatgattgtcatcttgtcagaatggcaccaaccaaaggaggcaaaggcgagtcggcagagccttgacgtctgtgcaaacctgtcaagcaagtggccggtaaaacaactacgaccaggcatttgcctgagcaaaagggggctagattgatacggattaaaggagcacgaatctttaaacaaaatcaaagtggaccgaagcggtctcccattggcgcatctaccggggtcccaccccctcatccctgaaagcgcctaccgccaagtacgctttccttgcaaagtccagcatagtagtgtaagctttcattcaaaaggaaaatgaaattcaggaatgtgttggctggctgtaccttgtaatcagtttaagctttggtagtgcaaaagatttggtgccacaaaacatagtacatatttagttattcattacaagaaaaatgaacacgcacaagacgtatacgcacatattcacgagtgtgctcactttaacgcacacttattaagagagagaaatggaaacatgtttttaaagtactaaattaaattgttgatcgaaacctaaacaattatcttaatactcattagttgtatgtatgtatatagttaattggttttgtccatagaggatgagttaattcatcctttatcttggtgacaaaataagtgtcttggatttttatatagagggagtaataacaaatctcttcattgatttcctattaaaagcacttccgtgtcggatatcgattacactagtagagtctgaatgtgtgggagtggtaaaatattatcatgtcatagcaattgtagggacgaatccactttgaattttctaaatgtaaacttcaggaatgaaaagaaaaggtcagtgtttaagtccaccatgacttagttttttaatccctaatcaagtgtcaatgtatgtgtttgttttaagcaaagtagtgatgggggtgtatacagtagtttgcagatcactaacagggattgctcaataacaaatggcagtggaggacttgtcaagaaagggagtttgttcacaaggcttccagcgcagactgcaccgaatcatttatttcattttcccattattggtatccatccggccttgtagccttcatggttacgtgtaacctacccaggatcatgcctgaaaaaaggggtggtaatttgatttatttcggttctagcttttctattctccaaaatatggccgaattgaacttgtcaaatggtgagcttgcatgattttgtggattgtaggaagtttgaagaaattaaccaatttggcaaggtgtgcgacaggcttggttttagtgaggtagagtcaacagtggtcaatttttgcttttgactgtgcttgacttggtacatatatattgaccatcaggaggtcaagctaccagttgtactatacgattttgttttcctgagctaagcctaccaattatatatactagtaataagattacaaaatgaactatggcatatatttctctgaagttttagatatagtcaaccactttaataaaatattaatttggcataatttagtggattatttcgaaataaagtttgtaaacagtaaaattaccaatacgaacttgatctgacataaaaccacttggttaatttgctaattaagggcaaattccagttgttttaaacctaaaagattttatgtgcttatccaacggctgggtagctacttggcttaatatatattgatatgtgcggtttaaataaaataagttgctactccctctgtcccacagtataagggattttgagtttttgcttacaacgt

SEQ ID NO: 65184 - DNA, 709 bp, Oryza sativa
cagttgtaatgctgcttaaatgttgctctcttcagagtagtacacaaatggactccatgaaagtagttaaagatgtggtttgatatggttctgggtagcattgcaataaagaattcatttagtctagtactcctgaattgatgctttatttccttatttatggacaatttttgaaggcatccattttaaaaggcattcatatctggttcttcattttttttctttattcttgttttcatctgtgttattgatgtttggttgctagctcaattcatgtttttctcacttatttgcaggtgttagtacaggtactggaacattttaatcaagtcgagtcacctctgcatggttagtgttctgggtcaggcaaaatcgctacaagatgaaagaagatattatgtttgacaaccaaacaaagccatgcagatcaagggttgactccaaaagcaatataaatgtgctcaagccaaaatttggatcctcttggggttcccaaattgtcaaagggttcacagctgacaaaaagaccaagaagacagcagctgctgcaagcaagaagccacctcttgcaagtgtggaaaatgttaacaccagcaaccaacagattccatatcattctagggttaagagatctcttatgggagatttcccttgttcacctgctggtgctcaggttcacccccatgtctttgattgccatggcatcagg

SEQ ID NO: 65185 - DNA, 878 bp, Oryza sativa
tagtggctttttcaaaaatattagaaaaatacagagtccagacaaatcacagaaaatatgttgacaggcataacatcatagccataaatcaaaatttcttgtatgtaaccaaatgttgctaaatccttatacaccagagaggataaatttttgacagaaacattcagtgccatataatgaagagtatagagagagatgaatataattcgaaagcagatttaagaggtacaatacaacaaataagagcccttcaaggtacacccatgaggccattatccctccaaaacacatttctgaaggtccatttgattttagagaccaaggcaataataatgctatggcaagggtcaatttaattttagaaaccaaggttgtcatgggctcatggcactcaagtgagtcattaccacagtcactagatcatgatacaatactgtcgttcctgaacctgtcccagtttgctggtcacagttgatgcaggtcacctccaggccgtgtttggttattagaggcatccaaatcaggtacagaaacctacctgattttgattggggcaacagtggccaggttcctcgccattcaggtggtgctggcatgtgtgaaggtgtgtggtggcacactgcaggggataatccagcagtagaagatggggaccaagttgctacaccctgtgatctcgtggccctcaaggttctctgtcgccgatgcaagacaagtcagcagaagaggggaggaggtttggagaagactagggcatttgcttataaaagatggtggcaagggtgtctgctgaaagcctgaaactgcatcgatggcgaggatatgagattatgttagaactgaggagatagagcaacagaattgtgtggctggatggg

SEQ ID NO: 65186 - DNA, 691 bp, Oryza sativa
catgcacaggtgacgctctacagtgcacaaagtggcaaaaaaaaatacaaaagcttctctttcccatggcaaattgttaagtacaaatctaaaaaaggtatttgactaattgccaaacgtaaaagtgacaaatagttaaatttcccgaatttataggcacacgaagatgtcctgcatgtgcaaacgtgtacgtatatatacgtcgttgttggtcagtataagtagtcttcagtataagttgcttgacttggagtcttggatttttggcagagtgcggagcttttctctgggcagcagctgtcagcccgatttttccaagctttttttctcacaggactggaagttctggaagggtttgattcccttgtgaaagggatgccacgcccttgctgtcggaaaatatatagacaaccagcctcatcatttacattagacatgcaggatcttaattttaaaattaattttagaatattatttctaaaccgctaagaacatgtatataagccactttagcttataatcagctcatagcaaccgattgatggggacaaactgaatgtgcagtgcagctggcttccagatttgtccaatcaggaggtatttgagttgagttgagtcgagtctcatgtcgtgtttaatttggtcctcaatatatacttgcttgttgcacactactcggtctgcaactgaa

SEQ ID NO: 65187 - DNA, 1277 bp, Oryza sativa
aacttggcctcaagtgcatcccgcatgtccttcccagaaggcatgtgcatgtacacgtccactatgttgtcagcgagtacactgatcaatgctccacggaacaggcaatccgaagcctcgaacttagcctctttctcaggagaaagaggtgggtcacttcgtttgccccgtgaaacatagaagcactgcatcgctgtcaaccacaatagtgcacgtgttttccatctcttatagtttggaccatcaaaggcatgtggtttcagtgcagcagcaaagccaactaccgaaaatgacctatcaggtttttggattgttggaaatttggtcataattcggcatattttaatccaaaataacaagataataaacatgatatttacaataggatttgatccagtgatagtggtgaatgtaatcaacatgagcatgcttaacgttgaataagcatcaacaatcacataatgacacaatgttgacattgcgatgaacattaacagtaaaacttctaattgaaataatgtaataaggttataccccaagaatggtcctccgctggagtttgaggcagtattgcctccgttggtgttgacgggagtctccttctccttgtctccagtgttcgacatgttggtgaagatgaagtagatgttgacgaacagtgagtagtcgcgccttgcgctccccaaaaacatgatcgcccgcccgtctgtgcaaacgtcgcagcaacgcgtggtttcggaggcctactctcccaacgcgtgtgcacacactcgttgggatgggattaccgtagcaacaacagctttggaaaatggatgaaagtgtgtcttctttttctcgcgggagatcaaatccattcccattttataagaggaatggaagatgaagagtaagagtcatggaataggaagaggaatggagcaactaattgtcatcaactagccatgaaccatccttcactacacaaccatcaaccaacaatcaattaagagtaattgatgtaagttaccaatggaataggaagaggaatagagcaactaaatgtcatcaactagccatgaaccatcctccactacacaaccatcaaccatccatcaattaggactaattgatataagttaccaattccttaatcaaatggattaattctcaaaactcttcatcccattgatatcccatagaagaatgaattcacatgaattcctagcataatgagccttggaatttatttgatttaattgatttaaatggattaattacccaattaaatctaacaa

SEQ ID NO: 65188 - DNA, 702 bp, Oryza sativa
atgcacttttagcccattgggctgtaaatttgatatggtatttgttgcgttcggttacaacttacaacatctccgtcctatttttatttcagttagggtctctctacacatcattcgacaaattttcaggccccaaatttgtcagatttctgatcccttggattagcatccaacggcagcaaaaataaagaaggaaacaaatagaaaaaaaataaaaggcctaaattgggccaaaattgcaacgtgtaaatataataatgggccgataaaatcatattgggccaaaaacacaacaaataattttatgattatagcccaaaatcaatcaacttggcaatcaagaaagctggagaaaaggacagcacatacatcacgtgatcaaagcacacatccagcgaatcaacgcttctcccatccaaaacagatccaaagtcagatcgaagaagatagacatggagagcgaaaagaaaaaggcaaagaagaaaagagaagaagaagaaccaaaatccaagatcaaatctgaagaaaaaatcaaaacatcaagatccaaacaaggtcagttaattaacaagaaacaatcatatagtaaatacagaaaattacactgtacatacacatgttgaactgaaacatttgcaccatacaagcacacaacaatatatttacacatttctagaacagttcatagctagtgcacacatg

SEQ ID NO: 65189 - DNA, 1548 bp, Oryza sativa
agtaaataacaacataccttcgcataacgaaaagcatgagaacaagattttcgattcaatatttctttcttaacatctttaacaacctataataaaaatagaaaaaatatacattaaaaaaataaaaaacaataacaaattataaatacagtcaagaaagtaatactacctcctttctaaaaatttcatatataatatcatcaagttcacgacgagaaagctctccatcctataattcatatatttcgaaatagatattagtaaactacaaactaaattcatataacatagtatttcataaaaaaaacattaataaaagactataacttacacaatcagattcatcagaatcatctacaataggtgctttacccaaatttctcttagcagcaggagccatctaaacaaaaaatataaaacaaatatctaaatcactttcttaataagacaaacaacaatgaaaaaggcaaatcatgcagaccatgaacttggctttacaactataattagaagaaaaacaaaaaaaaataggagtgcacagctaaagatgctttatcatggagagtgcacaaggaaacaagactccaacaacatgacacagctgatggaaacaaaagaacaagcagaagatttcactaaagaagtatagcagctgcacacaagctataccaaggagaaggtggcagaaaaataacataacaacaagctgaatggaatcaacaggcacagcaagttaatgaagatgaagaaaacagggtacagttgataggaattaaaaaaaaactgacaaacaacaatcagtagattttgaagcactagtagctgtcaattacacaagaataacttggaagtaaaaaattaggaaatgcttacaactatccaagggacatggaaagtagaatcatgcttacaactaaaaatctgtaaaagtttaatctactacaatatacaaaattcaaaaataattacagtaataataataacaaaaacaaaaatacaacaaactaagttcagacatcacaaaattttagaaactaactagctgtcaagttatcaattctacctcacaagccatcaatactaccctgaaaaggacacaactacaaataaatcggaacacctcacaaacatcccaagaactaaagcataatagaacacaatgcgcgccagccatcaaaatactaccctgaacaggacgcaactgcaactaattcgaacacctcacaaacatccccagatctaaaggcataataaaacacaagcacaccaaattttgttcaaatagctcacatatatacactaacttgctaatctaacgagagaaaactaccgagatctacttcacacagatctagttcacgaacatcacataatacctaacttcctaacagattcgaagaccaccaagagaaaactcaatcaaaataggtttcaaaaagagctcatgcttgacgaaagaacacctacaccgaatcggatcaacaaacacatccatacaccaaaaatcccaaacgagaacaaacaaaatgtaagagatctagttcgaac

SEQ ID NO: 65190 - DNA, 679 bp, Oryza sativa
tttgtgggcctgcatgctcatgaccctaccttggggctttcatagtgcacttacgtgtcatttagccatataattctacgtcaattttgctatatatttgtcgataaattttcccctaaaaatttgacagatgtaattacagtacaaccgtaatgtaattacactgtaacttgcatgtaattacactgtaactataatataacttgtatgtaactttcaaaaatctctccataatatattattttggtaaaataaaggttgtgggaacaattttttttcagatatgtgtgtactgtgattttttttctttctcaccaaaacaaatctttataatagatctaataatttaaaattacgtgaaacttacatacaagttacactgtagttacatgcaagtagagatggcaatgggtacccggtccccggtccccggtcccccgtggagaattctcccattaggtgatggtgatggtattaattgtgtctccatggggaatcaaatggagagaaagtattctccgtcgggtctggcgggggcgggtttggttccccgtcccccgtccccgccctctgtggaggcccgatataaaagtatgtgtgtagtaatatcctgtgtatttgacccatatggcccataaaaaccaggcccaaagcatagagtatataaagcaattgtgta

SEQ ID NO: 65191 - DNA, 510 bp, Oryza sativa
gatcaagacgcgaccaaattaaaatatcagcaactaattaaccaattcaaacgataaaagaaaacgttaaataatatccgtctctcacacgatcttttgaagtactaattttatttcatatcctctggctaaaattcaattaaattaaaattgaggatttatcatttctaggtatcaacttttaaaacatctcctctccacttttcagttcatcaggtaagtccacacttgccgcaggtgagtcagtcgtggtgcttcgccataagtgcgccaacgtctttgcactctgggttaggacacatcagtcgtagcctctccaccttccccatcacgtcatcgacacgatagtgacggagcaccgcaagctcttccttgcggtgctcatgctttcccttcttaggtgtcgcgtacgccttcttctttcgcttcttgttgccgccgccgccaccacagatgcgaccgaggaggtgcagcgtcgactccttctgaataccatagtagattagcgtg

SEQ ID NO: 65192 - DNA, 561 bp, Oryza sativa
gcaccaatagtgaagaaactcttctcaccatcatatgcgaaatttttttttgcctgatcacttgaattagtttgctcacttgaaaagagctttttcattattgttgctcttccacaacatgaacattggtacctgttttatgttcgctgcgtattgcaaatggtttgccaatacacataataggtatatatcttacattttggtgtgctttacatatttgttctgtttacttttgtattatatatctattttttatttattttgcaatttttttgttatttaataaggataataagctaaaggaggctgcaaagattgattcatcatttacaaggttttccaccaagtatttctgtcgagttatatctgcactttctccacatcagaaaactattattcagggtgctggttttcagaatttgcttgagttcaacagcaattatgttccaaataaatttgctacttggattgcaaaacatgtggattttaagacctcacaaataattttaagagacaaagtaatttcagttacaaagcagactgtttgtgacatttttggtt

SEQ ID NO: 65193 - DNA, 803 bp, Oryza sativa
gcggcgagcatctcttcgccgttgatggcggccggacctttgtcaaacgtcggtgcgcgccgcagcgatggcatggaatccggagtccactataaggaaaaaaagctgtagtctgtgttcgtttagagagatttgaagaggattggaggagattgagggggaataatttcacaccacaataagtgtggaataaatcccctccaatccctccggattaaccgaacaaggccgcaaagggagaacaattgccatgtcatcggagatcagaattccgaccctcctcgggtctagctctgacggccttccaaagctaacaacatgtagtcagtcagatcacatggtcaatgtaaccaagacagtgctgaaataactaacattagcctagccacatctgaattattgagtgcaattatcgaaaccgtaattttgtggtgcataaaacaatgggaccatgaaattctactccagcaccctcttttcgaaaagaacaagatatcttccataccaagatcagaggcattcttctacttcgcccttagattactttgccatgttgacgctctgcatagcttttctctatcgtccgtgagtgccacggtgttcgatcgatccgtgtggcgctcgagacggcggccgaccgtcacagctctaagccagcatggcggttcaatcaagcccctgtgtggcccaaatgagactaaaacctgtgtcaatgcggttataatttgaaaatttttagtttttaacaatttgggaataatggagtaatatttttctagcaaaaagcaacatatatgttgaca

SEQ ID NO: 65194 - DNA, 1311 bp, Oryza sativa
  unsure (1)..(1311): unsure at all n locations
tataattcagctagctgcttctccagatgtttctagcttgtggtaggccggtctatctgaatttcgtacgctgcaggacaccaaacagagatcaacatttatgaaacagcaaagatctcgtacatgcccccatctccaagattatattgggtcatctggtgaaattaatctcctggcaaattaagtcaagatgcaccgtctgcaacacgaaatgtaatgttgacacgcaaatgctagaaaatgatttcagatatggtttatattaggacttgggagttgggacacgtatgttttatgttcagatagggtctattcagtcgtagagaagaaagtgaaattgcgagcagatctgcaaacatacattaaatgatgcatccagaagagttagaagtcatgacactactataagtcagattaagcttggattatttccagcgtttccttgcggtcgctgcacttgttttatccaagactaatactgtaaacaacttctggtttgattggaataaataaataaatattaggtatgacacgtatgtccacatcaaatcttcacgggccagcttccttccatcagatttgagaaaaaacataaccaatctggactaattccaagtcaatcgatttgactatagattaaaaaaacaatcacctagctgatcacacttatcctcgaatttcgaaaacacatttttctctaacctatataaaccctaccatggttagcaaaattccgtaacaaacatcgataatacaagatcataaaaagaaaaatgaagcctttccacatggccactctcgcggcgctcatggccgccgcggccgcggccgcgacggccgctggcgccgtgacgttcgatgcgacgaacacggcgtcgagcaccgccggcgggcagcggttcgaccgggaggtcggcgtggactacgcgaagcaggtgctcgccgacgcgtcgtccttcatctgggacgccttcgagcagcccggcgacggcggcgaccggaagccggtggacgcggtgaccctgaccgtggaggacatcgacggcgtggcgttcaccagcggcgacggcatccacctgagcgcgcggtacgtcggcggctacagctccagcttcggcgacgtgaggacggangtgaccggcgtgcttgtaccacgaggcgacgcacgtgtggcagtgggggctgcaggattacggggcgcattcgtgggtgtacgaggggatcgccgactttgtgcggctgcgcgccggctacccttgcggctggttgggtgcagccggggcaagggaacagctgggaggacagctactc

SEQ ID NO: 65195 - DNA, 604 bp, Oryza sativa
aaggtcttaaaagcatgcgttgtacactttagactaccgccgatgaaagggaggaggtatcagtctagatcaaatatcaaatacactatgcgaaatttgtatatatgtccgtgataacatttcaagcaaattactttgactgtgactattctactgccaaaagaggggtgtcaatacaacacaggacacactttcagctttctgatgacagaaaactgtaataggttatgttggattacgtgtgccttgcatatcttcgcaaatacctgggctccacgttcatgtgggtagttgaatgtactctacaaagctcgttgtgacaacacgctgcacctctctgacactgaagtctgaacctaatactcatcccatcatttttcttactggaaacaaattaagctcttaagacaattttgtcaataatgcgcttctttttttaggacaagtcggtgatctgccattattcgtcttaacaaatgatgatgggatgatacaacatgctgctggtgtctttttacccaagtggaggggtgaactgcatcttgataaacttcacatcaacttaaaggcctacaaagaagcctctagctccatgaggtatttt

SEQ ID NO: 65196 - DNA, 596 bp, Oryza sativa
ttattttttcatgatttatcatccgtagcacgaacgatgtcacctctgaaatgatatgatatttttaccgccacaagcatatatgtacatttttttccccaatcgctatagttggtaggccaaccgtttcatatgaaattccccgtgatccaattccaaaatgtactggcgaatcaattcagttggaacatcaatggtctctgatccccctaaactcctcatatgccgtaaatttttgtagtacgaaatgatccacggtgacaaatttgagagacagatctgatccacaacgaaatcgaaaacgtaccctcgaggtacgaataaactcccggttttactggcactgttttgtgccttagctgccatctcgccaatcactttcagacaggcaaactagccaagcccggttcagtcaactgtagctgccagtgaggtgataaggccgatgcagatggcgacgtagatgtactgatgtccagtacgtacgacacactgagccaatagcaggtagaagaggaaaatatatacccatatataacttcactacaatagaaaatatataatgcaaagtttatatacagtgtaaaccctaaaaa

SEQ ID NO: 65197 - DNA, 2072 bp, Oryza sativa
gatttacagagagttacttctcaaccatgcaaaagttacttccaattaacattgaagttacttttattaaatgttaaacttacttgtgttggtgggtactgattaaatttaatttctagataaaatcatatttttatccctacaatgaattacttctaatatcgtgataaaattacttttgtgttgttttaagttacttttataatatatgtaaattacttttagactttattgaatttatttttatatgtctaagaagtaatttagtcaaatctaaaagtaacttatatatatatatgataaaagtaacttacgtatataataaaagtgatttacaaatataaatattttttcatcgtaatataatatgtaagatcttgttgtgaaagatttgtcagggttatggataccacatacctaacagtagttgactaaatctcggcaggacccactacatatcatgtcctatacggaagcaaccttcggatataggaggagttccggataaggaaagacgaccaccacgatcaacacacacaaaggatcaacacccaacacaatcgacatagaagccacaacatagaagcctacatacgccaagacacgccgccggatatcgacttcagggataagcacggctagtaccctacggtgtctcccgatactgtcaggagagaccgaagcgctatctttgatctcgctaggcacggattcaaggaggaagactaccctgttgttgactacgagtcagatcttcagaccgccatgtcgacaacagttagataggctaccccaaatattgtactggtgtgattatggtgaataagagcaatactggcttcggccaacaggatgtaggttaattacctgacaattcaggggcccgaacctgtataaaaatccttgtctccatctcttttacctcagtctcgtgtatatcctagcaccgacgatccccatgccatgcaaataccgtagtcgagacatcgaatgtcgacagatttaattgtaataaacataattgtaatcggattatagatcagataaataatttgagagaaacttttatttgaatgaagaggaaaaaggcatacatgatctattaaaaaaaaggcaggcaggcactacgttgatccttctcattgagccattagagcgcggccacgcggatgtacgtcaggacgacaagcacgatcgaacagctgtgaggcgtgtcgcgtgatacgactaaagcgagaagcctcttggtttagattttacgtaccacctaaggacctaaactaaaccggttttgtaagttaaggatctcatatattgattttctggttgagagacgattttatagtttgatgacaagatgaaggacctcgtacgtacttttccctatcatctaacagagcagcagcatgagatgaacccagtagattaaaagcccgcatgaaattaactatacagcgaccgaaacatttcggccgtgtttagttaaaaaataattcttcaaacttccaacttttccatcacatcaaaactttcctacacacataaattttcaacttttccgtcacattgttctaatttcaaccaaactttccaattttggtgtgaaacacagccttcgctcattggccggagaaataagttcatctgaggtcccttgacttgtcaacgaatccgattttcgtccttcaactgaaaaaccagatacaacaggtccctcggctgtcaaaaccagtgacataggtcccatagcggtttggacggtgtttttatctgacgtggtgcttacgtggcaattcgaccgtgaaaaataacaaaacctctgggacccacatgtcagcttcacacatacaataatttcaaaaaatggtggggcccacctgtcattctcaaatcccctctcttcttcctcctctctccctcccatatcccctcttttaatatctcccctctaatccctcctctcgccggcggagataaggacgtcctccattcccacccccatgggcctaccgatggcggccggcgcccctcttctcattgcccgctgcgcctgcctccgcctccggataacc

SEQ ID NO: 65198 - DNA, 661 bp, Oryza sativa
ggtgtccggtatctggttttgcggttgggggacgatttcgtaactcgatgacaagttgagggacctttggtgtaccttttccaaactaaaataacctcctctccatgtggatgggtcggattaggcccactaaaggaattaaaatcgacgatgcacgatggatgatggatatttcattagggcgaagctatagcaatttattggggttaggagaccccgatgatttcttatgagtccccttatactccttcctattttatagctatgaccccggtcaaataaaacactagaccccggtgattgtttcgttaaagctcatttggtggcaaggaacgatactattatcaactagcaaatagaaaattagttagcaattgtgattatacgtcagtctagatagatatacatatatgttttagactggcgctcataaagtggcccttatttaggataaccaactaatcctattattatttcctaattatcatcacaatttggttgaacctggtctctcaagtttgaatttgacgaaattagagttctgaaatatgaacgtttgatttttcaagttcaattacatgatcatgaagcatgagcctgggaaatataacaaaggtaattttcaccatataagaggttgttatattcttttccccaatat

SEQ ID NO: 65199 - DNA, 2680 bp, Oryza sativa
tgggcgtccaccgggaaagctggcgagcggggctggaggcgtgtgctctgcttgtcagaggtcacttccggctgtagactagccctcattgtaaaaacatgtttcctttcttaagcagctagaggcccatgtggtgacccctgaccagataaaaaggggaccaggcctagaagggggaaaaagaggggaaaaaaagagaaagaggggttctagagcctgaactctctctcgctctccggctctcggtattccttcacgcacagatccaccagaacacaggagtagggtgttacgcttctcagcggctcgaacctgtctacgtcgcccgtgtcttgtgcacttcctctctcgctgacgttcctcagatcgagggcgaagaacctcacttagcgcccccggccgaatcggcaaaggggggcctgcgcggtctcccggtgaggagccccacgctccgtcaaacccgtttttgaatcgggagtaagaataatatttagttccggttgaagtactgtattttcaaatcgggactaaatatgtttttactcaaaccgggactaatgtgattttttagtggcccaacaaagatcatttctccaggagtggccagtttcaactaaaaaaagatttaccccatttacgatgatgatgtgcaaaagtttgattcgatttgtctacttggttttgagattatcacctggtgacaattctgattaacattttctgattggcggagtcaatacaaaagagaatgctttattttattacagccacagtgtatttgtggaggtactaaaacggaattaggatggaattagtgtctttttcaacagtacttcaatgttggtctttcctgtcacattggctccttgctatggtatggtatatattgttaccttatactccatatttgaaggttcatggtgttgctattaacgccctgaactccactggaatattttcaagtgtccaacctatggttcagtaatcctaactacccctatatacaagcatcatttgtttcttcctttaaaactgatggcagatatatagaattgtgttttttttttacctaacaagaccaccaaacgactttgtttgtcatccattttcagggtgtgccctttaaagcggcaatcatgacaatcaagtccttcccctgagcaaataccatgagaactgatcgtcaccgtcgccgttctattgattgacaaagcgttgcctggagatatctactatgctcatcagttttaaagtaacttttgaatttgttattaatttgggttgtatatatcaaggccgatgaaatttttaatttttaacgtgatcatctgcatcgtatgatgcatatagctaaaaccgcttgatgtatgtgcacgattgcaatgttaggtctatgtgtatcatgtttcatggaaggcatttttcagtaatggggatgtcatatttgcaattatcaaataatgtcgtagcattaaaaggatgtccaagtaataaaacaaaagccagttgtacgtgggcgggtagattgctgattgagatcaaactggttgattttatggttaaaattattatacttgctcgataaattcacgtgtcagcagaaatccaatatacatacatgcatgtgccagtgtttgattagttttgtaggcttggttttagggtatattatgtaattattggtcatgttattttaatgtttttgttgcaacaaatttacctcaatgatttttttaacatcatttttctcattgagattttaatttactatttttttcctgcagcaacgcaaggcactcaactagttgttgaaaaaacgtgagaatgttaatgagattgatcctttccgatttactccattcgtctcaaaatataacaatttttagcttttaagatttgtcccaaaatataacttctccaccaactctcttcctaaccaatcacaaccctccaccattcacttttcctacctacctccactacctatttaatcacaaccctccatcacttatttctatctatttttttaataactatgtcaaattctaatacttcttatattctggatcgaatggagtaattagttatatcacatagatgtgttgggtctccatcgacacgacaagctttcccccacactcgcatcacctccaggtcagcacgggttgccggcaccagctgagcagccaaaaacccccgcccgcagtttgctaagacagcagcagtggcttctcgggtagttagcgcgggcggattaaatttgtgataaatgtatagctagtcctactatagctatgggatttagatctagaggtgtaaagttacgacgtgtttgggtgtttggacaataataaaaaaaactaattacagaattcgtcggtaaaccaagagacgaatttattaagtataattaatctgtaattagcaaatgtttactgtaacactatattgtcaaatcatgaagcaatctatctatctatctattatatactaaaagtctattaaacttcctataaacactctcaaaccgccaagtggcaccctataaacgctctcaagttgtcaagtggcactctaataaataaaaagaaatccaaccatctatttttacttgaattggtagacccattattttggatggtttgatctattttgtaaaaaaacatccgaaaccaacata

SEQ ID NO: 65200 - DNA, 10641 bp, Oryza sativa
caagtccattgaaatgactatatatgttataataaacttattttacttaattaaccatgacaatggacctttgtcaatatgtattttatcactgaatgaaggcaatcatgtgattagcttgaagtgtttttattgctactgtattcttgtatggattaaagatggtatgaattaagtgtaataacctgatagtactttggttctttggcctttgtatagcttgaaaaatagatatcaggattgattgtagtgcattatgcctagaggttatagctcaacagcacattaccctcaagtgcctggtctggcactggtgttttctgcttgttcttcattttctaaagacagaacaggaagatcatgtactctaaaagcaacccaaaataactttggttgtatatgattactttagcatgacgcatgtcttctccccacaaatataccagtgttcatcacttactgttttgaatagtgtacttatatctccagtcaattaggaattcatgctgtgagtgagctcacaaaaaatgtccaactgggcacttatattttcccagcctatcctgttaacagtatctgaatttatgatctctttgagcagtgagcaggatgattatgaagttgtcaggaaagttgggagaggaaaatacagcgaggtctttgagggtattaatgtcaacaacaatgaaaaatgcattatcaaaattctcaagcctgtgaagaaaaagaaggtagttcatgattcatgaatcctgttgtccatcctttttttccttttcccctgaacatgctcttttactggtaacatggtactgtttccatcttacacctagctttgtgtcaatggcattagtgtttattattttaaccatagttttcttttgtatgcagatcaaaagagagataaaaatacttcagaatctttgtggaggtccaaatatcgtgaaactgcttgatattgttagagatcagcactcaaaaacaccaagcttgatatttgaatatgtcaacaacacagatttcaaagtgctatacccaaccctgacagattatgacatccgttattatatctacgagctactgaaggttttattctttctcaattttttgttactgtaacattgccaacaagaaactacttattcagcacttttccagagtatcgttcttgttgaaatgaaatctttgaaatttgcaactatatgcataatatctaacttctagttccaacttatgcttaatactatttttcttccctgagggcttctctgtgtgcatgaaggctttttctatgctagtaacgagatgaagaaatctttgcccatgataaaagcaatgatatcatgttctttttcttctataggagaatccaagtcatacatcgtttggtttgagcaatttttggctgatccaattatgatataacacccttttctgttgatgggtgcaggctttagattactgccattcacaaggcatcatgcaccgcgatgtgaagcctcacaatgttatgatagatcacgagcttcgaaaactccgattaatagactggggccttgctgaattctaccaccctggcaaggaatataatgtccgtgttgcttcaaggtaggggcacatactgctctgttaatgggtttatcatttgattttcttatagagtaattaacaacatgtattaatcttagtatgtttggtgaactatttaagttagaataaactggcgtgcagtttatttgatgattgttttgatgatttactgaggcaataggcaaatctaattcttgcggatattggattgtttgcgttaatgatgtttaaagtactatgaagaacagaaaaatgccagcagcatgagcatataatcacgtttaaagaatgttttctgtagctactatgtttgctgtgcctgtactactctcattccatattttccctgttgcatccctttctttttttttttttggttgacatgttctgtttcactggaattcaggtacttcaagggacctgagcttcttgttgacttgcaagattatgactactctttggacatgtggagtcttggttgcatgtttgctggaatggtattaccatgacatttatacattactttttctcatttcatcaattttgtaatgcaactgcctttttctataaaagaattaactggtgctgattcgctaataatgtgttgttgagtgcagatcttccgcaaggagccatttttctatggtcatgacaaccatgatcaacttgttaagatcgcaaaggtgatttctcagcttgtttatgttaaaagatgatgttcatacaagaatgaaatgcatttcatgtttagcttatcattcatactgtacactatggtttatcttatttcatttgcagctcaagttatccatgtttgatgttaggaattgtttcatttgttgttatgatgcgattagttctgatagtaatcaggagcaacagttgtaacgctctcctgcgtgttcgagaaaaaaaagtaacagttacaactatttttctccgctgaactttattctggtcaaacttagtcactaacattttattcaaacttgcacgttaactatggacacccttcctttctgttgagtactgcttcagtaaaagtcttattgaacttgagctagatatgtgataaatcatctttagttatttgtgttgtttccctgactccctgcattcacaggtacttgggacagacagcctgaattcatacttgaacaagtaccgtattgagcttgacccacagcttgaagccctcgttggaaggtatatgaattacaattatatgtgatgcaatgcaagacctctagttttaatatgaattaaaattttgacatttttttttcatatgcaggcacagcaggaaaccttggtcaaagtttattaatgctgacaaccaacatctagtatccccagaggtatttccagtgccccttcttcagaggttatcacaaatgtacctactgtcattaaagtattaatggttttcaacatgatttcttttctatgttaggccatcgatttccttgacaagcttcttcgctatgatcaccaggatagacttactgcacgtgaagctatggtaagtaacttgttctgcacttcctttgatttccttttttctatgcaaaatatgcgttttactagtgtacaacatcatgatattttttttgcgattgttcctgggcattattggtctctgacctttgatttggtgtaccattgccatgcacttatataacattggatgattgcaggcacacccatactttctccaagtgagggctgcggagaacagtaggcctcgtgcacaatagacaaaagaacgggactattgctgactgtcgattagcagcagtcatggagctgcaccgtattagtgacttagtccagtcacttgtattgggagtttgagattcggtaatggttgaatcacctggcaagaggattctgggagagcatgtaacagctcatgtgtgcttaaccgcaaacgtggattgtgatttactcgtgctgtttgtatctttgtttctgacgattgattgaaacacattgttctcgttgagtataaatgtttttttttaatttgcgagttggtccgttttaagactgattgtaatgatcaattagctgtaccttaatggttttatgcaccttgacttcggacatcatcgctgaaccatttcaattccctatattaaagttgtcagctatccatgctaactgaaacgctatttatgcgaactgaattcctctttagaatgggcgttctgaattctgatgaacaaattcgattctttttcctctaaactgacccaagttaggtttacagtttctagcgaagtattccagaactaacctattccagaagttcaaacatgattagcctagtaaatctgaagaaaattacgcttgctctcacctataaatcagaggttacaggtcgatcctggcttataaatgataaatggggtctatactgtaaaagttgtgggccaatcctgtatttcagatgcatacaaatgtacttgagcccccaatactctttatgttagatgcatacaaatatacagtagtaggagctcatagaagatcaagcacagaactatatctactactacgtataaacaaggtgctccatggaaaaaaaaacacgatggcataactgttaaagaaactctgggttgaagcaatgacttgtaccacaggagacaccggaaattagtgaagagtgatgttgcaacataacatattgactgaacacaggcagcaaatccacacaagattaatatcgttgcacaagaggttgatagagcattacatatttagatgaggcacacaaccaaagaagcagcagcagctgaccaaagtttagacccatacatagggcaaccagtcattgcatacaagatgatactagtggattatggcagcttctctttttctcttctgattgagcagagagatgccaccgccattatttcttgaggtgagggaagcacgcggtgaggtcgctcttcggatgcttcgcctcagcatgctctttgcacttggtctcagaggtggtgcagatgaaagtctgcatgcatatcttgcactgcattgagatggaaccgttgttgagtacaccagattaagaaaaaagattaccacaaaatcgtacatcgtgatggctacaatggaaaaattcaccaagagaatgcactagatatcaatacgactacagattcgagaaacaacaacgctaggagcacaaattcatgctttacatatcttaaccagtgaagccatcggcaaacttcggcttaatacataactagtggactgatgaaagatacttaacaatcagttcattaatttgttgaggacataacttccatcacatatattctaacgattacacaacaggataatacctcacaaggattgtcgatgctattgctacccgaaggttcagataaatcatcacactgacatatacagaactataagagtacatggatctcaactaacaaaacctggaattagatccaggcaagcataaagctaacctggaatcattaacagcagcctatcttgtgaaaaataaacgattgttttacatcagcagttcttttttcctttataaaagctcaaaattaacagaactttgagaacataggctgtcgatatatgtctgaacagagccgaaggaattgaacccgattgatttcctgcgtgtctacacgcgcgtaatcaaaaaatcctccctaaatcccaccataaatcgtggtcccaaaacacaagcaattgggggaaagaagaagatgaggaataatagaatagggttaggtggagggagcgaatcgggaggggggaggagatggatcgggtgctcacctggatgttcatggccttcttgttggcctcaagctggctccctgcgaaaaatcaacagcacacacaacacacgaggatgatgagatcaagaagcaagaaacacatgaacaaggaccaaatcaagaccaaatcgaggcacgagacgattgggaggagaagggggtaggttagtatacccttggcgcccttgttcttctccatgttcctctccctcgccatcttcgacttctgcccattgccgccgcccatctcgtcgacctcgaccttcctctcccccttcgccgcaacaagagaagagaagagaagaaaagaaaacgagttttttttttcttttttggaagtgatgaagggaagcgaaggcaaaggcacggaatcatcgggttttaataggaggaggtcggcgagcgtgtggggcccacacgggctgatctgggccgtccgttttgggcgtcccgtgggcctcacgggagagccggtccgatccagccaaccgtctactgtaacgaggagtaatgggcgtgcctaacctactactctttgctttgttgactgccaaattggtcaaaaaaaaaccaagtaatgataccaaaaataaaaatacaatatacccaatcccatgattattaccaggtaaaaactaccatcatatttaacaaaagataataatgcttatgtgtggactagtattttttatgagcttaatagagagccagaatagcaaacccctcgactacaggagtaatgggcatggctaagctaacgttttgtttgttgttgatggatttgccatattggtcataaaccagcaaacccaataataataataaaataatgccgccacaatgatgtatctttcggtgctgtaaaaaaaagtgaactttcgatgctatataaccaattttacctgataattattagtcctaccaaagtaaaaaaaaaatcatcctacaatgtcgtgtaaaacttaagccatgtttaattcccaaaacaaaaattttcacgctgtcacatcgaatatttggacacatgcatagagtactaaatgtaggggaaaaaccaattacacggattgcgtgtaaattgcaagatggatctgttaaacctaattacgctatgatttgacaatatggtgctatagtaaaaatttgctaatggtggattaattaggcttaataaattcgtctcgcagttttctggcggaatctgtaatttattttgttattagactacgtttaatactttaaacgtatccatatatccgatgtgacaactaaacctaaaaattttccccaactaaataaggccttattaagctgaaatctactgttaaaagtaattatatggtccgacaccgcatatgatggttatatatagggttttataggtatgactcctttaacatttatggcacctataatcttatcatcgggcatagtataaaaatgaagttgactaggctatgttcttttccacagctccaaattacaacttgctcatttttcgttagcatgcttttcaaacagttcaattgtatgattcgtgcaaaaaaaaaagaaactatgaagaaatttcttaaaaactcaaataaatatatttttttaatttttatagctatcccgttctacgttgccgctaatttgctcatttatattgttcaaatggtcactaccaccagcttccactccctaagtataatacagaggatatatttaacctaggattaacagtgtaaagtagcactacccttccctctttattttctcactgggacgtgggacccacatcaggtaaaccgttggaacaatccacgttctgttaccgtggcagtgaaccagggagagtggccagcagcggagaaaaatgtcaacgccaagattgtgatcgagtcgagtgccccccatctttgactagcctctagcttagctggaggagcgaagagtaattaagggtatatttagattgtagctaaaataaatcttatcaaattttgataatttgacaatattacaaaaatttagcaggatttcttatgtgttttactagagtttggtaaaaaactaaatggatacatatatttgacaactttatctaaaaaaaatttggtacggtttaatatgacatcaatctaaacaacccctaaattaacaggtgtcttgggattgctaactaaattttagccttagctatagctacagaagaattgaggcgtctttattttctttgccgaaagaaaaaaaagattctagttgtagtacaaaaataattcatttcttttcaactgaacaagaatatggtgcttgggaccaatgaaatgaaatagctaaacttagagcacctgcaatggtaaagtaaggtgctctctataaaacatgtacatctcagcaatagattagattaatagtaaaccacctcaatagtatgtctatatgggtatctatagctctctaatgcattgcctcgtttttctctatagactatctccatgttagtagatagctttgctctctctcttcatttaatctcttctaagtaggaaaatatgctgacatggatatcttgtagagagcctatagataaccattacgggtgcccttagccattgtgagaaatgaaatagtttaaggaccaatgctcatcgtcccacctataataattagttgagtaatatatattgtttatgcccttaagattatacatgtatttttttattgacaatataataatctagtattatatgagtcacatttaatagttaacgtactttttggacaaaaaataatcttatgtagtagtaggacggttcgttggcagacgaggtgaggtgagatgagaggcggctttgacacaagtggagtgaagagaggcaatctcagcttgtggctggagattgacgacgatgcgctggcatggcccacgcagccaccgggtgggccccaccacccatatgtgatcatcattatctaaagagtattttattttattaatttataattgtttttttttactttttacggaacacactactacgtttaaataagaagtaattattaagaatttgggcattagagggagtgtagcaccgtacttcctccgattcttataattattatgttttgactaatgctatggtcaaattttttaatttagaactctgtatcaataattctaaaaatattaagtttaaatgtgctaataaataaataaatatcattatagaaaatatagttaaagatatattttaaaatatagtatatcgtcatttaaaacatcacgaaaattcatggaatcatttaaatgtcatggaatcatttaaaggcagatcgagcgcgtgcaccgacgcggaacggcgttgacgttgacagaatcatcagcgcacttattactaccagatggaccccaccaatggtaaattaggctgagagaagaagcttctggatcttgtccgaacctagctgtacacacctgtactccatcaaccaggagaaactatacctcgtcaaacctaggtgtgggcattcggttttttctgttaaatcggttcggttttatcggttttctaaaatgtcggttttcgtataatggcaaacagaaagcatacagaaaagttaaaaaccgaggaaaaaagagaaatatgttttacattttttgatggattcagtaaatttggtcagaattttaaaattttgactagacgttgtcctaaacaccaccgatttataaccggatggagcaggatttccagaaaagcgtggttattaagatatttcagtgtttgaatgaaaataaagaaaacaagttaaagtagaaaaacaaatgagaaaatatcctaataaagaagggatgattttcgtcaaaaagaaaagtatttccacatatgccgctaacttactgctcctaaatggggaagtagtgtattttccaggatcaaattgtttcaacaggccccctattcagtataggtctctctccctgatagctgggcctaggcccatgatggagaaaactgaatctgtcgtgggccacgaattttgtctggggtgggccttcaggcccattagaaggtgtagcactgttgctagggcttgtttgaggaagcttctagcaactgcagtttctcctagaatctccagctgccagaagctcctccaaactgtccagctttttactagattctgagaatctatagttgtagaatctagaaaataagctagaagttagaagctgggaaacctagcttctccagtttctcactatctagcttctcagaatcttggcttactcggttcttggcaatcctcacaagtcacaacaaacactgagctcaaaactgtcacgccatttgattgctattatgctatatagcatacatgtttgacagcatatataacaaatgatccatcatcatattgcgagctccaagtgaaacaaattttcagcagccaaaataggaatttgcatagccgttgggctcgtgatcagaagtcagctaatttaaacaacagtaacctcttccaaacaataaacctcatgattgattattgatgccgttttactcgatgaagttgtattgctcaatgcttggaacagtttaataaataaatttacgtacgtattgcgacgtacccgtcaacagcgagacgcctgtgatgacttcgtcaatctctctagaatttgccggcccagtcttcgaaaatgctcatagggatagggtttacgtacgtgtgttcataagggtgagtgcgtatacgttgtgagtatctgcattgtactgtgtaattctaaaaaaaaatttacgtacgtattaatatattactcttgcatctgcactcaccaatccaagatatggctacatgcaacatttttttttactttgacaggactttgtcgaatagtttttatgaatacagtaggctttgtcaaatatgatgccaccttcggctagcatagcatctcagagaatgagaaacgcaccatggtagtagccatgaacgaacgaaaacaagagcaataattaatcatcaattatgaaaaaaaaaagaatactccctatatcttggtcgtcaaattaacatttgcgaaaggaggcagtagtagctatttcttcctagctagttgtatatatgtgcttgcttgctttcttgcagctccacttttgttcttcagcttattagtccaagctaaaatttactcttaaaacttaattttagagatgattttatagtttcttcatca

SEQ ID NO: 65201 - DNA, 3725 bp, Oryza sativa
aaattattcatgttttcattccccatcattttaaagttgtaaacaaatattaaatttgttttacttaatttaatttaaattaactaagttttctaatctttttcatataattttctatctttttctttctcatctcttttatcacaagttttttttccaaattctaaataatcaaatttgattataaaataataccacaaattattcatgttttcattccccgtcattttaaagttgtaaacaaatatttaatttgttttacttaatttaatttaaattaactaagttttctaatctttttcatataattttctatctttttctttctcatctcttttatcacaagttttttttcccaaatgctacctaaacaaaatttctatattatttcatccctacacaaactttctctctcatcatctcccattcccaaatttccagaggcagaaaagtagaggaggatggagttgctaacctttagactccttcaaattgtatattttcaccaaaacaaaatcaccaaaaattttggcagcacctccccttaaactcaacaaatttatgaagccttctcgggctagctggaggaagaagaagactttatatggatggacttttagtcccagtttgtgttgcctgacacaccctaacaaccagcgaaccgggactaaagacgggactaaatctttagtaccaaccgggactaaagatcaaatcttcccgttgaacttataaactgggactaaaaattgtttttagtcccggttttttgatgaaccgggacaattgtggtttttcccctacccgataaagatcacttctccagcagtgatttatgcctaacacagaacggcagaaaaaatttacgccctctaatatgggagggggggagtagtatagtaggctagtagctgtaattaagctccaacagtgtgtgcaagtgcaagccttgtcaaagtcatagccattagctagctttcactagtcaagatgtatattcatatataacacgtgaatcccatacgtacacaactagtgcataggctcctgcttcatatatgtacgtgtatattggttcatcagaacatatatttatctttggcaggacgatggccctatgtgataaagcacatagcaagctgataacagcccatcccctacttgcctccgttttcgcaattgtttttgttcctttaagagatttacacgtgttgggctgttttgcagaaagctcctcatttttgtacgatatatcgcataggtctttaaaccgactaacatcccggttgtttttttttatctggaaaagctctcgtgttttagagaaatacaatgcgaagtagtgacaatctcggttttagggaatagcgctgtaaacatgggaaatagagaagtgttcttcaaaaatacgtgcctttgtcactaacagatagatctacctgtcggtgacaaagatatggtgtctttgaagacagaggatctaaatcccttccatccacgggccgctgctccctgttcccctcttccatcccattcatttcaggactccatcacgtaccaacatgcaatgtatgtgtgtcacaaagacttgcagacttcattactccctccatcccttaatataagagattttgacttattacttgcactatttgaccattcgttttattaaaaaaaattgtgtaaatataaaaaatgaaaagttatgcttaaagtacattggataataaagtaagtcacaaataaaataaataataatttcaaaaaaattttaataagatgaatggataaattacagtgtaagaaaaagtcaaaatccattatatgatgagacggagggagtagatagttttgcaccggcggtccccggacaaaaaaaaatcgctaccgatccctctagcatatagaatttcagagaaataaaaaaggaaaaaagaaatcgatgcgacgcaccggagccatagcatagggtttaggaaatccggctgactcgcaccgcagcgcgcgcgttagacttgcgaagccgatttgattcggcaattccatctcgctgttgccgatttgatttcacgcagatcgcggacgcaggccagcaagcggcaggcagcgagcagcgtctccgcgagatagtgatggcggcggcgacccctggacggctcatgtctggacgactcctctcgccatcgtcgtcaggaaaggcgatgcatgtgggtgtagcagcaggcggcgtgtaggcgtggccggcgtcggggtgcatgtgcagtactggcaacaacagcatccaagctgcgcgcaacgaatcaaggcaagagcaggtgaattaatgttgattatatatttttcagtttcgatccctcacatcttactgtactgttgactgttgtattaatatagatggttgaaatatgaagatagataatgattaatggacacattttattggcattagaaagcctagacccaacaagaaatactatagcaatctagccatatatgtgtcttttaagataaattattacttcgttgataattttaaaatggttataagatgacttattaatatatcgttgcacttttggccaattgtattatctatattagtattgtacatattcgcattattgtttttcggtgctcaaacatattttttagtcggaccacccatacactaatgctagatacaccactgtagttttgtgttattgtgcacgtgttcgaagaaattaaagttcggttgtcggtttcatggaaaccgtagagctgaaatcttcagtccaaagaattaatagtgtttttttaataaatgtccaattaagcgttgtcaaagtcgtcgccatatatagcatggcactactcaagaaccaagtcaacatctcactcgtgagtcccacacaactagtcaaaacacggatatgtttaatcagttatgcttaattaacacatggattaattaaatatatattatacataaaaatgttagtactaatatcttaatgttattagcaatattgacggagaaagttttttataattaatgtgaataattataaatctacttttgaagcatgatataaatagttaatgtgaataattcactccactattaactagtagaaagaaggcggctttagcccctattttttcttccatatgcatgctgataatacacgtatgacatattagaaaagaaaggtgaaatgtttatatatatgttctttagtaattcaaaaaccaataataaaacaataaactatgttgaatttttttttaaaaataaagttctaaaatttaaattctggcagcgataattctatatatatggggcaatcagtgggagccttagtccaactaatttgacaactagatggtagctcgtgtcatttttcttcacgaaaaatgtatataaaccaccacaaaaagcataagtcgtagagatctccaatgcaaagtattgtcaaagtcgtcgccattatatatattagctcaagatattgcatgccctatagtcaagacctgtcatggacaccaaacaagtagttaatattgagttaattagtcaagagccgccgtcagctccagagcttaatttttgacataattccatccagtaatcacgatagcaccgtggccaacatgaacaatctttctcttcgctccagactaacaagcaggcactagtaaaagtcaccgccatctagcagtgatccagaaaatcgatttgttgg

SEQ ID NO: 65202 - DNA, 605 bp, Oryza sativa
tcgtcaactaggtgttggtgttccatgccgccaagttgacgatgactagaaaggttatctcaaatattgtacttgtgtgattctgatgaataagagcaacaccggcttcggccaataggagtagggttattaccttctggtgaaggggtccgaacctgtataaaaatccttgtcttcgtctcttttatctcaatctcgcatataccctggtaccaatgatctccatactatgcaaacaccatagtcgtgatctaaaacatcgacaatggtgcgcctagtaggggattttgatgcttcaaggtttcgacgagatgggttcaagaagacggattgtccgacaacaaacaatttggctatagggggatccgacccaaccgaagtgcgttctccgatggatcgggatcctcgtcatcttaagcttcgtcgccgaggatttttttcgacgaggatacttaaacgactttggccctgggagatctgacccgaccagagtacgtcccttgactagatcaaatcatcgtcgctaacaatttgatctatcgagatcacccaagctttagggcccgtggcataccagaagatttcaaatatatatgatttcaaac

SEQ ID NO: 65203 - DNA, 1071 bp, Oryza sativa
gggggggggttgggctgggttgataaacacatttacggcccaccacggcccttttgaccctacaattattactcccaaatgattacacattgcagctcccaaatgattagataagaggtgtatacgcgctagtacaggatgcaagcggggatttcacatttgttactcaaaggatattattacatttcttcagttcaagcaggaaaacccaatgtgtaaaaaaaaacctgaaccattaggtttaaatccaagtgtctttcttttcaccaacactgaactcaatcctcaacatgcagtaaacaggcataggaggaccaagggattgatgatgcagctgaagttagcataaacaacgtaattacagttcagttcatcatgcatatgatgcatccatcattattgttatctccagatacagatcgatctctctatatatacacatcatgcacgtatggctgtacattttgcggatcgagcatgatcaggtatcagctagcgttattctcagatacttgagacacaattaaaagaactactactactactctccaatctgaatcttggttgtagctgcttgtttttgaaattcagatatattcgacccggcgaaaattcagacaagcttcagactttcagtattttcagttcaggttcatcacttgaaatgctgaaaataccagttcaacaaattacacgtgtatttctcagcaaaagaaagtcaaatatacaaagaccgagttataaacatcaacgccaacaggttatgacttgcagcatgcattgatctgataaaccactccgcaagcgatcaaatatatataactgaacctattattcataagaagatggttttccactttctaccatatagtgcagttgatagtgttaatttgtgctactcagaagtcataacacaacatacataacattacaaaggttcctctagattccggtttattccttaattttatacagaaactaacttaaaagtgcaacaaatagtaagtgcacactgatcatcatattactctcaaactaacttaagttcgtaccactgataatacaccaaac

SEQ ID NO: 65204 - DNA, 3937 bp, Oryza sativa
  unsure (1)..(3937): unsure at all n locations
gccggagaggagaggagagtcagtgagggagagggatctaagggagagagagagaggtgagggagaggataagtgagggagagaatgtgacttagaaaaaaatctgctcagaatgggtctatttatattgctcctcattttttcgcaggcaccgcttaagtagtctgcctgcgaaacagcaaacatcaccccaatttatatttttgtaggcggtcatttggctccaaaagtcatgtccgactgcgaaaataagaccccaatgttgaggaaaatgctttttctagtagtgtggagcaggacggtcagaaatttagaatatttgtatcgtgtatataaatttgtaatcttattttcaaaagattttctaaataatttatacaagaaaaaacagggagatatatgttctcgaaggtgtaaattgttttatttctccccgttgtgatttgtgaatattgttaggggttattatgaatttggatcgaggtactgacgaagaggatgaacagctgggcacattagaatttggatcccttgcttagaagggattccaaactacacggtcacggtctaatagtctacttcatccgttttacgttttacaatgtaagactttttagcgttcctcacatttatataaatgttaatgaatctaggcatatctatgtgtctagattcattaacatctatataaatatgggaaatgctagaaagtcttataatattaaacagagggagtagatcatactgctaagcgatacagtaaacccagtcaatgttactacaggattttcggcacagtaccgtgcggtggttactgtagcatacggaggtcactgttatcacaggggaactctatgttgtactgcagatgatccggatccggttattacacacatatataatatatatctcatcatctaggaaacccactcgcaagagcattggtggagatttgaataaaaataattacacatctattaaagtataaaattaatccttcttaatcttttctaatccctatctaatgaggattaatcgaacaagcctttaccttgtgataagttatgttgtctacttcgtggagaaaccttgcttagttatgagatggtattgctccaaatcttgatcagtctgaaacgaactaacccagcctgcacaaaaaaggtccataataaatcaagacttgcatcaagagtcgccgtcatatccggagctttaatttggacataagatcacaaatccagtgaaccaaaaaacatcaattttctttgcttcgaactggatttacaaacgacgaattgtaccagcaacaactaacagtagtcactacctaacctcgaacaactaacagtagtcagaaactcgaacacacttttcgtcgaaaagtgattaaacactcgaaagtacgttgtgttgcttgagatttatatggtgtgtgcgtatatatgttgtgaaatccagcttaagcggtagtttgctatgagcacgttttccaaattgccgaacggtatctttggtgtataaaagaaaaatcaatgttgaaggttttttttaaaaaaaactaaataaatctaatttccatgtgtttcaatagttaatggacacgggagaatctttattttttttattacaattagatcatgttagcatatgtaaataaagcaaatttgtaggcagaaattaccggagtaatttttttctagattcacaaataaaatactaattgatttgtaggtagagaacatccgataatttttattctggattcatcccctaaggactcgtcttgttcccgtgttagaataagtcaagctcatacaacactgtcgaatgaatacttagtcaaaccgatttaacagccagctggaaataaacgaatctagccgaatgagtgtctgtttatagtctaattttgttccattttttcccttatgtaaatcaaacttgatatttcaaatttgtgtaaaaaaatataatattccataatctcgtattactccataattttgtcataacttataaacaataaactggtactctcgattgaggggacaggcgcatatgctctcgattgagggggttaaaattaatttatttctcactttgtttagatgtcatggtttgacaagtcctgtctgcttcatggaaacaatcatgcttatgagttgctattgattaattgctccaaatattcagtctaaaatggactagcccaccttaagaaaaacattaatcgatcgggacttgtagcaaaagtcttgatttttcttcgttaatcgcagtccagagctttttgacgtaattgcatcaagtaatcacgatcaccaccgaacccgtgaatccaaaacaagtatagccaacacgaacaattaatcttgggtatttttcttcgcttcagaccagaccaacaagcgacgacttctcaccctactagtagtagtcactactacatatagctggagcagaatggtcagagagatttggacatttttccgtgtgaaaaaaataaccaaattactacctacattttttataaagaaaaaaaaactatgttgttgatttctagacatgattttcaacatcaaacttactgaaaaactatacaagtatcatttactttgttatgacttattttagtattaaagttttattttcaaaacatgacttataattttgttatatttgcgctaaatatttattaataaaaactgtcttcaaacgttatatttaaaaaatctacagcatgatatattataaaatagatgaaaaaggcaaacagccgagagctagctatgcagcaaaatatatatagatccggccaaaaagaaaaaaaaaacgataccattaagataagaccgaggaacaccgtgttggaattattggcaacaagtccacaaagtcaaaagtcaaagctcatcctccccatgctgttgcagtctttgccacatatatgaagccaagcaggtcagtcacgggcttcacgtcgcctcgccggagaagaagacatcgccaacatataccccccctccctacctagactcagatcagatcacctgcccatcgacgagcacaagagcgatccattcctggtttgaatcgagcttggtttgtttggttggttggtttcttggagtggatgatggcgaggtggtgcgtggggtggccggcggcggcgaggggtggtcgggatgagctgacgtggcaggcggagctgacggcgcacgcggcgggggagttctccatggcggcggcgcaggccaacgcggtgatggaggaccaggcgcaggtcatggcgtcgcccggcgccacgctcgtcggcgtctatgatggccatggcggccccgacgcctcccgcttcctccgctcccgcctattccctctcatccatggtgcgtgcgctcgccggcgcgcggcggagctcgatcttgtggtttgatttgaatacgttggcaacaatccttagctgatttgttggcgccaaaaattgatgagcagagttctcgccggagcgcggcggcgcggtgnacgccgacgtgatccggaaggcgttcctggcggccgacgaggagtacctccagctgctgcggtggtcgctgccgaacatgtcccgcgcggccgcctcgggctcctgctgcctcctgggcgccatctccggcgacacgctctacgtcgccaacgccggcgactcccgcgctgtcctcggccgccgcgcggcggccggccagaccgtcgccgagcggctctccaccgagcacaacgtggcctcggaggaggtccggagggagctcgccgcgctccaccccgacgacggcgaggtcgtggtccacgccgcggcgcgtggagggtgaaggggatcatccaggtggcgcgcgccatcggcgacgtgtacctcaagacgccggagttcaagcgcgacccggcggtgcagcggctatgc

SEQ ID NO: 65205 - DNA, 545 bp, Oryza sativa
ctgtcctttagacaaacttgctttactgtactcagggagcctgtttcagatttttcctgaccgcatttgcggtaatatatgtgcattgaaggcatatatatatatatgtactactataagtaagaaaatcaagctgtatcattcaaagaataattctaagtaagcatctttatacaatttcatgcaccaggtgccaaaaaactaatataaaaacatctatgtgaaataacttgaaacaaaacaccagtcgacagtggcacaacctgtcccatggcaaggatcagtgggcacattcaacacccgaattggtaactaaatagttacaagctactcattcaagaataactaaaaatagttacaatttaatggagttttcatcggcgagcccgggaggctgcccgggctagctgggcggtggctccgcccttgcttctaatcaatggattattgtgtgatgcttgtgcttccgtctagtaagctggtctgctggctcatatatcccatcatcacatcattattgtcgtaatttcacatggcttctaggg

SEQ ID NO: 65206 - DNA, 1843 bp, Oryza sativa
ttttgttctggggacatcttttttctgttctgcggtctgttccttgtgttgattgccatccattcaagcgggtaaatcagatttgatggtttggtggataaaaggtagtatgtgattgttcagcacggtttagcagcgggctagctgctgctaagatttaacatcgatatggaagtttgagaatcggtggactctaatacttgtgcgtgcttccgttgctgccaagccatattgcttattgtctgaatgctcgctcttaaccatttcatgtgctcatatgagcaatctgatttttgtatcaaatatgttatccctccttttttttttacaatagcagatagtgtttatgtgtgttaattgtgaggtcaatttttttttacaatagcagatagtgtttacgtgtgttaattgtgagatcaacttgtgcattacatgtatgtacatgtcactggttcgaacatgttagactttccttgttaatggtgatttttctaagccagttaagtagatggtagcagataaaagttctgtatgtcgactgtagaattaaaatgttcagggcgtgatctgtagaaagatgtagtaggggtggctggcaggttgcagattcaccagcactgttccttttttcccccaaggagtatatagagaggaacaattagcttgctggagaattttcctatgatacgtgtaacatgttttatgtgatctgtcagaaggctgttactggtgcttaggtctatatgtgatttattttttattttgtttgtggtgtcttgttacattgtgtaactggctccttgaagtgttttacggcctttatccgctgcatgtgctaataaacacttttaagttgcacaaataaactgtgggttccattttgtcttatatttttagatttactggatattgcttgggaatgtaagttgcagagtgttgtagtaaatgatattatggtttgttgttctgtgcaatttactctactgttttcaatggaagggttcatatacatgttcccaattatcttatttctgaaattctccgtattgaatcctgttatcctgtattgatttcatatgcactgttgtttgtatgacagaaatagtcatctcagctagtgaaaatggtgcaatacaatttcaagcgtatcactgttgttcctcctgggaaggacttcattgacatcatcttgtcccgcacccagaggcaaacaccaactgttgtccacaagggatatgctatctcccgcattcgtcagttttatatgcgaaaggttaagtatacccagtcaaacttctatgagaagctgtccactgtcatcgatgacttcccaaggttggatggcatccatcctttctatggtgatcttcttcatgttctgtacaacaaagatcactacaaacttgccttgggccaaatcaacacagccagaaatatcattgcaaagatagctaaggactatttgaggctgctcaaatatggagactcgctgtaccggtgcaagtgtctcaaggtggctgcattaggtcgtatgtgtactgtcattaagcggatcagtcctagtttggcatacctggagcagatcaggcagcacatggcgaggcttccatctatagacccaaacacccgtactttattgatttgtggctatccaaatgttgggaagagctctttcatgaacaagatcacaagagcagatgtggatgtccaaccctatgctttcacaacaaagtccctgtttgttggtcatgctgattacaagtatttgcggtaccaagtgattgacactccagggatccttgatcggccttttgaggacaggaacatcatagaaatgtgcagt

SEQ ID NO: 65207 - DNA, 559 bp, Oryza sativa
attctctacattttatagatcgtgaccggtagatgaaaagtttcaaggaaccctataatacatataaatacattgctgaatatgatagtgcaaatcaacaccacgagtttctattttcttactgacataactactgcttagcatgttgttcttcaacttttcagggtgctgaaacattctcatcatttacccttttttttaggaaatattatataaataatctcagctggctgaccaaagcttgaaatttactttcgaattgctttcaactacaaaacataaaaacaaactgaaatcaccatgattgtgtggagcattataggacgagattgggtggaatgcagacagatttataaaactgaaacaataacatatcagaatatagtagaaaatttatgtcttcgtgatattgggtcaaagtaccagagaaagtgagtaacattaatttgttttcgcagagtgccaaaagagctaccaatttaattattgatggcctgagaaagtattaacttagtcttaaacatcatatattcgtagttgcacttatactgctccacgc

SEQ ID NO: 65208 - DNA, 684 bp, Oryza sativa
catacccccatcttaatttttaattcagtacatgttagtcggtcatatttttgcttttaaacccttggattattttaatttgcatatacgtccaatatttacagtataccctctaaaaatcacaaacatatataaacgtcaacccctcctctcatcaccatatctcccacccaatctctccctgcgtctcctttctctccgcttctcccctcgccggcaccgccggggagtctctccccagcgcgtcgcctctcccctccccggccctctctccccggcgctcccctctccggcggtgccacctgtctccccggcgctggatcgaggcggcggcggtagggcggatggaggctgcggtggcgccggatcgaggcgcggcagcgccggatagatgcggcggcagcggcggtgccccatcttcttctcccccgcctacttcctcgccatttttggccttggcgcgggaggtagttggctacaacgttccagggttacggtacggagcgacgcctctcccccaacacggctgctcgcccgttcctcgccaaaagctaatgaaactatgcgatgctatgcggggggtcagggagctctacgagagcgcggtcccggccgagctggcgcgaatattcgcgtcgggaggggtgagaccacgcgacgcgaatattcgcgggtgagaccacg

SEQ ID NO: 65209 - DNA, 1121 bp, Oryza sativa
acccttacgatatggtaaagaccaagtcttgtacgagtaggactcctcccatctgtggattctgttcctatcacgtgatagatttccttaacgtatacagtaactatccatatacacgcgggtataccgtatcagtatacaacgtacatccaagaatagagggtataccttatccgtgactctgacaatttccttcatgcatcgggcacccattgataagcattttttctttcttaaacaaatatctatgaatatgtgttgaaaaaatcatgtgacttataggaactgaagtgtgccgtatatgtgcctaataataagaccaaatatttttcgggttttttgcaccaacaaaaataaaaaacaggtacacccttacaagtgtcgattctatattagaaccggcaccgtgccgttttttgacaaattgatcctttataaaaacttattttgaaaatagcccctgccaaaaacttcaaccaaaactaagccgtcggctcaacgccatcaaggttggcgctgaggtataacgtctcagcgccgataatgttggcgccgagatttttgttgagctggcattgagccacgtggcacggcctagaattcacttcaaattcctgtgaaaccatagacaaaattcaaattcaaattcctctcaaatatcctcaaaattcaattctacaaaccttgagaaaataagaaagttcactgttcattttgggcctctcttcctttctctcccaggcccaactctcctcctccttttctcggaataactgcactttgactccctcaaaagtgacctgaatctaattcatgaccctaaaccgcaaaaccggatatctcgacccccgaactattaaaaccggtgtaatttgactcctttggtggttttggaggatggtttcgctgacgtggcgctgacgtggctgtgttgacctagtctatgggttaacgtggcgcttaggtggcatctaaattaaaaacatataggtgggacccgtttgtcattcacacatataaaaatttgtgggggccattggcatatgggccccatatgtcatcctctctctttctttttcctcccctcttcctccattctctctttctctctttttctcccc

SEQ ID NO: 65210 - DNA, 1628 bp, Oryza sativa
  unsure (1)..(1628): unsure at all n locations
aggatccccccgcgctgctcgccgccattgttggcctactctgagaagttcttcatgatgttttttccgtcaagagctacaagactagaagcggagccactgagacgtatgcccctgtatgcctaccgattttacgttcattatcgaagtaccaatcattctccggtgcgttggattctactccactatgtatagatggccaaaatgagtcgcccgacacggcctggccgggacacgactaaggcacggtccaagatcagtcggaccggctcggcctgagattaaccatgtcgcgccgtgcccatccacggggggcgcctacacctatatcccaggcatggcccaataagactcggatcatgccatgctggctcgaaggcacgactagcataccggattgatccttggaataagtttattttgcctacctaatttttttaaggccgtgccttatatggctagaataagtatattttaccccctcacatctttatatcatgcattatatggctggaataagtctatcttgtatccctcatctctttgggccagccgccaatgggctatggcgcaagctaccattgagcccgtgcggcctgcgggagcgaggtaccgttgagccgtgttgtgcccgggacggcacgacgttgtcgtgcaaaggaagaggcttatgcgtagcccaatagtcgggtcagactggcacggggccgacaactgtcaaaaaataccatacctgggctgggccaaatctttgtgccgtgtactgagctgtcgagctgctggccttttggcccactatactatcacccatctatggctgacgcnntantntgtactcctttcatactcgtaagannagtcgtttaggacagcgacacgatctccaaaacacaactttgacttcttgtttctataaaaatatttattgaaaagtgatatatgtatactgttatgaaagtatttttcaagacaaatctatacatataatttttatattttcaaactcaataatttgggagttattcatgatttatattcctaaggtttgacttaaacattgtcttaaacgacttcctttatgagtatggagtgagtacataagattggttgcgaagcaccccgcctactagcatagaagaggaccccgaaaagttggccctaattgaacaaggtaacaaaataaagattacatgcttttgtttggatcatgtttcagaactggttgcaaaaaaagattgttgtacttccaagcccccccatggctcctgcgtccaagcctagttctcctaatccctaaaaatcttgtacgtatcaggattcaggagatatcattttactagcaataggaggtggaacatagtttttctaatcttgattaatttctttggttttcagctttggatgtgagctgtggtatgctgaatttggtgggcagctgattgcgcagtcaactaatcaagtctacttttggccaatacttaagctggggtttcttgtaacccagttttgctgtaacttcggcgttcaaaaaaaaaagttttgctgtaacgttgctggtctgctgcacatgtattgcagtatgaactattgatattcatgttggacgtttgttgttgcttgtcagacag

SEQ ID NO: 65211 - DNA, 909 bp, Oryza sativa
ataatcgactaagctcggtaggacccactgtataacaagtcttatacggaatcatacctcgtatataaaagagttcaggatccatatttgttttccaagttctatttggacaaggacaagaggatatctatgggtataaatacaaaacctcctagggggagagaaaaagacaagccaacacaaattaacacgctcagtcagaataggcaccaatacatgccaccagacaccgacatcagagataagcctagacagatccaatctggtgccattagaggccaacaagagggatctagcgctatatctgatctcgccgagtacatatttgaggaagaagactaccccgtcgtcaactaggtgttggtgttccatgccgccaagttgacgatgactagaaaggttatctcaaatattgtacttgtgtgattctgatgaataagagcaacaccggcttcggccaataggagtagggttattaccttctggtgaaggggtccgaacctgtataaaaatccttgtcttcgtctcttttatctcaatctcgcatataccctggtaccaatgatctccatactatgcaaacaccatagtcgtgatctaaaacatcgacaatggtgcgcctagtaggggattttgatgcttcaaggtttcgacgagatgggttcaagaagacggattgtccgacaacaaacaatttggctatagggggatccgacccaaccgaagtgcgttctccgatggatcgggatcctcagtcatcttaagcttcgtcgccgaggatttttttcgacgaggatacttaaacgactttggccctgggagatctgacccgaccagagtacgtcccttgactagatcaaatcatcgtcgctaacaatttgatctatcgagatcacccaagcttgagta

SEQ ID NO: 65212 - DNA, 570 bp, Oryza sativa
cggagcggcgacagccgcgtccagctcgtcggcatcggtcgtgctgctgctggtggtggtggtgatggcatcgtcgtcgctcgtggcggacggctcggatgtggcggtcatggcgtcctcggcgacaatgtcgatggcgagtggaaacacagacgacgacgactcccgctgctcgaagtcctccaaagcccgcgccacggagcgctggacgtcggcggcgctgtggagggtggccgggggcggcacgggcgaggggcgaagcggcgaagttgaggcacgcggcgcggccacggagcgcgagcatggcggcgtcttgtgcgcgcgcggtggtgtcggcgccgtcgaacgtgccgagccagagcccagagcctgcagccgcggcgcccctcaaaatcaaattcatcagttcttgtaatcttgttctcctagaccctgacaaatgaaaactcgcagtggttcatctgaccaaaaaagaaacaaacagtgtattggtccttggtcgaattcagattcggatggattcacgagtcgaataatcaaatcaaacgcatgactagagtagactcgatc

SEQ ID NO: 65213 - DNA, 923 bp, Oryza sativa
aaagaggccatgacaggacccttggcataaccccctctagccaagcacaccacacctcaggtttcacccccgtccccagcgggcaaggggcagtcccctctcgtgcgtaggtgaatccggaagcgacagaaaccgtcgcagggcccgccccgctccatcacgcccacctttgcctggatgcgtcggctagagaaaagctacactacaagtccagccgttgcccacgctggcttgtggtaagtacgataagttcttccagggcatcccgcgaaccggtctttaattgccatgggtgcgactagcaaaaccatgcacccacagcccatcattcagtcgcattttagttggataattacgaccatgaagcatggccagatgtctcgagcacgcagctcattctgatactaaaaaggtctaatactgtaattatcccatcaactgagctagtgctaattaagcatggctaagcatatagttctagctaggtcacataagtaatatgagctagtcgatttattacccaaggttgacaaagaacagatatcaagtaaacatggcacaagcaagcagataggtaatacccggatcccatgtaattagcaaaacatgcatatttatttgtaaacggtaaaccatttataaattgggatcaacatgttcaaggggaatgtgtgacttgccttgcttcttcacttggatcttctgaactcttatccttgcgaacgcgatcttccgaaacgacgggaactacacgctggcacgcaaaacgaggaaaaactctaataaaaactaaggaaacagtacataaaaagtaaacaaacatgtagagctcaattttagatgaattttgcaagttgaatggctcaattcggagttcgaatgaattagatatgaattttagaagttttgagccatttaaatga

SEQ ID NO: 65214 - DNA, 3033 bp, Oryza sativa
ctgtgacccgagagatatttttgattttatcccttccttgtacctgaatttataccccagcagctccgagtccttttctttcacggttgatcgccaaaacagatccacatcaatgatatctttggtgtgacccctgtagaacttgccgtaccagaatttgacaacaggcgtaattctaccaaacttcatatccgccctcctcctcggattaggattccattgtcccatgataagcctccatcctgcccgatgtcgaaaagcattaggccagatccaaccagaaccagcacgattaacctgatcaccaacccaattacagatcgcagacgtgacctccgcagactttctgagcagatcggagagaacctccatccagatcctcctttcatgggaggagaaggctgccgcaacccagtcgcctgggtgccgcccagaccctaactcacgccaaaacatgtttgtacaagttaaaggcaacttgaaaacaatataggagtatatgaccaccaatcaaacttaaatcactgaaatatcgcttacctttcatacattcatcagttgtctggataagagtggataaaaagaaaacctaataaatgttaatgtgatgaatttgatgacaatgaccccgagttattttttcaaaacacggaagatgctcacatacattgatgcacatacacgcgcaccacctataaccataccggagagactgtcatttctcaatattgacaaatttattaccacagatagcaacaataaaatttaaaaaataattaatcgtaaatacgagcacgtgcatcagatataaaacttaataaaaacttagattgatagagttacagttttttttaaccccgcagtgtatacttgtattaaaggagaggaagccactgtatagtagccttgaggctaagagttaccgttctagtcaggggcggatccagcgtggggcggcggggtctcgagcctccactactactgatgtaaagactatgagagcccccacaaagaccccactaaaattttttaccatatataactttatctagtttgtttagacctcattgctatttctttattgatccgccactgattctagttcatgacaccataagttatcgatgtgatccgccactgattctagttcatgacagcataagttatggatcacatcgataaaaacatatgccggtttagttctcaaccgctgtactaattctttagctggtttcaaacaaaataggacaagcatataaagatgcgatggaatttgaaaacataagatgccaagtggcatatctctactgttttgccagtttgtccacgagccaaaagaaggctccaatgagaattcccccgtacatgccggggtggcgccacatgacaatgactgacaggctggccccacgtcctacctggctggccccacccctgctctttctctttctcttcttccctttcgtcttcgtcttcgtcgtcgtcgactcgtcgtggccgccggcaactcacgcccaccgcgcgcgcgcgcgaattaatacaaacacattaacacacacagagagagaaaattggcgcgcctcgcgctgtgcgccttcgaattttggaggcgacgcgcgggaggacggaatcggccggggattcgctgcgtcgccgcgcgagagcgagaggaggaggaggaggaggaagccgggatgggggtgtcggacaacacggtggggctttcgctggcggtggcgtccagcgccttcatcggcgccagcttcatcctcaagaagatcggactcatccgcgccggcaagggcggcgtccgcgcaggtcatctctctctttgctttgctgcctcattctcaggtcaaccgttgtttgcttcttgggattggtcgccgcctagctcaattggtcgcacggcatctcgcttagtttgacgacgcccgcatctcaatcccttctctggggaataatcgaacactttggtggatcttgattcgtatgcagcaacacctggaattatggattacgcagagcatttttgcaattggatcccatcctgtcctgatgattagggtggtttttttgtttgacaaatcgttgcttacctgcgccgccgcgattgggtggcggctgctgttgctccgcttctagatcttgacgaggctgcggttggttagtccaagtcgtaagcctgctcgtgcgtgcaaatcagcatcgcggtcgtcgccattgtcgctgtcttctagatgcaaacggaaactcttgctgtttcgtcttggaagaccttgtcaattcaaatgcttttgggtcggatctctaaaatttgaacccagatatcttgactttcagatgccgtgctccctatttatccccctgcgttcaattaccatggttggcattttggcaatgtaaaagcaaatgtttttttttactgtttcatctccgttgccaatctaaacatggattctttttctttttctttttttttacttactctgatgactctttgtgggtaattgccctcccatttcatcttacctgcttcttttctaacacattacaggtggtggaggatacacttatcttttggaacctctatggtgggctggaatgatgacaagtatgctcactctacacagcatttacagttagcttaattaaacttgacaatgcagctgaatgtcatctctgttgattgcacaagtgttgcttggggagatagcaaacttcgttgcttatacctttgcaccagccgtacttgtgactccccttggggcactaagcataatcgtaaggtgatttttttcaaaccaaagccttaagttcagtagtcagcactatctttgattctcctatatatggttgacatacattttgttttttttctccaatttggacagttcatttttagcacatttcgtgctgaaggaacggcttgagaagctaggtgttcttggttgtgtatcatgcattgtcggttcagttattgttgttatacatgctcctcaagaacatatgcctaattctgtagaggaaatc

SEQ ID NO: 65215 - DNA, 6496 bp, Oryza sativa
acacacatggctttttgttatcattgcaatcatctgtgtggtttctcagataaattacctcaataaggtaacacattttcctggctaccaattacttggtgcaagtatgttttgctcgattgcttcctcatgatctatttttcagtttttgaaaatctttgaaaaataaatttgttttttttaccacaaatgctaaaaaaccttgagtggtgcaatgtttctgtgctattctgatcattcagtgtatctcacttttcatgtaatcatgattttttttcccactttgcaggcactggatacctttgatttagctgttgtttctccaatttattatgtaatgtttacgactcttacaatagtggcaagtggaattatgttcaaggtagaaacaaatatttaaggtttagttaattgagactgatcccttggatggggctcacgacttaattcatcttactatcaaatgcaggactgggctggtcaaagcttcagtagcattgcttctgaattttgtggtctgataacaattcttaccggaacaattatgttacacacagcaaaggaggaagaaacaggcagttctgcaggtatcccctgttccttgttttaccttacatggcacttgtcagaaagaaaaaaaactgtgtgcaactggatcatttaaaccctctatttcatgaaagaaatgataaataagggctttcctgcaagtacttaacatcttatgtcattccaaattttcctaagctatcattttctgctgacaattgtgtgcggaatgacaatattgctctatttaaagccagccctaaggccctgttgaatcagttctctcgggaaatcttacttaagaaatactccctcggttgattttcatactaatcagccagccctaaggtctggaccaaaatttattgtctaaaaatcataccaatatactccctccggtttcataattcttaacgttttggacaagttttttgtcaaacttttataactttgactaacaataacttaaatatatttatttttaaggtactaaaacaacatatatagtttgccttacaaaatgctataatgaaaataaaaaaaatatgtatttattgtacatattaatataaaaatatagtcaaagatatatttcaagatcgtgttattgtctaaaacgtcaagaattatgaaaccggagggagtactcatattgtatgggtattcaatggtcaaagtttattctcaaaaagacaatgacttttaaataagatacaccttacaaaaatcgcgacggaggtagtacgctttagaccttttcctattttggagctcactggagccttgatttttcttttcctccctaagctgtagaacagaactatcatatgctaagatttgtgtgtattttcaatagattattgtagcacatggtttaaattttgaactgagtatgctttccttattttgtttcagctttgccatggcctttggatagagggtccatatcctggtgtatcagtttagggagcgacaatctactgaagaatgtcaatgaggactactttgcagctctgcaaagttctcctgcgccagtttaattgtacatttggaagtaatttccttttacttccattgacgaagaaacttatagagtgatgtacaaaatatcatgcaaattgcacaggaaccttagcagtgccaacattctggcagttttgttgtagaagattttatctgacattctttcactgtacataaggacttgtaaaatttgtgaaaccattcttggaaccacacgatgttaggaaattcttggaaccagattgtcccagttacctaatctgtttgtttgacagtgagcgagcagaattgctcgctgaatgttgtgcagtatgaatcagaaaagtgaagtatggtgcatgggcagcatggctgctgtcgtcagaaagtgaaataagatcttcaggattcgtttgaatctcgcttattttactgattcgatttacaacctcatcttttcgcttatacttatacttatcggtcaaaatttaaattttcaaccttaaatttggagttgattttggagttttttcatcgaagtttatttttcaacttttgcttttagttcgccaagaacacatatataaaagttttattcacattatttttcgtttgtaaataagccaaacgatggggccattaatttccatctaagttattttgcgtagtcctgatttgtttatacttgcaaaaggcatagtcatgatttatttatactggtaaaaagataaaggtggtgaatgcccatccgaccattcccatatgtaatgaattgttcccatatttcacaccatcactttttttcacttatatggtgaagagtcgctagtcaattttattagtttgtttttcatcaggaacggcggagagtcgccggtcaattttattagattaggagagcaaagtagtacaaatataacacaaggtgccacgagacttagaacaacaaagcaaatcaaatctagggaatacatcgttcccgtggagactacacaaactgtatggctaaatgactataataagttacaaagtgcaaggtgaaatttcgtttataactgtcttgcttcgtgcactgccacatggctagtacggcccattactaagtagtgatttctaccgctgcctgaaaatatgcatacattcattccttcttgatttagcaagatacaattataagtttcctcatggcgatctactaggcaaatccatcgtcccttgtgaatagaggacttcagagcgtcgataaaccggcatccaaatttagagagtaaaaacacatatgcttaatagggttcctttaccgtgtgtcgaatgtttgattcggccaccccattactacggattgttggccgtcaaccatatttcctaactagttaatcacatgaggaacaccataacaattctcaccatgttcaaaaactagaatgaattctcacctatcagagcaggtttaataatatcatcaacttgctggctataaaacaaccacatcatctatatcccgttagtataggttgctcatataactacggagtaacaactaatatattttttaattgatatgggtcccactaattactgcattctttaccattgttccaaccatgaaccaatctccattaggcttatttctctttcttcattgtaccgcgtgctacagctggcgataattctatcgtcgactcgtgttctctctctaccattccatcttctagcacaacagtgaagctgacatgataacactatcgtaggtccaggttggcctactagacatgctctcatatatcatcaatattttggaaagatcaaaagaaatttgccaaatttactgctttgtgatgggtgtatttagttcaagctaaaattggaagtttggttgaaattggaacgatgtgccgaaaaaatttaaaagtttgtgtgtgtagaaaagttttgatgtgatgaaaaagttggaagtttgaagaaaaagttcagaactagactcggccacagtggccacagtgtgttggctgtcctaaagcaaaacacatgaatcagtgttttgactcatttctccctttgtaaaaaaaaaaacacaactacagaagagagagagagagagagagagagaggggaagcgtcaacctcccgaatccatcgccgccgccgccgccgccggcgatgtctccgccggccgacaccgccgcgctcgcctccacgtccggcgccccgctcgcgcccctcgtcgccgcccagctcaacttcgtcctctcccaagccaacctccccatcagggtgggtacccccgcgcactgcttctctcctcctccgctcccgcctcacccccgctctctccttccttgcaggtggggcagatctggtccggatgccgcgacggccgctacgccgatcgcttcacgctcgccatccccttctgcctcgactacgtctactgtaaaccctcccgctcgctggctccaatggtttagggtttcatgtctctgatgattctgcaatcgcaggggacttcctgtacaatgcgctgtcgccgaaggtggcgccggatgtggtgttcggcccggacgacgaggggtttcagccgctagtcgatttcgatgagaccgggagtggggagaagagctgcttggcaaattgggattgccgggacacctcggccctcctctctctcatcaaagagctccggtaaggataactctgtatgctagcgatgttgctccttagttgcttactgtaatcgcgcttcgcgtgtgtgatgattggagtcagttggagctgagagttgcaaacgcaagggaattgtacgcgacggcgattgcatatgcctttattgtggatgatatattgggatcctggattgtcagtgtggaaaaaatgttctggaagttttgatcctaaactcgcttttaaactggttgctcttcacttgattttggtgcagtgaattttatattgaataccaaaagaagcgggcagccgaggttgatgacgcaagactgaaatttgaaataagcacagttctgtctaaggaggtaatgcactacattcagcacatcttccttcctatgggcattatgattatctaattaatgcaccgagcgtatatattttttaagtagaagactagcagttattctggaatattaatatcccaagaagaaccatgtattcgtaactcataattggttgatccattctacagcttatcgcctcttatttttgcctatttaactttcttgttttatgataatcgatggttcagtaacaactttttaaaatggacacattgaacaggggattgaagtctgcacggtatcgtccaatggtagagtaagtttactagtttccatatctgttctttcatgaaaattgatgtttgctcttacttatttttaatatattcacttatagccagatgaggtgaaatttgctgtcccacttctggatctggaccttgccaaactggttcctggatgtccttggaaacttcctcaaaagatccatttgcaggttaacttctaatgccattccttccatgggcatagttaaaatggtagcagtgatgatgacgaggaatccattcagcaaatttttagctggttatgatctgttgaaatttgaaatgcactaaagtaatgattgtaggaaggcctttcgtccatatcttattctggaacagcacttggtaaatctcatgtagcaaagatagtttccatcttctctaacaagatagtacacacagacggactgtctctctgttattatggttactcctgctctagaatagtcccatcgttgcatattatactgggcaaagcacaacaccagtacatgaaattcaaattgatcataagttttcctgaaaataaggatgtaaatttcacgcttaacaatcccttatatgtattaacatattttagaaatgagtgtcttggttgttatgggatctcacttggatgttaaagtagaaatacatgatgtgattatcaagtactcaatatgcacgctgcaaaaagagaagtactaaatatgcaaatgaactgaaaattctttatggaaacttcccaatcagtgccagcatatattaatttagaaatactccctctgtcccaaaatataagtatttttggacttcaacatggtctttaagatgctactttgaccaataatatctacaaaagtaagatgttttaactaaaaagaattgtatattatgatagtttgtttaatgatatatctagtaatatcaaatatacatgatcaatcttttttttttgttattaatagtcaaaatttaaaaagtttgacttgacactattctaaaaatgcttatattttgggaccgagggagtatatgatatgattggcaagggtttaaaacgaaaataaacttggtaaacttctagcaaagaaaaaaaaggttgcaatacacatcctgtgcttctgtggggcacaactgttcactgtatgtctgtatctatagtttgtacaatcttatggaacctattacttttctattgtgttgaaaatgtgttggttgctatgcaggctgtttttccaattagcagaagttactcctctgttccttctgcaccacgactcaaattagtctcaaccccagatttgaagtcatttttctcagttgatgatgttaaactccctccatggttagatggaatgtaagcttgccagacttgcacatgaagattgtctctcattgcatatattatatgtcagcacaaaccacacatatttgccagtgtttttcttcttctgttacaacatttcaaagaagtaaagtaactgtcgctgatgtgtgcttcctttcttggcctgaattgtgaaggtgcatggctgagtatcttcctaacttggaagaaaatcttaaaatccaggtactatagctttaagttttgcatgtaactgttggtcttgactgcctgctctt

SEQ ID NO: 65216 - DNA, 578 bp, Oryza sativa
ttggtaataccatgccaacttgacaagcttcaacatctgcggatttggggtacggaggtgcagatgattgaatttcatgtttcctgtcttacgcgttttgggtatagaggggaggcaatctcaatcatgcttcatggttgcccaaaatcagtgaaggcaacaatcgtatttcttgaacttaatcaacttgaccatgtgttcactgtgcttccaagtgctttacctgtcaaggagcttagcttggatttacatatgtacgactatgacctaggacaggtttgtccctttgttccaaggaattcatcttttggtttgcctttttgtatatttgtttgcttgcttggtagactgccttaccatttgtttggttgtctttcaggttcatacattgacaagaccactgtggagattatgggtatcccatatctacacggcgatggtattcgaactgggtacaggatacctaatgtagatagaatatcttatctgtatctcgggtttgtttcttaacttgtgtatcaaggaaacaccctgagacttagtcggttacgactgtattttacctttatcttcatatt

SEQ ID NO: 65217 - DNA, 5446 bp, Oryza sativa
cctcaaaactgtggttctatgttatgcaacgagacttagtccttcatgataagatattaaggcctaatgaaaaattcttgaatcctgattcctacagcagtttaaccgttcaataatttgaagggagaataataataataaattaatgaatcctacatcttgactccataaaaattataagtattatcaattacatacggcaaaatacagaaattatcaagtgatacatacagaagtattttgagccaaattgatcaattgctggatagtagtttccatatgctcttttgaatgatcctgaggcgcaaaatctgtcgttaatctgcacatcagaattcacagcaacagcatagtgttaagtacaggaagtgctgatatgattgtaaatagcatcttaaatgaaaagcatacttctcagattcttacttgttgaaatagcgtcctaagttatgccatgttgggtctttacacaggttaccaaatcgaattacttctcttgaaaagatgtcaagttcatccctgtagaattccatcaaatccatgtcagccaatcgcattaacaacaaaaaaaaaaaggaacgataggacaacttccttcttgaaccaatcataccttttgtcaacataagcaatatacaatagttcactggaatttgaggagaccaatatttgcactccatctgaacgcaatatttcttccttcaattcctttatactcgtgtcggagcaagatctccacaaattggaagctttagctattgtgtttgcgacttcaaatgctaaaatacagactctattgcctcgatttgttcccccagagagaaatccactgccatgatttaaatttgtcatgctactcccgagggtatctaacacctcgacagcagcaatgctggctcttcctaaaagtgtacctgtttctggtacctgtcacaacttagtatgtcagagttaatatgaaaggaaaagactactcttatcttctaatgatatagtctccgcttttgctgccttcaatttccaatagaaagacaactagttatagcacaaacaaagcaaaaggaagagcgagagaaacgtattatcccctctaagaagaataatatcagatgtttcgtcgtaacaaagaacctaagaaagaaggtatatttatttgaactagcagtgcttttcctgtcaatcttattgcaaaattatgaaacaagccaatttgaagtgcaagcttttcgatgaaaacatagactcaatgaatgaaacgggtgaaatgaaacaaaatggggaggtcactcctctaaggctattccgtagtcctttcactttgggggagatggcctcctttcatttttctgatgatatatagacgatcacccctgatgcgcattggccagatcaaagtaggctgcgcattggtgtatttcttaacccgatactttagtaaccatctgtctatatctttttccatctccaggatgactgccgaatcactgggtgcctgaattataacactagtaacatgctgagagtacataaacaaagtcagcttctttccagttatacagtctgtactttgtctcacttattagctcctgcacatttagtgttttcttccaagtagaagctaagcagatcactcatgtctttgcaagaagaaaagtgaaggatgtaatttcccaaactccatggttggcatggaaaagtggtcagcaggaaggaacaaaagcagaagctcatggttgggtcgctggcttgaccagtccaagaagtagactcaggctgacagcaacgtgaacgttaaataagcacggcagttcttcacttatctgagcaaaaggacggaatcctcctcctataggacaatagtgcttacaatatgataaaccaagggccgccaagattgactctgctgcatcctacacggacttgatgaatttttgtgtgtgtaagctgttggttttcacttgctgtatgtattgttgtgtccctctctttcccctgatccgcttaaagaattcatgcaaagatgcagtgcagattccccacggtttgtgaaattctgcatcctcagaccactgccaatctagtttgatttgagttaatcaaagcggagactgaaatacgagagagcagcttcagatgaagtccccatggaagccttgacagcgaaaggcagctcaattaaagcttcacagtgatgctcagtttgacggcttctctgaatttctgaacacggcggcgagagaagaaacgcagcaaaaaataacatcaaatcaataatacccccaacttgtgattttgaggaattggacgtggaaggcggattgagatttcgaacccaaacaaagcgctccgtttgcggcaacgcgtgtttggtgcatcaagtcgtggagaattctcaccggctggctacctaactaagcagaaacaaatcgcgaagtagagagcagcacatgcagctgtccgatggaagttgcaggcaagcagggcggagagttgagctgaagcacatctcgatggatcgatggagctcgaaaattccaacacatgcagcacatgatgcatagaaaattacggtggtagtagtagtagagtaccttgtgggaggtgagtagcttgggcggcgggatggcgagctcgccggagtcgaagtcgccagggccgtagcgaccccggcgcgcctcgtaggcggcggcgagcggctgcaccgagcgcggcgcggcgtcgtcccgaaaccgcctggagcacacgcaccccatagctctagcttagacgtacaggtgctactagtagtatctcagcacgtatcagcctcgtcggcggagcagcaagcttaggtttcgcaggtggcggaggttggagtgagggagacgacggtggtggtggtgggaatggatcggatcggcgcgcgggattggaattggaagggaagagcaagaggaggaagagggggagggaaggaagaccgagagacgagtagtcgaggagactagttgtgttgtgtcgtcctgaccatgctgctggtgctcgtcttgttgcgttcgcatcctttgacttgttctctctcccgcgcccacgccacgctcacgtacgccacgcgcctccccctctctctctgcaaggcctattcggttctccacttctccaccacagtttaccggagaaactattttcatcatctcgttgtttacatgtaactttgttatggaaaaaataaaaaaaattaagaagatgtattaacatgtgatatatcactctacaaacatgtatgttcaaatttaacttctacatctcgcaacgaaaaaacaaacgaatttatttttttttgcgagatgtagaagttgcatgtttgtggagtgatatatcacatgttaatacatcttctcaatttctttcaaattttttcataaccatttgagtgatgtgcaaacaacaagaggatatcccctcgaggggtgaaaatccactccccagtttaccactgcgctaaaaattatggggctcttttgttctctaccttacttcctccgtcccataaaaaaccaacctagtaccggatgtaacatatcatatccagattcgtagtactagaatatgtcacatccggtcctagattcgtttttatgagacggagagagtatctaccaaattcttggcatgttttggtattaccaatttttttttgtaaggtagagatttattatacatgtttggattgctactaatatgttgccaaatgttgatgatacagagaagaagactctagattagtgccaaattgatcataggaatagccaaacaatttggcttcaatccaaacctatactattactattgaaggtaccaataaattggcagggcacattttggcatcaatccaaaatggtcatatatcagatttactccttcagtaaaaaaaagtctaacctaaaatatcaaattcgttgtaataggatatatcatatcctatcttaggttggattttttttaaggagaaagtatctacttactactactgtttttgttttatattataagttgatgttgaacttctttggatttaaccaaaattttaaaaatatagtaatatttttaattaaaataaacatagacatattatcaaaatgtatatttaatgttagatttgatgaagttaatatgatgttttagatgttactttttttttacaaacttgattagaaaaatcaaaacaacttgtaatatgaaaatgaatagggtaaattaagtcgattaatttcttgaccatcatttagaaacttcaaaatattaatagtaaccaatttttttgtttcaaaagcttaatatcggcctgtagcctagtggttacaagagcctcagtagcacctaaggtcctgggttcgactccccatgggagcgaattttccaggatttatcggcgttgtgctttcagtggtaggcgacgtacccgtcaacagctaggcgcctgtggtaacttcgtcaatctctccaggatttgccggcccagtccagcctagtctttgaagatgctcataggggtagggtttacttcgtcaatctctccaggatttgccggcccagtccggcccagtctttgaagatgctcataggggtagggtttgcgtgcgtgtgttcatagggcaaaaaaaagagcttaatatataatttgttctcatagaataaaaattctctaggagatatttttactactactgcatactccttccattcaaaattaaaagaatcaatttttttattataaatctacacatagtctatatttagatttgttgttgaaattattttttttttggatgaagggtgtactgttacagatacagcaagattaaaaagtcttgctgtgagtaatactgttgctgaatgtttttcctctgttattattaatttatattattattgtcgatggtaggattagaccacgtatgctaaattgctgggtttagtctccgaacgaaatggtagttatgtgtgcatagttgaaaattggatttggcttcttcaaaaccgaaacacgcttaattttgaccttaatgcaggtaccgtcaatggaaaaaccgcacgtgtcctttgatcacaaacaaaagtcattgttctcctactataaataggactgcatatgcttgtcagatgcgtaaagtatatactatcggtttagctttctaaaatctcattaatactatgatattatcattgttattactttccctgtttcacaatgtaagtcattttagcattttccatattcatcttaatgttttttttagaaatcatcttgatgttaataaatctatataaatatatataatgtgaaaaatactaaaatgactcacattgtgaaacggaggaagtattattttaaccatcaacccaacagtactctctcatcttctggtttactcttcctcataaatttttctccccatattaatga

SEQ ID NO: 65218 - DNA, 716 bp, Oryza sativa
ttccattcagttattggtggctatatcatatgacagagggagtagaacagtaaattgatacggatgaagtagctggtaagcacgtataggagtaactaattgcaatcaaagcgtttgtgcttaccaaccagtattaggctctgtttatttcagcttaggattattataatctagattactgagtcagattactataagctagattgttataatctgtagtagaataagcggttaattgtttctttcctacattattagagcctaaattattgggtttgcaagtctaaagagggagtgggtggcatggtgggtaatttttcacccaataatctggaaaaagctcacctaaatgagcttattagattataataagctgtgctccagattataataagctactttaataagttgtatgtttctttcagcttactcccaataatctggattataataatctcaagctgaaagaaacattgccttagaagccattatattattcagcacatattagaaatcgatcatgacaagtgaatatatatttgaaccagctcggtcagtgtcattagtcgcacggcaaacggaagtttaaacgaacagagattataactagctaggtctaggtgggcacagggacgatgttcttaattaggtcattaggtgaatcatctcaagaagttaagttaagtctgtttatttaatccggtcgggctgcagga

SEQ ID NO: 65219 - DNA, 12963 bp, Oryza sativa
  unsure (1)..(12963): unsure at all n locations
tgcgacgatatgctaacacctctctaattaaaaaagtttctgtaggtgctgaccttttcaattcagagcaagctcaaaacaaaagactaggttcctgcggtctagccttacattatgcgaacataatcaatcaaattgaaaatattgtaagttgttttgacttttgatgatccatacccatgtttttcatcccttctggatgtaccactttcaccgtctacacgtttgctatatctgatcttaagactcagtgctctcataatctactgtgtctgctggatatgccccacttccatagctcacatgcttgctatatataatcttaatattcagcatttgcataaagttttgattatgttgatgaatcattcatttattcattttccttaagttaactacaacagtcagttgtaatgaatattttatgtttggtcagtataaagtatctattagtttcttagctactgagtactagttccaacaccatagtgcataggttgtattaccaaagtctagatgtttaatccttaatctccactacagctgatacttgattgattatagagtcaaagttctcaaaacaatgtgtaattatgcaggtttctagaccactctctcttcctcctagtgctagggacaatctgtatcatggtctgccagtaacagtgaagtcagctctcagatcgcgattgcaatcagttaatgcccaagaagaggtttgtgttctctgcagccctgtggtggtaaaacggttcatttcctatattctttatgcacatggaagcagtagtagtatttagatatgactagctcaacactaataagatcttgttacatgctagtttccataagcatattttgctcctgaaaaaggtgaaagtaaaatagtccatgtagattgaaatcttaatatgataataattctgtatatatcatgttaacaaagttgaggactttatatttccagttgtctccaaagcccgcaaactgataaatgtatgctgttttcattatgtgcagcgtactgtagctcaaattaaagctgaaatgcagaaaactcttcgctggattctaccgattgctgaaaatacaataaggtgggcggaacttgttgcaaagtcctactgacttctgagcttagggttattttctccctaaaattcattcctttgtgttttcatacttttaccagagcacatcaaggttttggatgggtcggcgaatgggcaaaccttgggttagtatcaaatcgtgatttgcttatcatataccttggaatttccattgataatataacatgagataaaatagtaacaagtattgctccttgcaacataacctaacatactgctattttctagttgcgaaatgaacaagaaatcaggctcccagctcagtatcacccgtgtccagactcttcattacgccgataaggcaaagacggagcaatacatgctcgatctggtggtgctgctccaccatttagttgtccaggtgaagaacagaggctatgggagcaagtcctcaaagcacgaccagtcccgatcccgcaagggaatggatcttcaacctgaatccaagctcaacacatctccagtgaacaacgccacatatccgagcccgttgtcggagtccgaacgcgagacgctggaccacctgagcttcaagaggacgggctacggtaggagcaagagctgcgagcctccacccaatagagggaagaaggcacatcgaacctgggattcatgccggagccatggcagctcgccggcgagggaattcggtaggaactcagcttcagagcttgacaagacgatggacctggatgtaatagatgggttagatagactgacttcttaccacccaacatcccccacattttgttaggtatatgctgcacaaaaataggtattcttttggtgttcctacggttgattgatcgtatatatatcttgtaaatgtgtgtgatctacctatatattctcttacatgtacatatatacatagcttagtagtacagccctgagtttgagtggaaatatagcaagatcacaagtgatgctctatgcctcgttcccatctctccttttgccttacaatttgtgcaatgtaaaggggaagtttcagcacaaaattctacatcatagtgttacttttttttttgaacgactcgcatgagacggtgcgaagttctattgatagagcaggaaaaaattacaagattacaaccgtggagggttgtaaccaggaacaagaaaaagaaaaccatcacccacacaccgacagcgccaacacacaagtccggaagaagactatcaccggaccggccgccgctagaccaacaaaaggaacacagacgagatcgcccccgaggggatgccaaaacgacgtcttcaagaagagaagcgacggaaaaaccgccgccgccgtccgtcggggctcaaaggagccaagactgggcttacgcccagcaagcacccttgaggggtgagacagcacgacaacgccctcaggagggggaacatcgatgtcggtccggtcaaggccgggctaggttttcacccgctgctcaccacctgcgaatccacgactgacgctccgatgctccaccaccgctcaagctctgccgacatgtgggacccctgcaccggcggcccccacccgctagccttcgtgcgtcgaagaccgcgccacacccaccggcagctcctcctcgcaccgaggtcgcctcctccaccgccggccgcgcctctcgcgccaagccggcctcctccaccggacgcgcctctcgcgccagtccggcctccctccatcggccgcgcctctcgcgccaagccggcctccatctccgccgcccgcgccgagccggcctccgctgccatcggctgcgcctctctaagccaagccgatctccgacccctcctatagtgttacttatcaaactcctgtttgggggagcttcttgttagggttctctctaggatcacctaggtttagatctagtcgggtagtactcttgggtggatgaacaacattatagagatgaaacgagagggtttagagaccgaccggttgaggtgttggaggatgaagaggtgccggacatcatcgttgttgtcgcgtgctagacgtgggcggcagcaacggtgtgctcgatggtgatggcggtcgtggcagtggcggtcgtagtcgatgacgagacgtggtacagcggtgagacttcccgtcactggctacgccccctctcgatcggttagggtttgcgggtggagatggcggcggcagcgaacctcgtgtcgtgtcgccccggcctccatccctctttatatggcgcaggatgacgggggcccaccagccattgggctgggcgcccccgatcagggcgcaggtgaaggccaccttgagccgttgggttagggagggagatccatctaacacttctggcagctgcagcttctcatagaatctccagttaccagaagctcccccaaacagtccagctttttacccagattcttagaatatgtagttgtagaatctggaaaatgaactagaagccaaaagctaggttttccaacttcttcagattctcaccagctagcttctcaacaattgtttctcaggatattaagctccaccaaacaggccgaactttgtagcagctggcctcccatcgtttatcttttagattactccaactaaaatttaaattaaacttagttttaagttgattctaagggttttttttaatcttagtttattttttacagtgacttttagatcgataaaaacaaacataaaagttttactcataaactattttcagttgtttcgtataaatcttttttacggcttaataatagctgtagagcaaacaaaagagaaacgatgaagcagacaactgagaagaggtcttggccacaaattgcagccgggtccaacaagtttatccagcaagattatctttctccagtctctcagcaatcttatccagatgcagatatagcagcagcatttctcgcacaagctcattccggcgatgtccatgtccaccacccacctgtacgcggcgagagagacccgaccaccgcctcctccgccgctcgccgtcgccgtcgccgtcgccgtcgacccgcccgccgaattaattaatacggccacagcccacaggtttagtaccccgtttggatttctcctttccaagagaccaatatgccaaagccgtaagatgaatagtgtcctagagttgttctagaggaaaaggataattgacagcaacttttctccaacctggcccttgtcgattgatccccatgctgtatatgatgatgatgatacatctatgtcaattgggttctagaatgaaaatattgtatgtgaatcttgtcggtgcagatgccagccttctagaatctaagatacactaatgggattgtacaaggtcaggcatgtgcatgcatagtgcataaccccagacagctctaaacaagttataatacattaacatgcagcatatcctataggggttctatatttctctaaataagataatagcagtacatctgttctaaaatatacaagtaacttttagctatgaattttttaatggaggtatagctatgcaagcatatataaacaagaaaaatggtccctatgtccaaatagaaaaaaatgtaaaattaatctagaaaaaatgtcatgtctttgtcatcacaagcataactttcaaccgattagtgggcgaaaagcactggatccagataaccacaaagaagaagaaaatcaccctcccccaaaatcattccaaaaacatcaccttctccagcaatgatctgatccaccacagcacattggcctctcatgagatcagctggcctctgcgaaaattactgggaaaaactatgaggctacgatcctgaccgtcgatttcggatcggacggatggatcaccatggataccattcaccgtggaagaaggaaggttggtctccaccatggcgccaaactgtgaaagcaacagccatggagaaggagaaaaggacatgcacatactactctctgactcagcaaacaatcacataatcctctaagaaaataaaaaaaatgatttcttctagagataagatcaagaactcaacgtccaagtggcaccactaaaattcctcaccccctaaactccctataaataattcacctttcttttcttttctgatctcatcgactcgacgacgacgacgcattccgaattattcaagaaattcaagaagtgaacagaggaggaaaggaaacatggcttcgtttgcatccacggcggcgccttggggatgcgtcgccggagctcggcgtggcggcggcggcggcgggcggtgtggggtgcgcgcgtccgcggcgctggcggtggcggcgccggcggcgaggacgcactacgaggtgctcggggtcggggcgggcgcgagcaggggggagatcaaggcggcgtaccggcgtctggcgagggaggtgcacccggacgccggcgccacgggggacgaggacttcatacggctccacgccgcgtacgccacgctcgccgaccccgacgagcgcgcgcggtacgaccgcgccatggccggcccggcggcgtcggcgttccggcgggcgcccgcgtcgtcgttccggcggcggacgtgggagacggaccagtgctggtagggcagaagcacaactccggtgctccctgccctactgcgccgcgctctccgccgccggagctccgtcgggcacggcggtttgccggcgagtgacgtgggattctgtcggccgtcggatccatcatagaaggcccagatcgaagaggaaaagaggaagcggagcgagatatttgcagaggagccctccatttaccatctattgtcaacaaggtcctcccgcgaccatctcggccgttcgatcgacttgtgcggcgcagattgagccaaaaagagaggcgcagtgcggatgttttcctatgggaccctcaagtattcggtattatcaagcatacccccatcccgccgccggcggcggcggcggcggagcaaagtgttgccgcgccggcgagtactgcggtgatcgccggcgtttcgtggggataacaccgctaatgcatggttcttctcctgcaatcctgtgtatatgctgtaacacgaagagaggcaattttagagaactcttttgtgtgctgattagcttgtttatataataggttttagctctgtctctctcaactgtaaatgatcaagaaactattgtttcttctctttccttttcaaatcatcatcgttgagtactaatttgaagaacactcgaatgtgtatctttggtgattcaagttttttaatttttgcagttacctgaataagcatttctagtttttgcatcacttctagtgtcagagacaggatacgctgtccattctgcactctgaataagataaaatatagacatgacctagtttccaaaaaattaaaaaaaacatgacttgaactgaactgctgaagaagaagcagtatacgcctactacttaacagagtgaccagattataaaaagggattttgttcacttgaaatcatctttaggatcaaaagaattgtgtaaagaacacctgcaaattgcgattaactgggaggacaatttttcctgtgaaccataagatgggataaatgcatcccaatacaaccattttgtgatgattctgctagtgctatccacagatgatgtctgttagcacagaacagaaggcgatgcagtctcgggcttgtttgggaggcctacaattcggcccaccaggattcaggccttagcatgaatttctttcatgacaccaaattgaaatctcttgcaccaaatttttcggtttcattcgccagcagtagccgttgccatgccaagatacaggacagcatcacaacgcatcatcgcagcaagtcagaaacagccaatcacatgatgccacgtgcatatagatcgatcgggttcagagtttcttttttaattcagaccatatgcatgctattattctgagttctgaacaatattattctgcagtacaacaaacatgatagtacttgaaatcatcttgaattatataagcccagttgtttatagctactgtatatacactatacagctagctactatacagatataggtgaggtctgatgaacggctcacctcacatatacagatcataagttttttttgacgcaacagatcataagtcaaaacagaatagcattgacatctccatctctgacagagcacaactactgctcgcgtataaacgatcgagtatacaacaatttttgctgctcacctactcgcaactaaacctttcttgtactatctgtttaatgtcttaacctctctgattctctgattgattctgcaacgcatcacacgcatgttgactctttaatttctttatacaacaacttgtaggtttctcggaaggacccatccattcatttgacgaactattttccttagaaaaatgatataaaatagtgaagcccagtagaagctagcttggttatctagctgatcatgacatgaacaatcaaaatttttgcatttgatttgttcactatctcctctctgtctcttctcatccatgggagcacttctccattttctctccctactactcttcctctccttgctccaaggtaagcttagctcaaaaacaaaatcatcaagcatatgcacatttgtaatttaattcagtggacgacgcagctatctgtttttaagcttaattgttcacatgatttgcttgtaatttctctaattcagtgctcgaaatgttgtttgattaagcaagaaatcactgatcaagatgaactcaattgtgatcaatatattaccaggagcacaggctgcgacgttcaccataagcaaccggtgcggctacacggtgtggccgggcatcctctccaacgccggcgtcgcgccgccgtccaccaccggcttcgccctctccccgggccagacgctcgccgtctccgtcgccgccgcctggtccggccgcatctggggccgcacgctctgcggccaggactcctccggcaagttcacctgcgccaccggcgactgcggctcgggcgccgtcgagtgctccggccgcggagccgccccgccggccacgctggcggagttcactctcgccggcggcagcggcggcggcggcggcgatgacttctacgacgtcagcctcgtggacgggtacaacctgccgatgcttgtggcgccgtcgacgccgccgccggcgagcggcggcgcggcgagtaataacgggagcagctgccaggtgacggggtgcgtgatggacctgaacaagtcgtgcccggcggagctgcaggtggtggcggcgtcggcggcgaggagagcggtggcggcgtgcaagagcgcgtgcgaggcgttcgggacggcggagtactgctgcagcggcgcgcacgggtcgccggcgacgtgcgcggcgacggcgtactcgaggttcttcaagggcgcgtgcccgcgagcctacagctacgcgtacgacgacgcgacgtcgacgttcacctgcgcggccgccggcggcggctacgacgtcgtcttctgccccggcatgtccaggtaaattgatcacaaaatatttctgcacgcacgtcttggcatgcatgcatgcgtgctttttttttttcaatttcacattggccctatacaatggcacgtcgtgtacatgtgcatgccatttggcatagcctagacggtccacaccctctatcataatggcactaccactacagacactgacgtgtaagataatagtagggtgagacccatatatcagtgttgtcattggcagtgatattatggtagaggatcctcaccaagcttttgaccagattgacttcggcgtctcgtttctaggcttgtttctttttctttcttttcgattacacggaaatcgtatacgtgcacgcaccacttctatgaatgcgccatctaacacgtacatgagattagaggtgggagacctctcggttctgactctaataactataaaattgatgtctttatccactgataaaaatttgctggctatattttttgtctgcttttctaattttaatcaaagaaacacgctttgggtattagaaaaaaattgttcgtctgtgtcttcggttagttggcattggtaataagttttagtttctgtgactccacaggaactcgaatgacaaatcacaacctgaaaatgatcagatatttaatcaagccttgattaactttttctcgagattacataatttggatgacatagacgcctagggtcgtgacaaaaattttaaaccaaataaggttcaatcgggacattgcgtccatcttaaccgtgttgttcctgattggttttgcagcacaagttgctgatataattttttagttcaatcattttggtgcatcgatcacttgaacgtgacagccagtgctggcatgcaccacgcatcacttgaacaagtttagtatgaacaaaacagagtgtctctctctgtctctgtgggaaagaaaacttgggcgtcgtctgcagaattggctagtttatatatcgtttttggctacaagaatggcgccaaattttttttttctgtttacaattaatttttagaaagtttctgtttacaattatggttaattaatataaaactaagtacatttttatttgctaatgttgcgatgattgcaacctgatgcagcctaaaatctggtggaaatcctgaggcagtaggcttgccacctacctactcaacaatggcgttcactggaaatgcagagagcttgacgatgagcaggaattcgcttgtgatcctcctgatgatcatcagctcagtgatatcgacgctatcttggtgatgtcaattcaaacattgtatttgcgtgatgtatcccattcatgattatagatttagcagcatatttttgccagtttttcttggaggaaaacttcattctttcagagcaggcagcaggttcatccactgctaaaactataatgcacaatgcttcaagattcgcaaatatataaaacatactgtttctgaaaatgcggatccagatcaaactatttctgaaaatgttcacaaatttcaaaaactaaagcaaattacattgtaaaatactgggcgagcttcttcttcttgacctgtacttgtttaccgaagcacgctgacgtccggcgtgcccactttctgatcttcttgtcttcagcaatgtcggaaaaatcacagtgatcatcatcagccaatattgtgtggggttcaatggacataaactccagggcaacggcattctcaaggatgaaatagaccagctcctcctgaggacggtaacaccgaaacccgctcatgtagaccgtcttgaggtgatcatggcggctcaagcgatagtcctcccttgctaccttggtcttgcgaacccgacatttgtacttcttgtaataatacatctgcataattgtaaactctaagcacaaaaacatgaaagctctagctgtttaatctatgcatcacacgaaaaatactacctaacagtatctaacgcatcaaaagccacacatttaccaaaagaatttccatttagttggattcttgtttttatccctctaacaaacaatgaaagcttgatctaattcccactggttctagtgcaatgaaggaaaagaacgacagaaaaacacaattcaattttgtttttcttcaaacattgattattataggtttaaaaaacatttagtatatcatagatagattgaatgcaattgaaaccgcgctaaaaattttaacaggtgtacataatctcaaatgaaaatgagtgaaggcaaaggaattatagcgcacttaatatgactgggtaaaatggatcaatactcacatgccattctagcacctccagtagaggagtgaattccaagtagtgcgccaattgaacaactcccttacaagtattcggagcactagttaagacatatacctcacacttcagatgcctcanatgcataaacatgttgcgtggttgtcgaaactagatttcgacaataataaaagggggtggctatcaagcttggaaagtgtatgggtttggagacaaaggatttatacaggttcaggccttcttataaaagaagtaataccctactcctgtccggggatgaatccgccgagtgtattattgattgtatgattcgggaaaaatcagcatatgcccctagaggcgcccggaccccccttatatcttggaaggagtccggattacaaaagataatctatattcctaacggaatatgaagataaaggtaaaatacagtcgtaaccgactaagtctcagggtgtttccttgatacacaagttaagaaacaaacccgagatacagataagatattctatctacattaggtatcctgtacccagttcgaataccatcgccgtgtagatatgggatacccataatctccacagtagcccccgagtcctttgcagtcgaccatcgtaaccctctcaaagatgataatccgagtacttcaaactcttcaagccaaaatctgccgagtggactgtaaagggcgaaaagataaagaatatggtgcatcgaatagatgcacctaattaggtgtagcccccaactatgtgattagttaacaaactaaacatatagttgaaagacaaaataataacactattgtgcattacatgacaaaagcgtacgcggcgcctaaataggcatgctagccgactgctttttagccacaataaaagaaatccgagtggtttacactctaaaaggttcacgaatgaactcacttgacaggcatccgaataaaaaaactctaaagatacccatcaagtaccataaagattatggtaataaataagtcaaatagcctaggccatgactatttaccatgaaaactggcatataacacgccaaggaaatgactataataaaaacaagtcattcctagttaacccaaacagcttttgtagcctaaaaaagcttgcaaaaacagcataacgcctttctgtcggacacctttttaacttgcattgcaataattccaaagaattatatgaccgcataaaaaggatttcatcagcattgggcaacactgttgtgtgcataatattgccaaagcaaaatatgcctaagtccctaaggaacacaatgggccacgctgttaaaagtattgggctgaagtattgttcaggcctaggcccattagcacctccgatacccttaactgaaaaatccgatatccaagcggcgcttcgtcttccccgccggaactctcgccattttccccactccctgctacagtgcaaagctgcgccggcgaactagggttcacaactccggccaaatccacctccgaaaagtgcatcaaaatccttctcgtgatccaccgcctcaatccctcacctctcccaagccatccctcgaatcaaatcagcacatttgagtgaaaccgatggcggaagagagagaaagcttcgaaggccaatgggcgtcgtccgacgtaacggaggaggatcttaaggagatggtggcgcacggcgttctccctgccaaggagatcatcgggtggcgaccagcgcacggtgaggctttcccgtctccggatactcatgagattgtggtcttctcgcatttcttctacggcggctttgctcttccgacctcaaaatttttccgcgggatcttgaatttctatggaatcagcttgcatcacctaaacccgaattccatagtgcatatcgccaatttcgtccatgcttgtgaagcctttttggggatcaaacctcactttgccctattccgccggatcttcttcctcaagccccaaccaaacaagaacaaaccgtgtgtagtcgggggggcaggattccaactaaggggaactctgagccaaaaat

SEQ ID NO: 65220 - DNA, 1708 bp, Oryza sativa
acgttcccaacatatctcatagtgcaggcatttagcacggcactgtctatcactcccggttgtaaacttaactaggatgggagaatgatcagaacatggcgaagtcagatggaccacctgtgcattggtaaaaatatccctccaactttcatctgccaaagctctatccagccgaacctttacattggctgaaccttgtcgcttattatcatacgtatgaggtacccctgaaaaacccaagtctaccagctgacaagtctgtaacacatctctaaacgcctgcatttgggcattactccttttcctaacagaagtatgctcaaattgccatagagcttcattaaaatcccctacgacaagccacggcagagaggaagtctgtttaagagcatttagatgagcctacatcctgcatcgattttccactcgtggttcaccgtacacaaaagtcacatgccacaaaggaccatccgaggacagacgcacatacgcatcaataaatctttcattaatagaaattatttccatgtggatagattcatgccaaaacaaagcaagacccccgctcatcccctcatagttaacccccacaaaacccttgaggcccaatcttgatcgcagacgtttaactctatcgaccttttgtcttgtctcactgagaaacacgatatgggaacccgcctccttaaccaaggcgcaaaggtcatgaactgacgcagcgttcccgataccgcgacagttccaagccatgcaattcattgctcctgacgggacccgaccatcggtcccgtcagttgaccagcggccccagggctggttgcctcattctccttcccggttactaccccttcagtcttcctggctctcttcagtgcccgtgaagaaacgcccgattcaaacacagatttgctgctttcttccaccatttgttgatattccagcagagcttgcatgactctccctgacttctttgttgcaccctgtgtttgaggttccctcctgtcctctccactgcaatcttcagacaattcatcaccgtaggaagcttgctgacttatagtcttaatagccggtatcatctcacaagaaggtaatgaagttgtatcttccacaccatccaaccgaatctcaggtccacgtttatggcttgctccctctcttcctgggagagaaaccttctgtacttctgtctcccccaccttcattttctctgcatagcccgccaactgttcatcaatctgtgtgtccccttccttctttgcagactcaaaaccatcatgagcgtccactcttggtggaaccaagtcctccccctgatctccttgtttctgtcgtgaggacaatgaacttgcactccctgcccccctgaagaacaggttacgcaccacccctgaagatgatggtactttcaccttactcaccttcctctcaaagggttttagaggggagcatcttaactctgccgaaaacttgaagggctggtcattgttgactcctttcctattgcactccttgtcagagtgtcccagatatccacatatgaaacaaaaatgcggcaccctttcataccaaagatcaaaacgctttgtgacctctttgccctgtgctaacatctttatagccaacttcgactttaacggacgcttgacagataagtccacacgaatcctaaagaaatcatgtttgttccgcccatcgtcacccacat

SEQ ID NO: 65221 - DNA, 17281 bp, Oryza sativa
  unsure (1)..(17281): unsure at all n locations
aaggtcaaaggggttgtgctttacttgtggagaaaaatggagcaaggatcataaatgttctacttctgtgcaattgcatgtggttcaggagttagtgtcacttctacaagatgaaagtaacagcagtgaacaggtggaagtacaggatgaaaaggaggatttaatagccatggccatctcacagcatgctgctagtggaactgaagctgctcattccattaggctgagaggatggattcaagaaactgagttgttaatgttgattgactctggcagtaccaactcttttattgatgaacaagtggcaatgaaattgaaaggagtggaggtattgaaacagcctctgaaggtgcagatagctgatggaggacagctattatgttctaaaattattccaggatgcacttggtacatgcagggccaaagttttaagaatgatttcaaattaattccattgggaagttatgatatcatcttgggcatggactggcttgagcaacatagtcctatgcaagtggattgggttgagaagtggatagaatttcaatatcagaatagagctgtgaggttgcagggtatctctagcagtaatccttcttgttctttgatttctgtaccacagttggtggggatggcaaagtctggtgctattatgtacatgataaaaattgatgaggttgtgaacctttggaaaaaaaaggggggggaanaaccagaaatttcccagcttccntatccagcaagtaattcaacagtttcaggaagtttttgctgaacctaagggtctgctgcccagaaggaattgtgaccataagattccattggttgaaggggcacaaccagtgaatttgagaccttataggtacaatccagaattgaaaaatgaaattgaaaagcaagtttctgaaatgcttgattcaggggtaatacaacctagccaaagtgcttggtcttcacctgctctcctagtcagaaagaaggatgggacatggagactgtgtgtagactatagacatttaaatgcattgaccatcaagagtaagtaccctgtacccatcatagaagagcttctggatgaactgtccggctccaagtggttctccaaactagatctgagggcaggatatcactagattagaatgtcacctggggaggaacataagactgcctttcaaacccattatggacactttgaatataaggtcatgtcctttggtttaacaggagcaccagctacatttcaagctgccatgaacaagaccctggctccagtgttgagaaggtgtgcactagtattctttgatgacatacttatatacagtccagatttaacttctcatattaatcatgtcacacaagttttacaactgcttaaacaagatcattggcaagttaaactctcaaagtgttctttcgcacaacagcaagtgtcttatttgagacatgtgattggtgttcatggtgtagccactgaaccgaagaagatacaagatgtgattaattgggctgttccaactactgtcaagaaacttaggggttttcttggtttagctgggtactatagaaaatttgtgaagaattttggtgtcttgtgcaaacctttaactcagttattaaggaagggagttccatacaaatggactgaagaaactcagcaggccttccaacagataaaacaggccttggtaacagcaccagttctggctctaccagatttttctaaaccctttactgttgaaacagatgctagtgactatggcattggagcagtactttccgaagataatcatcctatcgcttacttaagcaaggctttgggtccacgctctagaggcttatcaacttatgagaaagaatgcatgacagtgttactagctgtggaaagatggagaccttatttgcagcaacaggaattcatcatcctgactgaccaccacagtcttgttcatttgtctgaccaaaggcttcatacaccctggcagcaaagagcatttaccaagttactaagcctacggtataagatttcttatagaaagggtagcactaattcagctgcagatgcactgtctagaaaggaaaacttattggaggatcaggtgatggctatatcagttggggtgccactatggttgcaggaagtaacagaaggctatgataaagatgcacatgcctctcagttagtcactgaattgtctcttcacccccaagccaaaaaaaactacttttttcagaatggtctaataaggtacaagggaagggtgtgggtaggagacaacccttcttacagcacaaactgatctctgaaatgcatgataatcccataggtggccattctgggtttcctgtaacttacagaaaattgaaacgtttgttcgcttggaaaggaatgaagaaacaagtgcaacatcaacttaaacaatgccaagtatgtctgcaggctaagccagagagactgaagtatccagggctgttgcagccgttaccagtgcctgaaggggcttggcaggtgttatctcttgattttattaaaggtttaccaaagtcagagagattcaattgcattcttgtggtggttgacaaattttctaagtttgctcatttcattcctttagcacaccctttcactacggcaacagtagcataagctttcatgagaaatgtatatcgtttacatggcatgccaaaggtaatcatctctgatcgtgacagaattttcactagtcagttctgggagtgtttattcactatggcgggtatcaagttacatatgagttcttcatatcacccgcaatctgatggacaaaccgaaagggttaatcaatgcttggaaattttcttacgttgttttattcatgccactcctcgcaaatgggctgcatggctgtacttggcagagttttggtactattcgtcttatcagtcgactgtgcacaaaacaccctttgaagtggtctatggttatcaacctagtcattttggtataagtatggaagattgtgtagttccggatctagctgaatggctctctgacagaaaattcatgcaccatttgattcaacaacatctgcatcgtgctcagcaacagatgaaattctatgctgacaaaaaccgcagttttagggagtttcagttacaaaactgggtttatctcaaagtgcagccttatgtgaaatcctctgttgccaaacgtgctaatcacaagctctcgttcagatattatggtccctttcaaattttgcaaaaagtgggtagtgtggcttataaattggatttgcctcctgattgtttgatccatccagtggtgcatgtatcgcagctccgagctgctactggattcagcccgccagttcagcaagctttgccatctcctttggacaagttgcaagttcctgaatagttcctggatcactgtattgccaagaaaggtaacactgttatttctcagctattgaccaagtggacaggtggtgcgattgaggatgccacttgggaagatgaggaggacttgcagactcgttttcctcgtgcaccggcttgggggcgagccggttttcaaggaagggagattgtcaggtctactgatgataacctgactcaggagaggctggacatcggcaagcaggagctagggaacatcgacaacgagctggaaggtgtacaggatggaggcgcactgaaggaaggcgttggctcacaaggaaagcgtgttcgtattgctaatagaaagtatgtgggctctgaatgggccgtgtaatgcgtgagttgtaatgggcttgcccagctgagaggggttggtgaggagagagagaaaacggtatatgagacactgttgcgtgttcgaacggcatcgaactggaacttggaggcgatggcggcggaggctccgatcctgttggatcgagagagttactaaagttccagataatttcgtgtgtgatcttgattggtgcttgctgtgagttagggttctaacaaaaccctagcctagccttgcaaggataaggagcagacgtgaagtcgtgaactcgtcgtgccttggcggcggcggcggcggcggctgaggcctcctccacctccttcctagacgagccttctccttcctcctctccaaattgcaccttcgtcttcctcctctactagaaagaagcagcgccttgtcctccgatcctcaacgcccgccgccgcttcaaaccaccaccatcactccggatgccaccgcccctccctgatcgctggggtatctctgggcaaggagctcgctcggcgaagttctcactgctccggtctctctatcggagcctcgtcgcggtcacatcctgatttttgtttcaggatttataaattatttaataaattattatttgaatttatattaaatgttcattaatttacaagtgaagttaaaggtgggaaataaaacttcctaaatataaagcatggatggatttattttttattaaattctccatggttaattatactctcttgaatattctcggatttttcggagctcaattcctaatttttaatcatacaaagagcatttcagtaattacccacatattaaattaatcattaaatggtctaattataattttgttaagtactttgagtgtccaagtattttcaggatttttcttgaaattatttgagcattggaagtatttttaacaattcaaagatcatttaagtgattattttaattggaaaaggttctaaaagtcctcttttggctttgggccgaaaatcggcccaaaaccttccctctctctcctcttcggcccagtcagcccgcagccgcccgcgcgcgcgctcggccactgacaggtgggtcccacctgtcaggcctgtcgtcgtcctcctcgcgccgtcgcccggccggaaccctagccgagctgcgccgccgtctccttccaaattcgctcgcgcctttccttctccggtgaaatctatagaggggaaatgatcttcaggatctcctctaccttttctcttttggaatcatgggctaaaatcgtttggaaatccgtggattcgagttcgattcggatcgatctctctcctccgaaccctagactttccttcgcgttgccggtcgccgtgggccttcgccgccgcctccttgcccctataaaaggacccccaagcccgccgctacccgctgccaccctcgctttcgcctctcgtcgccggtagagccctagcaccgtgtagcctcgcgccgccgtcgtcgccgccgctccagccgtgcgtcgccgttgctccagtcgtcgccgtcgttcgggaaggccgccgtcgtggtcgccgtcgcgtcgccgtcctcgtccgcccctccatcgttgctgtagaccgccagagcaccgccgtcgtcgtcaagccgatcttctccgccgccttttcctcgacgccgtctccgtccgttgatcttccgccgccgttttggtcaccggtgagttcgccgcgtcgctctctacgtgctggtgccctccgtttgtgccgtcgcgccgtcgttcgccgacgagcttgcgcgcccgagccgccgccggtggtgacgtcaccgctgacgttatcgtcgtcgtctctcgtggtccggccgtggaccggtcgatctcggctgtccgttttggatggaaagatctcggccgttcgtttctgtgagccgccaccgtgcacccggtccactgcaaaccctagccgctgacgcaataaacccctttttccttttcaaaaaaaattcattattgcgtcataattcaattaaaacccatataattgatttaatccgatttaatctttgaaaattcataactaattcatcttagctcggatttagttggttcaagtctctaaatttttctaaaattgagatctacatgttaaaaatatccacatgtacttttcatgcttatttatgtgctgttttggtgtttttgctcttttctgtttagattccgacgtttcaggagagtccgttttcgcaggagaagaatttgagtagttccaaggccagcaaggcaagtcacacagatcctaaacacaatcctttgagcatgttgatcctatatttaaattctctatttatttcaactgtgcatttattttcgaatgtcactgggtggtgtgaatctattcctttgttatggcatgtttgcattgattactttattccttgataccttgggttattataacttgactagttgagctttatatattggttcagctagatattagatatgattgcttagccatgcttagaaacattaacacactattgggataacttatgactcactattatttaatgatggcttaatgatagttcacgatggtcaatcgtgattggttaattaattacttgccaactaaaacttgataatggtgggttgtgagcacatggttttgagagtcgtgctcatgacaattaaggaccggttcacgagtttcggttgtgaaacattaaccgtgccaaccacaagccagcgtgggcaacggctttaccttttgtatagcatggttcattgcggagcaccagactgagaagtggcggagataagcccacgggggtcgctggggagtccatgccttgtttataagggggtgattatgatccaggaaaggtgcgctgtggtggattgtgttgtgcgaggggtactgtcacagctcctttccgaggtaccatggtggtattgaggcacatggtgacatgttgtggggctgtgtcttgtgggtacagtggtacacctctggccagagtaaaactattcgaatagccgtgcccgcggttaagggcgggtctaacaatgtctttcgtgattagtctcacacttctcatcataataaaagatgctataactggtaataatttgattagctcctggtttggaatggtatattcctggtttggagatagaactgtgcagccgggatggttgttcaaaatggttgggcctatgcaacagggtatgttgtatagcgttggattaatattgtttatttattacttaactgttttattaaattctgaaatgtttattaaatgttgtttatgcaaatgaaaccctactatgccatcctttgttatcctgtgcacttgcatatttgctgcgtggcttgctgagtatgtcatatactcaccttgcaatcattcatcagaggaggagttctacagtgatgctgatggtgtggaggattaggtgtagccctggtcaagctgcctgtggagtggagtcgtctgtgccgtttatcttattttttccgctgcttagatttttattgattgagaggaactatctacctctgtaatgacattttattcgcttattaattagagtaataattgtactctattaccaatttgttattgtgtgcctcggctgatttctggacaagggttcacacacatgtaagtgtttggaattttggatagaaattccgggcgtgacagtcgcctacggagacaagtaaagctccaactcagtcaatgattgttgattttgattcatggtgagggattaaatatatccatgcgttttgctgtggggaaaaagcttggattttgggggcacttcaggcagatgcgcggttccatgtttaatttcacaagtatttgcagggtcccagctccacttgtaagtgtttttggtgttcatgctaggtttgggcttccttggtaaatctgctgaatacctcgcgagggacaaagacaggatctgtccagttctttttttttacttgtgcaagacagaagattatgtaatccctattacaaaacggaaaggattccaaatacacaaactacttctgcgtaataacaatatttatccagtcaaggttcggagtcctgtgtcaaagtcggtgttggtacatatgataattactattatatctgtcttctgtatagactagatccgtgatgttctgttttgtggttgtggcctcctttgtagcagcagcttatggagaacacgatggcggccaagcggagctggatggagcaccatcgtgtgctcagcgacgactcctcctttcacatggaagacctcccggaggtaaaaaaaaaaaaaaaaaactacttttccttgatctttcgtcacctcctaatttggtttggttgggagccggacagcactgggctgttgttggcctgcagctgccttctcactcccactcactgaatgattgatttctggcgagggattgattctccgttccttttgctgaggggaaaatcttggattttaggggctgttctagccttctgctgaggcctcttagttttcctgttttgttctggggcaggtggatttctgttttctggggattattgggggaaatattgttccttgtttatttcagaagtatttgcaggggtaatacgacattttttggggagtaaaataatgctttatatactctcagaaatatactgcctaaagtttttgtggacagaaccagtccaaatttttaagtagagattacttgatccctattacagaggtaaatggttccaattgaacgaattacacaagaatatagtatcccatcgaggtttggagttcaatattggtgcaaggattggttatataatgtgtcttcctgctgcagctgtgtatggactactcatgatttgttttgttttgtcacatgccttcttgcagcagcagccgcaacttatggagaacgtggcggtggccaagcggagcaggctggagcaacaccgcacgctcagtgacaactccttccgtgtggaggatctccctgaggtaatattctttttttttcctcacctgtcctcacctcccaatttggttgggttggggaatcatgatttcatctttaggagtaaaatgattattctttgatgctttctttgtcaaccccttactttttgaacctgcacacagaatgatcaagcgtgttttgatcttatatttgattttttgctttacttttctcctctcttatctgtggctatgtatgagggatggagtataaattcagttccaccatggaggtaacaatcccacttacacgcacatcagtagtacttttaaatgcctccatctgtaacccgctcctttggagactcttctgttgcaatttgtgcacacagtacagggattttcaagtttgaaaaagatggatcattcactaggaccttccaagcaagatgctggattttttcctcaataaaatatcatgtagttttatctcctcaccttttctttcttccctgcataattttatcaaaatccccaattttctcctggtctttttctactaagggcttataagccaaaaaggctaagcctaaacaaatgatgagttttttcgttgggattttaaaagccgtaagccacccttacattgttaagttaaaagctaagtacgagtagttcttttttggcttatttgaagtggaggtaggactccaccattgaacttgaggcttaaaagccaccagctgtaagccaaaaagaatcagcttaaaatcctaagccaaaacaaagatggcctaaacattagctatctctgcatggctttgcgcttgacatcagcatttgcacccatgcccttcaattcttttattgaaattcctgaccctactcttcctattttgccatatgtaatcttaatttcttatattgttttctacactcaaaattagaggcgggtcataaattgtaagtaaataatcatctagcattctctgctttgcatgccttaaatatctagcactccttaatgttgtatgtggcataacatatactccctccgtttcatattataagactttctagcattgcccatattaacatatatgaatgtgggcaatgctagaaagtcttataatatgaaacagagggagcagttaaaatgtgcttggcttcaaatcctcatcattttacctattgggatgctgcgaattccttaacaaggttgttatcttttgttctcctatattttagaatgactttactatcagaagccaacatttatgcacaccacattgttctagatagaaccttgcaaacctgatttcaaatattatttaggatgcatcagttataaacctactgcgatggaccacaattcatcaaggggtaagaaccgccaagaggatagcggtctgtgtcagctgcttaaaatggaaggagacgtagggtggggcgacgattgatggactgggaatgggacttatccttcattgcttgtgcactaattgatgcacactatccttttatagccatatgtggtttaggggtggatgtcaagttggctcggcttggttcatctcgtctcgtaggcaagctcgagccagcttgtttagctcgtgagccatgggcaagagataaaggcactcaaggtaggagatgatctcgagttcatcgatacttggaccacgggggaggagcatggaggagatgagctcgagttcggcggcacttggaccacgggggaggagcttgaaggagatgagcttgagctcgctagttgaggagacaagctcgagctcataggcacttagaacacggggaggcgttgctgctcactggtgggtagaggcgctagggtcgggtggcggtgcaggcttgaggcggcattgggagtgggcgcttgcagcatctggtagtggcacttggtcgagtggcagtgtgggcaggtggcgagtggcgatgtcggacgcttggggttgtcatatgggtgatgctgggccgagtggtggcaccgggtgctggggacaagcggctgtggttgcctttgcctgtgaggatatggtttggtgtggtgtgatggctttggtctgggctatcacgtggtatatgtggtgtggtgggctggtccctagtggattgatgggctactgttggtggtgggccatggtttgatgggttggatgtaacctgtatgctccacgcctccagctcgtttggctcgcgagctagctcgagctggctcattatctttaacgagttaaaatgccagcttggcacgttatgaaaatgcaacgagccaagtcgagccgagcaagctaacgagccatgagctttttcgtccacccataactaggttattagcagctagggcataagatcaacaaatagatcaagtagtacttactccaatcacaaatatgaacttaatctaggctcaagtcttttttttaaaaaaactttgactagctatgtttataaatataaaaggtgtccagccaatagtgcaatacatgagttgctttggagaatgaattttgctctgtatcttttctttgcttgcctgagttgcttcctcaggaccttcgatctagaaatataatcacccaattgtttgcccttttcacaaaacattatgcattcaatgtttgttactccttcaacctctttttagctttttctctccatttagttgcccatagcgtgagtttcctcctaattgtgttttagatccctgggtcaggttctgtcatgcatttgatttccaactttctagaaatagaatcacctcattgttttgattttcttcattgtattcagtgttccatcctagctaaatttggtgttagtagatgcattatttttagtatttttggttcttctgtactatctcttatctatttcgtcatcggatttgaatgtgctaggtgactgggaaaagaagaggaaaaacccattgaagtacttttctcattgtgtcctgactcaacctattgagtacttaatgattatcacgcctgtctgtttctttgatcaaaactcaaccctcatcatcctcttgttgcaggaaattcaatctcttctattatctctgctgtcactgaaagaggctgctagtacaagcatcgtgtcgagaaactggagaaaactttggacacggtatcctaatctatgctttgatggcagcaaggacgggcctgctgatatggatagtgtgaaaatagaaagaatgaagttcattgatacagtaaattctattattcagcaacacagtggaatagggctcaataaattcagtatcaggtgcaaccttctgaaggacgactcagacattcttgataggtggattcgctttgccactgcatcaaaggctaagattatagatatgaacctgtgcacaaatagaaataataaaggaccaaccaaacatttgtatgacttccctcttgaggctttcggtgatcaagatatcccttttatccagtgcttgtttctcaacaatgtttctataaagccacactcggatattggctttacgaaactcaggagccttcatttgcactgtgttcaaataattggagatctttcaggcttgctatttaattgctccagtcttgaggacttggaggtctttgcgtgcttgggtgtgactgctctgaatattccacaccaactcaataaacttaggcatttgctaatttgtaatatgcgtatccagatgctggagtttcatgttcctggtctttctcattttgaatacaaaggtactatgattcctataatgcttcatggttgctcaaaattacagaaggcaaccctgaattttcaccagacatggcttgaagaagataataataaagtattgggccatgtattccatggaattcccagtgtttcggcagttgaggtgctcaatttacttgttgatatttgcacaaagcaatcggtctggtcctcacaggtacatcctaataattatctttgctcacttagctgttcaaatggagatgcgcttcctgatttgttctggtaatgtttcaggtgcatacgttgacagcaagaccaacaatcatgtttatgaatttgaagcatctgacttatgagatacttatttttactaaagatccaaacagccacagtggagttcttcagctggctcagtatttagcttttgcaccgcagctggagactctagaattgcatgtgagtgctctcctgcctttcttgtttttgcttatgcttctttctttgttggctatgtatagattgcaatagttagtagttacatatatttttgtttcgaaaaacagatgttgtatcattcgactcactgccgctgctggcatgagggtgcgggagtctcctacggacatatgccccatcatcacctcaagatggtctacatgagtgggttcaggtgctaccgggctcaggtcgagctgctgtttgccattcttgaaatgggtgatgagcttgagcatgtgaccattgatccaatgacgagagtaccgtatagccctgatttgatgaatttaggcatacctgaggacgagatatgtcaatgggcgaaccgtacctcacaacggtttggtaaagcaatctctgttgtaaaacctccctaggtggtgttggtagtcctgtgcatatacgacttattaccacctagataagtgtttgttcagattcagtactgaaattgctgacacaggggtttctgttttgtttccatgagtaaattgttttttattttattgtttgacaataaaaggcttggacttgtttcttaattttgtgacaactttcatatgtcagttttatttacgagtgaagtacacaattgattcttagactgcgagtgtcatctagctctctaacctctcaagatatactttttgtcgtataggtttaaaaggggttcaaccgacttctgtgtattgatctacaatgtcaatcacataaaaaaacaaaattagaaaaaaaaagcatcatcttctcttattatgttaaggtgagaaaatattaaataattgcatatttaacacaagtttgaaccggtattatggatctgccactataaaaagtgtaattggatatttaccataaaaaatggttggaatccaatatattgccatgggactgacagtttagatgaacactgttacaagattgacttctatgaaaatcaggacaagaataccccttcccaagaaattgaaagattaacacatcatatgccaaaactcacgcatcacgagcttagatggtgtttggatccagggacttaattttagtctctgtatttagacactaatttagagtattaaatatagattacttacgaaactaattacataaatgaaagctaatttgcaagacaaattttttaaacataattaatccataattagagaatgtttactgtagtatcacataggctaataatgaattaattaggctcaatagattcgtctcacgaattagttcaagattatggatgggttttattaatagtctacgtttaatatttataattagtgtccaaacatccgatgtgatagggacttaaaagttttagtcccatctaaacaggtgcggtggtggtggcgagtgcacggagatgttgcaaacttgcagaggctctgaatattttgtggcacgctctagtccattggtagtccaaaaggaaagtaatcgtgtgttatatcagattataacatgggtgattagtctgaaacatgcatgtagaaagcatgatgaagaactcgaccagaaatgagagagagagaggggaggggtgaagcaagacgcattcatggccaatacatgtaaaaatatgtagaccagtggcatattttaaattacatgtaaattgtaatggtattgatccaaatatgtaaattatagtgacatatttcaaaactgtcaaatttataatggcatgggcatgtatccaattaaccctagggctaacgggtcagtttgggctggttacacggtttagactggctgaaccagtggttagcctgcttatcaagttctgagatcctgaagggagttcactaagaattgagataccttgttatcttgatcatcaattcagagacttacaaaacactgcgcaaccattcaccaggcaattcacgacgaggtaaagattacgcatgtcaaactgatatttcagtacctcaatcagacttcaaaaggcaaacatgtattttaattgcatgcttcacatctcatttacataatcagacccgtgataaaagagtaccacttctaaatggaagcaagattaggcctgaatcacacccccaagttccctgacaaaacataaagagtatcactccgagttggaaacaacagattataattgaaatcgcaacccctcccccacacccgtgtctggtcacctcaatctcaatccagtgcctcaacctgtgcaaaattacatgccaggtaaatcaacaggttgtcaaaaagaagagtacgtaatattgatgaactatagttttctcattagtgttttttctttcaaatgcaccattggtacttgaaaaaggagtaccaaacaaaaagaaataaataccttagtgtttacgactctataaacagaagtcaagggatgcacagtatctttggaagcgctttgccctctgttcttcaggttccccttccatctccataaatttcatgatcgccacttcctcaccagctgcatagaatgacctatttcatttcatggactaacacttgacaatatccgaaatcggaccaattgtctgtctatacataccatcatctgaagaagcatcagatgcttcagctggggtagcatcatctggtacagcagttgaggcagcagctggagcagcagtagaggcagcagctggagcagcagtagaggcagcagctggagcagcagttgaggcagcagctggagcagcagttgaggcagcagctggagcagcaggtggggcagtacatgggacggcagctggggcagaagatggggcagcagctgggacagcatagaggagcagcgttagaacaaaactggatatcaaaggctcttttcaggtaccattgatggatcatctgattttttgtgatagctgtacaaacaaatgaattgacttgtacaaacttcaaaagttgttctaggaaagtcttccgacaaaattttatatagaaaattccagtgcaaaacacactatttaggagcttaggaagcatgcaaatgaaaatccaaaaatctagaatcagaaaggaagcctttatatcaccttctttcttctcatggattaccgtaatgtccaagaccccttctccagtggtgtcaccaggcatgttaattgggtagctccctattagcgacttcttgttcattagacgtgttaggacctcaagctgagacctgatatccatgacaacctgggatcttgaagtaggatctgtcatgaactgttgaatggctgcgtgtcttctcaaggacttcctggactttatgctcaaattggaagcggccgatcacaccaagcaaggaagtgcgggagttagccaaggtatcgttcgacgtaagcttgttgcccatcatgttcctgatgttctgcacgaggccatgaataatgggccatgagacggtcccatcatcattaactgccacagcatactcatctggtctgtggtgtttaaggatccaaatcatgtcagcggagtgagcagatgatgccccttcacccaatccaagcaccaagactctgttaagagcgtccaccttcatctgccgcagcagctctgtcctgcatgtgcagagctcatgttcctgagcaaatttggatctcaggttaaacatctccaccagattccccccagcctggacctgccgaagggcttcccgaaggctacagcagtagccgttcagcttggacagcattcggcttttctctttagccacatcagggttaagtacccgcatagagaatggagtacgagcaatcatatactccatgtcctggacacatctcagagaaatgaactcagagtagagaaatctaatctcatgtaagcctagagattgataatgatgtgttatatcaagtgcatcactatgagaccaaaccagcccctgtgctttgccatcagataactcccaagcagacaaataagttggaggaatggaactcagtaaaaatctcacgggcaatctatacttgtcagatagcgcttgaacaagctcactctccgaatggggtgggggtggatccacctgaacggcgacggcggtggcgacggagggggtgggaaggagactgcggtgggcgatcggcgaccaggaggcggcgccgaagatcggatggggtggatccaccggagcggcgatggaggtgggcgggataccgatcggcggtgaagacgcggcgccgaagatccgctggggtggatccatcggatccgcggggaactggcgatggatggaatgggaataatttggtgggcgatggcgatggcgatggcgatgggcgccgaggagggctagagttggaacttggaaggactcagcttgg

SEQ ID NO: 65222 - DNA, 3422 bp, Oryza sativa
cgcggtggcgcgcgggatgaaattggggacgccgtctcccgccaggatgatgggttgggaattatttttttttacctacaggcaggctcaagcagcatatccgtccgatcagtttcacatggtccagattttggcaatgtcacgttgtgacttagctaggcaatgtcacccaagctgagtccgggttggaattgatccgacgggattgtggtcttggggatttgccggcctcgtggctcgtgcacgttggacgtgtgcgcttaaccgcgtcgctgtctgggtctagtccaaactccaaactgaccgaatcgacctcttctccggtccagttgctccaacacggggtgacaactttcggattccgtacctattttcaaaaacagaatctgtcggtcagaattttttggaaacgaaaacggatttagaaatattttcttggaaacgaaatcgaaaatcgaaaatgataagggcagtttccgtcggaactcgaatcggtcagaaacttttcggaaattttctcggaatttccagaaatcacaaaataccatgtattctattttttaaagcactgaatagttaataccatagtgtttggttgctatttttttaaaaaaaatatttgttatgcaaatctaatattacataagaatatttttttcctgcattgggatttatcaacagcattactaatttattccgtagattatgttttgtgacgtaccgttgatacttaacaattagacttatatgattgtgttttatgatgaattgttgaccgttaagacttgagaattgggtttatcagtttgaggggtttttttattccgataaattttcgttaccgtattcgcgccggctcgttttcgctccgttttcagtttcgataatattcgattccattttcgtatccggggtttccgattccgatttcgattctgaaaaaaaattaaaacgaaaatgacaaagatgatttccgtccgtttccgtacgaaaatgataagggcagtttctagtactatttaacatttaacactaatgacagtaattagaaaatattttaaagatttcttttttactaacagattgaaaatttttttaagttagatttaaaaacttttgatttaaggttcaaattttaaagtcaaaatttgaaaacattcaactcagatttgaaaactttcaactcgagatttaaaaactttcaactcagattcgaaaactttcaactcgagattcgaaaaatttcaagtccatatttgaaaattctgaaaactttcaactcagattcgaaaactttcaactcgagattcgaaaactttcaagtccagatttaaaaattttgaaaactttcaagttgagatttgaaaatcttcatatccaaatttgaaaaaaaaaagttaagattcaaaaattttcaagtcatgatttaaaacttgcaaaaaaggaaaaaaaaaggaaaaaacacacaaaaaggggaaaaacacgtgggaaaaaggaaaaaaaagaaaaaaaaatgaggggatgcgacatggtgggggccgcgcgcgccagatacggactggcacgcgcacgccaattaggaattctgccaacgctgaccaggctgggacaaccttttcttctccgaaacccaaatgcaacattacctttggccaaatttatttattttaagggttaattggatccattgtaattttactagtttcgaaaaaaatatcatttgaagcatctaggcccccggtgttaattttggtaattaatgacaagcactaattgtggactaaccgttgtctttgagctatacattttaagttaggtccacgtcatatgtgcgcatggatgattatcaatggattaaaattgacggcgcaaagcaaagggaaagaagacggtaaaactagcgttttaatttagaattgatcgaggtgtagggcgatcaaatttgctagtttaattttagtttcgccgtactattaagaggggtaatgacctagcaaaaagatgattttaattgccacattaggtcatagcattttcatttgtgaaaattcactacacaaattcattgggtttggcctgaccagtggcggtcagaccggccatatagtgccggtctgaccggcgtgccctggccggttagaccggctacatagtggcggacagaccggcggcactttcccggtcagaccggcctcatggagacagagatgatgctgctcgggatggccgatacagagccgacggagccgtagtcggtcagaccgagccaatggcggtcagacggagccgaggccggtctgaccgaccaccccatgtcggtctgaccggccagaccgatggggccctctgacagggctacaacggctagttttctagccgttgcagagtagcacggtctgaccggccacatacctccggtcagaccggcagagcacagagttgggggatttcgcccccaacggctagttttggtgggtgggagtataaatactcccccaccagtagcaagggggctctcttggcacccaattcaattgcatacaccccttgtacctctctcacactcacttgagctttgtgttcatccatctagtgtgttagagggttgtttagctaagagtcaagtgcatttgcttccattgtagagctagtgtggcacttgatcatctccacaccgggtcattgcgtgttactcttggaagttgccgcctcctagacggcttgtggaggagttgcccggtgacctctccgagaagattgtggaggaggcccggcgccggtttgtgagtggtttggagttcaccaccttcggagtgaaggaagaactaccccgagtgatcgaggcttgggtagtcctctccgtgggccggctcccgccttgcccaccccttgatgaagggggcgtgcggtggcttcgtggttgagcggtggagttgggctcgcctcaacggggagtaggaaaccggcaacttaggttagatttgattaggtgttatttagttttaaatcgcctattcaccccccctctagtcgacatctcgatcctacaagtggtatcagagcttggtctctcttgattgggcttcaccgcctaaagagaagatgtcgaacgaggtgaaccatgtagggaaggctcccatgtttaatggcacaaactactccacttggaaaattaaaatgtctactcacctcaaagctatgagcttccatatttggagtattgtggatgtaggctttgccatcaccggcacacccttgacggagattgatcaccacaacctccaactcaatgcccaagccatgaatgccttgttcaactctttgagccaagaggagttcgatagagtgagcaaccttgagaccgcatatgagatttggaacaagttggcggagatccatgagggtacaagtgagtacaagga

SEQ ID NO: 65223 - DNA, 574 bp, Oryza sativa
ttgttggcgttcttggtgccagtctaatcctggaaacgccacatatatttacatagtatttttttcgtttatgtgaattttgtcttttggggatctaaatgatgcgaaactctgaaaggaaagcgtccaatctgcggattgtggcgttccatgacatttctttcatattgaataggaagatctgatagattcctcaattgatatgattttgtttaaggttatttgctttgtgatttttgttaaattctttgtgcttttttttcagatgtggatgatgaaatcacaagtgaaaatacagttatccctgtctgattccttcataagggtgctgagaatactttaatctgacacagttttgatgaacctatatctccttttaaattctatggctgttcgtgcagattaatcttttgtgagttgaatgcgaattgttggattggatctgatgcctttgatgacatgatggtttcagaactggcacacatcgttgttgccagagctatgttgatattgctcatgaactaggacggtctgaggcctttccaatccgatactatagaaaaataagagttca

SEQ ID NO: 65224 - DNA, 1520 bp, Oryza sativa
  unsure (1)..(1520): unsure at all n locations
tttgaaatcantgtgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgatgaatcccctaatgatttttatcaaaatcattaagttaaggtggatacacatcttgtcatatgatcaaatggtttcgcgaaaaatcaataatcagacaacaaaatgtgcgaactcgatattttacacgactctctttaccaattctgccccgaattacacttaaaacgactcaacagcttaacgttggcttgccacgcattacttgactgtaaaactctcactcttaccgaacttggccgtaacctgccaaccaaagcgagaacaaaacataacatcaaacgaatcgaccgattgttaggtaatcgtcacctccacaaagagcgactcgctgtataccgttggcatgctagctttatctgttcgggcaatacgatgcccattgtacttggtgactggtctgatattcgtgagcaaaaacggcttatggtattgcgagcttcagtcgcactacacggtcgttctggtactttttatgagaaacgcgttccgctttcagagcaatgttcaaagaaagctcatgaccaatttctagcggaccttgcgagcattctacgagtaacaccacaccgctcattgtcagtgatgctggctttaaagtgccatggtataaatccgttgagaagctgggttggtactggttaagtcgagtaagaggaaaagtacaatatgcagacctagagacggaaacctggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattgtcaccacccgtcacctaaaatctactcagcgtcggcaaaggagccatgggttctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaagggaagacttactcgtggctgcaaccctactagctcaaaatttattcacacatggttacgctttggggaaattatgaggggatctctcagtgcatagcttgagtattagatgagcacacaaannnagcccgc

SEQ ID NO: 65225 - DNA, 10246 bp, Oryza sativa
tcaagattagctgcagacgtacgtacttttgcagatctatagatcacggccggccggcggggtggagcaccggagtttaactccggtggtccaggccgagtttcaatactccatctgccccattttttcttccgtgttctactgctacatgcaaacaaacaagcagcaatggcaatggcagtagaagaaagaaaaggggagcgatttcaattgaatgctgcctctatcttgaaactgaaaagatacacgcacagagatcaaaatcagatcagatcgatcagaccagatcgatgggtcgatggatggactgaatttattggtggtttcatggcagttatttctgcaccaagggttattgaatgtgggcatgtgaactcaccggcaagcctcgccggcgccagcttggccggccggcatccaaaccgatccttcttcaacgctaatgctctcctaaaatatataagaatttttagtctctagaatttatcctaaaatataataccttctacaaaaattttttgctcaaccaatcataactcaccacctttcaaattttccacctacctctacttcccatccaattataaccctagctttattatttttttaaaaaaagttttgttatttaattctatctactttttttaataattatgtccagctttaaatatacttatattctgaatggagggagtagtactcagcttgtcctcatctctgcacttctgcagtaaaaattaatatggttggttatagttgccatggctagccgtccagcgaaatgcaacctgattattagctgaggtagtagtagctagatgttcttttgttttagtacacctcagtgcgattgcggtccagctagctgatgatccgtatggcacggtgtctgaactgtagactgtagagtacacttttgtatgctgctctgtgcgtggcacgataatatgggtgcactcgagctgtcaacacagtcgatcgcccatgtacgtgcctgcccgtccagctctgtgtacgctacactaataatttcgtgtgtacaggttgattcaaaaagtaataatgtcaaacatggattgattcttagggatgtttagttcacaaaaataaaatttttgggtgtcacatcagacatttgaccacacgtcggaaggggttttcggacacgaatgaaaaaactaatttcataacttgcctggaaaccacgagacgaatcttttgagcctaattaatccgtcattagcaaatgtacgctactgtagtatttatggctaatcatggactaattaagctcaaaagatttccctcctaactgtgcaattagttttttaatttatctatatttaatactccatgcatatgtccaaagatttaatgtgatgtttttgggaaaaagtttctgggaactaaataggaccttagtctgttggttacagtgacctgaggcctggtttagttcccaactttttctttaaacttctaacttttctatcacattaaaactttcctacacacaaacttctaacgtttccgtcacatcgtatcaatttcaattaaacttttaattttggtgtgacctaaacacaccctgagtaacttctaaagattttgagttcaaatattcgtacaagcgaattttagattgggttatttgatggactaagttcccaatttaaaatttcagattaggttgtttgataagataagttcctaatttaaaaggttgcatacaactgattgaatgtagagaaaaaaaataccattctctaaaaaaaaaaaaagaagatggatacagttacgtactacgataggatattatcttttttgcgggaaaattatctgtcactaaaaaaattattaatgttatttcacaaaaaaatcttaatagttttttgtttaataattaatgagttaagggtttgatgatccgtatagcacggcatttgtactgttagagtaaaatttactttgtagcatgatatcatgctgctttatgtgtggcatgatatgggtgcgctcgagtacattcctagctagtacgctacactaatgatccgtatgtacatgttgatttaaaagtaataatgtcaaacaggagatggtacttgctactaatataagctttgtgttaaagttttgaccctcttcgtcaggttatagacaccgacgtatcagcggcgtagtaaggcccacaagatggataccatttcttattggctgctgtgatgattttcggttaatggcatattcaatggtagagataaatacgatctcctagacgacttaagattatttaaagaacatatttttataaaagttaagacgatgaaggctctaaccattaacttaaaaaatattacttttattattgtctctcatgcaaaacatgtttccatattataaatactagagttattgctgagctgtctttactcatagcaatgacgtctctctcttacatgtgaacaaatattcttaataattagcaacgctaagagatcagtattaacaaccattatacatgtccttagctgtagctagaatgtaatttttgaaacataagtttaaattagtttaaatgtttcttcatcgtattttctattttaccttttaagtactgctaagagtatataatgtaaagatcttattctaaaatcattttcggttgggataagtcgatctatttctctcccccctcaactatcatgccattaatctcgactttaatgtttttaattagatcgagtacatggtaacatgaaatggtacaatcatcatatatgtcatgttgctctgtatatggcgcgacatgagtgtgctcgagctatcaacacggtcgcccatgtacgttcatccaactctgtacgttcttagtacactacactaattatccatatgtgccaagttgatcaaaagtaattatatcaaacaaaaattggtactcgcttctgtgcttgtgaaattaattaaagttttgatcgttctcgagtttaggtacatgagtttacaaacagtgacgcatgcagctagcggcgtcgtaaaacctagaagagagaatagcaacatttcttgttggctgcgaccttcagcatagaagctacaacaggaatgtaaattttggaatttaaagtttagattaaatctaaattctttttttcatcgttttctgtttccgtacatactttcaaaatgctaaaattaagtagagagatgtaaagatcttatcctaaaatcttggtttgtttgttattttttttgtctttcaatcatagctcaatccattagagcgagtgcaataaaatgatgtaagagaattatacaagttagtacatcacatttatacttacgtgaataaaagagaagagaagaaagaaaaaaaaactatagatttatagccaactgcaaaataatctctactaatgaactatacaaaatagacgggagaattaggtataatgaaatatatattttaatgaactatacaaaatagacgggagaattaggtataatgaaatatatatttatagctaactaatatgtgagtgaactatatattaggttgattataaatgatgttttaatttttacatctaatagttaactattggtaacgttggaattgcagaatagcgggatgattaccatgatctggtaccatgatctggtattttgaatgaaaaaaaatatttatatttttaatttaaattctatgggctttaatttccataccaaccgattcaaacgttgtggctccgtcaaagctctaatcaattggaatccaaaaccttaattgctacacccattatttaagtcgtactttttttaatcactgttgctgcttcccaaccgtttagggaagtcgagcttctagaacgtgtggtgcgtcttttaatttttttttgacatagtaacaacttttagtctcagaatttgttccaaaatataacaacttcttccattcacttttctcacatatctccactactcatccaattacaacctccactattcacttttacatactttcttaattatcgtgtccaaccctaaaacttcttatattattatgggacggagggattacaaggacgcatcgatgaatccttgcatgttgtttaagaaagaaaaacaattggaatagtttaaggtctttttttttctctctctctcaaccatgcaaaagggtcgtgcttcaatatagtattaaaattgttggttttatgctgaaatttagtgttcttttcaatcgcagatggaagggttttcaaatgagaaaaaaaaaatcacagatggaaatcagaaatcacaccaaccatgggtaattcatcattttgaggggggaaaacaatggaagcgatctcatacttggctagcaccaagggtcataaaaaactattggaaactgtttgatttttttaaaaaatagaaggttttatgctagctggagatcatcgcttttttttttttaaaaaaagaaggttttgtgctagctggagatcatcgcatactactcgatacatctgccaaaattaaattaagtttttttttaataaaatttggtccaatttcaccagtagtgaatggtttcgaaactattcgggagcggttcttttgatagttcagttttataaaccttggctatcccacatcatcctttaattaaactgtatattccttccaaaacaaagatgcaaattaatcatataaggcagggtaaaggctatgggcgttcatatgaatgaacacatgtttacgagtatgtgtttgcaccgtgttttgcaaaaaaaactaattaacataggtatttctcgacttggaaaccaatatatatatgagcagatcaagcagcagtaggtacacttaatcctggataaaaacaagagagaaaagaaaaaagagatccactaataaaacaaaaaaaaatcaaagaagaagaagatatcaagagaacactctatttaagtaaaaatttaagacatcatctgcatatccatccatccgtccgtccatccgccatccaacggacagcagctaccgaagtatttatatcgtagtacttaattaggcggacgcggcggcgccgcctccgccgccggtggcgagctcgccgccgacgcggcgctcgacgagggcggcgcggagcgggttcttcatgacgacggtgaaggcgaaggtctcggtggggtcgggggggccctcgccggcgggcgggacccagcggaactcgcggaccatgttggcgagcatgagctggatgtggaggacgccgagggtggcggcggggcagatgcggcggccggcgccgaacggcatcatgcggagggcgcgggtggcggtgatgtcggtgtcgaagccctcgccgccctcgaggaaccgctcggggcgccacgcctccgggtccggccacgtcgccgggttctccgtcacccacgccgtgtagaactccacgctggcgtccgccggcacgcggtacccgccgagctccgtgtccctcgtcgccgcgtgcgacagcacgaagtggctcggcgggtgtcgccggaatgtctccttcaccaccgcctgcacatgcgcacgccggcgatcgagcgccgcgaatccatccatttcggttagcaattcagcatatccccaattccccatcacccgtatcttcttttttttttcatttttttttcattttattatacaatgaaatgaagcgaactgcttctctgtctcacaagaaaaacaaattataggtatgagtttggacaggcgtataaccagattcaaaactacgatacaacttttttttttaagaatggttttactcccgttgtttcataaaaaaacaaaactaatatatgatgtgatacattatagttaatacttatatagataccaagagattagttctcaacaattaatactacacgttattggtggatagggagttttttttactgtctcaatccaatctcggtgagctcctcaatccgcatcacccatgtcatttttttttaaaaaaatgttttttattcttcggattatactatgaaatgttaattactataacaattaatactagtacatgttaatggtagatggggaattttttatgttgtttaactcatggggatgcttgtttgcacgaacaatatgatggggacttatcagggttttttgcaaaaattcatggtgtaaattaaaagggcaacctcaatagctgatgaaattaatacagtgcagtgcttatcattttcagctaaacagaggagcaaatgaaagctcgttttctcagaacacaagtaacatgtccttttcatgacatttgcttgtagaaaatgccatttggactgcgccggctttgttagtgccagatcagtgccttaatttctgtggtgaacttaattagtagccgcaatcttggtttgcagctcgggatccagctcaagaacaaaagaaattaaacatggtacttaattactactgatcgattgacagtgacactccttttagttgtgacaaaagtttggttggtagctgattggtctgccaatgattgacaacaagaacaattgtccatttgactcctagtgtgagtcccactaacctttttaccataaaatttctataaacctcaactcattcaaatttttaagaaaacatgtttcattttgtccttgaacagtgcattctaatacatggccacaaaatttgagtttttttaggaaaaaaacagtcaaaattgtcagatcaagtttgatactaatatatgcagctacaattaggtagtggattaagtagtaattaaaccagaagagtagaagtaataataatttggttggttaataaataaataaatattacctgcaagtagggcatggcctcgacgtcggcctcggtgatgcgcgcggtggtgccgaccttggagacgacctcgccgtagagcttgtcctggacgccggcgtcgaggacgaggtgcatcatggcccactccagcgcggtggcgctggtgtccgtgccggcgctcatcacctcggagcagagcgtcaccagctcgtcctcgccgagcctcttcccccgccccggcggctccaggtcgaacagcgagtccacgtacgcctcgccgggcgcgctcaccatctccacgccgccgaccaccgtgttcccgtcggcgttcctctcgccgccgcccctgatgaactcccggcgcgcgcgcaccagcggcgccaggcagccgagctggcgccgccggagttcgcgcgccgcggcgagctgcttggtgaagagcggcgtgaggagcgggaggaagtccgggagcttgggcatggtcatcatcatcacgtccttgagcacctcctcgatctcgcggatgagctcgtcggggatcttggcgccgaagcagatgcagatgaggatgctgcagatggagaggcggcagttggccatcatcctgacggcgccggtggcggcgaactcggcgcggagccgccggaggtggctcccgacggcccactcgcggatccacgagaatcccttcacccgcggcggcgacacgatctcggcgacgaagttgcggcggagcgcgcgccagagcgggccgtacggcgccgagttgacggtgcacttgccgacgctgaagagcagccgcgtcgggctgtcctcggggcggctggcgaacgccgcgccctgcttgacgagcgcgtcgtggatgaggtcggcgtcggtgacgacgatgagcgtgcgctgccccatccgcatggtgaagatgggcccgtacttctcgcggaggtcgcgcaccacgtacatgaagggccgccgctggaggatcacctggaacaggttgccgaccaccggccaccccggcggccccggcgggaggccgtcggcgccgccggtcctggaacaccgccgccaccacatcgccgccagcaccgccgccgacaccaccagcagcacgtcgttcatgtccaccatcttcgacctcgccgccgccgtcgaacactcgatcgatcgatcactctcagcttcttcacctcgtagcttggtatagctcgccggagtggaggaagagtgggtgggtgggagagatatatagcggcggaggcatgtacacagtggggtggggggagtaaatgcggagccatctaccatctgaaagggagacatgaatgctcgctccagtgtgacattaatggcgagctcgtgaaagctcagctctctgccctaaccctaaccctagccgtggtagtggaaaatgggaagaaaaaccagcggcttggcccgtgatgagctaacctggctgtccaccatggccatggccgctgctgttttttttttttcttcagccgttagccatttgcttcccgcgctttaattcccgcgttcggttgggaagacgacccacacactcatcactcggagtagtactctactgacgcgtttgcaaagtagcaaactggcggctgcacacggtttttcgtttatgcacagtaaaagcatctccaacaatcacttcaaatttgactctccaaatatcgggcctgttcattttaatgttattttcaaccttaccaaattttggtaagttgccaaaaaaatggctacatttagtttgctgccaaattttggtaactatataagaaacgtaccaaaattttggcaactatatcaaaatttggtaatgtttttttttatcaatgtgaacaggcccatctatttggtcaactctccatttaatttagcaagttaaactctcttttactccaacagcctctccattcgtcctctctattctgagtctatatgataattgggcccacacgtcagtctctacacctccttctccctcatctttctccccttctctccaaaccccccttcccactcccatccgtcgccgccgccccatccccatccccaccgccgctcgagctgtgtccccatgcaccgccggtgccgctctgacggcaaattcgtgcggcaggcagggagggagctctcttcgccggcggtggtgtggcgatgcgaggaggtgggcggtcgcgtgcggtggtgcggcgacgcggggaggcgggaggcgagacgccggcgactcgcgacgacgaccttgacgccgctcggggcggagctcggcggcggcggctcgcgacgacctcaacggcggatctagaagggggcggcggcggagctcgaggcggagctcggcggtggcggtggcggtggccggccgcatgacgacggggcggcgggggctggccgcgcgacgacggggcggtggcgccctcatcattggtgcgtgccgcgtggagagagagggggaaacaggcgtgggtcccacatatggttagccggttttggctggccaactttggctagtctggtggggaatttagccagccagatggcttggagaggtatttagctagtctgttggagtagattttttgtgcaagttagccaaattttaacttggaaagccatttggctaggctcttggagatgctctaatgtattttactcatttgagtaaagtgtacgagcggtccttaaacttgtagaggtgtgtcatcttggtccctaaactctcaaaatgcatatccaaatcccagaacttgtcatagtgtgtcatctaggtcccaaatcgccacaacccctttagaatcctacgtggtattgatgtggcatgccacacggacatgacgtggcatcattttaactgacaaatgcgacccatttaaaatatttcctttttttccttctcttttttccctttcttctcctttctataagaagaaaggaaaaaaaagaagaatgagaagaaaacgaaaaagaaaataagaaaaaaaaagacacgtcacgtcaatgtggcatgccacatcagcgtcacataggatcttagaggggatgtgtcaatttaggacctagatgatacactttgacaagttctgggatttggatatacattttgagagtttagggatttatatgacacaaccctataagtttaagaaccgccaatacattttactcatttgacccgcttgtttagttccaaagtttttcttcaaacttccaacttttccatcacatcaaaactttcctacacacataatcttccaacttttctatcacatcattccaatttcaaccaaacttccaattttggtgtgaactaaacacagcctaagagtcatttgaatagtagaaactgaaaaccataggaatggaaaaaacacatgttctaacaaggggctgcaggaat

SEQ ID NO: 65226 - DNA, 845 bp, Oryza sativa
ttgtttttaccaaaaaccaacaacacaagccactccctgcagcgatgaaaagacagcaagtagaacagtagattctttgagcgatctgccacattggtcgatccgcaactagacccaacaccattacaccaggcgacaaacaccacctgacaccttgtgtccaacctactgcagacggccgctgcagccactgggttaccatcatcactctgcccgtgccgctccatccatcctagagaaagagagatggagagagaaaagagaagtcgagtggaagcagaggatggtgccgtttggaggaactgcggaattcaaagatgggtatttgagcatagcctcacttgcccatgtgcctcaacattagccaaggctgctatgaacactagcggatgattggtggagatgtggactgttgagcatagattggtaagtatttatagaaaaaccaagcagaagtaagattgataattgtgcacggtgaaaagagtaagagagatgcctggggtgtcttgtgaagctcacaagccaaaatgtgtaaacaaaggctgggtgtgagaaaacatgacaggctacctagatacattagttcaaagtccagtatgagcctacatacccaatttcatgagaaaaaaacatttcttcttgcatttatcgagaactgtttatgaaggtcatatgtagagcataagataaacaacagtatgggtaatgcccactaaacatcactgctaaaatcatttaagaaaaaagaagggcataatgcgcagttaaggatgacaggtgacatgttatccaactaacggagccattgtttcgcttattcgcgggataagcaaaacggcata

SEQ ID NO: 65227 - DNA, 1389 bp, Oryza sativa
  unsure (1)..(1389): unsure at all n locations
agcggntttgttgatatnnnnnnnnnnnnnnnnnnnnnnnnnnnnnnnnnnnnnnnnnnnnnnnnnnnnnnnnnnnnnnnnntacgaaaaaaaagttcaactatagatccgattcccccttaaaaacgaaaaataaaaggcaccactccttttgagtccgatataccagccaccactcctctcagtttcaatctataccatgatatctcacctgccatctcttaaaatgcacaccggtgaatttatccggcctcagtgcatcggcaaaaccagccatagtaaaatcacagtgcctataataaggtttttggattgttgagattatgggcatataatgatttaatttattccataaataaatcatgacattacagatgaaaactagcatgaacgcatcattagatctacacatgtaaactacgtagaaaaacatgaacagatcaaatatgcgcaacatattgaacacgtaccgaggtgacgaaaagaccggctgcttggtcgaaacttttcgcaggtgtctacgaaggcacgaaacacgcgagcgaagaggaaggcgagccgtcgcgaacgaacagggagcagtcgcgcgaagcgctttccaaaaaccttattgccggcttcttccggtgcaagacgtcaaaggcagaggttccggagacctgctcttccgatcgctgtgcacgcccgcgaaccggatggagtatctacgagcgacggcgcagttcagagtaagaggcaaaccctagaatggatttcgcatatattgcgtgaagaccgcgggtcggtttatataagagaaggntcccttgatcagggggcccggacgatatctactgggcgtaancgaaccggataaagcgcgcggtactaatcggattccacccgtgttgacgcattggattttttggacgtttccaaaaaaaaacaaatttcaatttggggaaaaaaaatcttaaagagggtgcttcttccccaggggtgaggccccttttttggaaacttaacaccatagttgggcacgccccctttttttttttttgaaagaaaggaaaaaaaaccgtgttgttccttttttttcccccaaatatttaaaggggtggggggcttcttttttaaggggcccttttcaaaaaaggagggggttaaaacaaggcggctttttgggggggttgtgtatcaaaaaaataatggggggggggccctttttatcccaccggggggggggggtgggtttaaaattaaaaaaaccccccctcccaggtttttaaattttttgggggggggggggtactccttcccccgccggtgttggggtaaattttttcccccctattccttggtgttaaaaaaaaaaaaaatgggtttgttttttttaaaacccccacccca

SEQ ID NO: 65228 - DNA, 776 bp, Oryza sativa
gctcggtacccctctcccaaaccaaatcaagaacagaccagacatacaccaagaaaactgaagtactgaacgaacccccaagaatcaagcagcagctacaagggcacaaacctagccgggcaaccgccggcgggcgtcgagcagcgaggaggaggaggcggatctgcgcctcagcgcctcctccgccggtgagtcgcgccgccttcgatccccctgtccccgcctgcttggagccgtgcgcccacgctaccggcgcgccgcctcgtcgtcattaccccggctgccgtggtgccacccgccgcgcccacgtgtcggtgcctgtgatgcaagcgctaaggccggagagcgagattgggagctaactagaggaggcggaaaccctagaggaggaggagaacggaaaccctaggaggaggagaggagaggaatgaggagaagggcttacccttctcgccggaggaggagtcccgacggtggcgggtctcgccgaagaaggaggcgcggcggcgcccgctgttgttcgcacgagagagaagggactcctgttgcgcgagcgagaagcagcggcggattgagagaggaaaaattcccgacctccgaaggtcggggtcctttccctagggtttccccgcggattgggccgggaaatccctgcctcgtgggcttccaaatggacatggaataaaacccgtgacaatttcccccgtgggcctttctcccagggaatgggctgggatcccagtgggatcctgggctgccaaaggagccctaagggt

SEQ ID NO: 65229 - DNA, 10286 bp, Oryza sativa
attggcctttaccagattgaaatcggttaggctacagtggataatgggttcaagctatgattcataatattcatatctgagttggtcgtatagtattttggggaatatttgcaagttaccaatggtcctgtcagtgaaattatttgtcctcaaaccatactgatctcgaagactgaaagtttcaagacaagtattggagcaataatttgagtacctagtctgtgtaagcaatactggtgaataatagagaggatcctgagtatctctgtgaactttttatcaccatgtttcatcgattgagcattaaaatgaagcaccatggccgggtaatctttattggacttcttttgatctctgttactctccagttgtcttgatatatttttcatttgctttattctaaaatatcaccactagaaatcttatgcagtggtgcaaaacttacatcagactacccttaaaatttattcccttgctctattgagttttacttcagttttttttttcgcatggtttgttcgatgctccttaacctgcctgctaacttcaacataaccgtgcctagcaaatatattaccttttcatacgccgaggttatttattccatattatccaaaactctgcagatctcctatgccaatgggcggtacttctgctttgctcgcgaccaggataagtggctcatctctgatgctgagactattgaggtagataacttgctcatggcctctgcagcagccatgtaggcttcttgattctgatctgctctctgattctgagctgttaattgtgtacaggcagaagattcatgggagcagttgcttgaacgcttcagagactgcaggctccaacctgaagttctttttttcgagatcatcaattagatagatggactgcctggaagaaccctgtcataatattgtattcatagcttcaagttaattttgacatttttgcaagcaacttgcttgtcattatcttgatgctaacagttttgatatatctccttgtaaaactaccatttcttaccagttttggaatgttcttgatcattgaacagcctgtatttgttccattccttctctttccagtttccagtggtgtcaaggaaagttacctctttgtgattgaaaaaataaagaggaaaaatatactctttttggttaagcagcaaggctgcaaataacgagcaaaaacaaacttgtcaatttgttccagctgcagtagctgtgtgcatgcatgtttataatctgtcaacattgaggggttcttgattatggaacttaatgaactcaaatttcagtcagaaaacattcacaaaaaggacatttaagagtacgacttgtttctttctggtgccagattatgactgttccggctcgagttaatactgatgacacaattaacagattacaaccacttgtttttttcaccaatagactatgacacaattaactgtgctacttaagatttgccaaatgcagaggatcagttcatgtctaactacaactagttttgtactccgtatttttgtttgcacgtctaatcagtgtacacaatgctagatacccagaaaatatttagtaaatgaagttttcttcattaaggattgcttatataactagtactccctccgtcccaaaaaaagacaaactctgggtttccgtatccaacgtttgaccattcgtcttatttaaaaaaattatgaaaaaaattaaaaagacaagtcacgcataaagtattaatcatgttttatcatctaacaacaataaaaatactaattattaaaaattttcatataagacggacagtaaaacgttggacacgaaaatcagagtttgtctttttttttttttaacggagggagtagactagtagcagttctttcatgttgtttgacagagtcttgggagatgctcgatttagctctgtttggcgcatgcttaaacgctcgctcttcgctgcaggtgggccccatctgtcattgtaaggttggactggtaattccaagcccaactcgttatgggccgaaaatgttgggccttattgggcatctgaggcggcaccgaacaaaaaaagttgggccggattttctcccctcggcctcttcgtctacccgtcgcttccgcttggactccgaccagtggagggcaaccagccgccgccgccggccgccgtctcgtcttgggatcgcacgcggcgcggaagaggtagggtggttgctaggtgagtcagcctcctccgatctctccctcggacgcgtcgcgatgatctggggtttcatgggaatgcctcttgctttgcgaatttgagccatttcgatcttctttgcagtgaggagggaggtggttggaggaggatgagcgaggggaggccggtgccgaggagggagagcccatggggcttgccggagggggacaagcgggagcccaaggcgcaccgctgcaacgaccgcgccgaggacgtcgtccaggttccaccccctctcaaccctaatccaaccacagctcacgacctgattgatctcttattatcttcctaccgatgaatgagtggtgatgaatgtgtaatggaaattgcggagctcagagctacccggatgatagttttgtggagaacctcttgtcgctatgcctgtttgctagtactaaatttggatcttgaaggcgcttgatagtgaaattggctgtaattgcatcgttaaacatagttgttttggcattactagcctttcttacttacaattatttcagtgtttacctaactgaatgtcttctcttcgtgttacataacaagattgcatgatgttctctgcccaccagccaccatgatcctgcatgtgcattgcgccattgctgcgattgttgttgctttcaggctgcaggtggtatttccatgtttgatcccaaaaccatgtttaggaacggcctagatggcaatcagattcttatgcttacccaggatgaaataagcctcagtaattaacccaaaaaccaatggcggagcttcatcgaaatagtgagggggccaaatgtctgaacattagatcctcagtattgatcaagtacagaaataaactcaaattggttcatttgcacttattggccatattactggtctatactcctaggtgaataagaaaagtgggaactaataggcaaattataacaacatacactactaggtgaataagaaaagtgggaactaataggcaaattataacaacatacactgctaggtgaataagaaacctcggggaggccatgaacccatttaatcacaagtagaaatggacgaattttcagtatggaattgcccctaatttcaactagcatgctggttccactcacactgaacctgccagggtccaaaattttcatcctgtctgggattttcagtaaagagttttcatcagttatcagcgtctgctatgtaatgaatgtttcccaagaatgctgaagaattttgctctgtgcctcaatgtgttgattatattatagcaaatgatgatattgttaattctgaaattcttggccatctttatgttgaactcatcctgtctaggatattcagtaaagagttttcattggttatctgcgtctgctacgtaatgaatgtttcccaagaatgctgaagaattttgctctatgcctcattatgttgatcatattagggaaaatgatgcaattgttaattctgaaaattttgtccatttctatgttgaactggttttctaatttctgttgcaggcttgctttgaggggaatcctttcaagacagttccaggtccattcaagctcttttggcaatgcatgcgttcgaaacctgggtatgtacaacttcttacaatttgtatgtttcatgcttttgttcacacatatattcccagtaatatgaggcaacatacgtttcaataggtctagcacattaagaactaatatgattgataaaggacattggaatcatctgattgaggggttttaaggagtggtcacaggatgctcatgataaggtggaccattatattgtgcctattgtttgatatgttcttctctttatgctccttcttgccggtggctcttccaccataggtccttcagcagcctaaagaaatatgtgccatgtgaatatacctagtggctgcagaaaatgctcatgatgactaatctttgcagtgtaaaaggctctagtgttgtgattcctttcaccacatggattagcatgagctttgttttctgaccaactgaacttgtaatctctgagagttgtgtgaattagattgtaaggcaactttgtatttgagaagttatatagggctattctcaattaaatacaaatccaataaaattttatgtatgcttcttggcctgttttgccatgtagttattcgttgcttggttacatgtgtcatgtatcaccttctaggatggtggtttggttgctttcttcacttccaatggcgggtagggtttcttttcaaatgaaatttgttgttgtcaaacctgggaaagggaaaggaaaatatggtctatctcaatttggctggttcagtttggtcaagttaggagcactgacactgtctggctgggagcaactgcttcaaacaggctaatgctagaaccactgaactgaccaatagccactcaagtgagaaaaagaagtattgttgctagttgctaccataccttggggtagaaatcgaggcaaccctttcgatagacattctttccccaagaagcttctgtacttcagaaaactgttgtagacaaaacgctatttacttgagtccactaaaatgtgaagctgtgagaaatgttgttatgacaaatgtacttgtgtgtgactagtagtagttagattgtaatgagcatcgtaaccctgaatatttctcttacgtttgtatctgaagttttcatgtaacaacctgttatttacagggaggagccaacggagccgtatacttacctgcagctggatcctcccaagagagcggaagtcaagctagagtaaacagcacctaagtcgtccacaagagtgtttagtttatttcatagtggtttgccttcaaaacaacgcctttatctcctagggaccatgttgtgcacaatgccttatgtttgcatattcaagaataaaaatttgacaatcctgatccagagtaatgccttatgtttgcatgtttgaaattgctgttgctgatgtaagaattccctcccgatagaatgatacctgcactttcaagatgagttactcagggccaaaagagtaaaaggccctgctcaacttactatttttttgaccccacgaaaaagagtgaaatggcttctgaaacaggttcacttattatggtgtctgagctctgtactgtacgtataagagtagcaatgtagcattatgaatgcgctactgtgtgtagatcagttgtgggattgtttactgtatttgtcagtgcatgagtcttaatgaatgagacggtactttggtacaggtccataatgataatctgcttcactacacaaaatctgacactccctaatcagcctctgattatttccttttgttctttcttgcttgcatgagtatttacacaaggctgtactgtacatgttggttgctctacagatattcttcaagagccagcacttggttgatctacagatattgttactgctactgctactactgctgcacatggtgatgggccagggaggcatcaaagctagagaccgtgccgtccacggtgagtcagtcttctctgttattattctatcgcctcaatgcacaataacaccagtgccttcatatgcacccaacctctgcattgcaaaattttgcaactgttgcaagtgactgatccaactcctaggttggttgcagatccaaagctgcaattatctgacacggatgcagatatgatcctgaactcgaaaaccgtttgtgttgcagatcccaatcacgcatcgatcgacctgggactgagctactgagctaagcttaccatggtgatcttgattcttgtaacgtagagactacaccatcttctgctacatatagcccggaatgcaccaatgcatgagtggatcagctcacctgaaagcctgaaactgaactgacctgatcacctgaccatcaatggcgtccaagaacagctgcgcctgccacggcgtcgtcgtcaccctggcctcgtgcctcctcctcgtcgccgccgccgtctccgtctctgtcctcgccgcgcacgtcgccgtcggccgcgtctggtctcctgccggcgccgccgccgccgccggccatcaccattcactctcaccggcttgggtgccatcaccgtcatcacgccatgctcatcatgccagggaactcgtgaaccgccgagtacgtacgccatgctcatgccacactcagactcaacggtgtttgtgcagtgatgatgtgatccgtaatgggcaatggatgcagaattgcagcagtgcagtttcagatgcaggaagtgtcaatgcaaaaaaaaaaaagtcagcgatgttgctgtgacatgtttttgataaatatttttgacatgtatatttgacaaatatttttgtttgtgcatgcgtgtgtgtcaggttcaggtcgggaggatggaggccgggctggtccaggcgcgggtgtccatccggcgagccagccgcacgcgcagctgcacgccggacgacggcggcgggttcatccccaggggcgccgtgtaccgcgacgcctacgccttccaccagtaagtaaattcaccactccgtattttcgttcccaaaaacacacaaatacacataagggctcaagagacggaggcaaaacgataaatcggtaacctcactaaattcttattgaaaaacatcacattcacacagttgtctcctttgccaatccgtaacctcactaaattcttattgaaaatgtcatatttatacggttgtctcctttgccactccacatctggccacgcatacccaattactcactccgttttatgttttatattattagacgctttaattttttaattaatttttttaaagtttgataaagtttataggaaaatataataacatttttaatgtataacaaacatgttatcaaaatatattaatgttacatctaattaaactaatttgatgttgtagatgtaggcaattttttttatgaatttaattaaacctaaaaaaatttgaaaaaaaatcaaaaggaattataatatattataaaacaatggggctagtaaccaagagctatatatgtgtaattaagttggccgcggctagctgctgccggctaagctaggataagcattcgtgattcgtcgacacccgatcgagggcattaacacgccttcctcgccgatttggacggcaaacggcctgaccaaatgcagccatcactaaactctacactacacggatatatgaattcttcgtacgggctcgtgcgatgactcgatgatcgatcggttgttggttgatgggtgcatcgctttggctctgctctttgtttggtgagacatgcatgctttgtgacggcaacgcctagctaatcttacaggcagagaccacactgctccattattagaggtcatcacaattcatcatcatcatcagccggcttctagatgattttgtaattagagtactcttaattatttgtgctcaatttatagatataacgtgtggacctacctaattataacctacctagtacacgtagtacttcactactttgacaaaatgcacctgtagtatactagaggtactatatacggagtatatgtaagttgtcatgtaatggtagacgatttttataaattgcatgcaattgaatttcactctacttgcgtacccagtacagtaaaattttgctactagagcattgtactgtactacatttatttttaataaacgatgccgctgattttttaatacacgtttgatcatttgttttatttaaaaaatgtaattatcatttattttattatgagttgtttgatcataaaaaatttgatattcatcaaagtttttaaataaaatgaattatcaacatcaaaggacgccgtacggaggaagcaatactatcgtaaaacaaggggaggttaattttaattgtggtcatgattaattaacagccaataattaactgttactgcatcatttgatcattgattatactatcatcaggagttacattgagatggagaagaggttcaaggtgtggacgtacagagagggcgagccgccggtcgtgcaaaagggcggcgccgccttcgccggcaacgacggcatagagggccacctcatcgccgagctggacagcagcggcggcggcggccggcaccgggcacgccaccccggcgaggcgcacgccttcttcctccccatcagcgtcgccagcatcgccggctacgtctaccgccgcgacatgatcgacttctgggacccccagctccggctcgtcgccggctacgtcgacggcctcgccgccatgtaccccttctggaatcgcagccgcggcgccgatcacttcctcgtctcctgccaccaatgggtaaattacactccacactctcctgcgctacttttcgcgggaattgagaaatactccctccgttcaaaaatataaatatttttagcatggtgtcaaagtcaacatttttaattttgactattagtagtaaaaaaaataaaaagcttaattatgtaaaattgatattactagatttatcattaaaaaaactatcataaaatacaaaatttttaaaacatattacttttatagatattattagtcaaagtaatatctcgaaaactgtatcgaagtttaaaaatacttatattttaggagagatagtatatgtaatttcagtaaaggcgttgaaattaattaattctacgaaattatggataaattaatgaatgaattaattaattccgcgtctcaaatggggtcacttgtatcgtacccgtcaagctctgcattcaaatacaaacagtctagcactctagcagtctagcttgttagttcgttaaccaggcagtttggtgatcagttgctttcacgagtttaaatgcataataattaataaaccggcaacattttagtactagctgtgatgccacaataggtaacgaaacgtatcatgtttagctatgcagagagaccatagttatagggagacatgatgacacatgaacagcatcatgtatccatttgatcgtgacacgaatcaaatatatgctgcttaattgattattgcatctttttttttaagggaacaaaagaaattcaaacttaattgactcgatcgctgcgacatgtgtgcgtgcgtgtaggccccgatcctgtccgctgccaaggcggagctacgcggcaacgccatccgcgtcatgtgcgacgccgacatgtcggacggcttcgaccccgccacggacgtcgcgctgccgccggtggtcgccagcgcccgcgcgacgccgccgcagggccgcgtggcttcggaacgcacggtgctcgcgttcttcgccgccggcggtggcggcggcggcgccgtgagggaggcgctgctggcgcggtgggaggggcgggatgaccgggtggtggtgtacggtcgcctcccggcgggtgtggaccacggcgagctcatgcgcagggcgcggttctgcctgtgcccgtgcggcggcggcgagggcgcggccgcggcgagccgccgcgtcgtggaggcgatcaccgccgggtgcgtgccggtgctcgtcgacgacggcggctactcgccgccgttcagcgacgtgctggactgggcacggttctccgtcgccgtccccgcggaacgcgtcggcgagatcaaggacatcctcggcggcgtctcggaccgccgctacggcgtgctccgccgccgcgtgctgcgcgtccggcgccacttccggctgaaccggccgccggccaagcggttcgacgtggtcaacatggtcatccactccatctggctccgccgcctcaacctcagcctcccctactgaattacagaatgaacaacaaaaaagaaagttaattaggtccctgcagtttggaacgcgagaaaatttcacgttcctacaaaatttgaactgttctatgttcgaaacgagaccggccagtgtgatggatctgaccaagctagctaagctaaccaaagtgtgcagtagaacactgtacactgcatttctgcatttatagacaataggttgtgttcgaatgagttattcctaatttctcgcccctcgttttctacacgcagg

SEQ ID NO: 65230 - DNA, 1801 bp, Oryza sativa
ctatgttcctccttccgtgttggatcagcactattgttagctgacttatccttgtctcagaatcttgtaacatcatattctacaagattgtttccaagttctttgtttggcaattagattgatactatgactttaaaaacaattacaacaactgatcatcgtttggatatgatgttcttttggcagaaatctgatcagcagaaatcaacaatgacaatgagggcctacaacaacatactagcaatggcgcaggtgatttctttattactttagtggaactgtgtgatatgtgaattgcaaaatgctatcgcatgtgagaataatgtggtgacacatatgagggtatttttgaaatcacaagaagcttccaaatgctctctgcttgggcttctcatggtggaccagttacaattttaaatgtataacaaaagaactattgaaaatactagcaaatagcagtgggagtttttttttcgttacagatctgcttttgagcatagtaccgaaatctgaccactgttagtcaagaccaaaaaaaaaactgtgaccagggcccggtctggtttggattaatagaaacaatgatagtgagaaaaactgggatgtttaaactttctggtacattttaattccgcttggagtcgaatcccttttacctgaggttatattgcatgtgtaggatgtgctgataagcaactgtgttgagattggcatgtgatttatttaaggaagttttcaatatgagcctttattttaatacaggcttggggtttaattcaaaattaatactctgaactgtctggctcactgtcaaaccatgtttgaatcagcgaaccgaggactgatttgagtgaatagttcacatgctggtttgagttttgcactatgcttttgaggcctgtgaaggaactgcaggactatcttaagtaaaagttaagtggccttttataattgcatgtacacaaccgaattcaactttggctaccaatctctacgaattaccttagatatatgaaaatgacgagtaggttgtgtcaaaaaattccattgtagttgtattaatttgtacaatggaaaagttgcatgtgttaatgtctaaaacacatcttattctactgctggaggaagcataagtacacggcaatgtatgaaatatactgcttgtgtatactaataatactaacctacctaaatgtttatgctttctaactaaacgtgatgaatgttcatttcagccgttgcgtgcgaaatcccctttatttattggtgacaagaaaatcactctctcatggatggagcagccaaagaaaccagcacctacaacaacagggttagatttctattacctaatattccatttccccctcagactttgcatttcattatagttaagtctgctttgtggatcttttagagggaagaggtcccagcctgctacaaatgggaacacccctgcgagcaagaaggggcggggagagggagcagcccggaatcaacttgtgaacagagcttttgaagggttatcccgtggtggtagagggagtggaagaggccggggcaggggaggccggggaagaggatggggctaccgctgagaatagttggaaatccctgcaatctgatgggagaatagatcagctttctgctttgatttgaggtacttctcaggagataagcttttctgtatgcagcaaaatgggattggtgatagcccgtgaaggcatgctcaattgctgaatgcatacagaaagctcatatgatggatgcttgagtatatcgatgattttttagaccctagtcg

SEQ ID NO: 65231 - DNA, 904 bp, Oryza sativa
cttcctccacctcattctctctcttctctatctcttcccctcttcctctcttcctccctagacgcgcagtgaatgttaagctcgagcgttgtcaccgtctccctctggtgcaacccctccctctcccttggccacgcacggctgtgatggtggccggtggtggttgctatgggcgactagttaggacttaggatgggccctcggtggatctgagtgatggaataggagaggtagccagtgagcgagagctcgccagcccatccgtggaggcgtggtggaggccaaaacggagcatcactgacccagcctcttcgcgtgctgcactgagcccataggtggcacgcttgcctgttcgcttccagtccgtgcgccttggcacactatgagccctgagttgggagagggaggagggaggaggagcggtgcaggtccttgccgtcatcgtctttgtcgccacagccgcatgacatggaggtcgaggcgaagggagaggaagaagatgaggcattggagtcacgcttcgcgggagagttgtcctgagttagcaaggagcttcaaggcggcggcggtgcagcgacgaggaggaagctcgggctgttgaatagttccacattggttgtggaaggctaaatgacctaatatataaacggggaagcccctcacctcataggctagcttttgaggtgagaaaggctctttacgatcctacaactggtatcaaagcctgactacttcaacatctctgacccgagagacactgtgtgaaggcctgatggaccgtgcatgtttgcgggcttgtatatctgagggaccgtggggatacgatgaaagggcagtgaatggttgagggacatcaatgttgtgaatgggggagattgttgaatagtcccacattggttgtgga

SEQ ID NO: 65232 - DNA, 2296 bp, Oryza sativa
tcatttttacaaatgtaaatttaaattagcattatatatttgtcaagtgatatcagcctcgtatgttaagattgaacgaacaaatatcattgatgggatattttatatttataatatagatttagtttaacaatgatttgtagagtaatatatttatctttaaatagtagataatactatttcaaaagaccatccatctttttcgaatgatacacctttttttttatagtaaaggattttgaaaatactatttcaacagaccaccgtgcatagatttttctttgttccgaactttcgatggatagtggttaagctttatttctttttccaagtcgtatgtacttacagactacttatgctctttttctttttctagcctaattgatatatggatctcccgtatacggacacagagtaacaagttattagtttttaaaataaaatacatctaatctaatggtctaaattattggttcaccaatttaattaaaaatcgacggtgatatttgcttaaatttatagagtaatagattttatctttaaatattataaaactctattttaaagataatcaattttttagtggtactaagcacgtatgtttttttttgctttgttgttttgttttttttgctttgttgtttttatagtaagtctgtgcatagttttttttctttcgatataaacagtaggtaatagattcattgttttctattcttacgtatgtacgttacctgtatatacgtatatacgggatggatgcatatgtccgcgcggggtaaggggaggactaaaatcagttttgttttctttttccggtgaatagtagtaaggtattagtttctttttaaataaaatacatctaatctaatggtccaaattatcgggtccaccgatttaaataaaaatcgacagggagattagacattaccacgtggtggtctagaagcgtttgtagaagtgccacgtggcgagtttcatggactttttagtataatagatagatagattttttttaaagaaaatgatactcccagctgagcaggatgccaggatggaagggaaagcgctgagaatgaagagttggaaaacgtgacggttagaactggtacctcagtcgagcgtcacaggcaaccacatccgttgacccagcaaccagagaggaggaatgcccgtggaaggtcccaacggaaattaggtgatctcgcatggcccatgtatgcttccattccacccgtatatttggcgcgtctagtatcgtcaaatctctacccatgcacatggtcactccggaaatgctaatgggcgggtgatcgctcccccgtccgcccaacgatcaccctttactcctcccctatactcagatacactcctccctcctctcctccttccttctcctcttattctctttctactatagtacaccgcaaattttttttaaaaaaacaaaaagttagaaaaatttatgtatagaaatactatatataaaaaatttaaatttaaattcaaatttgaatcggctatgtaaacttttggcttataaactttggatctataaactttaggcgtataaactttagatgtatagaaatactatatatataaaatatttgaattcaaattcaaatttaaatcggatataattcaaattcaaatttgaaacgggtatataaacttttgacttatataaactttagatgtatagaaatactatataaaaaaatatttgaattcaaattcaaatcagatataattaaaattcaaatttgaaacgggtatgtaaacttttgacttataaactttgggtctataaactttaggtgtataaactttagatgtatagaaatactatatataaaaaatatttgaattcaaattcaaatttgaatcggatatataaacttttaacttataaactttgggtctctaaactttagatgtgtaaactttagatatacaaactttaggtgcataaatttactaaaataggaaagtattacagtgcttaaaaaaaaaagaaaatcaggtggagagatggaggggggagggggattgatcgctaccccatcttccggcgatcgatcgcccagtaggatcctccggtcactcacacgaaccgtaagcgtctgaccatgtatgccgggccaccatccgtggtccgtggacaagggcaaggctccgaacggccgaacattcccaaatcgtatcgaatgagggcctactggtggcagttagtacttaaccatcttctgccgtatggagcgggaccacagacgggttacaggagttgaggagt

SEQ ID NO: 65233 - DNA, 9683 bp, Oryza sativa
ggtatacctgtttcctgatctttggaaagtttggaaatgttaggttgataacatataatacattgataattaatggttggtgagtggaataaagggaacatacttcctcatctgagacccatctcagtgctgttgatagagttcctgaatcagtgactatccttagacccttttgctttgtagtgtccatttgatttctttgttcctcatcgccccaaggtttaatacggtgaatggatttaaaatggcgttgcatatttcttggaatgcgcgaagctggatatatatccacaaaacctggtttgttcataacattttcactgaacctggcacagaaaaaatgagtaagttcactagcaacaagcaaatttatacattttagaacctcaaatcaacaggcatggcattaattacaattcacagaatcaattcagtgaaaagaaaggggcggtagggaaatgtactggacaggcaaagaaacaggaaagccacaatggaactgtgcagttaaatggaaaaaaaaagtaaaattaatagatatccttatagcgatcagaatgccatttgaatgagagaccatttacgaatacacttataagccacatgcatattgtgtgtgtgcaaggagattcaatatcatttctcgcatttctaatgataatggaaaagagatgggaaataaattgaacaagtgcatcattgaacagatcgatatacaccttagcctcatacttagcactagcagtctgtgcataaactaaaccatttatacattagtaatatgatgatgtgaggactactaagaattatttagtaggtaatatgatcccgctatttttaagcattgtaacagaacagctatacagcaaattagcaggcagtaagacagcttgacacacatccctatagactctatgcagtcaaacaagctaaataatgatatattttcagaacagaagcatctcccaagggttaatatgaactcaacaccatatatgttgaacatatatatcttaccaacaagcaaatgtcaccaaataatgagatcgcttgctgatagtaagttgcagtctggcagacatgcaactggaacaaggaatgcaaagctaatatgaaaagttcaacaaaaaatagtacaatgacagccactgtctattatacaattcatgtacctactttcgacccagctgggcaatctcaaggttcagatgattaacatgttcgagtttatctgccatggaagaaattatacttttagcaacactcaagtggaaaacaagaagcaccagtataactctagtaggccaacctttaggaagatgaattccccctttctcaaagtcaacacgcaaggtggtggctgcccttcgagcttcctctgtgagcatgacaccttcgctctcagctttaagtattgcattgtacaaagtagtattggtattcagatactgcatagaatcacagggaaaaaggaaatttaatggttctgacttggtcatttcactaagttctctccctcattttttcctcaaaccaactatttcggtatgcaacatccatgttatcgagcttacttgaagatgttcataaatcctcattgatgccttatctgcctcatccataaattccctggcacagaatacacatgtaattggccactcaaaactaaaacacattgctccagagtatgattttcataagaagcaaccagtaaccagtgtacactcacttatctgggtgcgtattcctgcacagctctgccgaatcaataactgagcagacctaaccaaatcatcaagtataaaacgcacatcactccctcaataccaactcaagtactaattccgcaaaaaaatcattagcagaagaggaagtaggctacagtgttcgatatctcatccatggcgcggacaatctccgcggacggcggcagctgcccgatgtaggccacgagctcgtccgacctgcgcgtttcagtaaaatctcagcagccaatggatggctccagcttccagatgagtaggttgcggttcagtatctccaccccttacctctcgatggcgtcgtcgacgaagcggcggaagcccttggccgtgcgcagcacatcgaagccgtacagcccggtctccggcctcgccgcggcggtggagaaggccgccgccgcggcgcggcggagagaggctgcgcgggagagcattgcggaggcactcagttgattcatttcgacagccacacgtctccagagtctagacctcgccgtcgccgccgccgctgctcaccggaggagcatgggcgagaggaaggggatggggtttagtgaaagtgaatgtaaaattcaattctgtgagggacctttatgagaaaattcctttcgccattctctcctggatctatcttggccgcctacggttcatcgaacggttaagacaagtccaacgtggatgcgaaaaatattcgcagggtgtaaacggaaatacaatattgtatgagggcttatagggaaaactatccctctgggctttactctcctcggtgtgggccgcgtattcttgatccaacggatcacaacgagcccaactaggatggctagggctctcatcttttggcccaatcagcatatgccaatgccaacatttaaattttttaacttaattttgaagttgtttttgagtttttttcatcatagtttcttttacaagattgtcatttaagtcgctacgaacataactgtaaaagttttaatcacaaattatattttttttactaatacgccaaatggcgtattttccgcacatagccatcggatgaggctgtaggtttcgtcgtcagtgcttggctgaaaattgaaatcctctttttcaaaaaggaaaaaaaacagagaggaagaaatccactcaaaatcgcaaggcaactttttaggaagatcaaatcacaggcaattgaagctagtattggcaaactatttgtgttggacaatcacatcgagaaaatatgttgagcaggagtagaagataaacaattcatccattacgctttgatcagcacaggtctaagtacaacacaatgtaagtcttctgacttgcgacattgatacacagcaaaacgaattctgatccaagtacagaatgatgatacagccaatcaacaaacaccgtcacatgtaaatcctctactgtggcataagcgataacatctctgatatggaaccaaaattcttatgccaatacagaccacaacgctaggaacaagctcatcaatcctggaagaccaactgacatagtgcgatgaccagcgtttttgccacctgatggagaggctgcaaacaatagaattaagaattgaggttaaaaaaaagtactctgtaaagtgttatcgtgatgttacatgcgtaatcaattcgaataaacttttaattttaactattttacatgtgagaaaaagaggcagaatgggatctttgttatcctttactttgctaatgctacatgtattcctaccgaagtaatataatgcattgtattcaaataaaatggctacactacttcttaattgtagacacttagaccccacattagctctataaaaaaaagacccagtgtttgctatccctgaacattgaacgcacgagtatccatagcaagtctggaattttgaagaatttgatacatctacttcatggctagtgtgagcgtaaaatgcaaaaatatcatcgctaaataaactgactaacagcagtaggatgcataaatataactctgtaaggcagtctgatagactgttactaatagcatgccagatgcccaggtcaacacaaactgtccgtgttaaccatttctagcctctttcaatgatgctagttagcctgatcacccatgttatttggttgatttgccgacttaaaatgtaacatctttaaataaatttgttcagaccaaactaactcctactttatgcagcatttattatctgtcttaactgctatggttttagcaccataaacattttctaaacaggtagtatcatacagcagtgatgaaccttcaaatcattgtgcttaacagtagtccacagtaatccttgggaccatgtctaatacatgtctaaccatacatattaattcattcatctatttaattggggtccaagttcacatcaaactcaagttgagggatttcttcctacagatctatctgatatgactttatcaaaatgctgctgcttccagttgaaattcatagcattaaaaattatcggaccagacaaaaagtttcaggtagtgaggtatcgcacatataacaagctaagaaaatcttaagtttaaatagccatgcatactatcttcagaaagtatatattacctggaggagagttcgtaggggaattccctgcaaaatattattgtaggacacttatcagaaaaccatacaaatatatgtattaaaattatctaaggaaaaggacggttgccaaatacaacagatatagtagcgaactggtgtgacttccaaaaaaaaatgaattttgtaatgatgtttggtaaaagttaccagcacaacaaaacagtgctaaacaaatctagattaagtttcatggttccatttcatcaggtcaaagaaattagctattttcctagttgatttataaacatcatcccaaatgtgaaatggctacaatactatatccaacggtaggctgagactaatcattcaactagtattatacccaaggcgaactggtataatctgacatcgttgcgtcttcagattaaactacgattattacaggacaggactggggaagcaaaaaacaggaatctggatgcctacaaacttctggtcgacccaaatcatggagcttggtcttatattcacacctaaatgttttttctttgtttcgttttgccctgatagagacagaaatgcaaagccaacttccctacgccacttattgacttatgcaacaaaaaggcaaaaacattcctttactttcccaaatttgtagtaattacctttttttttcgccggacaaatttgtgttaattacatcgacttgtcactagaaatatgacattatacatggcagtaagaacagtttatgcggccgtttgtttaaaacatcctaaccggatttatttcttcaaccacagtgcagtgacttcgatgtgcaaaccatcattccatcaaccaggcaaacaatgcattagcaagaacaaggcctcatatttattcagtgtaggaacagtcaaatcatgctatttgggtgagtttttggataccaatattacaaaaattaacaactcatgatcgatgccacggtgataatttctatcaaaaacaacatattctctctctctctctctctcttttgctgttaaaagaacaagggatagaaggaggaggaggagggtaaaataagttggttaccggggcacatgctggtggtctggctgatgccgcaccgcgtggagaggcggagggcgtcggagatgttgatgttgaaggccttgaagatctccggcgaggcgtagaggtcgcagaggcacttgagctcgttcttcaccgcctccttgagcgggtcgcagcacgccgccggcggcgtgtccgtcccgttcatgtactgcgcgcacggcaccagcttcgacgcgcagctcggcgtgctcggcgacgactgcgccgccccgcccgccgccagcgagatcgccacagccgccaccatggccgccaccgccgcagccatccgcgtcgccatctgtctctctctctctctctcccccacgagcaccgagcaaaggtggtgccttttttttgtgtaagctctggttacacttggtgctgtaggtgcgcccctggactctgtgaagcttttgctttatagaaaaaggaggaattttttttcttcaggtatttgagaacattcagcaattgtacttttcaggttctgactgtgtttagttttcttcaaacttccgaaaaaatccggcacataaaatgtttgaacacatgcatggaacattaaatgtggacgaaaaaaaattaattgcacagtttacatgtaaattgcgagacgaatcttttgagcctaattacaccatgatttgataatatggtgctacagtaaatatttgctaataacggattaattaggcttaataaattcgtctcgcagtttacaggcggaatctgtaatttgttttgttattagtctacgtttaatacttcaaatgtgtgttcgtatacgtcaaaaaaatttttggaggagaaactaaacacggcctctgtttggtttggggattggcaattggacatccaggaacttttaaatttctactatataaatatgtgaaaattccctccaaatcaaaccaggtttgtcaacattcatcaatttggcaatattaaaaataaaaaaggttcagctatttgaaaaggactttgcaaattgcagaccaatttatggtctccctctttaatgccggcttctgcttctactactctgaataaaggtttgaatgttttttttgtaattaagttgtacttgtacacgcaccctctgatgataaaggtttgaatgttttctgtaacacaaaagatacatgttgatgttttagaaaagtttgtggtcaaactcttagaggacatgcctgaattttcaacaatttgcaccgaagcgtagacctagaatctaataacgaagcaacacaaatccatccgaacacctagcatcggatgattatgtggtaggtaactttaatttaagcttataagcgatgagtccaaagtagttgttgtaaatggtcatttattattattatttgtaaataaaagtgcaaagttgatagaaaaaccctctatttcgcttcaaactttaactatactatcagtctattacccccgtaggcggtaaaaacacttgctagcaactgtatggaaatatagaacacgcatttatcctttccaaatcacatgattaacgatcaataatgtctagaacagttagtaaacactacttctaccaaattctacaacagctaacccaggacgctgctctgaaccttccagtcagttgacttctgaattctgaccaagtctcacctatgcctagaaattactccctccgtccttaaaaaaagacaaaccttggtttccatgtccaactttgactgtccgtcttatatgaagtttttttataattcgtattttcgttgttgttatatgataaagcatgattaatattttatgcgtgacttgtctttttaatttttttcataatttttttaaataagacggactgtcaaacgctggacacggaaatcaggtttgtctttttttttttttgacggacggagtagaatgcgaaacagcatgtcagcatcatgtggcgaagagacttctctgtttttccccatggttggagcactgagacagcatgaactccccgcaacctctcagatagtcagatcttgactagaacagttgaacattttgttcccagacaaagactccaaggcccagttcagttaaagtttttcttcgaacttctaactttttcatcatatatcaaaacttttctacacacagaaacttttaacttttccgtcacatcgtttccaatttcaaccaaacttctaattttggtgtgaactaaacacagcctaaaatgtgaattttgaccaaaaagaaacgtcacattaaatgtttggacacatacatagggcattaaatgtgagaaaaaaaaaccaattgcacagtttacatgtaaattgcgagacgaatcttttgagcctaactataccataatttgatagtgtgatgctacagtaaatatttgcttattacggattaattaggcttgataaattcgtctcgtaatttacagtcggaatctataatttgttttgttattagtctacgtttaatactttaaatgtgtgtccgtatacttaaaaaactttacacccaataaactaaacaaactcttaagttccttgtgaagatttggactgagcatttgatcaatgttgctgaacaaccatgcctgtaaagaaagtgtgaagatgtttactgtactggattcctcttgaaggtttttcatgggattgtgatgataatcatgatgattagctccaagcaatcatcatgattaaaccgagcgtgtccgaaaactttcagccgtggatttcagctactcatgttgtccgaagcttctgtaatgattccttcagcaagggaatctccatcatagtacttgccaaaagaaatgagcaaactccgtcttcaggtcgatcaagtacctgaaggaaggtagataagcatggtcattcttcattgtatgatatgcaaataaacagtgtaaagaaaactgatgtgagtatgaaaccatgaagagaatatttgtaaattgcaactgctaccaacttgctgcattaaagcaaacatagtgcatgttaccatctgtatttcactaagtgaacctagttcacatgtgttttgtgacggataggcctccaatcaccaattcaagagtaaaaacttaatttgtatgcattcactttacatgattattcatctcccaacttgcagcctaaaactgaacaatggtcaagagggtagttcatccagttaaatttaattgtaacatttttttaaaaaaaaaatgccgagcaactcaatagcagggagtggagacagctacaggaaccacatatgtagagacaactcataatcatgataattatcagctcatattagtactcacataagtactgtataccacatgggctgcatccaataaatgttcatgttgcctgcttgatcagtgtggtttggcagtctcattaatagatagctgctataagggataaaaaggatgcggtccaactatccaagtccactatgaacaaggcacagcacaatactggtaggttaggtgttgcagttcaagaaacggcacaagcaaaaacaacctgttgttttgcttctaattaaattaaggcctttcttctttttgacccccatgtgaccatgttaatagaatgaaattatgtttccgtcgattcgtcggtactattgcaaaccgtttacacaatcagtgaatcagaatcaaggaaataagttagatacaaaatttggtaactgaaaaattatatatacggtagttaacctttggattcatgtaataagctcgataaacacatgcagcgttccttatctcatctgtggtaccagttagtcctgttagatcccggaattctgttaatcgggcaaatgagaaaacagtagttagaaaatataactgaacatgataaaatgattagatgccgcaatttcagcatatctctctaagtgaaaatttaatctcaaagtgaaacgggaattagccacgtcatccaaccaactactaatagtgttgtagcagggtgcaaacaccttttcctccaattcggtcaaaacactacgaggttttgcaagacctaagtatccagaggggaaaacactcattctgagtggaaactacctttccaagaggaagaacaccttcccaaaaagaaaataccttcccagaggaagaacacttattcgaatagaaaatacctcttcgggtgaagaacaccttattagggacattacataatcgctaatacaactacacatattttggacaagttacaatttcacaggtgtttt

SEQ ID NO: 65234 - DNA, 1980 bp, Oryza sativa
aaagttgtgtttgctgttagagctcgtttttaaggataggcgggagaacacttctttccggcctatccccgatcttgttcgtacctaaaggtcacaacagtggcaccgtccgtggggacggaaagtctccattgaattgggctcaaacagtaaatgcgacgttctcaacgacagaagactgtgccagtacgctatacaggagcttttgcaagcgcgacagctgcactcgagagagagtgggaaaaggcagtggaagaaagtgacttagcaagagcaacggaaacacttgataagctgtgggcagagatggccaagacatccacagcagcaggaggtaatgaaacaactcaagaagaaagaattgctggtgcggtggtggaagaaacagggaaaacacccatgagtgatgtagagcttgctgaattggtccaagcgcaaggggctgtcatggtgagtaaaggacaatatgaggatcaagtgatcagtgtgcaataccaggggctagggaaaagcaatcagatcaggcaaaaggagatgcccagggggagaacaaagaaggagaaagtatcaaagccacccaagctcaagatctaccacgaacccaagctcccagtcaagtacaaaacccatctcaggctcaaattcccattcttacccagaatacacctcaagctcaaatcaccattcctactcagaacctagctcaaaccttgatccctagccaaaaccaaattcctattcaaacgcacatttctttccagccgcatattccaattcaaactcaaaatcctaaccaagtacaatatcctcaaacacaattacatcaaacccacccagttcttcccaatcaaatccaaatcccccaacctcatatcctacaaagtaatatcccacgaacacaactcccacaaaatgatacaccacaaatacaagttccacaaacccaaataccacagattcaaacatctttgcccaacttcacacatacgcaatcaacaaacactcaagcagctcaaaaccatcaccaagtcccccaaggtttttcccttttccatatgcaacaaccagagatgatgtttgaacaagggtacatcccacaaatggccaaccatatacaatatgcaggtcaaataccgaaccaagcctttcaattccagcccacacaaccctattttcaaccaaccagagcaatagatacaaagaatcccttaagtcaaaacctgcaaatggcaccttggccaataaacttcaagttgtccaacatcacaaagtacaaaggagacacagatcccaatgaatacctcagagtatatgagacagcagttgaagcagcaggtggagatgataccacgaaagctaagatactcccaacaatgctagaaggagtagcattatcatggtacactaccattccaccaatgacaatctattcatgggaacatatgagagacacctttcgagcaggattcattggggcgtatgaagaaccaaaagaggcagatgacttgtatgccatgaagcagcttccaggggaaacattgagaagtttcatcgtgaagttttcaagggtaagatgtcagatcaggcatgtagatgatgaaatgctcatagcggcagcaaaaagggcattgctacccggtcctcttcgttttgatcttgctagaaatagaccaaagacagcaaaagacttgtttgaaagaatggaaagttttgcaagaggagaagaagatgagttgagagtgcaagaggaagaagccgtcttgttgggaaaaaagcagtcaaagaacaagcaaatttcccaaggggaagaacaaaagggagagaataccggaaagccctggaaaaagttcaagtatgactataaataagatcagaaaaaacaggtaaattttatcggagatggatccaacaatgaaagagaaaaaggaaaacatcaatgggacaacactcgcggagggagaaacaattgggggcaatctg

SEQ ID NO: 65235 - DNA, 1273 bp, Oryza sativa
tcttcaggtaatatgacagtagtccaggtttttagatgattcgcagcaaggagtgaaaataaattgatcagcactgcaacattgatctttttatgggttgtcgctttagctaccactctgcttatttgcaagctcgtgatattcatactttgaagtcctttcatatgatgctaatttcatattcattgggagcataacatggaataaattaatggtcaaagtatgttattgaacaccatgtaaaaaatatatcccttaaaaaatacatgccttcagtaataataggttcctttatatctctttcagtgcacccaattcttgagcttgagatgtgcaactaaacattttcagagtacagataagatagatatcaagtttgcattggctaactctttcatgaattatgtgtttgtggaaatggcaggtatggtttacaaccatacactgagagcacaaaacgataaatattatgtttgcaactttgcatgactagctggttcttgggttgggtatttttaaaatggactgtgttgtctatcacaaactctttgttttacctattaaccatacagatcatacatcttattaagttctattgcaagctgcctagctgtatgagaaaggaatatatggtcgttgcatgctagaaggatattcttttcttcatatatgaagtaagtgatatgggcctaacagtgacaattagagatgagatttctatcattcaagcaacatgctttggggttgttctccatttaagaaaattgaggttgtctataacttgggcagtgtaaatattgaagcatcaatgacagatatgcgcaatggaacaccaccatcagttttcttccgttgctttgtataccctataccatttctgaagatcactataataccaaaccaactgctaacattttctttatgaaacaggcaaccatgcggtcggtggaaaacaattagaggtacagtgtggagtggtttgcaatccagttagcaagcttatgcgcactcaagatgaaggaaggggatgatgcaatttggagcacctctttctgaccagatggactcaattttcacgggctcagaaactaatgaaaaattagttcatatgtatgttgtgcaggcaatagctgtctcttgaaaggttctcacagccttacagatcagtagatcacaatgggcaaggtcaagattggaaggaagtgagaacataacatgcatctgatgaaggaattgacagcaggatagactgagaataagccggtccttttct

SEQ ID NO: 65236 - DNA, 1057 bp, Oryza sativa
atgtcttcatcagtctaatacaaatacaaaccatcagccttggaaaataatacaaatcatcaaacatccttcatctacacgaacaaaagacagctcgatgccttgatctcttagttttgaattacagtaatcattacaagttagactgaaatgtaagtcaaaaaagcatcataggagagtttggattcatatgactgagttttgagttttaggtcaaaataaaatggagaaaaaactaccatattgactacggtattgcaaaaaatgcattcttaatacctattatcagcaagatacgtgatgggagccaccatgaaaagggctaagtgcatatgcaacatatatacttaatgcatgttccacgttccttggtaaaaatacctttcttgtgtttctgtttagtatctagctatctaccacctaaaagcgtccagaatacataatggacagaagaacaatgtcaatttaatttctagacaaaaaccaaggacaccaaaaaggatcttacaaatgtaaaacgtcgaggaactaatgtgaatgtgaagaatgtaactaataacatcaattatcaactttttccaaaattccaaacacgatataactgataaccaatttacttgatgccagccacacatcaagaccatgaccagttgatggtgttcatttgtgctacgaattatgtaataaaaccgtctcaaataatcaaatatgttaggctaaccagttggtgatgtgcccattaggtagttcactattaaaagtggttattcactgaatgaatgcttgtgcgtcttttggtgaatgggagtaatcatttttctcatcctgatgctagaaaaacagtggtttgaacttcatgcataattgtctgatgtggaggttggacaatttcaccttgaaggtttcctgaaacttcatatttcagagaacatatttctcaatgggaaaaaaaagaaagaggaaaaaggactgcattctgcactacgcgctcaaattagtaatattacaaaggttgttcaaacatacataaaagtatggtagcatgtcatgttaatgt

SEQ ID NO: 65237 - DNA, 584 bp, Oryza sativa
gcatgcctggaggtcgactctagaggatccccccgtgaagcctttgtaatgatctgagaaatcctctccaagtctatccgatgggtgtccagtaacaatcttgtaaccacataggctgtgtgaggtgtttagtgtctgcatttcattaggtcagcacatggccattcatgaacaaaagacatgggggataatagaggctagagcttctgacatcaaaccttatgggctaaatggagaaaaatgttaattaaccctatcacaggcggatcgagcttggacttttgggggctacgaacaaacaaaacaagagaagagtttcatccagatgtagaagagaaggtagggttaatgcaagcaaattcggtggagaggaaacctgtgtgagagagatgaatcacagaatcagaaagaggatgtggatgctaaccaggatgcagtaggaccacgggggccccttccttacccggttgtgctttggttgccgttgacatttcccaccaactttgggtttttttttggccttggctccagctgcggacactctcacgtcgtcctcctgtggatggactccaacctcgccccgt

SEQ ID NO: 65238 - DNA, 4799 bp, Oryza sativa
gaggaggaggaggaggaagtcatggtggtggttcccctcgaggcgcttcccgacgacggccttcctgcagcggcggcggcggaggaggaggacgtcatggtggtggaccgcgtcgaggcgcttcccgacgacggccttcctgcggcggtggccccggtggaggcagcggccccggtgggggaggaccccatggtggtgattcccgacgacgcggttctgcgcatcatcagcttcctcccgctcgagtccgccatccgcacgacggtgctctccaaggagtggctaaggctgtggaaggaggattggggccagaaatccaggcgctacgagatccgcgcccgctgcgcaccttccgtggaggacctcctcaagatcctggaggaggagcgccgcctcgagcgcctctccgtcgtcgtccacaccatcatgaagagctctcacctgagagaaatcatcgagagatccgccgaccgccgcgtcgagcagctccacgtcgagctgaccaacccgaatgttgtagacaaggtcaggttccacttgccgatcttgagccgcgtgatcgcgctccagcacctctcgctccgccaaatcgtcgtctccaagatgcgcttcaagccgcagcagcgcttcaacgagctctcagaaatctgcttccacttcgtctccatcgagagctacatgctgagaaatgtgatcacgcgctgccccaatctccgggttctggaccttcgcagctgctttgacctcgacgccgtcgccatctcgccgggcgggccgaagctgagcagtctcaccatcgccgggtgcaagcatctcaataaggtgaacgtcgtcggtgtaaccagcctccgctccgtcttctacagcggccgcttcctctcgtccttctacctgccgcgcacaagtcgccgctcctccttcaccgacctgtacatctgctacgatggcccgataatccccatggtgttcggtaaatgggcacaggatgcactttccaaactctccaatctctccaacctcaccatctgcagcaattccctcacggcctgtttggttggagggagtttttaggagggattgggagtttagaggaatggggctattaagagttttgtttggttgggagacatgagaattttggtaggatagggatggggaattgaggaaggaactccctccttttcaataattaggtaggggcaggtaattgggaaggaattcctcctttactttttttaagcaaatctcagccatccctttttattaatgacataatctccaactaaactccctatcaatttccatcacctctatcaaacaagatattgggattaaaaatcaaatttccatcttaatctcatcatcaattccctcgtgtaaactcccaatccccttccctcgagttaccaaacaagccgtcaaggtttgttctgttctgttctgttccgttggataaggatcatgttgttcttgttttgaaatcttttggtggactcatcgatgatttgatatccttcagattgtgcctagtttgcctgatgaagaacgaactacccagttgaaatggcttggcggctttcggcgtttgaaagagttgcagttgctcatgtttgacataaagaccatcaacgtgtttgatatctatgcgttcctccagagcttccacttcccaaatctgaccaaactcttcctgcaggttaatacattgcacctcataagcatttctggaatttggatatcgcattgcttaaagtcgtttcccccttttattgcatctgatgaaatctgcatatggtgttctcatctaatcatgatactcctgaacacgattacggtctgtgcttgcagctcccaagaatcagggaagatgtgcaggaggcggtgagagaagatgtgctgcagtcgatgagcgaaggtgtgccagagtatgccttagataaccttaaggtggtaagaatgatgaacttcaacaggaccagaattgagatgcatcttgtgaggtttttcttgaggaaagcaagaaacatcaattcactgcaacttgtttctctttttcacaatgcgattccgttgggtttggctgttcaacaaggagacatcatccaaggagctttggcgagtggcgttatacaagagagcaactctggcgctggtacaacccagccgtgtcattctgaggtcttcatcgatttttagttgccagtcaccagtcagagttatggccctatagcttgtaatatccgagaaactggaaagtgctaatcgacagtatacaaatatacataattttcacctttagtttcttttctgcatcttcaattttagtatcaccagagaaactgaaatgcatgatatccattatccaatgtcttgtgcctgcctgctttgtttttgtgttaccattcgcattatatttttcatagtatatctgaaatggcatctctatgaattgaaaacatctccaatacatctttcaaagccaatttgactatgttaaagactgaattgtgatcctatttttgtagtgtacttctgaactagtcatgatcttcttttcctgtttgttatcttgggtttcagattgcactaacagcgattttggatatactgcatgtccttgtgtttatttctgatatgatctatgggattgttacctacatatttctattaatctatcttcacataatttgtcagaactcagaagtagctcactgaaatgagctgttaaaattctggagttagtagagaattagtttcaaggtttgggttactaatattagtacatagaacacactgctttttccttaacctttactggcataaaatgccaaatgacaacaagtccaatggttcctttctttgacagtgcattcttatcggtgtggtcatacctatctgatatatacagttccacaaatttctgaagttacgtctcgtattatactgtcttgctgctgttttaattctgaagctatcttttgctttatagccctttgggtgactgtatattcttattggtgtagtcatacctgtcttttttgtttatgagaactgtcatacctgtctgatatattatatatactactatacaaacatccgagcttaccttttgtaccatgttgtgttgctgctgtaagcctgtaacagttcccaaagtgtttttcgcactctgttaattactgcattaacatgaattactgcttgttgtactgtttttgtatgtcctgatgtgccaacctagtcctcctagtgatcattattttgacatatttactctttactatctatgtgctagcttaatattcttcctgcttaatattcttgcaagtaggatgaagccacaaattcattcataaacagatagggtcaattcccagatgtcacaagcaacaccatgtcattagaatgcttgagattggaggtaaggagaatgatgtcatttaggtggtgtttgaatctcctaaagatgaagatgaagataaagattatttgaggtggtaataacgtatgattatttgaggtattaattattaaaaacttgaaaaatggattaatatgatattttagaacaacttccatatagaaagttcttacacgaaacacaccgtttagcagtttgaaaagcgtaccacgagtatccaaaagtttatctaacttttgttgaagaaaagaacaaggccttaggatggtttgctgcagcttacagccttacagcagtaggacagcaaactgaggcaaagcatcaacaagatagtctcattccagagtcttaggaatgtttgagatatggtttagaatgttagttgtgataggagctccattcctagggatcaaagttagtatttgcataatggagttgattgtgttattttcagcaagaaaaagatatcttccatttttctccgttttctgtgagtactattccgggtgggaactaggaatggtgaacacaaccttagtctctattcccttgcattacttatctacaccttgaacttgtttaacttacccttgtattagatttagaaaaaatatgtaatcaacgctgataagaaaatttatgaagcaatcatacttcttaaatatggtaggtgttatccaattaatattcctcttcattaagtatcttaaacgcatcttatgataaatgtctgtgtgaatgcgcgagctacttttctagttaaatcaaatagtagataaaattgagtagatagcatgagtgcatgacgtggatgccgagctcgttgatgggccaccatagaaaaatctgctgctagcaacaggtgagatggtgtaaagatcctcgatatattggtgaagtcatgcaaatcttcgtccgctggccagggtctcccctgctcgtcgatgaggtcaaggtatagatggctaaaaggcccgtccggcacgtcccgacccaagcacggcccaccagcgccatcgggctggtacggctggcccatgggctgcacctccggtccaggcacagcccaccagtagtcgggccgtgtcgggccggcccaaagacatgggtggcccatcgtgcctttttaaaataagtctattttccctcccttctatttgggctgtgacatatatatagctaaaataagtctattttctctccctcctctttgggctgacatatatatatatatatatatatatatatatatatatatatatatatatatatatatatatatatatatatatatatatatatatatatatatagctaaattaagtatattttccctccctcctctttgggctgacatatatatagctaaaataagtct

SEQ ID NO: 65239 - DNA, 23915 bp, Oryza sativa
  unsure (1)..(23915): unsure at all n locations
ttgtgtgtcgggcctggcctgcggcccatcgtgtcatgccagcccggccgtaccgggtcggcccaacgtgttggtggagggcccaggcacggccccgacccccgttgggccatgctgtgcttgggccgggccataataccgtgccgtggaccggaccatcgggcctcgggctttttggccatctagcctcaaggttgctcatggatgctgccatgttggtgttatcagctggcatgtatccagagcccatcggagtaacagatggagtaggctgaaatgtaacattagtaatcgccatgcctccaaaccagatttcggtggccttgacaactagacttgtgaacaatgacttggggaagcgaccgatcagttgagggtcattgttaaacccgtagtacaccaaccaatcccctgaagtactgtccggtacatcattaaccaaaattaaagagaaatactaaaaatgtatgcacttcgtccaaaaaaaaacgaatttaggaatagatgcgacatatcctagtacaacgaatttggatcagattcatagtattaagatgtgttacatctagtaataggtttgtttcgtggaacggagggagtaaacaattgtcttaattctcatgtatcactcattgcctggtaccttgagggtgtgtttagttcacgccaaaattagaagtttgattgaaattggaacgatgtaacggaaaagttggaagtttgtgtgtataggaaagttttaatgtgatggaaaaattggaagtttgaagaaaaagttaggaactaaaccaggcctgagtacttttaagttgatataatgcttgtctccatttggtttatatcttatacatcttgtctccatttggtttatatcttatacatctggtttatatcttatactgcttgtctccatttgtacttttaatttatatcttatacatttacaaaatttttttgaataaaacgaattatcaaatatgtgtttaaaagtcaacatcatcatgtttcaattccaatctatactttctatatagttggtacccactaaagctaaaactcaacatgtaagcataccacatcatcactcactagcaattactattctagcctattttaaatcccatgcaaacatggcatatatcatctacaatattatattatataaatcaacaagcatgtgtcaaatcatcttcctcacattattttttcaacatttcaactttcatcatttcgacaatatttaacatatactcatccgtgaatcccgcagcaaagcgcggggtatcacctagtttcttatatagcaatgacgacaaaagaagaagagatgaccggggttgatgagtggataggcgacaaagaaacatgaatgtggcgtttgccatgggagagcatgttataaaagttagtcgatatagcggaacgacgactaaccttcctgatcgcttcagtcatcgatcacccaagacatgccagataatgacacaggaacacacgatatttgttaacgaggttcagccgaagcctacatccctcgggctctgattatgggcgctcctccccaaccaatatagctcctagccgctatgagtccatggcatcgctgccatcctctccctgcgtgtctacgctacattgtagtcgccatggttacattgtggtgcccccctctctatttaagagagatgccgggttacagagtccgactctaactccaccccctaacacctattacaactccaagtccaactgtaaccaaataggactagtatattcgacacctattctaacaaactccaccttggtgaatatacgccacctagaagtagtagaatcatcatgctgatccaccggtcctccagacttgggttgtcttctttgcagcttcaccgcaagccgcccgacgagtctgcgccaaacccgccgccaccaaaagcaattgctatcccagcaaccacttcctcctggactccacctgcaacagtgcaccctcgcagcttgtaaagatgcgactccaccttctctccagtcatcacagtcatcttgcccttcatgatctcaatggtcttcctattccgattaccgcggaatattaacccttcttcatgcaaggttccaagcgaaatcagattcctctttagccctggtacatgcttgactccctgaagaacatgttcaccttcatcttctagcttgattttgacttcactgtcacgcccaaaaattcccgaatagaattccaagcagaatgtgcaataaaatccccgtccaggaccggccagggtacacaaacgacaatgttgacattcagatccacgtcttacaaacatcataaaagtcttacataaatgcagcggaaaaacgaaagacaacaggagctaagccttgactagaactgcagcgggaacaccactccacaggcatcctcgacagcacggacgaagcctactcctcggagaaacctccatctgacacatactcgtactctggggttgggaaaaatagagcaagactgagtactacccactgtactcagcaagtcataccggaataggggtatgatgcagggaattatcaaaggagagctagagtggttcatttgcataaaacgagcatttaaaaacaaaaattgaaagatttaaacagttgtaataattaattaatattgatcatccgctgtccaacgctatcccacgttgcaacaggcctaaccatccacctatactatccaatttcattagactaaactagggtaagactaatcacggtgaatctggttgaccgcccataaccgcgggcacggctattcgaatagttttactctgattagaggtgtacaactgtacccacaagacacagccccacgacacgtttccgtgcgccgacatgccaccacgacataccggaaagaggccgtgacaggacccttcgcataaccccctctagccaagcacaccacacctcaggtttcacccccgtccccagcgggcaatgggcagtcccctctcgtgcctaggtgaatccggaagcgacagaggccgtcgcagggcccgccccgctccatcacgcccacccttgcctggatgcgtcgactagaggaaagctacactacaagcccagccgttgcctacgctggcttgtggtaagtacgataagttcttccagggcatcccgcgaaccggtccttaacttccatgagtgcgactagcaaaaccatgcacccacagcccaccatgtgatttatttttattaaccaacaccaaaacggtggtactaaaccaaccttatcaattgaacctaaaggctatgttttagtgagctttccccattgtgtgctagtggaactaagcatggctaagcaattcctagtccaaaatctattcatgttataacccaagctaacaaaggagcatgatatcaaaatggcatggctgtaacaataggtaaacacctcatagtaacattataaaacaatgcaatatttgaagaaaaacaatagagcatttgcaatataggatcaacatgttcaagtgacaagcatgacttgccttgctctgctgctggaggaacctcggcgactatttcgaagtacaccggagcgtcggaagaaccgaaatctagcgacataccaggcaaacattgcaaacaggctataagactactgaaacagggaacaaaaccattttgaatggattctacacatttttcttgatttactgagacttgaatgggcttaaacggagcacggatgaattagttatgaattttagaagattcactgtgtttattactataacaagaagtccttaaatcatttattgcgcaataaatcccagggctgacgtcatcaagggggcgcgacgccgacatgcggggcccaccggtcagcggctcgggagagagggaaaaggggcgccggcaagcgggccccactcggcagcggcgcacgggtggtcggtctaccgtggaccgggaccacgcgggtggtcccccgccggtccacgggatcgacagcccggatcggcccggggccgattggactgtgcggcggcggcctggctcggctcggctcggcacaaagccgaccggccggccatggcaagggcggcggtacgcgcgcgtccaccggcgacggcaagcggcggcgcgggcggcggcagcggacggcaccccggcggcgacggcgaccaaaggcgacggcgagtgcgggtggtggcggcgcacggggaatcggggaaggaaagggaaaggggagggagtcctcaccggaggggatggcgacgaccggcgacgaggagcgacggagggaggtcgacaagcggcggacggggaccgggacgacctaaagaacgaaaaggaaaagattagagagggagagaggggccatagaaggcgggaacgccggccaaaggcggcggacatggcgactctcaccgtcgcacggtgggaatggtgctccggcggcgaacctcgacgaaggaggggtggacggggtggatctcggccacgcgaacccgacggcggcgacggcgctgtgcggcggctagcggtgaccggagtggcgggaaaggcggcggcaggtagatgcacggtgcgggagtgatggagagcttgggagagttcggcgaaatgggaaaaagagagagggggtggtggcggagcttaaatagggagagagggggccggacgtggccgggagaggcgggattccgccggccaacgtgggggagtgggagaggagagagaggcgggattcgaaaatcgattgtcgaatcccggccgtctcgggagcgcgggcgagcgggagagagggggaagtgggcgcgggagacgcggcgcacgcgcgggcgtggccgacgtggcccggaggaggcggaggcgtgggcgcggcggcggttgcgggcgcggcggcgcggcgcgaggtgggagacgggtccgataggtgggccccacctgtcggtgaccccgggagagaggagggggcgcgggctgagctggggcgtggcctccggccggcccagcaaggcgcggggagagaggaggggaagtgggccggcggcccactaagggaaaaggaaaaagaaaaaagaaaaaggaagaaaggaatttccagggatttaaatattgcttatgctcaattttaattggttaaaattatttctagggctctgaaaattccactaaaaatcctgttagtgaatttcaacatgtagaactcaagaaaaattccacatgtcagattcgattattatttgtattactttcttagggttttctcttgatttgcaccggcattttcttagggtcatttataaattaaattttagacttgggaggagaacttcagggtgtgacaaacacctactcccacggccggataacttgtgtcatcgcctaagtagacaaaaccaaactcaccagacttatatgaagagaaccactccttccttggcgtcacatgaaacgagctagctgaatccaatattcacgcttctgcatccttagactgtgcaattgacatcgtgagaagatcacaactatcgctatccgagtcatttgaagaagtcgctgcattagccttagtttttcccttcagtgttggacactccctgcttatatgcccccactcatcacatctgaagcactgcaccatcttcttctttttgttcttctttaccttatgcccagcatgatcttctttgactagaaaaccctccacttgagatgtttcaccctatttgttctttctcatctgatcacgagccagcaacgcaaaagtgatatctttagttttgatggtctccttgccgtacgtcaaagtagtcaccacatgctcatacgattcaggtaacgaacacaaaagaactatggcattgtcttcatcgtcaacttccacatccatcttcataagatcagtgactagttgattgaaaacattcacatgtgctgtcagatccgccccttcctgcatctttagcccatacaacttctgcttcagatacagtttattggtcagagttttggacataaactgagcttccaacttttcccaaattatctttggtaaggtctcctccatcacatggtacatgacctgatctgagagacatagccttattgtcgcagccgcctgcaactgcatctcctcccaatcgtcatcctccatcttggccggtttgacacccttcaaagcctttgaaactccttgttgagctaacaaatctttgaccctagtttgccacaagccaaaatttctggagccatcaaacttcaccaaatcaaatttcatacctgtcgacgccatcttgccaacccgcgacctgactggtctgtcgccaccagaatactcgcctttctcagtaccgtatgtattcgttttcacaatctcgtcttgtgatctgatctcagatatagactagcaaacccccgttcgctataatccgatgtgactaatcttccgccctcgatgtgcctctgctccgcacgatcttgtcggcctggcttggtccacccgtacctctacacagtaggcctatagggccccttgtacaacgtttgaccaatcccgccgagccacctgcttcgcttgattgctgacgccgagatgtgtagccttcaaaaacgctgccgcttcttgttgctttggttcgtctccctccttggctgcctatttaaagcacaaccaataggaaatcaatgcggccacgagtcggtgtccatacacgactgcatctgattccgtaacaactgcggtcgaattagccatatccgactctgacaagtcgattttttccgccaactcctccagccgatttcttttggcccaccaatctctctctgtcagcttttttacatggccctgccatacaataaacacacatgcatgcagacgctagtgctgctccttgatctgtacgatagccatatatcaatgcaagccaactgcatatacacgtggcctttcgaagtatgtacaatctccaagactgcagcttccaggtccatgcgcatgtgattgttgtatcctgctcgatttggtttttcttcttgcctttgctcgttagtctttgcacgccgtacgtataagatagcacctgtgctatctgtccgtgactatgcacgtaccgcagtcgcagccctcgtgttcaccatccacgaccccgtcgtccaggccctccacgtccgccgcgccgcgccacgctcgtcggtttcgccctttcgtcactggcctcctgctgccgcggatccgcgatcaccgcgtgcatcggacgcgccgtccatggcgctacccctccaatctctccagtcgccttcggccacgcccggccccgtcttccggtcacgttctgccatcgccggtctgatcgcgagcgaggtcgccgcctccgcaacgtcctcgttgtcgccatcgatctcatcgccacggctgacgatctcctgtcgatgcgcaatccccacctcgtgtttcctcctccacatgtcttcttgatccaatgctgaaaccttatgctctgataccacttgttataaaaattagtcgatatagcggaacaacgactaaccttcccgatcgcttcagtcatcgatcatgccagatgacgacacaggaacacacgatatttgttaacgaggttcagccgaagcctacatccccggggctctgattatgggcgctcctccccaaccaatatagctcctagccgctacgagtccatggcatcgccgccatcctctccctgcgtgtctacgctacattgtagtcgtcatggttacattgtggtgcccctctctctatttaagagagatgccgggttacagagtccgactctaactccaccccctaacacctattacaactccaagtccactgtaaccaaataggactagtatattcgacacctattctaacagagcaagccgaggagtgataaagaagtaaagtggcggcgatggcaaccacgtagcacacggagctccatacaactctagccaaactaccaacgaaacaatggcgtcttttgtaagcattgtgtcaagggaaatgcctagtcttttgcaactcgtatatctgaaattctgaatgatgatggggggcctttaactcgacactaatacacaatttgttcaccacttttgctgcctgaagctattatcctttgcatgtcaccaaatgcttcgtcataacttgttaatcgaaacgttaattaatagaaacagttaccccatgaaaccaattttgcattgcacacacaatacacgaacatgaatcatgcttttgcagcacacgtcccacatatagttttgataatggttctgtacacggtataagttttaaaattgttcctccaaaagaaaagcagggaagaaaaaagaacaagtagcagctaccgtagtagagcctgcagaagaaggcaagggagagcaaataaggcaagaaagagcaatagggaaaaagatcgagtggcaacttcggctgtgttgagatctagggtgaaaagttttagtgtgtcacatcagatatacggatacacattttaagtattaaatatagactaataacaaaataaattacagattccgcctgtaaactgtgagacgaatttattaagcctaattaatctgtcattagcaaatgtttattgtagcaccacattgttaaatcatggagcaattaggcttagattcgtttcacaatttacacgcattctgtgtaattagttattttttcgtttatatttacatgcatgtgttcaaacatttgatgtgacatggtaaaaaattttgccagaggatacaaacagactcttcattgatcctctgatcatctccatgacattttgtaagataagccaaaacttgttggctctgagtctctgacctagaggagtgccattgcatacatcacacatgcatgtatattgttgcactactgcgttgtatgattggcctgttgttgttcagaacttcaggttcatggcctcatgggattgaccgagagaggagaagcagcgcagttgactgtctctctctcaggaactaccgttttttaacaaattgatccttttcaaaaacttatttcaaaactagtccatgcaaaaaattttaaccaaaaataggccgtggactcagcgccattgactttggcgctaagctataacgtttcagcgccaacgtcatttgcgctaagctctaatccgaggtggcgtgagtacgctgagtcatcatagctcagtgccaaataacttggcgctgaggtcccaacgatttaaattaatatgaagacatatctagcaaagttccactgatagcataatgctagtagaggtctactctcaccttgaggagcagggtttgattcccatccgacctttttttttctttttagttttccctttttcttctctctcactctttgtttttttctttttctctctcactcactctttattaatatgttttttctttttctatctttatttagttttccctttttcttctctctctcactctttattaatatatgttttttatttttttctctcattttctttttctatctttatttattttttcctttttttttctcgtaatactatcttcaaaatatatgtttaatatgcaaatttttttgaatttgaaaaaaatatattgaagtggtatattatatggcaaatgagaacttaaactgaaatttcaaataaaattcaaaataaaataaattatagaatctgaaaggagcatatacttctttcatattggcactcaaaatcaaattcaaaataaaacaaatttacaaacggaacagttatttttgtaaacaataagagtgagtaggcaagagataaaaacccaaaaatacaaaattcaaaataaacgagttattgacgcagataaacgagcagacctgcgcgcggcagcagcagtactgtaccagtaccctggtctctgaccggtcatccgcatcacaaataaaattaataaaaatccagatcatgtactcctacacgcagggagggaaaagagatcagagaataatatgattcctgtagctcataggtttgtcaggatgatgcttggaactaagggtgtgtttagttggaaaaaaggaaatttttgggtgtcacatcgaacgtttgaccggatgtcggaagtggttttcggatacgaatgaaaaatctaatttcagaactagcctgaaaaccgcgagacgaatcttttgagactaattaagccgtcattagcacatgtgggttactgtagcacttatggctaatcacgggctaattaggcttaaaagattcgtctcgcgatttcccccataactgtgcaattagtttttctttttatctatatttaatgcttcatgtatatgtctaaagattcgatgtgatgtttttgggaaaaatttttggggaactaaacgggccctaaatacaccatccttgtcattatcatccgtttcaaaatgttcagtggtaactaataaggtatgtgatgtatcgtctaaaaaatgtgctatggtaacctatgtgctacctcatgcatgtcgcaatacatataccatctataccagttgatgccacaatggataggcattctgagcaaaggatgtgcttgtgtcaacaatatcatacagccaggagaccaaggagcaaagactgcaagagcaagagcaaacaaccagcttgggcatctctcagcttttcgatcgcctgaggctctgagctaggacagctttttttttccttcttttttttgagcagatgacaagaacctgttgttaccttaattggatcgaacatgttggacctctgtccgtccaccagcccaactgaacaacccaacagcagcagcagcatttcgaacaatgttgtatgagaacgaaccaaccaagaaaaacggagcggtccattagtacgtgattaattaagtatttactatttttttaaaatgaaacaatatgatttttttaaacaactttcgtatagaaactttttacagaaaatacaccgtttaacagtttgaaaagcgtgcacgcggagtacgagggagaggggttggtaaccatgggtgtgtttagttcctgaaaaaagttggaagtttgaagaaagttgggagtttgaaaaaaaaaatttaagtttatgtgtgtaggaaagtttttgatgcgatatgatgtgattgaaagttggaaatagggaggaaactaaacacggcccatgggttgcaaacacagcccaagtgttatctgagtctgactggtggacccacccgtgggacgagcccattttgatgatggccaatatcagagggcactagagcagagctgggctgggcagcagctcacaagacaatcgctagctagctttgagactttgagagtgaaacgagaaccaaccgacacacaaagctcagagacagagagagagagagagagagagagagagagagagagagagagagagagagagagagacatggagtactccggcgccggcggtggcgcgcctccccctccacctccctctccgccgagcgtgtacccattcctccctccggccaccttcattccaccaccgccgccggcggcaacagccgagccgtacgctccaccatccttgatcatctccccaccaccatcaccatcatcggtcttgcattactgggggttggctgttgcggttgtcttggtcgcatgtaccatctccatctggatgggatacatgctcgcaaagttcgagcgccgccgccggaggaggaagaagaaggaggagaaggagaatgcggcggccgggttggcggcggcggcggcggcggcgccctgcagctgcaactgcgcctgctgcggaggtggttcttgtgctgcccgtgttcatatccagcagcagaacattttctcgggggcagccgcaggcgccggcgccggcgacgagtacgacgacgaggatcgctgctgcgaggtcgggctcgcgatggtgctcgtcgcgacgacggtgtgcggctgcagcatcatgtgatgtgacaccgaggcgcggcggcgggcagagagcttcgaggcgtagacggcgaccacgcggcggcgatgcatgatcggtggaaggaagggcgccttcgtatcatctccctaccagtagactagactactctaatttattgcggtttctagtgtttcttagatttttctcttgtactataaaaaataaaaatacccgtgcgttataacgggtgaagtctattttaatcttattattgttatatggtttaattaaaataaaattcactgctagagttcgcttggatatatatatttttagaaaatcatgagctgcatttaggagtcctatcgtctcaagttagcttgagagttcttttaaacagatttcttatgcgatttcttatgtattaccaaaagtgaacgatcttaaaaaccgacgcaaatacgaatatgtatttacaaaagcaagcgaacttaaaaacagactcatacacggatgacgtaccaaaatactaataaaaatatcttcaatttttataacagtagagatctagttgctgcaatgatgaaaaaaaaaacgttctgcttattgagtcccccttccctacccgacgaagctgacggcaagaacgcggcacgccggcgccgccccggcgagacgccatggccgcgagtcgcgagagcgagatgtgttgatgggccacagatatgattatgggccattgcccattgggcttttcacatactttttgtctgtttgcggaaaaagtacaccgaaggtccctcaacttgtcatcgagttacaaaatcgtccctaaccacaaaaccggatatccagtgtcccttaactaatcaaaaccggtcacaatagttacttcagtgttttttgacccgattttatcctacatggcagttgagttagcgtggaacccacatattaggctgccacgccatctctctccctccctcctctctctctctctcactcttctctcctgttgcaagccggccggcggcgaacacggtggcgcggcggcgccatccgggagggtggtgcccggggggggggggtgcacgcggcagaggtcggcggcgccggtgccgaggaggaggaggtggtggcgctgttgtcgtcgtcgtcctcggcgccggggaagaaggtgggcactgcggtggcggaggcgagggggttgccgcggctggtgcggttcgcggagttgccggactatttgaaggacaacgagttcatcctgggacactaccgctgcgagtggtcagtctgcgacgctctatgcagcgccttcgcctggcacaaggagaccctacgtctggacgtaggtcgccgccgccattgctatatttttgtcagtggctactttcaaagagttctaaacttgacgtaatggtgacacttgatacattactccatagaatgaaacaattaatttcaagtccattgtaaattactaaattctataaactacaaaaattactgttgtattacataaaaatcattgttccttttttcagtggataaaaggaatcattgttcctaatatgccatcactaaaaaagccaataagtaaacaaaactagtaaaataataaagtacatattatgagtgcacgatgtggctaccgagcttggagttggtgactgcaaggggacaccgtagaaaaactggtcgtcgacaatacgggtgtaggaatagtacttgggggtggaggaatagccacccaaatgttaaacccgtagagcaccatccaatctcccgaagcaccgtcctatacaaatatatgtcaattaaggagatatatatattaaaatgaaacattacattcgttctcttatttataaacatgagagattaatttgaagctacttctctgttttataatgtaagagtttctagcattgtccatattcatatagatgcactaatatctatatgaactagaaaagatacccgtgcgttgcatcgggtagagaaaatttaatttgtacatatgtgttgcaatggataaataattacatcctattgtttcatttattcatgtgcttatttgaatcacttattaccaaataaaagactatttgtgcgtgcaaatcttgtatatacatgttcttagcgacacaaaagcaaatgttgtaaaataaagtataataaaaaaaaccaaaaagtcgaattcaaggttaagttctaaaatttaaaatttgacttctaggaataagaataagccaaacaattaggccttcaaacacgagctcgatttgtcatccagcttgatctcaagtcggatagaaattgatgacggacagaatcagctggcctcattggttcattgttgctgaggctgattctcaacaaaagcccatcagttcatttattgggctaaataagcatcagccattggtagtggatacaatcattcccgactctttttctacggctgatggaaatgattatgccgataagcatcagactgcttatgatgaaaagcaacatcataagccaattgatggatccgagcaatttcgattatcctttattttaattggcatgttcttttcaaaagtaaaataatcacggcgacacgcaaaggcgcgcgtggaaaacggactcagagggacactacatcgtaagaaaaaagaaaatgatttgacaaaaatataaaattaaaaccgattcaaatacggacgacgcactaaaattctggcggaaacattttcaatttttataatagtagagataataataattattattagttataataatttttaagtaatagttactttaaacattgaatatattatcatatcactctttacgaacattagctctacaatttttaaaaataaattttacacccactatattatattgtgtacccattattatagactaaatttaataaaaaatatttatatatatatattcacttaaatcggtattggaccatcatatctatcttttcaaaaaaataaacaaagccttgaaatgctagaaaatttgagaaaaaacacatatcccttgatttttcaattaaatcgatagatgaccattggattagacttgaaaaatcctgttaatcactctttctaaatcctaatcattccggctaatcaatcttcctatctctaatgcgtaagtacggttcgtatgtaggtgttacatgtaaaaaaacgtatgaccggcaaatcccctctcactgaattagattaaaaagatctaatcccacctgatctccaagtatgtacgtactgttatgtgtgcgtgcacgatcagcacctcctaccggctaccacagtccgcgtactcttggcccgcattttatttacctcctttttttctagccacttctttttccaagtatgaatcggactttttttttcgctgtttttttaacacctttttgctgtttatctttggctttctttacggggcggttttttttcgcgtgatttttttcgtcaaaatcacagacgacggtaacctctggctaaaaatcggaaggtaaagaatgccagagagactacgcgattttttacatgggcctagacgccacatgatttggaacgcgtgggaagagaatcggatgaagaaaaaaaatacggcacgacatacatgcgcggtgaaaaagaaatcgaacaaaaaaatacggttaggtggatgaatcagacgacgtacgaaaatcatgggtaaaaatatcttaaacttttataatagataaaaatataagtaatgatagaaattcttacaatataaaatagagggagtaacaattatgcaagttaattagctaaccttgaatacattgagtgcgatgtattgccttgttccgtttagctcggagatgctagggataacgtcgccgggtcgtgtggatgcgtccttcttaggttgaaagccagggcagtatacgtctacacctgttgttggtgcaccagcagcggacatctgtttttcgagataacttatcagtatttatcagtatatatacaaacgacacatatatatatatatatatatatatatatatatatataaggaattaacaaaaaggataagaaatggaagtagctaaaatactatcgtaagttttttgagtaaaaaactttgtatagttgaagtgtaagggattcacccaccgtacgagcgaggtaaaacacagggcgttcatcgcctggtagaacctacacgatattaagacgatcaactggggattaattcacatcatggcatggtcgttaagagaaaaaaactgcagggatgaattaaacaagtgacctacacgccaaccaatctgaatgccgtcgaaactggactctttgttgagaatataggcatataataatttaatatattccataaataaattatgatattacatatatatatatatactagtattaacgcattattagacatgtaaactaagcagtaaaatatgaacagatcaaatatgcgcaacatgtcgaacacgtatcgaggtggcggaaagaccggttgctcggcaggaactactcgcggttgtgagcatcgacgaaggcgcgcagcacgcgagcggagaggaaggcgagccgtcgcggacgaacagggagcagtcgcgcgaagcgcttcccaaaaaccttattgccgccttctccctgtgcaggacgtcgaaggcagaggttccggagacctgctctcccgatcaccggtgcacgctagcgagtgggatggagtagtccacgagcgacggcgcaacacagaggaggaggcaaaccctagattgatttcgtgtattttgcgtgaaggtggcggctcggtttatatagagataggtcgcttgatcagggcgcccgcacgatctccactccgcgtaaccgaaccggataagtcgcccgtaatttacccggacgatttttcggaatgtttccaaaacaaaacaaatccgaattttcctgcagcaaaacaaaactgcaaaatgaggctgcatctgtgtaagggtgaggagccaattttacggaccattcaacacgtacgtcgtgcacgcacgccgcctgccaggccaggcgagcgagtgttccccctcttctctccaccacacatgcttcaagtggctagaagagcctcctcccttttaaggaggtccccctctcctagaataaacaatgtggtactaaactccatatgcatgccatcccatgaggtgggcttttatgattttctaaagaattaatcttcgaatgggccttagcccatctattaattccaacgctctttgccatcatcattattattatcagtttttacccaaactccggcataactgttcaattggccggggcttaaattgaagccataaacatccatcgttactataaatccatagtagccatcttcttttggttgtgttatataccctaccatctgaaaaaaaaacatggggcagatagataaataagtatttcataaatttatagtaggtgaaaaatgattgattcgtaaataaaccactttacggtgagtataagaaattaccatactaatagaataagaaaaaaaggaaagcactatgtttattgtggtattgggattatattggcatatactccctccattttataatgtaagccattctagtattttccacattcatattgatgttaatgaatctagacatatatatctagagcaattttacggtctttgaggagggtacctcatagtacttaggtaagtactaaatttataatagaaaaagtggtaccttatgatatctcctcaaggaccgtaaaattgctcatatatctatctagattcattaacatcaatataaatgtaggaaatgctaaaatgaattacattgtgaaacggagaaagtattaatgatcaatataaactaagtgtataagaaattatatactacttcctccgtctcataaaaaaccaannnnnnnnnnnnnnnnnnnnacggagggagtacgtacttacagaaataacgtacttacaaataagaaacaagagttatataccaaatgcaaaactgtttctaaatatcacgtcaaaaaaaaactgtttctaaataaactttggtcttgctccgtggaaaattcaacagtagtaagctttgaaaagaaaactcacgtgaacagcctcgctgtcaacagcagcacggttcaatggctgcacccagtttgatctgtgaacaagctctgcaccacccctctcctgatgaaccattaatcccaaggttacatgacttgtttcgaaaacgaaacaaaaaacgtatgttgaaaaataatcctttttttcgaacgaatttgcatcagaatgcgctcatggctatagcatacacctaaatccactacgcaatgacgatgcaccagcaatgtattgcttaccgatcggttcgtcgaaagcacaggaagaatcatcagcaagcagatcagaaggaggccggggattgtcgccatctcgtcgatctcaatagttagcaataggatttgtagcgatatgtagcaaatgcaataggtcgccgcgtggcttatgtaataatatataggttgccgtgtttgatacatatggaatgtgttcttttggaagaaaaatatgggaaatatggaaatcattttgaatgaaatatggaaggcgactcacgcttcaaggtatagatggtcatatggcccgaggcccaacgacctagcccaaggcacaacaatttggcctgcccaagcacaacacggcccaactgggatgtgctcgtgccggcccgacctgacagcaaggccgtgcctaggctgcttcctcggcacggtgggccagcacgaccaaagaaaaatagttgagggatccatcgtagacttaatttagccatttgaggtacaacccaaagacaagaggtatacaaaatagacttattccagccatataagatacaacccaaaagagaagagggaggacaaatagacttattctagccatataagatagcccaaagagataagtgagaaaaaatatacttatttaatagagaagcacgatgggctatcatgccttcgggcccgcctagcacggcccgagtcttattgggctgagggtgcaacctgtgggtaggcatggcctggcccgatgtattggtcgggccgtggctaggcccggtcatggctggaccaggtggcccatttggccatctatacttcaagggggctgataggcttcaagaggcctgataggtgggttttaaagaggcactacactggaccttcaatgtgtcgtaccacgtagttgaaagtgattaaaaaaaggagggacatcttatttgttccagtgaaaaaaacagagaaagccacaaaaaggagggacatcttttatcaaacatcagatgtccgcgtactctactacatgcatgtagacccaaacacactcgtggtgtgcgctggcattttcttagaaatattattattttaataaaaagtcacaaaaacaaaagttggtatccggatttatttgcaaaaatagggacctgttgaactagcttagtttgacaagccaggcaatcgaatggagcgcattcgacgggatcctatcaagtggagcacattcgacgggatcctgtcgatccagccctgagctcgtgctgctgccgtcgtcatcgtcatcctcgcagtctccaccatggtcgtcgcctttcttgccattgtcatggcgcaccccactgcctgtgtgctgcttgctgccgcgttgacgcctgctagcctcccactgctcctcagcgagaagtagctgcccgccatggacctccgtttgatcttcaacgtcggcgtccaccgccacttgcagccgcccgacgagctcctcaacggacatatcatccatgtcctcgagcatctcaattgccaccgtgacttgcttcaacctcttcgggaccacgcgcaggaccttcttcaccacgtggctgtcttctatctcctccccaaggtcacgcaggctcgcggtgggcccgttgatgcgcatcgcaaagtcgccgacggtctccccgtcgcggaacatcatgttctcaaactccttcatgaagcgttgcacactcgctgacttcacgcggtcgtcgccggctcgcatcttcttcaccgagtcccacgcttccttcgccgacgtcttcacggcgagcccgaccttcatcttcggtggtaccgcgtgcaagatggtggccaacgcccgcctatccttggtgaccgcttccaccgcgtcccacaactccagcgcctccaagctcacccgcataaccaaggcccactgatggtagttggccctggttagcagcagcagctccatgacgctggaattgggcacgacgcgctccacggaggcatcggaggtcgagccatctccgatcttcatctccaggctctgataccaaatgttggcttagcctaggaacactctcacactcatgaacacaaacaaaataacaaatgaaggagtatagaggcttcttatagtccggggacacaccaggagctagcctccatgccggccattacgccacgttccacaggacccgcttgatgtcgccgtgagccacacgctcgcccagacgacgcggcttccttcccgaaccatgcgccacgcacaccactcctctaacaaactccgaccgagcgctctgcagcacccctgcactcgcgatcatgactcgatcgacctaacaagacgcacacaacgcacactacacaacacagacacacacacacacacacgcacaggctcactcacgccatgaacataccatggcgagtttatttccagcaattatgagctcataaagtaattccaggccgcttggggagcctggcactcgccgtcgccgtcgccgtcactgtagctgtagccgtcgccattgccgtcgccgtcgccgtagccgtagctgccgacgtcactgtagccgccgacgccgccgtagttgaagacgttgacggtgtatatggggccggtgaagtggggcccagacggcggggccgtcgccgtctccatcgttgtcggctgcttgctgacactctgcttcttcttcttcagttagctgatgcaccaatggattacgcttctgacgccgacgaggagcagtgcggcaacggcgatcgtcgccaccatatacaacagcgattccacactcatcttgctgccgttggcctttgggttggtgttggagtcgacagatgcatgagtgtagatgccgccggcggcaatgatgagtgccaccgccggaggtggaagtggaggtggaggaggaggttgcagagccattgtgtgtagaaagtgaaagtctgtgtctcacattcgcatcgactattcatcatatagcctgatcgaggttgattccatggaatcattgggcttgttgtgaggtaatactagcattgtagtctgtcacgccccgaactagtcccgaccggaactagcccgtgacgctccaaattaacctgttaatcgataccagtcccaggaaacagtgctggtatcacagggagacagaatatcacagcaacagaggtctctttattatagagtagatgtacagtcatgttgggctgcggacagatcccgagctcacaactgcattacaaaaggaaagcggaagccaggacttggaccaatcaacacaggcgcgacttgggaactaggctgaaaccctaaaactcatcgtagccggcatgctcctggaagaactcctcatcagcaggatccgcttcatcttcttcagcaactgggggggattatttatatagagcaagggtgagtacgggagtactcagcaagccatgggaagtaagtgtttaatgcaggcttcaaggaaaggctggtgtttttgcaattaattttatttgaactcttttctgaaacaactaagtgagtgcttctcaaacgacacggatgagacagtgcgtctcgtccggtcggagtatgtgcaatgtatcagtctttagaatttaaacaaggttggcacctggccaacagctttttcaacggccacccgggccaacaacttttcaaacggccacccgggccaacaacttttcaaacggccacccgggcctagctgatcccatcagctacagatttttcaaacaccgaaccccttttcacacagcaatttcacaagcagtagtcaaaccaaactacgctaggaatcacctcacatccgtccatgaccgtgggcacggctgttcgaacagtttgttaacctctgcagagggggtacactttacccacacgacattactaacccggatcacccagcccgtggggatcagccacgtcgggagacctccaagctttcatgacaaggcatttccaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattcgacccatgtggtcgtacttgtcttatgtttggatgaaattccaaggaattggtccttaagtgcgagagcgggaaaccgtacacccggtacgttccccggtccgcggttttggaaattcatttagtttgcaagcaccgacccaggtgtcgggttttccaagtcttttgtaaaactccagttttacccaagttgttactcagattttaagtttgaaggcgaccgtcgatactggcacagggtgcacgaatatcgaggcgtagctggatggttacaaggggacatggtatagcaattaacaatggaaggatcaaatgcaacaagttaggtaggtctgccaatctgccttgcagacggaacaacagattaagtgcaatcctatcaatgcataatattttgcaagcaatataattagatttcaaatataggctcaaaatgttcaaaggtggcttgccttgctcgagatctggagcttgatcctcgaaatcctcgcactgcgggtcttcgggctccgaaactacacgcaaaacgggacaactcaacaaacggcgaaaataaagccctattaatgacctctaagcgtgccattagatagatctcgagatttgagaaattttggaatttgaacggagtcaaacggatttacggttggaaagatattgaatttctaagattattggatttttggtctaaaggaaaaggatttaattaaatccttttttttggaaaagaaaagaaaagaaaaggggagagggagggaatatagacttccctcgggcggctagggcgcggcccgagagaaagggcggctcggccgagcttaacgggccggccggcccaagaaggtggcccagagcggcccaagacgcgcgcacgcgggagggaggagagagagagccggtggaccgggctcaccatgcgcggtcccgggtgggacccgcttgtcagcggctcggctcaccgtgcggagggagtacgtggctcatgcgcgcgggcgggggagggacgcggtgcacgcgcgcggttcgcggtggacgcggatgcagcgggcccacgcgcagcctcacggctcgcggtggaacgcgcgcacggggagggactgaccggggtcggctcgacccggtctaggctgagctggcgccgacgtggcgcctacgtggctgccacgcgggccggcgggaggtagacgacgacccggccgcgaatggacggcgggcgggcggcggcgagcggcggagcgaaccacggcgatacgggcaaaagctagcacacgggcggttgttcgtgatgaggggagacgagccaacggctcggattcgccagagggagttcaacggcggcgaatcgcggcggcgacaaccggcggggagggaagagggaaacgccgacgaggtcacgaggga

SEQ ID NO: 65240 - DNA, 7699 bp, Oryza sativa
ccatttggtctggacacaatctggcccggttaatatgcttgggccgaggttacactggtacacaattttcccttgtatttttcacaaggaataagtccactttgactcccttgcaaaaccggatatctcgaccccctgaactattgaaaccggtgcaatttgactcccttggtagctttggagggcggtggcgctgacgtagtgatgttgacctagtatgtggagttgacgtggcgcttaggtggcatttgaattaaaaacgtatatgtgggacccgtttgtcattcacacacataaaaaattgtgggacacactgacatgtgggccccacatgtcatcctcctcctctctttcttcttcctcccctcttcctcccttctctctttttttctctttctcttctctccccttcggtcggccgcggggagcacaggatggagcggcgacgggcagggtctagagcgcggcggcggcgggagctgaaactaggcctgataggcatttctaaacttaagaaaatatacgacttatacggcaggtgggggctagagcggcggcggcggcagaagctgaaactaggcctaatggtaccgatcctgagacactatgtcatgtccgttatactcatgtccatttctaacgttaagaaaatatacgacttatatttttcctaaaaaaacactcgtgaaagacaccgcgaagattatattcatattgatatggcaagaatacaaattacattgtagcactatataacctgctaggctataattagaaaagaaaaggccacgtcatacatctacaatacaaacaccatgtctcatatgcactcaactccatccacgtctttggattggagggggagatgtctaagagataatagtggatctgctctaccttgctatccctgctgcaagaggacaatccctttgaagaaaaagtttgataggaagtagaccttcaagtgacgcctctaggaccgacgacaaatgataatgagtaacaattggacggtgttttttttttaccaattcggcatagaaatcataggcacactaactgcccaagcaaccaataatcataggtactcgtatagtcatgtgaaaaaacaaaagagacaaagctattgtcctactgtatttaatttattggaaaaagaaagactatgtattacttctatatagacatgttgacaattcattaagattaatatattctaactttctacaaattcattaagagcaaaagacaacttaatttgatattttcacagcattaatttccattggtttcgaaattagtttcacttccttaatctgattctattattgtcttggcaaatatttggagactcctctgacctgtttcacctcttattgcctcctcatggatcttatgtttgaaagaatttactctctctcttatctttgttgctacctcattgtctcccatgacaatcttgacactctttgccaactctgtccccactattactccttcgtcattgcgatacactctagtgccaaccatccattccttctccacaagatatgcaattgtgggctggtctgaccaattcggcacagcaaccatgggcacaccaagttccaaggcttctaaagtcgagttccacccgcattgtgtgacaaagcatcccacggagggatgggacaacacatctagttggtcacaccattcgatcaccatcccattgtgatggtcatcaatgttatccaccaaatagctcaaatcttcttcacgcccatccttacgcaccacccacaaaaatggccactcacactcctgcatgccgtgtaatatctcgtctacctgtcgcttgctatatgtgagtatgctcccaaatgatatgtaaacaacagacctctctgaatgtgtatcaagccactccatgtagttcttcttatcccgctggaacatgtggattctttctttggctgacccagccactaagtggccaatggtaaacacctcttggaagtacggctgcacggctgtgagcgtggcaacctccaaaacattcaatgtgttcacaagaacctttggcttctctctatccatgaactcaaacaactcttgaaagccttcaacaacaaaactggacagcttgtcgtttgtcacatcaacaaggaaggatggtaagctacggatgcaaagaggttgcattccaggtaagaccacttcatacgatgggtcagaggcatgtgatgcaaagagctctctgtagccgtggtagtagtgatagtaagctgcaagcacggtggccggctggttccagaacacgactagcgggatgccattctttcgtgcgacatcgagcaccggaggcatcgccatggtgcacacgatgcatgtgacgggccgaccacgagcggcgagctgagagacaattgctgagaggctttcaaagcttgtgcagcggctacgtgccctctcgtcgccagaaagtatgctcagtttggatatgtcgtcaaagccgtcagagaaaggaacataggagataataccgtcggtggtctcctcgtcaggggaggcgatcagcgacgagaacatgcggcggtgagcagaagcgtggatggagagagtgcacatgactgaggaggcgtcaatgctagcgagacggtgggcaaggttttgtgcagggttgatgtggctttggatgccgtaggctacaataaggaagtgcgttggtgctgacggttgagggccatcgcaggtgtgttggttggctgcgttggccatggagggaggatttggaggctagctgttcaatttgtacgtgtttcagagatgattgttgcaaagattgtgggtgatcgggattgtctaatgtccataagttctgtatatatacacactccatagactagttgccaatggttttaggaagcacgcgcatatggttttagttgccaatggttaattaatttcaggaagcacgcgcatatgttttttttaagtatctaggtagataattatcaagtatctttcaatatcacctgttgttgtcattagtccacttgaaatttaattttgtcagttgtctgattagatttgcaaagtagattttctgagcttattgcagagagcaataatggaatgcatgtgatgttagcactgacgtatatgtactcacgttctatcacccaaaaaaaaactccatccgttctaaaatataactgtttttttacttttactaaaaatatctataaaagaaatatgtttaaataaaaagagttacatattatgattttttgtttaaggataaatctagtaacatgaattttatataattggtttttttattcttttgctattaataatagttaaagttaaagttgtttaacttgtcactatttatattttgagacgaagccattgtgataggtttcttgtttcgtgctgtctttgttgtcacattaatggggctagctgggatacatgagtaaaagacaagctaatcaagaaaagagaagagtaaaaaggaccagctacctagcgttttgtgcagtactatatggatcttcttgcagttgcaaaatctgaacgactgctcaaatcacaaatgcagcataaaatattcagaacaagtgtcaatccaatcaggcccgtttaattggtgaaataaaaaattttggacgtcacatcgaacgtttaaccggatgtcggaaagggttttcggacacgaatgaaaaaactaatttcataactcgtctggaaaccgcgagacggattttttgagtctacttaatctgtcattagcacatatggattaatgtagcatttatggcgaatcatggactaattaggctcaaaagattcgtctcgcgatttacatgcaaactgtgcaattagtttttctttttatctatatttaatgcttcatacatgtgtcaaagattcaatgtgatgtttttgggaaagtttttgggaactaaacagcccctcatttccaaaatcttttttatccggcattaatttggaaccgcgtgcatctaaagcaccctttactaaaatcaatgtagttgtatgcaaacctaaagcaatagcatgatgaaccaagaaatctccgggtcctattattaagaaaagcgaattactattctcgttaacagcattcaaccatccgggtaaccatagggttcgacccgcattgaaagcgggaccgctcgttgaagataagagcagtataggggtgtctagatccaggggcgtaaagttttggtgtgtcacattaagtattatatagggtgtcgcatggggtattcgggtactaataaaaaactaattacagaatccgttagtaaaccacgagacgagtttattaagactaattaatccgtcattagcaaatctttactgtagcaccacattgtcaaatcatggagcaattagtcttaaaagattcgtctcgcaaattagtcgcaatatgtgcaattagttatttttttagcctatatttagtactttatgtaggtgttcaaacgttcgatgtgacagggtaaaaaattttgaggtgggatctaaacaggacctatcttttcttcttgagttacgctccggtgctctctacttgaagtattctactacaagtagaattaatctcgaccgttaattttataagatagattagtaatctcctaatatagtttagggataattttggtatgggatgttttcttcgcttcttcgcatcaggtccgacgcattgtatctcgccccgacgcatgcaccgcatctccccgatgcaggttttcgcttcctcccggcaggcagcggcacggcaaaaatcactggcggcgcggccggcggcgctgccagcggctcggcgcggcgaaatcctcaatttgcagacgtgtttgatttggtaattgaggaatatagtcttaggaaagcatactagtgggctgcctgatttctctgttaagacagatgcttatgtttctaatctgatttcactgtacagcctgcgattgatctcaacaagaacgatcttttggatgaatgctacaaaaggatgctggaagaccatctgaacgatattttgagagacgatatagctttagtttgtcaccttagtgacggaaaggtgagatagtgtaatgtcaggaacaagtttgattgtcaggaacaaccttagctagttagctttattctctatctttggatcagacagttgtagtatcgagatgtcgactagagagaggtgaataggcgatttaaaattaaatgatacctaatcaaaactaacctaagttgctaggctcggtgagggacaagtctaactaagccactcacaaaccggcaccgggcctcctccacaatcttctcggagaggtcaccgggcaacacctccacaagccgtctaggaggtggcaacctccaagagtaacaagcgatgacccggctcgaagatgatcaagtgcacactaactctacaatggaagaaaatgcacttgactcttggctagaacaacctccaaccactaccatggatgaacactaagctcaaatgtgtgtgagagaagtgcaaagggtgttatgcaattgaattgggtgccaagagagcccccttgctgctgaaggggagtatttatactcccaccaaccaaaactagccgttgggggcgaaatcccccaactcagtgctctgccggtctgaccggaggtatgtggccggtcagaccgtgctactctgcaaccgttgtagccctgtcagagggccccattggcttggccggtcagaccgacgttgagtggccggtcagaccggcctcagctcggtctgaccgaatacggctccgtcggctctgtaacggccaccccaagcaacaccattctggcctccaggaggccggtctgaccgcataagtgtcgccggtcagaccagcctaacacaccggtcaaaccgccactgtctgtccggtcagaccgccactgtctggccggtcagaccggccagggccgccagtcagaccgccactatgtggccggtctgaccgcccctaatcaggctgatcacagtaaatacatatgtgtgtgtgatgaaaatgtgagcacaagtctaaatgcataatgacctaatgtggcaattaaaatcatctctttgctaggtcattacccctcttaatagtacggcaaagctaaaaaataaactagcaaatttgatcgcccttcacctcgatcaatttaaaaattaaagcactagttttaccgtcttctttcacttcactttgcgccgtcaattttaatccttcgataatcatccatgcgcacatatgacgtggtactaacacaaaatatatagctcaaagacaacggttagttcataattagcgcttgtcattaattaccaaaattaacaccgggggcctagatgcttcaacagtaatactatgcaaagtgagactggttaagtcgcagacagctgcttaatcacggtgcgattagggctaatcttttgcatctttttggtgatccatagtttcgtggttttgcgatttaatagcgtctaccagatatttcccgtttgatcgtcttgatggcttgcgggtgtgtgcaatgatcaaatatttgctgtcaaaatatcacgtgactgaaaatgcagccaactctgattgctaaacagtacatcatctctgattagcaacaaagtgtgcagtttgtgacatcagtgtccatgaaagcttccaggctttcccctggttattgccaaaaatatagtcttatttctccttctctctagaataattttggtaagtttacagcgtttggcaggaggaacgcacaaagactgcatgagtgtgcacaaaatctgtccatattttctctaaatttgtactttgtgttaggtagtacatttgtgggcattcgaaatgcccaaacgagattaatataaggtgcggtatttcttgtagcaggaaacacacaccaagccaaaccaaagagcaagccaacatgcttgtgctgtattcagaggtgcagtatttgtgcagtgaacaaaagtcatctcacattgctgtcccttgataatccatggatgccatcagtatttcacatctgaacattcgcgcgtgctcctccacgggcatcatctccgcgccacgctgccggtgcagcggctcgccggtgctgcacatcctggcgagctggtccaccgccgtggagacgaggtcgaccaccaactgcttgtcctgctcctgcacgggcgccatgatggcgcccatatatgccaccgagtcgtccgcggctatctgctgtggcacgacgggtggcgggatgaggtcgccgcagcctatggccggcgcctgctcggcgagggagatgggacagcgatggtgacagggatggagggaaacgggcgactgaggaggtggacgggagtcaatggcgtcaattaggataatgataaattacgataatactcctacatgaattattatctctggataagtataccccaccacgtttctactaccactataccactaagttaggtggtagtagaactagatctcaaccctacgattaaatacgatcaacggcgcggattactttctactgcaaatagaaagcattggagtggggctctttcttctttcgtttctattcatgtacagtttagaaatgattttttaaatttgaaattttatttattgaaatttaaaaaataatttttggt

SEQ ID NO: 65241 - DNA, 3322 bp, Oryza sativa
ccctacgattaaatacgatcaacggcgcggattactttctactgcaaatagaaagcattggagtggggctctttcttctttcgtttctattcatgtacagtttagaaatgattttttaaatttgaaattttatttattgaaatttaaaaaataatttttggtttcaaagttttacaaatctacacccctaaacctttctatgacgttacaacgcaccaatgaatatgtgcccgtcataaaaaaaaacctgtttggaagagagagcgttaggggtgtaaatttataaaactttgagaaaaatattttgtaaatattttaataaataaaattaaaacttgaaaaaaaatcctgaaaaaaccggggaactgtctactggagtacagcccatcaaagagacgaggcccatagcccatcggccaccacaatccttctcgattcttctgctctccaccgagaggagcaaggcgaactgcaggcggagaggctgggccacacgataccctcctctcccttcccttcccttgccgcttccaactccaagtctcgctgtgatcaggagctagggtttgtgcgatcttcgggaggaggggaagatgatcgaggtggtgctgaacgaccggctggggaagaaggtgcgggtgaagtgcaacgaggacgacaccatcggcgacctcaagaagctggtggcggcgcagaccgggacgaggcccgagaagatccgcatccagaagtggtacaacatctacaaggaccacatcaccctcaaggactacgagatccacgacgggatgggcctcgagctctactacaactagacgccgcgcctctggtaatttctgtttgcagttcttgttaggcctttcttttttgatgctaggctcttgttgatcaaatcgtgctgtggattgagaaacgcttcgttcgtacttggaattgaggactaggtacgcttaatttttgtctaggaatcatgaattggcgggctttatttgggtatcaagtcgtgtactaatactctgatagcaacttctgttccgctatttagttcagtctgtgcttgcatatgctgtagctctggccgattgattaggatgcttctttctggtattgtagtcattcgtgtcctcatcatttgcagaatagagggatatgatgaactctcgcatgctgactgattactggcgaggcaattaggaggattaaatgcgcgctcttgtaattctacattctttggttccaatataagctatgggtcaatcaactagacattgatgagtggatatttgctggtactgttagttacaaaatgggtttagattattttatgatgtttcatgtttgtaatgacctctggcaaattgtgttgtattcactggtgtccccaatttcccctcttgttatcttttgtcaactattggtcaggttttagctttgtggctttagaaatttgtgaggatatgctcaacaccgtgtgatgcctcccccctcccagcctctatttagagatttcctaatccagtaatttagtgcattatccaatgcataccatttgtttcttgtttgaatgcattagaatatcgagattggcaggttaattagggtgtaatttgagaatctgttgggacctgagttagtatagggtattagggttgtcttggtttgttggctagttatgattaatatgaatggacatgtaagtatgtaaccatgtgccataaatataatatccaggaaaggaaaatcctggcagccggtacattcggtactagaaaaaaaaattctgatttgcaagttctgctgttcagttattgtacttacattagccttttaatgttgcataagtaacataggtgcaggctgaaaactatagaagcaaagcatcctcctttttttattctgttatatccttataatttcaaacagtgtcatctgtctttggtgttgtctgttgtggccagtcactcatacatcattattttatcacatattcagttgttcatgcattgtgagttgtctagttattgatatcggaaattgtagctaaatgcagcgtggataaagtagtttgattagtggtgttattcttgtgttgatgatctcattatccttcatattcctgtgatgatggttaaacctatagtttccattcctttggcatgtaatgggttagcatcgatatgccaaagtaacttgttaaactttgagcatggacacgaaaaaaacctggcatataggtgtttaagatattgctttgtccttttctgtagcagcatgctaagtattgactggatatagctgaatggttatatggataaaacagttagcatttgatcacatatatagtgatcacacctgaggcctgacaaatctggttttccactggctgcatcatagcatgtgttagttactggagaaagatctgaaaaaacgaatcatacttgttgctgattttgttcaacgaaagggttctctgtggactgtggagcagaacaatttatacaaacgggctagttggtgaatgcttgaattcgagtatgccacattgaacaataagctggagatgtactcctacctgatattgatatgtacaagtgtatggactgttttgttttgttcccctagctagaattattcacttttaggcttctattgttgtaggaaaggctaaatcaactttggtatgcagtaggataccagggaaatcataaaccatttcacttgttagcatgtgttttttgctgagacatgtgattatatgctgttgtattttgtttttttatctcaactaatatttgttcaactgcaatgcaggctggtatgaatttagtcatggatggcgaacagattatgcccatttgagcggccagcgtccatagctcatatataaaactctagtgagctgtgtagttcgttgtgccaatgactgttgtcaactttgaatatgtcgttgtagtatgatcaacctgcagatgtgttgtatttgtgttgctgctactcataacataaataacatgttatgaaactttgatcaagtctcagtatcctgctcgtcctagtctgctttctccatctgacatgcattgcattgcaacttggattctgataaactgtctgctactcttgaaagctgcacccacagaacagcagcagtaggggttgagccgtggaggaaacccagattgtagtccgattccagttcaatttgcagcccaagcttcgtcaagttttgatcgattttgctggctccagtgatcgcagagatagattttcggcggtgcaggcagaaaacggcaaatcgctctaccgtttccactcgcgggag

SEQ ID NO: 65242 - DNA, 4717 bp, Oryza sativa
  unsure (1)..(4717): unsure at all n locations
gtgcgcgccacccgcggcgtcgctgccggcgcttggtattcgaggtcaaggtccttcacctcggcagcaccggccacacccgcgttggatgggccaccgacagaattaggatcctctgccttcacacgtgaaggcaccagcctgcagtcaagtaatatcccccgtccaaggcaatccaacagctcacgtgcacacccacttaatttagccaacaaaacatgcacatcagaacccatggaagcccagcaactgacagcacatgcacttgcaaagtctggtgccggccgcggtggtacgcgccgccgtccgccgccgccgctgcggtagacggtagtgcaacgattcaacatgcttgttgtctgggatttagaacattattacaattacaaaacagagcaatgcatgtattccatttgaccatgcagcaaccaaagcatgcattccatcaggcttgataagaagaaaagggtgaggagagaaaaaaaggtacacctacatcacatgggaaaaaaccaaggtatttcttaatgaagatttcattctagtgctatattttagttccaattttcactgcttctaatgtgatctggagtaaattttattttgagttatgttctctttccagcaacaagaggctagaaatgatggtctggatgcacaagctacaaaagataatatttctggaaacaacaatagagactttgaacaacatggggtcataaataccttcacccaattgttcatggtaatcttgatcataatctaaaagtataaattaaatgactgtaatgttactaagttttttttttctattcttcacttttacagggcccaagtaccagtgacctgtgtactgaagacttattatagctagggggatctattccagggcattggttttgttcttgtcagtccgatcctatgcactaatcacagtatatttcgattttttttttggcgtgcagtatatttcgatttatgatgtagcttgaaactccatcatactttgcagcgattgatgttaactgaaactcatgaattgcctaatggaaagcatgctttggttgctgcatggtcaaatggaatacatgcattgttctgctttgtaattgtaataatgttccaaatcccatacaacaagcatgttgaatcgttgcactaccgcggtggcggcggcggtgtgtaccgccgcggccggcgatgacaccgcttcatcagactttgcaagtgcatgtgctgccagttgctgggcttccatgggctctgatgggcatgtttcgttggctaaattgagtggatgtgcatgtgagccgttggattggtcttggaccggtggatanttacttgactgcacgctggtgccttcacggtgtgaaggcagaggatcctaatccccaccaacagaattatgctgacatccacgcacccgtcggctactatgtgtttggattcggatatcgcgacatggatggtaccaaggtgcacaaggcatggaggtccaattatgctgaccaaggctatggcgagggcgatgtcctcgggttctacattcatcttcctgatggagagctgtatgagcccaagcagcctttcctggttcactacaaggggcttcctttccgcgctgaagctcccaaggcggctgagcagaagacgccggatccagttcctggtgagtaccattgtgttacttcatgtgtttgagtagactagtggtagattgccagccaggaaaataacacatgctatttttcacaaaaacaacttggtatgaactagcaatttcacaaataagattctgtatgtaattgcaaggatgcatgtttcatgatgttatattcaatacttggtgtaatgtagaatttgtaccaattacagaattaccagtagtagatctgcataaataaagtgatttaggattcaggacaacagaatcgggtgttctttacatgtagggaccccttacatgtatgattatataggaaatattagaacttccaatagctgtaatgtaacagtggtgcacttgtcctaacaaaatttagaagtacgtttaattaagtttcatcagtcttttgcatcctatgtttgagcaagtttctgatctctgtctggttggacatattggtatctactcccctacatgtgtttcaagtcactatatctccattgcacaaactagaaagtagtttctactcactgctcttgaaatcatttccaaagcataaagtgtcttgtaccaagaaatatagctacatattgtcatctttattattggaggtgcttagtgctgaagcataatgaatgcagcatacagttcataagtcacaatgtaagaaagagagcaagaaatgcagcaaatgcttctctagcaatgctctcttgagaggcacaacatggaaaatgtaacaatttgcttctacagttgtacataacttattaatttgctttgctactcaatcaaagacaaaaaaacacctaccaaatgttactaaatttacccattgttctgttcaagagtatctatgtcatcatctgaccttaaattatattcttgactgtttgacagtgcatagtctgttgtattccatactagtaaaaacaaatacctgcaactcactttttgagaagataatatgttattgactattatatcctaaagtataattacttatttggttctggccttcttggatttatctacatcagaacaagtactgcatgatatactgtaccaatcctaactcgaaggtgcaatcttctactgtatcataggaggttacttttgggagtctttacttatccagtcattattgcaatcttatcgtgcagtagattctattatgttatgtgcacatgaataaaaagggcagttctttcttatctgttcttatgatgaagtcagaaatcaacgactgcaaagttttttttgccccaaagtcagtaattgtaaataagtgcacatcagtaccttccattggatcactatgttttgcttacatggattaaaaaaagggtttcttgtttgttcttcgcatagaacaaagtcaggatcctataagtggttgttttgcacacttgcacttatcacttactactttctagcgtcccttgttttcctacttacgagtatgcgactgttttgcacaattgcacttatatttcatttccgactttctagcatccattgttttatttgtgcagcctctcctctggccttcttagatattccattttaatactttatagttcttgcaaatgcaggtagtgagatatgctacttcaagaatggggtatgccagggcactgcttatagaatgcagctagcgaggcgacggtggtcgtgactccggcggtgaagggcagtggccggcccagagctcggcgggccgaggcaggagaggcagcgcacgggctcggggcggagcgagctcaagacgtggttctccagactacttcacgccggggcagcggggtcggcggcggcattagcagcggcggggaacgggttgtcatcgaggaggctaaggagctcgtcggccgtggagatgaggagggagcgggagcggcggcgggcgcgggagcagcagccacggtgcggggaggtggcaggtgggacagcggcggagtgcgtcgcggttttctgctgcttcccctttgctgtcgtcgagctcatcgtcctcgcggtcgtccgcatccccgccgcgctctgccgccgcgccgtgcagcggaaacggcgcgggcatgcagcggccgtgcgagggccgcgacggggcgaggcgcgttcgacggcgaactcgagcaggcacacggttgttgatgtaaaacacgaggcctgagagatctgcttaactccagtgcaggtccaaaagcttgcctttaggtgtatgagcgtgccaattgatttgatcctgcaatcaacaagaaacaaagacaaagaaaccgtggttaaatctgtaaactatagctgatcggctagttgccaatgacatatcatttatctttgagccgatgtcatatgtgaatcgatcggcaatcgtgaataagtaggaaagaactaaatctactcgatcggctatagatattaacgatatataatccctatgtcgatatatacttaaatcaagtgattgggataaatcggtcgccatgccgagacagtataaaccacttagattgaaatatatattaacaacgagactatatatgttcatagcatagccgatcagatacatctagcatgtatcggttaatactccgataccactctatattaagatattaaagaaagtaaaatatactaaacagaagcctaatatacttaaatgtaacaagatcttaacataaaggcagatttaacatatcaatcaagcatatggaacgtaaagtagttaaatcaggtaagatcggctgaaaccccaatgctactctaatcggcaaccagaaagcaggctagagattaatattctaatcacgacttataaggtcaaactcaactgatacagctataagtatgaaaagaaagacaatatctaaacaatcaagccgctggttgtttcatagagtggtagatatcttatataatctaagtcaacgtcgatatataacctaatcggttgccttctagtaatagacgttagccgattgaaggttagataacgatattgccaaagattatataggatatatgataactcgacgaattacataaacaaga

SEQ ID NO: 65243 - DNA, 8285 bp, Oryza sativa
  unsure (1)..(8285): unsure at all n locations
tatactaaacagaagcctaatatacttaaatgtaacaagatcttaacataaaggcagatttaacatatcaatcaagcatatggaacgtaaagtagttaaatcaggtaagatcggctgaaaccccaatgctactctaatcggcaaccagaaagcaggctagagattaatattctaatcacgacttataaggtcaaactcaactgatacagctataagtatgaaaagaaagacaatatctaaacaatcaagccgctggttgtttcatagagtggtagatatcttatataatctaagtcaacgtcgatatataacctaatcggttgccttctagtaatagacgttagccgattgaaggttagataacgatattgccaaagattatataggatatatgataactcgacgaattacataaacaagattagagtatcataaagatggaagcactaatcccgagaacgcaagccgccataacaagttttacctcttgttgaagatcgaaaccgatgcagctcaacccgaaagcaagaacccgtcgaaacaaaacgaaaataaagagggtggcgatgcgccgagattgtattgaatatgtgttagattgattacataaggctcggggtctatttatacccgagattacaaaatatgtccatgtcggacacgactcttatctctaacaaactctaagataccataagtctttgcggcagacttttgcccaaacatatctctaaggaaattacacagaatattctaattaatagatacaattgccttctcagaactctatccatgcatggcaatcatcatgaagcacgtttactcggtttgacaacatgtaccgagtcgtattgtcagaatcgacccaatcggctaaccttgtctgactcgaactccaccgaccttgatcgtagccgatttggactccacccgattcttgctctgcttccaaaacaatcttgatcttggattccgcttcgatctaatctccatctccaatactccaatactgaggttaccaaatttggtcgttaacaacggcatagtcgcacgcggcgttctggatagtgtcgtccggtgaggaggttggggatggcgacgacaacgacaacgacggttgtcgtccgttgaagtcgaagctgtcctctcgacggcgtcggcacgggagaagaggaacggctccagcacgggagaagagggaacggcgccgcggtggcgaggtcgtagcacgggacgagcagcggcgtgacggtgtcacgcagcgtggcggcgccgatcacccgccgcagcgacgaccttttcggcacccaccttcttcacccttcggcggcgggccacctgccctttccgaggctcgccgcacgaacgccagcgagtccgccgtcgtgtacctcggccgccacccccccttcaagaatagcatcgacggcaacacgccccccggccccggccccggcggcgcgttaaagaaatccatcaccctcgcatcattatccccggccttctcccgcaacgccgtctctagcgtcaccagcgccaccgccaccagcagcgcattgcccgcaaccattgatcacgagaaccctcacctttccctcccccaccaccaccttcatgaaacgccctccccgccggatccagccgcggcgcggtggccggcgtcctcctcctccgccaccgcatcgacagcgtgccccgctgctccctcccggccacctccgcggcgtcgtccctgcgtgtgcgagaccagagagcgagaggaaggagaaaggggaaagagaaacagagagaaagagaaaggggaaagagagagggtgacgtggacacctgccatgtgaggcccacatgggtcccatgctgacttagctgccacgtagactaaaaccggggtcaaaaccaccgagggacctcgggtgaccggttttgtatagttaggggaccccgcatatctggtattgcggttcaagacgttttcgtatctcggtgacaagttcagggacctccggtgcactttttcccacaggaaaaagtcaaaagcccacagccgagtagccacatttcagaaaaatcaagctacactgaataaaaaggagaaaggggaagcttcttcaagtaacttcttttcagataaggtacttacagattacatcacattttatatgaacatagtgcatggaattagtttcctgtttcaaactgtcaattttacggcacaatttatgtatctgctcaaaattcagtgctaacagaacaaaaaacttatatgcataatttatgacaattgattttatgcagattagccatgcatatctcaattttgatctaaatatgtacatgcagattagttctattctggtgaccaccaaataaacttatgacatgtctaaacttgaagggtctatcaaaagaatgaaaattcactcaaatgacaaacaatgtagttgttcttgtttttcttggttttgcatacatctctcacagaaactagttctcgactgcacacatgctgaaaaaaaatgacaagtagccttgaacaatgacagcttcttccaaggccaaattcagagcaaacaactacactcgacctgaccaaattcagaaccaaaaatattctggttgccatttttcacactggttgtcacatgatctctgacaattcaatgtagctaacagaacataactaacttgattatataacacaaaactcaacatgatatatcatagttttaaaacctaacaaaactaacttggtatttatattaaaaaaaacaattatttattagtagaacacggaactcttacaagggctgacagaacttgctcaaaaaaacatttcaagttatcttacaggagcaaacaaaacaaagtactctcaatagccatcaatgcggatttgatcaacatggattatataagtcttatgtatgcatgattatacaaaactatataaagccaggtactcttcagtactttccaacagatgacaaaactaagtactcttcagtgttgtcctatagatgacaaaacttacagagctaaacaaaactaagtactcttcagtgttgtcctatatatgacaaaacttgatcatagtgagtgattggtatttgctgacaagatagatagaagaagcaagcagaagaacaacacaaaactaattgctgacaaagcagaactaatacccatttcgaactaacaaaactaggaattctagtggctaacaaaactactaattacagtatttctgacaaaacttgaaagtagaggttaaagtatttctgactaaactagcaaaactaggaattctagtggctaacaaaactactaattgcagtatttctgacagaacttgaaagtagatgttaaagtatttctgactgaactaacaaaactaggaattctaatagcaaacaaaactaatctcttttcttacaaaactatgtttgttaaatgccatcataccttttaccttacctagacaagaacgaaatgcatgttagtgatcacccaccagaaatattttagttttaccaaatttagttaaaactatataccttttagttaaaactagcttaggtcttcataatgcagttatctacctaaaatggcagacaaaactaatttattaatttgattacaaaactaacatatttagatgcttagctcatcatgatgcggtcatctaaataacataacaggggagactacaggagagggaggaactaaaagtaatgcactgtgctaagtatttttaattgctaacaaaagtaaaaacgctatgtatcatagtgaagttctgaaaaaaatatattagtttcctctgaaatgttcagaacattaatcttgcaatgctttatattttttggaaaggagcagggttttagacactagcaaaaaaatggcatgatcaaaggaggacttgatggtactcaagctatttgaaaaactaaaaagctctcttgtcagtactaattgtttactgaattaggtaagtacagcttacagaaaaatcatgcttagttaacttcagtttgaattggcaaacaaaactaatactacccccacacaaatgaatcacaccttgctcacaaaacgtccccctcaaccacctgcaaaattcagctccccaaaacctgattttatacattcaacagtaggagataaaaaccattgagtaaatttcgtaaaactgcagatactttgcatgatcgatcataaaactacaattttaagaacttgtttcacaaaactacagattcaatttcttcgtttatcacaaaactacatatactttgcacaatatatcacaaaactacagatttaagaacttgttacacaaaactacagatttaatatcttcatttatcacaaaactacaggtttagtgtctccattatcacaaaactataggttttagcattattaaaacatgtagttttgtgataaatgaagacactaaatatgtagttctgtgataaacgaatacactaaatctatagttttgagaaacaagttcttaaatatgtagttttgtgatagattgtacaaagtacatatagttttgtgataaattgtgcaaaatacttgtagttttgtgaaatttactcaaaaccatttatgcattcaacagtagtaacagatctaaagcatttatacatcccacagtaacagattagagaagaaccccataaaaaatttgtgattacatcctccttatatatccaaacaaatcagcgtgcataagcatcacaaaaacaaaaataaattgctcaccaaggaacgagctggacagatcttgaggcctgagttttttggacccaaaccaacagcagcaacgtcagcctcacgattccccatcgccttgcctgttgaatgctgcaccagcatggattcatcaaagggggcagccgagtagggcgtggccgcctggcccctgaccttggcgacctcggagcttgtctccacggcggcggcggagggcgccacaccatgctcgccggcttcgcctggctgcagtgaatcgcctccgcaagatttgctccctcccctcgacgacatctcagcggaggccgccgcgctacgctcgccggctgagcccggctgtggccgaggagtcctactcttggcctcctctcgccgacaaggagaatcgctgccggcggattcaccccctcccctcagcgacattgtgcgctccgctgagaagtgggtggcactgtttcaaaataaaaaaaaaaaaaacgcgccctgtgtcagaaatatccccaaaccttgtttggattgggttacaaaacggatcctaacccgataaaaggactgcgggcccgataatgttgcacgaatctttatgtctatcaaaggctaggaatttgagtgtgatttggaaaaaaaaaacacgctggtaatgtacagtaaaaaccaaatacaaataaatgataggtacatctaattttatccatattattaattcatacatgataggtacatctaatattattcccagctgcaagttgagcatcagttcgtagttcttgtgccccttggagatggtctccccctgcttcttccccggcttcggcatcgtcggcgcgcgcatacacgacggtgtccgcacccatgacctgtcgttgcgactctcctcgccgccgtcctccccctcaaccaggctgtcaatgtcggacgacatgttgttcctcctgctcgacctcctcccttggtcagctccaacctccggcggccgccacatcccttggtcagcggcgacctccggcggcagccacaccggcttcttcgtcacgggctccaccccaggccatgtcagcaccttctgtgacggcagcagcgacaccgtctttccctcggacatctccagctcctcgagcagcttcgtgatcacccccttgggttcccggggcaacggcaccggcgggccaccggacggcgggtagtacacgcccttgccctgcgtctcggcggactcctggcaccacaggccaatgtacatccccgccgtcggaccaccggaacgtgcccctgcccttgggcttggcgtctcccacgcgccgtcgtaccggtcgccgtccgcccatatcaccgttccgcgggcgtgcatntcgccggcctttcacagtccgatgtactcgtggccggcgcgccagatgtactggcccgtgcccgtncctgcaagccgtcgcgcaagtgccgtcgtacacgtccccgttgacgtacgcttgcgtgccgcggccgtgccggaagttggtcgcccacagccccgcgaacgtgtccccgagctcgccgatgtacgtcccctgtccgtgcatgtacccgccggcgaagtcgccctcgtagatggcgcccgacgaccacgagaacttgccgcggccggccgcgcggccgccgcgccacgacccctcgtacatgctgccgtccgtccagagatacttgccggcgccgtgggggaggtcacagcgtaggtcgccctggtagaagtctccgctgggcagcagctggtcggagtggctgggctcgccgagcgacgcctcgtcgacgtcgtcgtcgtcggtgtcaacgtcgtcgaggacggagtcgatgtcttcgtcgccgtcgtcgtactggtagatggtgttggaggtggaggagctgacggagaggcttggggtgagcgtgatggggtcacctccagcggcattgccggtggcggccgccggtccgtcgaaggtgccgccggaggggacgacggagccgcgaaggatggtggagtacttgagcttgcggatgctcgcctcccacagccggctggccagagcagggagcgggttcatcttcttcccggtcgccgtcgtggcgtcctccgaggagcctaactcaacgtgacagggtcagaacgagaacgacgccggaggcggaggcagagcgaggctgtgcatggctggtgatgggtggcgcagtggaggtagcaggggcaagaaaatgtttggattggttggaggttgggaggagttgtcggggtgggtggatggcgctgccgccgctgcgccaaggagagctcggggggcgaaacatttggaaggaggcagaggtaacggtgagatagaaagccatgaacgctctaaaaataggcaaaagggagaaacagcagtagtaggctagctctggctagtagcatctcagtgtctgcttcgatcttgggggcttttcagttgatagcgctgagcaatgctcaggccctttccaataggctacaacatgagcatttcctacgttgaaatcgcagagaccaactgatgatgaactgatgctatcaggatccaggagctacggaactgaaatctgacagtaccaaactactccctcattcctaaatgtttgacgccgttgactttttaaaacatgtttgatcgttcgtcttatttaaaaaatttaagtaattattatttctttttctatcatttgatttattgttaaatatatttttaatgtatagatggccaaaaggcccgaggcccgatggcccggcccacggcaatttggcccggcccaagcacggcccggcccgatgggggtcgggcccgtgtcggcccggccggccgccgggccgtgcctggcccctccaccggcacggcacgatgggccggctggccaggcccgacaaaaaaataatagggagcaaaaatagacatattattcttcacagttcaaaggatagggatgtaaaatagacttattttagctatatatatatatatatacatatatatatatacatatatgtatatatatatatatgtatatatatacatacatatatatacatatatgtatatatatatatatgtgtgtgtgtgtgtgtgtgccagcccaatgaggagggagggaaaatagacttatttttcaaaagacacgatgggccacccgtaccatcgggccggcccagcacggcccgactgctagtgggctgttcctgggccggtggtgcagcccatgggccggcacggcacggcccggtgtgttggtcgggccgtgccgacccgacagattttggcccgagcatggccgtgccgggccgggccgcccgaatggccaactatatttttatttatacgtatagtttacatatttcataaaagtttttgaataagatgagtggttaaatatgtttaaaaaaatcaacggtgtcaaatatttaggaaagtaggcagtatctgtctcaacgacaatcaaaaatagcaaccacgacattcaagtacactgaaatcagtattaccagtaccaaatctaatatcgaa

SEQ ID NO: 65244 - DNA, 12582 bp, Oryza sativa
taccccacttccacttcaaattttttgcaaggggtcaagcacataaaggcttaacaaacttacctcaaaagactttcagctctctcattttggaggggccagcgccaacgctgccttcaaacacataacctccttgcccttgtcctgataatttcacagttcattagaaaacgtataacattagcccaaactactttataaggagaaagcgcacctgtttttgataaaccaaggccatattaacaatggcgtcagatgacaggacaggtttctgaccatggaaactgtgtgaaagataaagcagattgagattcctcaacctgtcccactctgttgtactcacatcatttctcagcgcctgcaaaaagagatacaaaaaaaattatgcacagcaggaaattagggtatgtcaaatttagaacttactttacagcaaatatcagctagcaagtagtttatgttttccaaagcattaaacatgcgctcacgcagcgcagtaactcttgctgctgtatggacatcgtcctgcagaaaaatcagtatataattataaccaaaacaaactaactaataggttaggttagccaaaagaaaaaagaaatcacattttacctctgctttaaacgtaacagattctgtatatgctattataccattcaagctccagtcaacaccttcgattggggtggaagaactcaatagaagttggacaacattcatctgtttccttttggctgcagcaatgatgggtgggtcctcaaacatgacctaggaagagagggaaaggggtgaggacatgaatgttattgtgactaacactacagagcacaccatttactttgaaaacaaaatgagggaaagagggggatgaagaacaagaggggaaggggtgagacctcatcaattgcgtctgcattagcaccagaatcaagtagaatctgaaccatagattcagatgaagtgaggtcagctactatagctttgccgattggctttgaaatctgaacattagctccagcctaaaagtaagaatatgtagatagataaggctaaaagaaaactacaaccagcatctgcacatgaagatattagcatatctcaaagagccaaacaaaaaaaaaacctgcaacaacgttttcatgcttgtaactgaaccattgtatgccgcacatgctaagggtgttatacctccatcaataatatcatccacctattaataaagacacattatgtgaaaacactagattcatattatgtgaaaacacatcatagcaaaagacgtgtattggtctttctcataagagcttcaagagcaatttcatcatccagtgctactgctgcgtgaattggtcctccataaagagaatggatatgaatgtcagccccaaagtctatcaatttttgcatcgcagcatatttgcctgacaatatatagagcaagaaagtatgtgttgggttgtgatgggattacattttgcaatagctaagaggaattcggaaatatactgaccaagaagaatagatagctgaagcggtgttaatccaagattatctttcatgtcaatgctaggttcaagctttgcaaggacatggccaaaataccctccgctgtttctcggaacagcaatatgaagaatcgtcctacctaaaagtacatttgttaactgaagttgaaaaaaatatgtgaatttaaacaaatgaacaacataactattacaaacctgtgctatcctttttgtcaacatcaatgcccaaaaactccactaaatgatgagtaagagtaacatgtgcacccttggcagagtgatgcagcacatgcatccctttgtagttaaaagtgcgaaaaagtgtcctatatgtgtaagtgcataacggcttctttgccaattctgcataccttggctgttaagaaacagaaaaaaaatgttgtaatgacaatgtaaatggtaggttctacataccttcggatgcatcgatagttgcggggtcggtaccattctcagccagctcaataaaccttaatgcttctataagacattgcagaatgacatgaatgtaagtatagatagagtaaaaacagcaaagggctagatgaagtaccatcgtcatgtttagtcagtttcttctttccagtcagttcccttggcgagctgtttgcatgcaaaaaaaaatttaaaaaaaaacaatcacagcatgttatgtaacctaataagagaacaattacctttttgatgacattgcaaaagccaaccagagaatgttatataacctaataagagaacaattacctttttgatgacattgctaaagccaactagaggtcttcggctctggaaaaagaagggaaacagcaatcagccaccaacaataaatctcattaaacatgagagtgccacgacatatttttacaaggatattgcaatgaaacaacacaaaatgtaaaaagggcatgacttatgaaagttctcatgtcatccagttggatagtaaataatcaaaccaaacaaatattggtacacccttaaacacacataatcgagtttggatctaagatgagacaatcttcacagctaaaatctcagtagttggccgttctgccaagcctgccacctccgatgaacccaaaagtccgaacacagaaacctgggcgtatcaaaatcccagttgaacacccaaaatcctaaaaagaaaatctaagagcaaatcgcattgattcggataataaaggaacgagacctttgttgagaaccggatcaagaaccccaaaatccgacacaaaaacctcacggcatcaaaaccactagcaacatcacacggattacatcgcaaagcaaggcagaaatgccaaaatccgaaccaaaaacctagcggaccccgatgaaccctcaaatttccacaacgaacaccaaaattcaataccaaaccggatcaacaccaccgacacatgattcaccaatgtactaaaaaatacggagactaaaaacctcacggcatcaaaaccactagcacatcacacggattgcatcgcaaagcaaggcagaaatgccaaaatccgaaccaaaaacctagcggaccctgatgaaccctcaaatttccacaacgaacaccaaaatcagataccaaaccggatcaacaccactgacacatgattcaccaatgtactcaaaaatacggagactaaaaacctcaccgcatcagaaccactagcacatcgcaaggactcgcggatacccgatgaaccgtcaaatttccacaaggggcaccaaaagaaagcggatcaaaactactgaaacatcgcacgggaaatgccaaaatccgaataagaccccgccggatcaaaagtcccccatgaaaccctcaaaaatacaccatgaacccaaaatccgaccctaaaaaacctcctagatgatcaaaatcactgggcacatcacacggattaatcacaaagtaaaggatagaggcagatgttaccatgggcctgattagtttggagatgagagctggctttccgtgttagggtttaggaattaggatgcggcgggttgggcaggcgcagggatgaaatttgtagggtcgggacttgcgccaggggtggggcctaatttatgaacttgcgtgttgcgtgtgggaactttcctatgaaatgttacattttaggccctgtttaattcccaaattaaaaaattttgcaccatgtcacatcgaatatttggacacatgtatagagtactaaatatagaaaaaaactaattacacaaattgcgtgtaaattgcgatacgaatcttttaagtctaattgctccatgatttgacaatatagtgctaaactaaacatttgctaatgacagattaattaggcttaataaattcgtcttgcagtttctaggcgaaatctgtaatttgttttgttattagtctacatttaatacttcaaatgtatgtccgtatatctgacgtgacacgtcaaaattttaatacttcaaatgtatggcccttggtcttaggcctggtttagttcccaactttttcttcaaacctccaacttttctatcacattaaatttttcctacacacgcaaacttccaacttttccgtcacatcgttccaatttcaatcaaacttctaatttttgcgtgaactaaacacacccttttgcttattactcctgattcgaaaaaaaaactaactaaattaaatgggactagaaacatcaaattccctccgtcccataaaaaacctaatttagaaccggatgtgacatatcctagtactacaaatctgaacaaaggcatatccatattcatagtaatagaatgtgtcacatctggtactatgttggtttttatgggaagtactccttccgtcccataaaaaacgaatctatgactggatgtgacatattctagtatgatgaatatggacatatatattcagatttgtagtactaggatatgtcatattcggtactagattgaatttttagggacgaagggagtagggggtgtttagatctaggggagtaaagttttggtatgtcacatcggatatacggacacacatttgaagtattaaacgtagtctaataacaaaacaaattatataatccgcctgtaaactgagagacgaatttattaagcctaattaatccgtcattagcaaatgtttattgtaacaccacattgttagatcatggagcaattaggcttaaaagattcgtctcgcaaattagtcgtaatatgtgcaattagttatttttttagcctatatttaatactttatgtaggcattcaaatgttcgatgtgacagggtgaaaaattttggtgagagatttaaactgggcctaggttgtttttatagagtgagtgttttacaaatagacacctaaacacttaggctgtattcttgggtgagggttgggaaccctcacctcccgcacggatggattagtgtatgataaattacaccctccgttccataaaaaacctaatcttggattgggttttttatcggacggagagaataagtgtttgctaaaaaaaacttaaaaaataagttagtatgattttttaaagcaatttttctatataaattttttgcaataattataccgtttagcagtttggaaagcgtgcgtgcggaaaacgaaggagtagaggatgagaacaggcagtgccgaacaccgccttaggccatgttcgacttagaaactaaggatcagtttagcacatttttgcctccacctcctctagagctgagtctaggcaaatagtttaactacacctaaaatggatgggtggagcgctattacaaaatgatctaaaaatgttgagctaggtttagacagttccacagctccactctaaattcaactcttgaagctaaatttaggagttggagctctaccaaacagaccctaatatttcgcgcacataaaaacaaagcaacttattagcacataattaattaagtattagttaatgttttctaaaaaatattaatatggatttttaaaacaactttattatatatttttttttacaaaaaagacaccattgggtagtttgggaaacatccacgtgaataacgagagggtagaggttgagaaagttgagagaataacacaacctaagacatgtttattaggcatgtaaatattttaggatatcatcgacgggttatacccacataccagattcggagggtacagggaaatgtttgtactaggggctatgtacacgagattatatcaagcagacgaagacaatggtttatactagttcaggtccctcaaaaggtaatagctatactccaatttatatggatgatgatgggaataccaaaaggattacaatgcgtctgccaagaatggcccgacgagatctaatcggtgaacaaggctatggtttcatacggattacttctcactgtggctggtggctatgatccgctactccatggaagggacttgtatttacactgatagatgtctccctctccaagtagaactcgaagaaacttatttcgatatagggctgaacagaccttatctcttgcgaataagactcttacaccttctattttgaagagataatttatttctattatcgctgtcgtcggcgaagccggggacggacgtccctcgagcccctccgtcgagcggtgcgcttctgtcgcccgttgttgccctctccttcacctcctgccgtctgccaccgagcagcgctcttctgccgtcgagcggcactcttctgccgccctccgctgccctctcatccgcctcccgcagcatccccgcctgctgtcaccgcctagctacgtaagacaaggacaatgagggaggtgaggatgaaaagtaggccccacatgtcagtgggcccaaaattttttttgaatgacaaatggggcccatatatatatatatatatatatatatatatatatatatataattctaatgtcatataagcgtcatgtgggatgaagactaggtcaacatcaccacgtagacaccatatcagcgaaaccgtcctctaaaaccactgagagagtcaaattgcaccaattttaatagttggggatcaagatatcagtattgcggttcagggataggaatatcactagttaaggaagtcatattggacttccaccgaacgttcagataagtgggtttgcgccgaacggcgtatcagaccctgtctcgcgctaggcggctcccagccggcaatcctaaccctcccctccaccacccccacccaccgacaccgtcgtcttcttcttctcccattagtcgctactcgccatggccgcatcccgttattaccttaatctggattttgacgtttccgatatgaagcctctgcccgactactgcttttccgaggcctgggaggtgtgggaagcccatgctgatcaatcggattatgaaagggaacaggctgttttgagggtaaggaaggaaagctctaaggttgatttttttttaaaaaaataattgattgcgtatctacattctcccgaattactatcattcattcgcatggttttttggatcgttttgtgttagtacgcccgacgccgtcgccttcttcggtggacttggttctatcagggtgcacttcgttagggcttatttgtatatcaggctgtccagattagtcctggtttagaagcgaaaaaatgaactaaaattccatccaattccatgagattagtgccacccgaactagaccgaaatttcgaggggtccgtcggtagacatccctgcggaaaggggagaggtagggcgtgtcggtgggaaaggagaaatgggaggtagagcgtgttggtggggatgaccaagggctgaaccccaaaaattctagtcccacggatgggagtttgcataaaggtcgcaaaatctcagcccgtttatttttcagatttaaatctttgtgttcgatctgtggtatatatacccgctggaatgctggttagttaactaatgattgcgtggatggaacacgtgggataattttgcatctacagttctattttatattttatttttaatgtagaactgttaccggatagagtaagtgctgatatgcatgttttaggcctaagtctttgccatcttctgtttgcattaaacatcagttccttgcattcaagaaacagacgtggcaacagaagtacagtctttaagaatgctacattgtcttatgttctgaaattattggaaatgaatttgctagatgagattgcgccattttttctgataatttgtgttgtatcctgttgtatgatttttttttgtatttcattctgttactcaatttgcataaatattcaactaatatttcataatatgcatgcagttctatgaagaaaaggagaaggagataaaagctgcttattctgaagccctaagtgacgaggatgatgaggagaaagatggagaaatatgtcaggtgatgatagctatcgtgacagtctatttgtagtgcagttgagattcattattcctcatgattattgactaatggttgcatctgttcagcttctgggttacgaagaggaacatggacaagtctctgcagggatggaagatataccagaaaaccatgtcaaaaaaggctgcacttacgcgagcccagagtacctggcggagctaactcagaaaattctattggaaataaatgtaaatgaagaccttggcaatgtaaggcttcaaggttcattcatctgcgtgcttttttaaatttatcttttaggtggttgggcagtttagtgcccagcgcagtttatattgattgataatttttctgccaatatgaaccgagatgaaagttctgcacctattttccttttgtttatcttgtactctgttatgctattggattgaacagccaggtgattaatacactcttattattttctcttttttatcgaagggtaacacagttgtctcttctggagtcatggaaggtgatgaggacaagaaaactgttaaaacaggttaggtgctgatgattttaattttgatttgccgctctgtttttctttttgttcaacaaaactaattatacaacagccatttcatattgcagtttaggttagttgtcaatcatagttcacatctatctctaatgcaaatgtctttttaggtgctatgtcatgaaatgaagcatgctcgtaatgaaggaggacaagtatttgaaggtgagctggaacacaagaaggcaagaatggcagaaagctcacagaacaaaggagaagatgaagagacccttctgccagtacgtaccgtttgacttgacttgatttaattgaagtgttctcttgaagttaatttgatttccttacgagtgttctgatgggccaaacttttgtacctgaacaatcaagatatgctacttcacatttcgtatataaccaaattttgatagggctagcttggaccccttcataagtttacttgaaatgcctacttcacataagttggaacgtgcctatttaaatttgaaccaatctttaggctttcaaatcagatagaaatgctgattcaaataaatgaactgggacttttggagtgcatttgttccctttaaaactacatttctccaattagtgctgagatattgtattttttcatgaaaataactcgattcgattaatttttgaatgttctttggtaggggtgacatggcattttatggttgatctaccaactttggtatttatttgcagtgaaatttggtttctgcacagaaagtattactacttcagttatagtgttcgctcgcattttagttttaacacttttagcttgtatgggcagatggggttttgattagtcaaaagcagttatgtgctttgttgtataagatgatttcttttcgacgcaatgtggtgtattttgtcctagaaaaagttcatgttgctatccgttgagaatgggaggtttgtccaaatgtttgcatacttttggatgtagttcttgtgcatctcaattttgcatttgtttattttggacctctgttgacacccgcatgccctgaaaacttgtttgtttttgtatttagtttattattcttttgtaatgtccaaaacttttttgattggtcgcaaagcctttcttttcttaccttgcattgtgatcgctaagctgtggtataacattgtgttatttcctgacaggtcggtctgacaccggatgacatctgaggtggctaatcaatgtgattcaatagaaactcaatctgctgcagtggtcctttggtgtcccaacattgttaaaaactgtgaacaacgttcatcgttgttccttgatgtcgacttctgtctagtgtcttgaattggcaagcctgaataatcactgttggtatttttaatatggggctgtatagatatcagtcaactaaagttttattaccaagttttgctcactttttatttacggcaggcctgttaagggataatatggtccgttggtgtacatgccttagagattatttaggctgtgtgatcgatcagtgagctttccttgggtctttttaagtgggttctgttggggtggaaaagctaattcgtacatacgaggtagtggcccacatttctatttgaaaggggaaaaagtctactttgactcccttaaaaaggtaggttcgtattctcaataaaaaaaaaccgagtttgacgacttcctcaaatctcaaatattaaaacctgcacagatcaactactatgacaggattgaaggtgtggtgttaaatgatgtagcctttgatcctggtcaacactgctgtcttagttggggtaatgggaaataaagggcgggggcttcttggcgggtttcttccacgtccagtgttccccatctcgttgcttcggcaggaggtgtggctgcggcggcttcgtcgacggcgaggagggtgtaaccgtgtaagagcagggatagtgagctcgccgagtgagggctcgtcggcatctgcttcgcacatcctgtatcgggtaggcccattcgactacgagctggcagtggcgtgcaagtccaggaccaaggctgcgaggtagatcttgtggagcctagacaaccttggtcagtgatatttcaaataccccaacgtgagggtgaggtttttttcgttttgctagctaggctggttcagatttgtgttttgggctggagttctagggtttgttgttgcagtctggtgggtgcgtgcgatttctttgcttggtttgaaggcccgacgagcagtttcatcaaagaattgttactaaagatggcaggttgaaggcatcagagcttgatgtaactaggcaggagttggctacatcaggctgtgttcttttgtctgtgttaccaacaccatttctctcgtttttcgtgtgcacgtttttcaaactgctaaacagtatgtttttttttaaaaaatatttctatacgaaagttgtttttaaaaaagctaatacttaattaatcacacgttactggaccacttcgttttctgtgcgaagacaactccacctctgacagcttaggattattataatctatattattaattaagagtaagctgaaacagatagcttattatgatatattattataatctccgaccctatttgattcagcttaggattattataatctggattattaatagtaagctgaaatggatagcttagggcctgttcactttgatgctaaaataaaccttaccaaattttggcaataccaaaattttggcaatgttggcactattaccaaattctgacataatttcttatgtatttactaaaatttggcaataaactaaatgtaggcactcttttggcaattttgctaaaaaatggtatggttgaaagctagattactataatatggtaattcactctaaatgtgcttttttaattattgggtggctaacagctaacaaacagttaataatctagagaaacaaacaactaacaacttgttttatgtcggtttattataatccagtttatagtaatctggctcaataatctagattacaataatcttaaactgaaacaaacatggcctaaagatagctgtgttaaaggataggaataagttcacatgccgtccctcaacattataccgagtttgtttgacatcccttatcctcaatatcagaaatcttcacccctaaactgtacaaaaccgtgcattttaggtcccatagtagtatagaaacctggttttgctgacttagcatcctagtcgaaaaaaaagtatgtggggcccacatgtaagtgagaaaatgatgtgggcttcacatctcttctttatttcctttttctcttctcttctctccttgtcttctcagtcggcagcagatgggggagaggcggccggtggcaggcgagcgcacatgaagaaactaggcggtggttgtgcgcatcgtctgcatcgtgcctgctccgtccgccgccgccccgcgctcacacactcctgccggccacctccccctccctcccaagcttgtgaagaagagagaagaaagaagatgatgacgtcgtcatccccgggtggtttcccacggccgcacccgacggcgggggcagtggcggcggcggcagaacaacagcttggagttgagaaagtcgtagcgtgtaggccgggcaggtggctgcgccaatggtgacgacattggcggggacagaggcatcacgaggatcgtcgggccggtcatccctccgagcaaggggaggtggagtagcaacgaggaggaggtggacacccgaagggaggaaagcagtggggaggtggagtagcaacgaggagggctaggacgcagccagttgatgccggcagaggagccactcggcgccgaagcaccagcagaggaagacaagggattcgctgctgcctctgacccctttgccgccgggaactgaagaagagaataaaagaaaagagaaaattaaagaaaaaaagagatgtagacctcacatttttctcttttcacttacatgtagacctcacatacttttttatatttttttctgactaggatgcacgtcagtaaaaccgaacatctatatactactatgagacctaaattgtatgg

SEQ ID NO: 65245 - DNA, 10856 bp, Oryza sativa
  unsure (1)..(10856): unsure at all n locations
gcgctaacacactcntgcgggccacctccccctccctcccaagcttgtgaagaagagagaagaaagaagatgatgacgtcgtcatcccgggtggttttcccacggccgcacccgacggcgngggcagtggcggcggcggcagaacaaccagcttggagttgaaaaagtcgtagcgtgtaggccgggcaaggtggctgcgccaatggtgacgacattggcggggacagaggcatcacgaggatcgtcgggccggtcatccctccgagcaaggggaggtggagtagcaacgaggaggaggtggacacccgaagggaggaaagcagtggggaggtggagtagcaacgaggagggctaggacgcagccagttgatgccggcagaggagccactcggcgccgaagcaccagcagaggaagacaagggattcgctgctgcctctgacccctttgccgccgggaactgaagaagagaataaaagaaaagagaaaattaaagaaaaaaagagatgtagacctcacatttttctcttttcacttacatgtagacctcacatacttttttatatttttttctgactaggatgcacgtcagtaaaaccgaacatctatatactactatgagacctaaattgtatggttttgtatagttgaggggtgaagatttctgatattgagggtaagagatgtcatgtaaagttgaggggctgtgttcgggaggaggggttgcggcacgcaaaacgaagcctctattattgcatgattaattgagtatttactatttttttaaaaatagattaatatgattttttaaagcaacttttgtatagaaattttttacaaaaaaacacaccgttttagtagtttgaaaagtgtgcgcgtggaaaacgaggggaggggttgagaactagtactaccgaacgcagcctaatttgtgagatgtactctcttcagtcttcccttccaaaatcacacagaaaaccctcacacagaaaactgccgatggcggacgccgtcgccgcctacgatgcgctgcccgcgccttcctcttcaccctcacccgcgttgccaccgccgttccagcccccgccccccgataccccgatatccgacgccaccccatccgccgccgaaacccccaatcttcccgacacccccgcctccgcaacccgactcccccttatccgacgccgcgctcgccgtcgacgccttcgatgccgatgcctcagccgtcgccgcgccacccgacgacgacgggaccaacccgttgggcggcgccatgaagcacatggccctcgcgcccccgccgtcgccgagcaagaagtccaagaagaagaacagcaacagcgtctggaccaggcccaactcccgcaagggcaagaagaaggccaagcagccggccaacgccctcgccggcggcagcgccggcgccaacggccggcttcccaagcccttcagcggcgacgacgagctcgtcctcaccccggcgccccgattcgcggccgagcgcaacgacgacgcgcccgatctgcccgtgctcctctcccgcgtcttcaagtccgacaaggtcgaggtctccgacgaccgcctcaccgccggcagcacaaagggataccggatggtgcgcgccacccgcggcgtcgctgccggcgcttggtacttcgaggtcaaggtccttcacctcggcagcaccggccacacccgccttggatgggctaccaacaatgctgacatccacgctcccgtaggctacgatgtgtttggatttggataccgcgacatggatggtaccaaggtgcacaaagcatggagggccaattatgccgatcaaggctatggcgagggcgatgtactcggcttctacattcatctacctgatggagagctgtatgagcccaagcagcctttcctggttcactacaaggggcttcctttccgcgcagaagctcccaaggcagctgagcagaagacgccggatccagttcctggtgggtatcattgtgttacttcatgtgtctgaataaactggtggtagattgccagccaggaaaacaacacacgctacttttcacaaaacaacttggtatgaactagcaatttcacaaataataagattctctatgtaataacaaggatgcgtgtttcatgatgttatatggaatacttggagtaatgtagaatttgtaccaattacggaattaccggtagtagatttacatagataaagtgatttaggatccaggacaacagattcgagtgctatttacatgtatatggttatataggaaatattagaacttccaatagctgtaatgtgacagtggtgcacttgtcctaacaaaactaaaaagtacgtttaattaagtttttgcatcctatgtttgagcaagtttctgatctctgtttggttggacacattggtacctactcctacatgtgtttcaagtcactgcacctccattgcacaaactagaaagtagtttctactcactgctcttgaaatcatttccaaagcataaagtgtcttgtaccaagaaatatagctattgcacaaattgtcatcattattattggaggttcttagcgctgaagcatagtgaatgcagcatacagttcataagtcacaatgtaagaaagagagcaagaaatgcagcaaatgcttctctagcaatgctctcttgagaggcacaacatgaaaaatgtaacaatttgcttctacagttgtgcgtaacttattgatttgccactcaatcaaagacaagaaacacctaccaaatgttactaaatttacccatattgttctgttcaagagtatctatgtcatcatctgaccttaaattatattcttgactgtttgacagtgcatagtcttttttgtattccatactagtaaaaacaaatacctgcaacctcacttttttgagaagataatatgttcttgactattatatcctaaagtataattacttatttggttctggaatttatctacatcaaaacaagtactgcatgatatgctgtaccaatcctaactcgaaggtgcaatcttcctactatatcataggaggttacttttgggagtgtttacttatccagccatcattgcaatcttatcgtgcagaagattccattatgtttatgtgcacatgaataaaacgggcagttctttcttatctgttttcttatgatgaagtcagaaatcgatgactgtaaagtttttgttgcctcaaagtcagtaattgtaaataagtgcacattagtaccttccattgaatcactatattttgcttacatggattaaaaaagggatttcttgtttgttcttcccatagaaaaaaaatcagtatcctatatgacatttacacaattgcacttaaatgacatttcctactttctagcatccattgttagatgctagaaagtatccatcgtaagtaggaaaacaagggatgctagaaagtagcaatttgtgcagcctctcctctggccttcttagatattccattttaatactttatggttcttgcaaatgcaggtagtgagatatgctacttcaagaatggggtatgccagggcactgcttttgtggacattcctggagggcggtactacccagctgcgtcaatgtataccctgcctgaccagccaaactgcgaagtcagattcaactttggtcccaattttgagttctttccagaagattttggaggtcgatcagttcctcaaccaatgaataatgtgccttatcgaccatatcagctggcgaatgaggtgcctgcagaaaacggtactgctgaaaaaaccattaaactgcagtgaaaattctgctttagttagagcttatgtaatccggttaaacagcacgcgggctgatggctatagctggtttagtaatgtttgtctggttagatggatgctgtagttattgaatatttttcacttgatggtttggccatttgaccttcgtgtagcaacgcatgccttcaatctttcccatccatgatggggcgaagttaatccgagatgttggggggcggtaagggcggttgcacgtagtctagcagtgggatgaggattaagggcgacagtttaatactcataatatgtaatatttggtcaataatgtttggccgaatcttatcctaaggaggagtaatacaaatagatgagaggtacatctaattttatccatgttattaattcataagaaggtattatacatttttctgtggatacatgtaagtagcttcgttaacagaaaaatgtatcaatgaagctgatattatacagaaaattttctgttgcatacaaggataccagcatttatgccagatgatactcgacctggggtaggcaggtagtgtgaattacctttgaagaaaaaaaattgaaacatcaatatcataatatattataacattttttataccagtgcagtctccatgtaaagaaacacaatgtttgcaaagcaccggacctttaatttccaatgtttcatatcttaatcttaaataaacaaatacaaaaaccagcttcatcattctgcgagataacagtgttgaagagctggaagacaagtgattttctaacataaatatggaatttgaaaatcctatataagacagttgacattttgcatagttttaaatgcatgtacataccaacgtgagagaaataacttcaacttgagtgccatttgattttcagatggctacaagccagatcggttttcaatctgctcaatgccatttctcgatgttgcagcaatgaggtcatgctaggttcactccttttgcgtgccattttccgggagatgttcttccattttgattcgaattcacaggctgcagacaaataattcagttaataggaattcttacgttttggtcaaacttgaaaagggaaacattcctttcatttttatgcaaaagatgcagatggcacctgagtatttaaagcacatagacaatgttaatgtttctctctgcagaaaaagaggcaaataactaaatattttctttatgccaaaggatcaatgaacatgatgaaactttcattataccaaacaaaacaagaaaagaatgaccagtacagacagtcatgtactcatgttgctacattatttcggtatggctaaataaacatagctttctagggtaatgtcataaaataccaacctaagatacaaaataatttcagaagaaagtgcaatgacaccctaaatcaagtgaaaactgcaaagaaaagctgcacttacaagctggagcactctatagctatatgcaattctagtaacatcttaatcaagtctgaggctgttggagaatgatggttacgatcaataaccttcacttctgttgacaaagccttcaataaggcatgcgagattccatggccttccagctgatgaagctttggcgccaccttttaattcaccattatgttgtctcaggctgaaataataaaaatactgtcatcaacacacaattacaatttaaatgtggtatgactaaagatgttcaaattttcacttcatactttctaatcatgttaattgctacatattcaagcatgtaaatcgtacaagcatgagcaagataactactacaatatttcaaggcaactgcaatgtatatatggagaaaaggacaggctctgatatacagcacgagaatatcacagtgacacaaatagacacaacttaacaaacatgatgaagacaggtagagacaagagcagataacagcttatttagcagaaaatattctgcatgtttaacctacattgctagaagtagaccaaactcaggtttgattcatgtgccaatatcttcaccaaaaggagtaggactaaacaatgacctgaatttcgttctctcccaagtcccataacttttcacaacaaatcggccgcaggaactgaggtcgattccaacctcctcaatccttattatttcaaacgctctgcgctgcgcctacttgctactcatgctctaccacaagtctacaaccttctgagacatctcgctctagaaatcagacaggagtaggagacagggaagcaaggtaagctgggaatcaccggcgagggaagtcggtggtgacgccgacgtaggtgcgggggatccgggaggaggcgatgaggtagacgcaccaccccgacgccgccttccccttcgcagcctccgccggcgaactaccgggcgcgcacgacgccgacgcggcggcggcggcggcggcgggctcgccggatttgggaggaagagcgcgagggatcttcgccgatcggaaggtagcggagagcttcatctcccacctcgccggcgaggcgacgacgccgtgagaaaattttcgaattggggatatttttagcacgtgcttttttagaggagtatcaggccgtggcccgtggggcgtgttggacatgggccgaatggacaaatgggccgtaccggaatgtgagcctaattcgacacggccagtttaagcctgggaaacgtgcgtcgaaaatgaattccggcatgcttcgaacgtgtgaaaatatgcgataaatcagaaatctacgtgatggaattcggatgattatattgcagaggttgcacgtgccaaataaccgtgcatatactagctgggaaatggcatttttctgatacgcgtaggggaaaaggctcgcttgtgccaaatttgaagctgggtttgggttgtcatgaaaggcaaatggagaaaagaattaggcactagggtgagtgtaaatcagagggtggttaggcagtgcaaccctggaaagtttttccaaatgtggaatgcaagctcgcggcatgaaagataactgggcgctaattgcctctgcattactgttcctcatccaagtctgacactatgatgttcagttaacaggttgatgtcgtgtaaaaaaaataggttgatgtcaagatcctcagacatcttaatgtggaatacaaatctcttttatttctaatgggaaaatagataaccggcccaattagtgtcaaatgcataatctgaggacacctggtgtccaataatgcaacactcacatggttcttgcttgaattatcttgaagtagatgctcaatctaaaatagtcggttatcttgtactcaaaatgatctagtgcaaactggcggattgtatctttaagtccaaaaggctttctgaataaaggtgcttctgaatttcatttaacgactgtcctatcctgaaattgtcaaactgacaaccagttcagccgaactagcgcgtatttaaattgcactgatctttcatcttaatattaaaatttcctgcaattttatttggcagaaaaaactagttcatcagttagcttgcggcattgccacgtgcagcatgcaaagcacaagaccaccaaactaacattcctaccccagcatggctgcatttcactgtaatcttcttcagatataaacatgtcaatttgcttccgaagaggctggagccttgcatcagtcccaagcagagtggatcattttggaggtttggccgatcaactttcgagtttttggttgcatatagtcacaaccaaactcaagatgcatgatgaatttcttccaagaaaaaaacttttggattaattgcccgaaatgtgggagcagagaacgcgcagctatgaaagacacggtgcctgacaacgcatttcccgccgttttcaaatcaacagaagcaactctgagctttccctccatttctcatgctccctgcgtatataacaagctccatctcggatcgagcgcatgcagcggtgacacatggcggcttctatctccggagctcgcacttgctaccctagcgcggcggtggcgcgacgtggcggcggcggcggccggtgctgctccgtcgtcaggagctcgctggcgacctcgtcgccggcgacgtgcaagccgtcagggatgatgcggattggcaggcagtggacggagctccagggtgctcgtgattgggacggcctgcttaacccgctcgacggcgcgctccggggcgagctcgtccgctacggcgagttcgtccgcgccgcgtacgccagcttcgacttcgacggcggcgcgccgtcgtcgtatgggtcgtgccggtttccgaccagctccctgctgcgccggtccgggctccctgagactggctaccgggtcaccgggatcctccacgccgcgtcgacgtcggcgcccggctggctgtcgtgcaggtccagctacattgggtacgtcgcggtgtgcgacgacgaggacgagatcgagcggctgggtcgccgcgacgtcgtcattgcgttccgcggcacggcgacgtgcggcgagtgggtggacaacttcaagtccactctcacccacctgccggcgcgatccggcgacggcgaggcggcgccggcgatggtggagagtggattcttgaggctcttcaccacccccggcgaagcgcacggcagcctgcagcaacaagtgcgcggcgaggtgcagcggatcgtcagcgagtacggcggcgagggcatgccgccgttgagcatcacggtcaccggacacagcctcggcgccgcgctcgcggtgctcaccgcctacgacatcacgacaaactcccccatgcaacgccacggcggcggcgacgacgacgacggcgaggcgccgatggtgaccgccgtgtcgttcggcgggccgcgcgtgggcaacgcggcgttccggcgaaggctggaggagagcggcggcaaggtgctccgcgtggtgaactcgaacgacgtcgtgaccaaggtgccggggttccccgtcgacggcgacgactgcggcggcggcgctcgggagggcgacgcgccggcgaggaggaaaccgaggttgccgaggtggctggtgtccaagatggggtgggagtacagcgacgtcggccgcgagctgcgcctttgcagccagggcgacacggcgcgcaacgtggttgcatcgcatgaccttgatttgtatctcaagctcgtggcagcctgcacatattagttaggacctgtgtctacgctaacacagtaattaacacagtaattagcacagcttagttaggacctgtagccaatgcattaacacgttaggagtaattaacgcacgcacctcagtttgctgtcaaacggtgattcttttttttttttactgacagagaacaggaatagatcaactacagagtgacagtatcagtcattcacagtttctgtaaaatggtgattcttttgtaatgacaaaacgtaacggaagttaaaatgtcttttgacctgttcacattactgttcttccataacagttcatatactgttcttccaaaacgtaacggagtacgtcatttgcttagcagatgacttaacgcgtacattgtcatggaaaattggactttcgatgtttttttcttttcgtagtaaaacaaagcaaattacgggctgttctgttataaaaatggatgagctacatattatcactgtttcagctcgaaagcatggccatcccgttctttttcccttctgcaccggccaaaacgcagaacattacaactgtcaggtgttcatggcactgtaattcctagtacaaatacagttttacctctcgcaggataaactataagtgtctaatagcatcaggcacgttgcttcttcccacttggcatatcatcatcgtaatgcccgccatcatgccctccatctttgtcacctttctttctcgcaagtatcttgttgattttgtggaggtcattcgtgagcttctggtccttgttctgcttcctcgtcttcctgccatcctgcatcttcaccccaaactggaatgcagccttcggcatggcttccttctggtcgttgtatgtggcccactcctcttctgtctcaaagtcccacctgtgaagacggcccttagcctgcaaaggaatcatacattataatgaagctggaaataggtagtattaagttttttaaaatggatagaaaacatgagctcaagaaatccacaaaagcaagtttatctttttttttctttgaaacagaggagaaacagctcctacccttaccaaatttactcttaaggaaaagcatcagttcagcgacaggaaaagacgaaaaaaaactaaaaacatccactgacgggttacacaacaaactgtgccatcccacacattctatgtaacccctaaaacaggctaggtgaaacaggtccatcaagtccacacaagaggctaaaaagcaactttatctgctataacgaagggaaacgaaaaaaaaaaaaagcatacagaatactacagtactcacttacccggccacccatgtccatcttcgataaatcatcttcttcatcgctgcctgcaatctcatgattatactcctgataaccaggatagcactcggagtaactatccgagataaaattaggatctttctcccgtgcatctttctccctcagctgtttaagcctttcatcatcgcgtttgaaaacagaaccaagacctctgtctttatctgcttgagtcatcaaccttggatcctgggttatatttggatcagctagtacatcacagtcctgagcgctttgttgcatgtactgttctggataagccatctgttgttcgccatactgatagcctgaccactccccttgatatccagcagctaccatttgagcttgaatagcatcgtacgcattctgacatcagaagagaacttttaggaaatacaggtcaagaatagaacaagctaataaatggctatttcagtagaaggttgtaaacaaacacttcgtttgtctccaacattcgacacgcataactataattgctcataacacagtagaaccaaagttaaacattagctggattaccgg

SEQ ID NO: 65246 - DNA, 3235 bp, Oryza sativa
tttgtgtccctctcctttttctttttcttcaagactttcccagatgatccaagtcgaaggtatgacatgattttagcaatcctatcaagtacagaaccatccacactgacagttaccatctcctgcataagcaagaagaatactgaggaaaataataaatttcaggaaacttcaatgtggcatatgatgtattgccataatacctctggaacagagcaatcagctttgctcctgtgaagtgttgtcggaatatcattggtaagtccatcctcctggtttcattaatgaaattaatcactctccagctaaaacccgtagttcaaatcaaagcagggaatgatgaaaaaaattatttgcaaatagcataaatcaatagtactggacatgccacaataataggcaatgcgaacacctttactcttattatcagaaaatcatttggaaggttaaatccattaaatgaaaacattatgcatacaaaatatgatctagtgatgatttctgacttgtaagatggatcatggtcatagtgaacatactgtatattagtaatcattgaagccatgatgcatcgcaatcacaatttaaatgtgcatgacataaaaatcattgcaccagacacatgtaaccgcaatactatactatagtctataagtatgatatttgaagagttctttcatccttcctttatttcttctcttgtttgcatattgtggagtgaagtgagagtttgagcatgttgattgtactgcattccaggtgatgagcagagaaacaaacaataatacatcatgaaacatagtcatgcatcatgtatactataaaagctgacaaaacataagcatgttatcatttacatgctagcacagaattgaaaaattcgaaattgaaatagcaataacgtttatttgcaacatagcagcatcatgtttcgtacagatgaatcctgatgagagatgaaaataaaataatatattgtagtatcatattatgaaggaaaatggccaccaccaattacaaaaaaaatgtaattaacataagggggaactttgaaggaggtaccatgttgtaaataaatgccatccgaccaggaagaaacatttcattcgactttatgatgctttgtggctttatgatccattgatagacagactgcaatgaaccaagaactgcttttagtgtccatgttacattacattacatggtcaataatataagcagccaacatcaattctattgtaaattaaaaggaaacctacctttgcagctgcagtgcggaatgagactgcttgatcttcttttgtagacctgtacaacacaaattcacaggctaaatatatgtatcctagttaaatacaaactcacgaagtgcgtccagacaaggacgaaggacatgagaccatattttcatagtgctacatcccaaatcaagagaaatgcctataagcaattgttgtattattccaatgagaatgctgtacagaacatcatgtttcactgagaatgatccagcagccactataaagcatagtaaaattatgaataattgaaatgcgcagaacaattctgcttgacagtattcatccacaacaaaacaggaaaacacctactaaaattccaacaagagaaaaatggatctctctcttaacttcacctcccattacaagaaataggactaggcctaaaaaaggttgacaatttgttgtatcacaaaataattaatggaatcaactctgcgctttcataaaaattatgcaagtgatagccactgttttcaatatattacagcatttgaaatgaaacatggatctgatagcttgtctacaatacttctcattattacaaaactatcaagagaaagtataattaaatggcgtgaaactaaagctgcagtatggtgggaagtaccttgactgtgtatcctttccatcttctgcttcaggcttcttttctatttcacttcgtactttgtgaagtagagcatagtccaagcctttgaccaaatgtgtatgttccagatcacctttaagatacaaagtgaaaattaaatgtcaatcaacatggtggtttagaagaaagacaaaaaagtgccagcaatctaagtctccaaatccacaacatatatcatattcttagaaaatatgtccaactaaagtatccatctttagttttgagctatagaaccaaattctttgaccgcatataactgactgactaggtcaaaatactaagtatatgctagttcttgatattttaaaataaaaaggaacctaaaaagcaagcaggtattcgctcgtcatatttcaaataaaagatctgaaactgccacaattttgtggacataaaacagttccaaagaaagattcaatttctcatttccacagatatcagaagcaaactatatcataatttcaaccgctcgtgcagatctaatgagcatttgtctatatacaaatgaagtgtttaaaacccaatataagttgttcacaaaaggatgaaaagcattctcttaaaagaaaagggtataacactgttgcagtaccaacctccgagatatttgcttttctcaatagatatcttgtgtgcatctgctagcctgtaatacaaacaattccagatgctgagttccagaatagcatacaataaaccaagcatataaaatgtcacacaaatgaaacctgtggtctgttaccttaaatctgctccaggaggtgccacagcatgaaatgaaccaagctctgtaggttcataatcagggttttgatcttcacgacgctccttagcacgatctcgataccttggtgtctctggttcttcttttttctcctctctgcatgggaaaacaagggagaattaggttagcccgattgacttgatccataagaccctaaagagagaggaatgctggaagtagttgtaactgcatctgatttatcagtgacgggttcccatcctagcggagcagtgcgagagatgacagggccacactagtaaaaaaaatggggatttttattaagtgcacaaaaattggtactttgtggccaggtttggtatctggtttagccagggcccaggggtgtgaaaaaatcattctaggtccaaaaagaagattcttattaatcattatcagtttatcacttcctactttaacatgattacagattctgcaaacttgacttgaaatgctgcaaaaagggaattaattatcctcctctgactacaatggatctgaata

SEQ ID NO: 65247 - DNA, 2723 bp, Oryza sativa
gttagaagcgttggccttggttggtctggccaatctaggcaaaccatctgtgcctgacggcgttgttctgggtatgataggtgggcccatatggtagtgcactgtggatttgctcaatttcagtcggttttgactaacatgtgggccctccaatccatatgctcgcgtataatttgtcggaggtacacttcgtcgtatggcgggtgtattttcatccaaaattacttgcatacaaatatttaccaatagttatggaaatggttagtaataatctcctaccactatgtttcatactttattttgtattctttatgtaggaattgatggttaaagttaatgactgtcaacagtggcataagttcgaagtttagtgatcctaagtatcagatgtgtgaggattactgggatgaattcgccagctacagaatatctaaggaggcaagaaaaatgagtgaacaaaacaaggccagctctgcaatgaacaagtatcctcactgacttgagccaagcgaatatgctaagaatatacccaaatggaatgagatggagaaaaagctatattgagcaggtgcaacacctgagacagagcggtggggaacccggacaaaacactatgtgtactctaggaacacagaactatcacctttggggagttgatcgccgcatgatctcatcggcaagagctaaaacagagattgttgagacccattcgtagtcatcaaagggtacttttgtgcctgaaagagatagatgagctcacattggcattgaggaacccccaacaccctggacgcatgaaagatgtaggtctcattccttcgaggtgtaggtacaacaagtataacataggagggagaagatcacagatacttcatgcaattcatctcaaagatcgatcaagatgaaacaaaatttagggagacaaggatttcttttctgatgttcgaataacagggatcctccactccgtcgatgtgctctagagaactagatctcgattaaccccttgcctcatcaagcaaagatccacgaagaagtctttggcctccgagcaggaaccagtgaaacttgctctaccaagacaacctccgagcagccagctcggaatgtcctccaagtctgaaggcgaactctactctcatacacctacccaggtcaaagtacagcttgagcaagctcgagggtgacacttaactgtctaggagatcaccctccaagagtaataaacaccaaacagtagcctaacgacaatccctaagtgcttaggtcctcctagctcgctcaccagcatcaaacctcacgaccacccaagaaacacactcaaatcactatgggagcttaagaattagatggcagaggtcaagaaactctaggagaagctagcagatagagacgcaaaatcggaattgtcaaaggagcacagggggggggggggaggtaggaatatatacccactccatgatgtcatgtagccgttactcacatctttgaactagaaagatgtctggaagttccggacagaaatgtcaggaacttattctgaccaacatttagggacatgcagaaaaacaggggcctagaatttccggcccagaacacctagatgtttcgacccacacattatgagaaaacccaaacttgtgcaagtgttatgcaaatgtgtctcttatctagacaccttgagcacatgaatagacggatgcaaccgtttggtatcccctgatagtatggcttttaatagactgaaaagtaaaaaagaaatttaaataagctccgagtccttgcgccgatttgcatcatgtttgtacaggtctccaagcacacttaggctgcttttgttattttgtgttcccaacaaagctgctgcccacggaaaacagaacaatctattatagcgtgattaattaagtattagctattttttcaaaaatagatcaatatgattttttaagcaactttttgtaaaaaacgcaccgtttagcagtttgaaaagcgtgtacgcggaaaacgaaagggggagttgggaacacagccttacatatttttacatagtttttaaaatgttagttgatgtgtctgtttgtgtgatataggatatattcttccgaatagtcccacaaaatgaactacgacacaggtgatgcatggacggctttacattcttattattacctttacatagtttcatacaacatatacatatatagaggcatccatgcatgcatccatccagttgtccggcatgcatttgcttatttatatgccatctcacaaacccacaacacacacactcataacacacaacgcatttgtttaactatatatatatcggccgtccacaagcacacacacactgcacaaacaaacacagatatatatatattcttgggttaatttcttcatctcatgtgggagcacgagttgaagcagtagttgaagcagaggccggtgcactgctggtagacgctgtactggcactgactgcaagcctgtggccctgcgaggctgcaggccttgccgcacgccgagatgggcgccggcctgcacgacgaggcgcagctctgattgcagattgagtggcaatcccgctgctgcgcctccacgggtgggatactgacgagcacgacggcggcgcaaacggcggcgacaacgactaaaacgacggtgcggatggaggccattttgtgtcagcttatgagctagagaggggaagaagaggcagg

SEQ ID NO: 65248 - DNA, 705 bp, Oryza sativa
tgaaatatgaaattttaatagttgaaacatttatactatttttcatcatgattataatatatgttgttgtagagttttaattgaaagacattcaatagtgtaatggaattcaaatcagataagtagtttagagaaaaaaattgtatgtatgcatagatgaagtcggagtatagacaattgcatgggtgcccgatattttgctagcatattaagaagcaaattgcgaagctgcagaatggtttcatataaagataatagtacctccattaagccattaacttggactatagaatacactacataaatacactcaaatttgggaaattttggctcatagcaaacaaaagttgtgttagtacaactagcaaatcccaaatgcatgttgatgaaatcgttgattactataggcagcgggaccacttcctacaggaaagcaaccatggggcatcgatcatcatcctcgaagggccatgctggatgttgcctccatgtaggatgaccaactggtaggcgaatccacatcaagacatgcaagatgtaacttgttagaatttataacttaagaccaaaaaatgaatcacaacataaaaaactgccacatacctatagcaaccaaacacaacctgccaagttagcatctgcactagtccttcggcatgcatctcaattcacacaggtgcttgtacaaccatgctagggcagcag

SEQ ID NO: 65249 - DNA, 589 bp, Oryza sativa
cgaattcgagctcggtacccatctgcacgcacatgcggtacataccgatatacgcgtccctgcacatcaatcttcaaattctcgatcggctagctgctcattggtgccgagcgtcgcgcgcattcttgtcctagtcgccggagcatggcgaccacaggacgattgctgctgccccacgacatgtacaggaggctgcaggctcccacggcagcggccgcggccgcggccgcgctctttattttggcgccccaccttccagaggcctaacgctgccgctgccgtaccggaaggatacagcaacggtcgcttcggctccgtcccggcgtgcagcgaggccatcgccgccttggaggagacgtcggccggcgaggcgaaggagaaggactgctccgtgtgcctggaggccttcgaggaggagagcgacaagctgatgaggaagatgccgtgctgccatgccttccatgagagctgcatcttcgagtggctgcaggtcagccgcctctgcccgctctgccgcttcgcgctgcccacccaggcggaggcggaggcgggactgtggccattgctcacgcctggttctggttcgggg

SEQ ID NO: 65250 - DNA, 3555 bp, Oryza sativa
tcaggatgacaatttgagaagttggtacacaaccaaccaactaagaggaactccggatgccttcgtcaatctctgcccatcaggtgcctctaaaggcttgacaccaatgtactgaaccactacaccccctccaattaccggaattaatgtcactggtgattgcttggccccgtataggaagagccaagatcatggtgacctcctcgagtgtcagcgtcagctccccgctgggtaggtggaaagtgtgactctctggcctctatcggtccataagagccgtcaatgccgcggcgttgtacagaggcatgtgccattgtgccatagtgataaacgccaacaactttgcccaccgttggaacgaaatgtaccagttgctgaacgggatgtgtgctgtgtgatctctgactcgtagagtcttgaggcgctgcatccgtagacataaaaaatttgttagtgtcagtaaatccatgcaataaatagaaatgcttaaaacatacaaggaatagtgaaatggaggataacctctccacttgctatcctaggagcctggtgcctctcctcaaagtactcctctagaccgggaaacaacaccctcttacaattgaacatgaagtcatcagttaatgatacaattatgatatgcaaattgagaaaaaatgtacaacaaagcaaaaacaacctgtgtactggacccaccacctccccccgtcctacggcattttttcggtcgatccttagatttgtctcgattcggacaccgagttttcttatggcctggttgatggcatatggaacatttgtttgtgtctgtcatgtgcttgtatctttgtagcctttatccatgtcatttttaaacgtttttgtccttcgtcttcctccagtgtcgttcttcaaggacaagtcaggaacaaagaactcacgtcataactcggccactgggatggatctaagtagggctcaaacctcggggagtatgtgtgctgcacaacctcattggaagcttcgaaacatatccgtggggacacctccatgtccaaaccttggagtctctagatggttatcatgtgtgagcatggcatgtggtggagttgaggaaattggcaagtaaatgtgttatctcttgcaaccacgacatagtgacatccaccccattgcacaccggccgtcttgactctgccttgtgtcagttacagctgcactgacctctacaaccgccttacaactgtcattacaattctataaatagaggagagcttctcatttcacaacacacacctcaaggagcaattctcactattccatattgtattatctatagtttagtagaaataaaaattaggagcttcggtcttattcatcccaatccaattcatccatcgtgtgagaaaataactcctcaaatgtgggtttggcacgaaacattaattgcctaacagtcatcccctcaaattggctttcactggtactttcatctaccacatagctactaaaatggagtcgtaccaatctatccatctacatcagttgaccgataaataagagtgcatgattctaaaatagtatgccagtctaaaaatagaaaaatgacattggtaccccaaaactacctacaatatttttgtaattttaatgcctaaccaacggtcacaatgtccttaggatctatacctatcaacatcaacatgaatcaatatgaatccccaaattcatccatagcaaaagagtacaaaacttacaaagccaatatgaatcctccataccaacatcaatatacaatgtggagattatgggtaccccatacccacacggcatggttatctgactagttataggggataacttatatctatggaatatgtaacagatcatgacttgggtattacgtttccttttatattatggagcggcctacagtcctgatttgataatattgtaaaatagatttaggaaaccgatactgtattggttaaggtttctatcttgtaatcctgccccccatactatataaggtgggcaggaggccctctagggggcatgacacacaaactgatcatcagatcaatatacacccggcggattcaaatccccaaacaggagtagggtattacctctcgtcgagagggcctgaacctgtctaaatcctttgtctccgcatccatccacttttaggtctcgtgcgctacccccttttcatattgtcgaaaattcgttacgacagttggcgcgccaggtaggggttgcgtcgagttttccgtcgagaagtgcgatggaatcaacttcataagtcgccggcttcatcttcgcttcgggagttttcacttctttgccgccgacaacttctacaatctgttgctctccgactcggacccaatctagctggcatatcagtctcgacatgctcgatggattcaatttccaccgccaccaagttgattgcttgatcttcgtttactaaaagaccccaagcacgatcgtgcggcatcatcttcattagcaagcctcctcgctttgagagattaacttgctcatgcggctacgacggtgcctcaaccaacgacttcgtcaagctcttcttctagccggaagattaatctcggctcggcgagttcgatgaccaacctccaccgccgcgagttcttttttcgatcgacaagatcatctgcatgttgctatatatacatgcacactcaaaatagccacgtgagttcgtccaagtctgctcgggcccatgtctatatatgcatgcacacaggagcacaacgacaagctacagaggatacatatacagcgtggttaacaaattcttattaaatcatcaccgagacttcctggacatacacaagaaggacaggtggacctccaaattctttgattaggagactaaccaggtcgatgcatataatgctgataatatatgtccaccaagcgtctgggtcacaaaccttcactaggtttatcgttttaatttctttaaataaactagatcaatattaatttttctagtcatttaattcacagatcaccaattatttttgatctgttattttgtgtgcatggtcagtgtactccgccgctgttgctgatggtgacattatcttcaccgccggcagccgtcgtcaccgccgactggtgtctctgcctacacggctggcctattatgtcgccgttgttgggcgtctacgacttcaccgccggcctgcctccgttgccgccgactggtgtctccgcctacacggctggcctgtaatgccgctgttgttgggcgtctacgactccaccgtcggcctgccttcgccgccgccgaccagtgtctccgcctacacggctggcctattacgccgccgttgttgggcatccacgtcttcaccgaccggcttgccttcatcaccgctggatggtgtctccccctacacggctggcctattatgccgccattgttgggcatccacgtcttcaccgaccggcttaccttcgtcgccgccgactggtgtctccgtctgcacggctggcctattatgccgccgctgttgggcatctacgactccaccgccggct

SEQ ID NO: 65251 - DNA, 1334 bp, Oryza sativa
  unsure (1)..(1334): unsure at all n locations
tctccactcaggttcatttttaatacatgtttttgtcatcaccaccttactgccatagattcagtgaattattttctttttttttgttcataaactgcagcttccaattcacatgcatggggggaacgggaaggttgcttacattgacactgagggaacattgtatctttttgaatttacttagcaatagcttcatctgatccatccattcaatggatttatttgcatttctgtatctctccaacttgtttccttaatggagttttcagccggcctgaacgaattgtgccaattgctgagagatttgggatggatgccaatgctgttcttgataacgtatggcccttaatttgactttaccatttcaggcctaacaaaagaagctatctggtatatttgcatctatttcttgtttagatcatatatgctcgtgcatacacctatgagcaccagtacaacttgctccttggcctcgctgccaagatggctgaagagcctttcaggcttctggtaggcatggcttaacataaaaatacattgataagtttgtgtatctcaatctcttatgtggtagtattgttttacctggaattagattgtggattctgtgattgcactattccgtgttgtttcagtggcaggggtgaacttgcagagcgccaggtattgccaatatttgtgttggctaaaacacacacaaataaataatcataaagtagttgaaggcctaaagttatgtactaattactctgaacttgcagcaaaaattggcacagatgctctccgcccttactaagatagctgaggagttcaatgttgcagtgtacatcaccanccaaggtgtgctttcaggactaatcctgtctatcccaagaaagagtaactcaataaggaatttcaaattacaagtgtctttgtttcagtgattgcggacccaggtggtggaatgttcatactgacccgaagaaacctgcgggaggccacgttctggcgcatgcagccaccatccggttgatgctgaggaaaggcaaaggagagcagcgtgtctgcaagatctttgatgcccctaacctgcctgagggagaagctatatccttttgcattgtgcatacatgtttactgaaactacttgttcaattggttaccttggttcagtatgctgctaaaatattgattgattttttctttgtccgaactttctcctcaaaactcttgcagctgctgtttttcccatctgaaaaaaaaacctgttgttttccatcactgaaactctgaagcttcgcatgacagattagcaataatgtggtgtaaaaaaaattgtttcccttgaccaa

SEQ ID NO: 65252 - DNA, 11225 bp, Oryza sativa
ctaccgttgttgggcgtccgtcgactggtgtcctcacctatacggttggctggtcacaccaccgtacatgggcatccatgtcttcaccgaccggcttgccttcatcaccgccgactggtgtctccgcctacacggctggcctattatgccgccgttgttgggcatgcacgtcttgaccgaccggcttgccatcgtcgccgccaactggtgtctccacctgcacggctggcctattatgccgccgctgttgaacatcaacgacttcaccgccggattggcttcgtcgccgccgactggtgtctccgcctacacggctggcctattatgccgccgttgttgggcgtctacgacttcaccgccggcctgcctccgttgccgcccaacggtgtctccgcctacacggctggcctgtaatgccgttgttgttgggcgtctacgacttcaccaccggcctgccttcgccgccgccgaccggtgtctccgcctacacggctgacctattacgccgccgttgttgggcatccacgtcttcaccgaccggcctgccttcgccgccgccgaccggtgtctccgcctacgcggctggcctattatgccgccgttgttgggcatcctcgtcttcaccgaccggctttccttcgtcgccgccgactggtgtttccgcctgcactgctggcctattatatgctgccgttgttgggcgtccgtcgactggtgtcctcacctatacggttggctggtcacaccaccgtacatgggcatccacgtcttcaccgactggcttgccttcatcaccgccgactagtgtctccgcctacacggctggcctattatgccgccgttgttgggcacgcacgtcttgaccgaccggcttgccatcgtcgccgccgactggtgtctccacctgcacggctggcctattatgccgccgctgttgaacatcaacaacttcaccgccggcttggcttcgtcgccgccgactggtgtctccgcctacacggctggcctattatgccgccgttgttgggcgtatacgacttcaccgccggcctgcctccgttgcagcccaacggtgtctctgcctacacggctggcctgtaatgccgttgttgttgggcgtctacgacttcaccaccggcctgccttcgccgccgccgaccggtgtctccgcctacacggctgacctattacgctgcctttgttgggcatccacgtcttcaccgaccggcctgccttcgccgccgccgaccggtgtctccgcctacacggctggcctattatgccgccgttgttgggcatccacgtcttcaccgaccggctttccttcgtcgccgccgactggtgtttccgcctgcactgctggcctattatatgctgccgttgttgggcgtccgtcgactggtgtcctcacctatacggttggctggtcacaccaccgtacatgggcatccacgtcttcaccgaccggcttgccttcgtcaccgccgactggtgtctccgcctacacggctggcctattacgccgccgttgttgggcaaccacgtcttcgccgaccggcctgccttcgccgccgccgaccggtgtctccgccttcacggctggcctattatgccgccgttgttgggcatccacgtcttcaccgaccggcgtgccttcgtcgccgccgactggtgtctccgcctacacggctggcctattacgacgccgttgttgggcaaccacgtcttcaccgaccggcctgccttcgccgccgccgccgaccggtgtctccggctacaaggctggcctattacgccgctgctgttgggcatctacgacttcaccgccggccttccttcgccgccgccgactggtgtctccgcttacacggctggcctattatgttgccgttgttgggcatccacatcttcaccgatcggcttgcatttgtcgccgccgactagtgtctccgtctacacggctggcctaatatgccgccgctgttcggcatctacgacttcaccgccggcctgccttcgccgccgccaactggtgtctccgcctacacggctggcctattatgccgccgttgcttggcatccacctcttcaccgaccggcttgccttcgtcgccgccgactggtgtctccgcctgcacggctggcctattacgccaccgctgttgggcatctacgacttcactgccggcctgccttcgccgccgttgactggtgtctccacttacacggctggtctattatgtcgccggtgttgggcatccacgtcttcaccgaccggcttgccttcgtcgccgccgtctggtgtctccgccagcacggctggcctattacgccgccgctgttgggcatctacgacttcaccgccggcttgccttcgccgctgtcgactggtgtctctgcctacacggctggcctattatggcgccgttgttgggcatccacgtcttcatcgaccggcttgccttcgtcgccgccgactggtgtttccgccagcacggctggcctattatatgctgccgttgttgggcctccgtcgactggtgtcctcacctatatggttggctggtcacaccaccgtacatgggcgtctacgtcttcaccgaccggctggccttcgccgccgccgactggtgtttccgcctgcacagctggcctattatgccgccgctgtttggcgtctacgacttcatcgccggcctgcctctgccgccactgactggtgtgttcgcctatacgtttggcggacttcgccgccgttaatgggcttcatcatctacaccactggctttgttccactggcgccgactggtgtttttgtcaccattgatggactgcttcgttcccacatcggctacttttgctgtcaccgagggaatacgacaaagctaagtcatcatttattttattctttatatgatatttttccttttcctttgcctcactacatcaactggttcgccgttgactagtgagtcgggggctatagatgttatatcatattttttaaacaattttcataatatttatcttgattgcttacaacatattctgagtacaaaagtgcctatcgagttatggagttccatcttcctatgctttccgtttggtttgccaatggatagttgtctttgggccgattcctagcacccgggggcttgttggatggacggaataacgcaaagtgctaagtattattcggaataaatcaaaagcatagagataagataatttattttctgctcttaataattgcaaaagtacccgagtagtaaactccgacccgtgaaactttgttccattaatgacgaactcatgtcactcatacgcatgtttgggaagtgcctaggccaactcccggtgcttgggggctatgactagtcgggcagagtttttaaacataaggagtcatctgctcggggaaatcaaaattgacaagaggagaaatacatatttataaacattttaaatacttgaatttttctcgagtattatatttacatcagatactactcatcctatatgtttgttctgtaggatccagatctagatatgcataaaagggattcatggctttaagcttatctcctacgctttagggatggatcagtcagaacatcaccaccggcttgctttcgccgccgccgactggtgtctccgcttgcacggtgtcacgaccggaaataactcaacgggcgttccttacgtgcgtgcattattccttgtcctaggaggcaaggtacaccaaaagttgatacaattcagagtttaacaagcggaagcgtaattaattaatttattacatgggcggcgaagacccaatacacaagaagacaaacgaaaaacagcggaagactagggtgtcgaccacatccgcttgacggcaggcacgagccagacaccaaagccttcatcatccaggggctcctcttctgggtttggcaaaaattgagaaagactgagtacaaccaccgtactcaacaagacacacccacaagtgcagaataaatgcaagggagtacaagggggttataatatagggggttagggtttgcagtaaacagcattaaaagacacttagttgctcaaagctattttgtaaacacgattgtagagctatacaatattattaatcaaggccgtgaacccacacgaacctgccttaacccaaggcctacgatgattcagaccgaactggcaacccgaccctgggtcccagctcgtcccaagccaacccaggccaaccattccacattttagttgttacgcaggttttaagaattaaaacactaacttgggtacattgctcggcttgcccataaccgagggcgcgactattcgaataaattatactctgatcagaggtgtacatctttacccacaagacacatcttcctcacgtgtaaccacgtgccacataccaccacggtatacggacgaaagacgtgacatagtttccaacccatcctagccataaacaagagtaccgacccaaccccacctacggccggaacccccgggacaggtaggcaggactgagcccctagcagcaggacaccggccctgtgccatgacatctcgactaccggccgcagctcgtgtagccttcatttgccctagagatgtccatcgacccccgacttcgtccatctctatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttgagggttttgaatagagggggaggtgtgaatccaattccacaataatccaaccattccatagtgtccaggtgagaagagtattcccaaagtctagagttgtaaaaccaccgaatgttgcctaattaaccagcgaagcatctaccaaaaatcatactagtggtaccatgagtagagtgtccactagttggggttttgtttattctagggtgaacaaggaaataataacaataacaataataaggtcataacaaaggtaaataggcatggctagataaaacagtgataacgcgggaatttaaataaagcgataatgcaataatttaaatcaaaataattttataaactgggattcaatatgttcaaggatgatgtgacttgccttgctcgctttcccaaacgtcggcttcaacctccacgaagagcggatcttccgaagctgcagcgtctacacgaccaacggaaaagaaaaggcttttactctaataaactccatataacaagcaggaacaaagcacaaaaatgggtttttgacttcttaaggaaaaattaaagacttgaacggtccaattccgagttcaaatggccaagttatggccatttgaagtttatatgctctttaaatggatatttgcgaatttcttcatttaaattttaatttaaaaagggtttattgcgtcagccgaggggagggggcgcgcggaccgggtccacgggagtggggcccacgcggcagcctcatggtccacggtggaccgggcgcacccgggttcgcaccggccggcgccgtgggccccacgcgtcagccgcacccgagggcgcgggcggctgacggccgggccccacgcggcggccactcggtgcacccgaaggcggccactcggcgcggccggcgggaggcgccgcccgcgcccctattgtcgccggcgtcggccataggcacggcggagcggtggccgagagaggggaagggaagggggaaaagaggcggcggtccacggctcaccctaggtcgacggcgacgacgaaaaaggcggccggagcggaggaaggcggcggcgcggctcgggtcgacggggtcgacggcgttccggcggtcggcggactcggcgagggggtggacggggtcgacggcggtgcggcgaagccggaggaggcgacgtcggggcgggagacggtcccggcgagcggagaagcccggccggaggtcgtcggcgacggaggagagagagggcgacggcgcgagctcgattccggcggggagacggtgcggcaaggggcggaaacgggcgagggaggtgcggggagggtttaaatagggttggaagggggagagagcggccggaggggatggaaactgccagggtggatggaataaggactttcgtgagcttcctgaagtatcagctgtttaagttccttgtcgtccggaacgcatacacgatttccgttccatagggttccatgttcatcttctgtgaaaccagcggctttaccttgtttcatattcttgaggatcccatgcatatctggatcattcttctgaacctcgcggatttgatcgagcaaggtaggcttggcttccagcgtagccaagaatccatgaccaactatgcttaggttcagggcttccatctgttgatgaagttccggtggaatgccacggacgccaagagtgttgcaacggctttttcgactcagcgcgtctgcgaccacgttggccttaccagggtgatagtggattcccacatcataatccttgatgagctctaaccatcttctctgccgaagattcagatccgactgggtgaagatgtatttcaaactcttatgatcagtatatatttcatagcgattcccaatgagatagtgccgccagatctttagagcatgaaccacagcggctaactccaaatcatgggtagggtagttgccttcatgaggccgtagctggcgtgaggcataggctaccacatgaccttcctgcatgagcacgcaccccaatccttggcgcgaagcgtcacagtacaccatgaagtccttgcgagtatccggtaagattaaaactggcgaggaaaccagcttttccttgagagtttggaacgccttctcgcattgcgggctccacacaaatttttcttctttcttcaacaactgtgtcatgggtcgagcgattttggagaagttctcgatgaacctccggtagtatcctgccaaacccaaaaagctgcgaacctgagtaactgtcttgggttgcttcccatcagtgacggcggtcactgtttcggggtccatagcaactcctttagcagatatcacgtgccctaagaatttgacttcggacaaccagaactcacacttgctaagcttggcatacaattgatgttcccgcaactttcccaacaccagacggagatgctgttgatggtcttcctctgattgtgagtataccaggatgtcgtcgatgaagaccacaacaaacttatccaagtattccatgaacactttgttcattaagttcatgaagaaggcaggagcattagtcagaccgaacgacatcaccgtgaattcatacagcccatatcgcgtggtgaatgcggtcttcgggatatcttcttcacgaatacacaattggtgatatctggaacgaagatcgattttagaaaacacagtggcacctttaagctgatcgaacagatcatcgatctggggaagagggtacttgtttttgatagtaacttcattaagagctctgtagtcaacacacatcctctttgtcttgtccttcttttccacaaaaatcacgggagcaccctagggggaagtgctcggtcgtatgtaccccttttctttcaactcttccaactgtttcttgacttcggccagttcatttgctgccatacggttgggtcgcttgtacagaggagtggttcctggagcaagatctatccagaattcaatctctcgcttgggcggcataccgggtagttcttccggaaacacatctccgaactcactgacgatggggatttctgacagtcctatctgatgaagttctgaactgccgacagaggttgggggtgcaaagaaaacaaccagttgatctggccctcggtacagagtgacagtgcgtcttgcgcaatccactactccttggaattgagccaaccaattcatcccaatgatcacatccaaattcttggtgtctagaagaatcaaatccgagggaaaaggaattccctggatttctataggaatggtagggctataatactttgctgtcataacccctctaggggtggtgatgagcagagggttcctaagcctttctacccccaactgatttctccccacgaatggcacagacataaacgagtgggaagctccagagtcgaacaaaatggtagcagggatggaatgaatgaggaacgtaccaacaatgacgtctggagttgtcagcacatcctcggcagtcacgtggttcacacgatcccgaatgacatccttaccaccgttgttggggcggggaggcgcttggccttacgagcgcctcggctttgggcatttatccgcaaagtgcccgggctcgaagcagttgaagcacagacgctgctgaccttgaatgtctctgcggccttgaccaggctgcacaacgggcgcaggaggacggggcgcatgggtcccttgctgactctgctgttgctgcggctgtgggacgcgcaccacgaattgaggtcggggcgcggagcgtgggtgctgctgctgctgctgctgcgaggaggatccccctggatagggattggtgtagcggaccctttggttagcaacctgttgattgtggaaattcgccaagcgatgcttgtgcgactccagttccttgtgcttggcttccaagcagatgctcttgtccaccagatgttggaaatccggatagtccccggagtccagacgcacggacaggtcagggtccattcctgccaagaacttctcttgcttctcctcatcttcacgaacatcctctggggcgtaccgggccaggttgttaaactcatgcaaatactccatcacagagcggttgccttgcttcaactctcggaattcccttttcttaagggccatgactccggcgggcacatgggtcctccggaaagccgcggtgaagcgggcccaagtaataggctgtccttctggctgcgtagcctggaagtggtccaccctagagatgcgggccctgcagttggtgagcggcaaagatgactttctcctcatcattgcactgcacggtatccaactttttccccacggcatgcaaccaatccaacgcatcaacggggttattggaactagagaaggtaggcggacagatgcggaggaactcggcgagtttagagtgttgtgggggtggtggtggaggtggagcattatgctgtggcggattttggatgtgatggaggaaagcagccatcatgttggcctgctgggcgaggatttgggtgaggatggagttggtgtctggtggtggtggtggaggtgggggaggaggtggaggtgggctgccttggatgttggggttgctaccttcgggttggttgtcatcaccggtagcagcacttctcctggttgtcaccatctgaaatatcccatacagaaccagccaagagagagaacagactattaaagctaatcacccacgactaccaaaattattgaacttattactgatataaaatgggttcattaaggttcaagttgcttaagccaataaaataaagacaggctccgacacagttataccgcacaccggtataaccatgccccacacgactctagcagaaaaacaaacgagaagaacacacgcgcaagcctactaactgctcgtctacttctgcgacgggccagggcggaaggtgagcagtagcgcatcctccatgctgccaacgccagaggctccctcctcctgaggaaccacgggcgcgggctcggcacgaggggtctcgacaaaacaggtccatgccaaggactgacgaacaagctcaggcctggaggtactcttgcgggcggtgatcttcaggctgcggtagacgcggcggcgcttggggcgacagacctctccctgggcgatcttgagctgacacagctgcgcctccactacgtctaggtccttcttcagctgcagattctcctgacgcagctccaggatcttcatgttgttctcgaccaacccgcggcgcaccatctggtggaagtcgatacgggccgcgtcatacgtgtccaccatgcgcgccaggtgcatgatggtagcgtcatcctccgagctagcatccctgaaggtggcgtagtcgtgggctcctccgcgacgagggtggtagcggtagggcgagtgctgcaactcgtccgggtagcgctggtgaagagtgccgatggcgaggggtgcggcgttctggcaagcggcggagaaagaatctccacccgcggtgactgccaacgaggtcctctcgggtgagccagtgaggatcactacagtgacctcccaagcagcgtggggctctgcatcgtcaccctcttgctccgggagttgcttgccctggtagtccactccatgcggataccccaagacaacgcacatgccccgcagtcaggtccagaccacgacggttgatgctgccggccatctacaaacaaaaacaaaagagaaaagcaacattttaaaggttagattttgacgataaatgaagcagcaggacagagagagactagaggattttcacaaataagaaacgatttttattttgaaaatattgctaaggcttgggatctaaggctcgtcctagggtcaaggggctctgataccaacttgtcacgaccggaaataacccaacgggcgttccttacgtgcgtgcattattccttgtcctaggaggcaaggtacaccaaaagttgatacaattcagagtttaacaagtggaagcgtaattaattaatttattacataggcggcgaagacccagcacacaagaagacaaacgaaaaacagcggaagactagggcgacgaccacaggcacttgacggcaggcacgagctagacaccaaagccttcatcatctaggggcttctcttctgggtttggaaaaattgagcaagactgagtacaaccaccgtactcaacaagacacacccacaagtgcagaataaatgcaagggagtacaagggggttataatatagggggttagggtttgcagtaaacagcattaaaagacacttagttgctcaaaactattttgtaaatacgattctagagctatacaatattattaattaaggccgtgaacccacacgaacctgccttaacccaaggcctacgatgatttagaccgaactggcaacccgactctgggtcccagctca

SEQ ID NO: 65253 - DNA, 1072 bp, Oryza sativa
cgagctcggtaccccctgaagagaagataaagtgaagtgaagattagggtttcgtcctggttcccagccgtcgcctgtggtgttgggtgttagaccgttggttccgctgctgctgctgctgttggtgtttcctcgtccgcgtcgtcggttgtattctcgggctgtctgagctgcaacctaagttaagataaataagtcctctatttattttaaggattgctatgattcatatttgtcaccgtgggtaccagcactatgtcctgggactggtaccgagatcgcggtttcgtaggaagcggttcgcgccgttttccctacgacacgctcctgtcaggtgccgttttacggcggtatcagattggggtgtgacatcctcgggccgccaccacgcaaatccaggcgagggagggccagatccggccattggggctccggatccgccgcctcctccccaccttgccgccgtggccgccacggaccacgccggtggggagcttcgtcatcttcgtcctttgcgctgaggagggagacgccacgaagagaagaaggcctcaccgccgccttccctgcccgctgccggctttgccgccggcgggctccatcggcggccaggtggggggagggaggaaaaggaggcgcgggcgggtagggtttttcgcccccgagccgcccgacgcggggggagggggggcatcacttcccgtttattgactgctacaaatgaaaattattgttctatggatggatatactcccaattgtactagtagtaattaattggaaaaaaattatactgatatcctacaaagctgcatgccgatgcattactgtcgtacgtatcaaagcagggaaccgatgatagacaggaattcctcaaattgacatcccgccatacatcggcaaagttttcagtaacagaacagaaaccaacatatatgcaaccaaaggaaaatggttcagcttagctaccattaatttgaacttgcatatttatagagtgatatattacatgttaaaacatcttctcaaatttttttcataactattagagtgacaagcaaacaacgaggaga

SEQ ID NO: 65254 - DNA, 2853 bp, Oryza sativa
acggcggtgcggcgaagccggaggaggcgacgtcggggcgggagacggtcccggcgagcggagaagcccggccgaaggtcgtcggcgacggaggagagagagggcgacggcgcgagctcgattccggcgggaagacggtgcggcaaggggcggaaacgggcgagggaggcgcggggagggtttaaatagggttggaagggggagagagcggccggaggggaaggaaaccggcacgggaggtccggccgccatcaatggcgccggcgagatttgcgggggcaaatccgcccgtttgaacgcgagagagagagggaaaaatggggggaaagggagaggggatcacggggagtgattccccccactttattgcacgcgtggacggcgggaggcggcgggattcgcggcggcggcggcgctagggcgcgggggaggcggcgggagcggcggaaggaaggggatgacgggtgggccccacccgtcagcgaggttggcgggcgggcccgtccgtcagcggcgcgcgcgcggggagagaggccgaatgggccgcggggagaggagagagagagggggggaaggagagatgggccgggccagcccaagggagggaagggggacttttagggtttttctttttataaaatcattttaactttgtttatttcttaataattattatttgtgctctgaaaattccactaaaatttatttacgcattttaggcttttaggaaatttacaaaaatcctctaagccttatttggcttttaactttgcacattttaattgttggaggctttcacatggattttaattattctaggcatcatttaagggatatattttagagtcgttttgggacgtgacacacggctggcctattatgccaccgttgttaggcgtctacgtcttcaccgtcggctgccttcgccgccgccgactggtatctccgcctgcacggctggcctattatgccgccgttgttttgggcgtctacgtcttcaccgtcggctgccttcgccgccgccaactggtatctccacctgcacggctggcctattatgccgccgttgtttggcgtctacgtcttcaccgccggctcaccttggccgccgtcaactggtgtctccgcctgcacggctggtttattatgtcaccgttgtaggacgtctacatcttcatcgaccggccgcctcgtatgacgccaactggtgctatcgtcttcccggctggccacgtcaccgccaccgcaaataggcgtcatcaccatcaacgcaagctgtctacgtctgctaccgattggtttcttcacttccatggctgcatgattctgccagtgttgattggccttatcgtctttaccaccggtcatctcgtctgctgttgactagcatcctcgcctctacgtctggtttatacagctaccactactaatggacatcatcgtcttccgtcgccgacaggttatgccgccgccaactggttcttttatcttcacaactgcgcgtcttcactaccggtttgcttctgttgctgccgactcgtgttcacttcatcacggctatgcaattttgtcaccatggtggagcaacttcatttttattatcttcggcatcggcaaactctattgcctctacttcaccaaccatgacgactacaagagtttcgacaccttggcatacgtcaccaaatatgatgccgtgttattttattacaacaagtggtgttccaatcttcaatatttatcttcactcaagcaatgactactcgacaacaagaagttacagttctcaactctatgttcagttgtttcccaactaaccaaagagtcgggggctacacaaatacatggctcaaaattcgataggttttatgtcaagatgaagcaatcaacaaatcagccaatgagttctatggaacctacttcgggagtcatcagtttcatcttcgcttcagagcagacgttctacttcagcaactcttattatttcaccggcaatttttggtttctccacgccgctacaatctactccaaatttctcaattatcaagtttaagatttaatctacatgtttgggagtttagaattatcaaccaatcagctcagtttcgacgagttcgacaacaacatctacattcttacaagtggagcatctgcaacagctataacaccaagttctactaacatctttataaatcaaggagctttgcatcaatcttcgttatacacacgctaacgtcaaggaaattattcgagcttcgatatcttctcaatagtttgatggattattgtcattgacttcatcaccagcacctctacctcatcggccctgacatctctgccgttgctaatggatgattacgtcttctcctccggttgcttccgtcattgctgacttgttatttcgccctcacggttgacctactttgcaaacgctgatgagcgtcttcgtcattatcatcagttgctacactgctattgactggatcaccgacatcgtcatcttcatcaatatcctgtcaagcctcttcaacatagccctattctactgctgtttgatggctgcctcgtctgtcaccgactgattatttcgctgccatggctacacaactttatcgctgggcgccttcatcttcattgctggctgacctgactgctgccgaccggtttcttcgcctccacagttgtgcaacttcatcacttttgattggtatcactatcttcactaccatcaatatttttgccacttctggtgggcaatattatatctatattggtcatcctgtctctatgccaactacgtcagctactatcaatggaccattgtaactacgacagaaggacaagctatatgat

SEQ ID NO: 65255 - DNA, 4396 bp, Oryza sativa
agtagagcatttttttgtctaggcttgtagggtcagtatctaacaccgtgctctctcattgattattcatttggagaagggggaatccttctcattgataaatcaacctttctgtataatgtttcaacacttggtgcatttgtgttcaatcaatgtgcacgtatgtatatactgtaatccaatgacatgtgatatcagatgtgactaggttaggtagtggtagggcactaggtgcgtggaaatgggatatgtgaaacaatgttgcatgatgttttgttgaaatgttgtattagtttatgttgttgtaacctcaacagtccttttatttcttcaatgagtagaatttttttgtgaaatttggccacacttccagtggagatttcccttgcaaggtgcagatagcagtttgagtaactatttgtagctgaaataataccatcaatgattcatgtggtggaaccttgaggtcatttgagactgatatagaggctgttcagattgtagccaaaataaaccttaccaaattttggtaaattgacaatattgtcaagttggcaggattccttatgcatttactaaagtttgataaaaaaaactttatttagcaattttaccaaaaaatggtatggtttaaaatgttattaatctgaacaaccccatagtttacaattcagatgattcagttcttcaattgcagttgcttcagcgtagaaatactttaaatgtgttgctcctgtcaacaacctgagctgataatcagaatccttttattcttcactgggctatgtgtgtgacgcttcaggaaatattcctcggcatagacacagatctgataagcaaaataggttaagaggttatacatttcataaggctatgcattgcattctgttgctagtttaaaaggcaggcagtgaatacatgttcagatacatacttgaccagtagattttgtgctgataaactgtgcaactctaggccagtcctgaccaaatctgcagagccccagaaacatgattgaataaacgtttttttcaccaatactaaagtacttccatagaatgcgatgcaatctgaatatacaaatttgcagtgatctgctagtcagaaagctgaaatctggagattaataggacaatccaggtgatctacattgggtgtgtctagttcagctatctgctagtcacaaacctcaagttttctgaatattagcaaagatttgtgcgaacatttgtttttcataccttccaattgcgatcctgaaattgacacgctctctgatgctccagccttcttgaggaggccgtgcagcggcggtgtacaatggtggcatcctgcgtttttgctggctattcttcttgctccgcaatggcggtaaacggcgtttccccattgtttccctttatcctctcattcagaccaatctcgcattttgagtgcctaaaacatcaaagcaaatatataatgccttgtgctgaaaaacaagggatgtatgaggagtatcgtacaaatggtaagatgaagaagaaaaaagaagttcagtaaaagttggctgatcttttgcatgctggttatgtactaagtaaaaacacactagtgcttgtggaatatttttttccagtttaattcgtattgccttgttagtacatatgtctgataaataaggtactgttttcatcctcctagtatgtactgtcagttcagtcatgtttaggggatggtatggaaggggaaaacagtgtgataattgcaaacgcctctctcttcttcgagtctttttttttttgtcatacttggctccattctcttcttaatataatgatggatagctctccagcgtgttcggaaaaaaaaaaacaactacgaacacctcatttcaggaatttgggtccccctccctcaaataggatactatttcgcccaaaattttcaaaaaactattttaaatttggtaaaatgtttttcacgtttttaattattccggacattctaaaccacgtttaaaattttttgacagttttttttgtgatttccttaatatagaatagaaccctgctcatatagtttatgaccagtcaatttcgtgcctgttttttttttttttgttaatttcatgctaggtagcataaagactctgacatactttttttttatcaccataggtctgtattagctcatcaaatcaaaggctaatccaccccttgtcacaagaacattctgtagcaaaacaaccggagcacctagattcgttttacaagttgcagttctttaccggcatcgcttactttgttaatgtaaattaatgatctcactgttcatactattaccttattactctgattaatactcgcaataataataaaacaacactatacaaatacgaacacatctaaaaagcttttggagaaccgcacaataatcttccggctagctccacaaaatgatgggctagacaaattatatcactccctactattcgcattttcttaataaagcttcttgcgcgataagttgatggcatgaaccaccctgtgcaaagacgcaaatacccctggacctattggctacacacaccgcatccgtgtccaaatgtccatgggcataacagtcattttcccctcctcctccacgaacatcgtcttcttcccctctcgcaagctaaagctgtgccgttctcttccagaagcttccgccgccgccgccaaccgagccgctccgatcctccccccctcgactcggccgcgggcgtacgtagagggggaccgaccagatggtggcggcgtcgcgcctcctcgcgcgggcgtcgaggcaatgcgtcgccgcggtggcggcgtcggccgcgaggcggcggcggtgcccggcggcggcgctgtcgctgcccgtggtgaccgcggcgaaggcggcggctgcggagccgtggctcggggtgagaatccttctatgcttcctctcgtggtgcttgttgtgaagttttaatgtgctcttcttcgccacctctgcgcacgccgagatgtcacaagggggattgggagggttttaggatgtgccgtttcaggtggcttgcgctgtggaaaatttgtctatagatgtttttgtggagggttttagagttctattcgtattattttataatggtgatggagaaatttgaagagaatccgcccttaagtcgcaggggtggcagattattatgttcagtaaactagtaattgtcagaaattatagtttaatggagatcaagtatttgtttgtatgaatagtttgcttctgtaacatgatcgataatacatcgtaggaatgactacgccatactcaattttatttcataagtgtatctttgttgcaatgctgcaccagctctgatacaagcaggagtgggaagttggacgatacctcattttttttagtaattacgattattattcaagaagaagacttgagtgtattttatatactatgaatggttggtacaccattgtatcatagccattcagttaacatacacttccactatgcaacactgagtccactaaatattttggggattcaacctgaacttactactcatgcttgcatatatgtaaacacaaataccggcgcatctttgaggactcctcatcactaacttcagcagtcattgccatgataaaagaataaatagttagttggaagcaggtggatagccatcagcaactggatcaacttgttctggatgtatcactttcttgaatcacacctgcacctttgtatttttatgctcttgtagcaaagaattagcagagctcatgctttttatttttaaaaataaagttactttctcatcgtttattttgtgaggttccctgcccccaacccacacacaatataacttgaacggtgtcagttataactggaagacattgtcatatcctttatattcttaatttggttacgtacttttttgacaagcaggtcccatatatgttgaatcagcccttgagatactcaaccaccatttttcaacgttttggattttcatccacttccccggaactaagtgataaggaggaaaaccaacgcaaggaccaggagaattccacaaatgtgtcaaatgaaggtagttcatgttcaattgagaaaacatgacaagataggttcacagaactccatgtcccatggcataagcctataagaagtgaggttctaaatgaactgcatttcctgattcaggcactgaagacgttgatttgtcaaaggaggatctggtgcagctagttcttgagaaggatggattgttgaagtcaaaagatgaagaaatcaatgatatgaaggacaaggttttgcgaagttatgcagaaatggaaaatgtcatagctaggacaaagcgtgaatctgagaactcaaaaaagtatgctgtgca

SEQ ID NO: 65256 - DNA, 4753 bp, Oryza sativa
ttttttcccacttttttctgatttttttaatcttttagcatgttttgagtttgaaagtttttaaattttgagtagaaaatttttaaatctgaacttgaaagtttttaaatcttgagttgaaagttttcaaatctcgatttgaaagttttcaaaattttcaaatatggacttgaaagttttcgactctcaagttaaaagttttcaaatctcgagttgaaaattttcaaatctcaaattgaaagttttcaaatctcaaattgaaagttttcaaaatttttaaatctggacttgaaaattttcgaatcttgattctcgagttgaaagtttttaaatctcgagttgaaagttttcaaaatttaactttaaaatttaaaacttaaatcaaaagttttcaaatctaacttaaatttttttcaatctgttagtaaaaaaatcttccaaaaaattctccagaatctttcctaattactatcattagtgttaagtatattactaatagaggtagttaaggcttaagagggggggagtgctcgctagcgacgcgcacgcgctagctaggagccccctcgtgacttatcaacgcgattcagtcatgtatgtatatatgctccctattaacacattcaattagtatcttctggttgtaattggacaactgacgtatatacatgcatgcagtgattagaacatttaactaaactttttgacataagatttaattttaaaattgaaaattttgaaaactttcaactcaaattatgaaaactttccactcggcattttaaaactttctattcaaatttgaaagttttcaactcacaatcttaagaatttttcatctccaaattcaaaaaatttcaactaaaaattcgaaactttcaaatcaagttacaaactttcaagtcaaatttgaaaaactttcaactcaatttttgaaactttcgactcaaatttgaaaactttcaacttcaatttcgaaaactttcaactcaacttgaaaacttctatgtcaaatttcaaaaagttcgaatcaaaatttaaaactttcaactcaaattttaaaatcttttgactgcaaatttaaaactttcaattacttttcaaaaaaaattggtaactgaattatttatgttactgttttaaaaataatgctaatgacggtaattaacactaatcaccgtaattaccggcgtcagctcgtggactactagtgagggggcgcgcgcggctgtgcgagttaagaagctggcgcgcacgcgccccctaggaagccctgagaaatttacagtataatatactacctatatatacttgcagtattaataaaaggggttaagtccattttaccctccaactcttcgttttgtctaaaatacacccaaaactataaaactggatatttcacaccctccaactttcaataccgttcactttacaccctcaagtggtttttcaactggttttcaccaacgtggcattgatgtggaagtccattcagcaaataaaaatttggaccacatctcagtccatagccacggagccacttcttcttcttccctcatctcctcttccctttttctctctatccttcttcctcccagagcacgagagcagcggcggtggcattcttgagcttgtggagtaggagatcggtggcggtagagtaggggactcgttgcggcgacgaggctcaagcacatccccagccttcccttctgcgctgactgccggcgagacccaggacaaggtccgcctctcctgtcgtaaccgagctcgccggtggagctagagctgctcggggacgtagagttcgacggtggcaacggggcttggggatgaggaactgaagcttgacgagacggcggcggctggcggatgcggatatgagcttgagcttgtcctctaccaagcgttggcggcgctccatagggaggactcccccccctcgtgtgtagctccggtgaggtccgcctcttgcgcgcggggcagcaagctccaccgtcgtcgccactctccttgccggtgaccacctctgcaaccctggcagccccaccgtcctcgcagcagctccacaccaccgccgccaacggtcgtgaggaagagaagcacgaacagggcagggagagatagagaatatgggcttggcccatattacctcgtgggctgacgtagcgagggttgacgtggcatctgacgtgtcaaaaaccacggtaaaaacagttcgggggttaagtgttcggtattgaaagtttagggtgtattatatctggttttgtaattcgggggtgtattttggacaagcataagagttcgagggtgtaaaatggacttttccctataaaagggtatattagcaatatatcagctttataatgtaaagatgaacttgaaatgaagtgcaatttattactcgtacaaatctcacatgttccccacttcctgtacaggatatgcactttcacctgggcaccctttttaagtgaagatacaagcacagccaacaggcacgtcaacagcatccgcaaaggctccgacagctgatgagcagtgactcactggcagcgaaggcagcaggcggactccaactcggaaccagcattaccatccttgattactgatttcaattccgattcgaactagctcgaacacagcggcgtagtcgcgtgcgtggtatgcgagccctagctataaatctgcacgcacatgcggtacataccgatatacgcgtccctgcacatcaatcttcaaattctcgatcggctagctgctcattggtgccgagcgtcgcgcgcattcttgtcctagtcgccggagcatggcgaccacaggacgattgctgctgccccacgacatgtacaggaggctgcaggctcccacggcagcggccgcggccgcggccgcgctctttattttggcgccccaccttccagaggcctaacgctgccgctgccgtaccggaaggatacagcaacggtcgcttcggctccgtcccggcgtgcagcgaggccatcgccgccttggaggagacgtcggccggcgaggcgaaggagaaggactgctccgtgtgcctggaggccttcgaggaggagagcgacaagctgatgaggaagatgccgtgctgccatgccttccatgagagctgcatcttcgagtggctgcaggtcagccacctctgcccgctctgccgcttcgcgctgcccacccaggcggaggcggaggcgggactgtggccattgctcacgcctggttctggttcggggacatgatcagcattctaatttggcaattgtcaccgtgcatcatcaagcatgcacatgtatatgatttcttttgtaacctggctcgatcagtttgttgactcggccgcacggaaaattgtaacaggcaaacgcagattgattaattctttgtagacactataacatatgccatagagatgacccttttttttttttacattcatagagatgacccttaattttactgaactgttcgctgttgccgctttgccatgctttgatcggagtaacgccattcctattgggagatgttcaggtgggccagcattggcatcgttcgggagcccgtttagaaggcccaattccgtccgggaaaccggtccaattgccgggcgaacgacttggacttccaaatgggcttatgggccttggctttgtttgagtcgaagctggttgattaatcttcggaggaaaaagtacaacgaaggtccctcaacttgacatctagttacaaaatcgtcccccaaccgtaaaaccggatacaacgcatcccctaacttataaaactagtgcaaactaggtccctcgacggttttgaccctaattttgtccgacgtgatggctgactcatcgtatgacccacgtggaccccacatgtcaggatgccacgtcagcagggcggcctctccctttctctcctttcctcctcctctctctctctctcacagacacacacacaaccttctctctggactgggcaggccgggccggcccgcgggtggggaggagggcgtcggcagccggcgacacggcggcagcggccgaggcggcgacgacgacgacacgggagaaggtggcgacgtctccgcgtgtgcgagctcggggacggagcggcccgggaggcaggagaaggaggagggccagcgggagaaggcggccggcaagggcggggaaaatcagacgagcttcatctcatctccgacgacgacgagctccaccaagaacgtcgtccccctctcgccgtcgtccctccccttcggcggctgtgatggggtgcgcggcgtccgcgacggacagcgctgcgcggcagaggccggtgcggtcgcctggccaccgcgagacgtccaccgccacgggcatcttggcggtgcgccacgagcccacgacgaccagcagtaggatgggaggaggcggcggcgatggcgccaccagctcgaccggccgccgccatcttctcgacgatggcgcacggggagaaggcccggtaggtcagtgtgcgcgggcacgggcgggcgtcactggcagatccgggtgaggaacacgaagagggagagcaggaaggggacgtcggccgcttcaggaattaatggaccggcgacgacacgacggcgggggcgacggtgaggtgatggctatcctcgggttcgccatggatgggtgggcggcgagttggtggtggtggtagcgcccggactcgaggaggaggttggaggaggccgcggcgagggaggagc

SEQ ID NO: 65257 - DNA, 1553 bp, Oryza sativa
ggcctgcctagaggaagatgagtgagatagggaaagagagaggaggaggaagccagagcctgatgacgtggcgtccagacatgtgagtcccacgctgactcaccagtcacgtaggataaaaatcagggtcaaaaccatcgaatgatgtaaaacaaacggttttataagtttttgactgttttttagaaaaaatgcagcgtcataaatatagattaatcttttctttgtagacatatatgaaattctgacacggagctttggtgctcactgtgtcttctgcgagtgataaatcacatactctctatgctgaaatggtgcgccgcttgcaactattctggaatagttaattgctgcgaatatgctacaatatacttatgtcacgtcggtaaagatgcatgcatgctaatatttttaacaaaaaaaattaagtggtcggcgattgctcttgcaatttgcagcagtcgcaacttgcgaacgacgaacatgcacgcatgcaatgtgatcagttcgtctgtcgtcgatgctgtgtcgatgagcagtacgtacccaagcacagtgcacactgccactctctttgtgtgcaagtggcagtggcctacactacacacatactagtacagcaatgcgtatgtctcgttgcttttcacggtgctgcagttctaatctccttttggtaagtagcacgcacgaatatatcgagatactcgcatgctgtcacgtatggtcggcttcttcaacatggcctactgatagaattggggcaatttggcaatgaggtgagacgattatatattctgttcttcggtcagcagaacggcgtccacggtcgattacactgttggtcccataagccattaacactgtcactgtaggcactgcatgttctgaatcagatgagctgagatatagtcagatgtctaaacagcggtttggctacacgggactccaaagggtgatcgatcctatgcacgaacaccatattgccatgcaagctcggatggcttcaggaagcatcctcgcctcccggaaagtgtagatgcgtactccctccgtcttaaaaaaaaaaagacaaaccctgagttttcgtgttcaactttagctgtccgtcttatataaatttttttataattcgtattttcattgttgttagatgataaaacataattaatattttatacgtgacttgtctttttattttttttttcataattttttcaaataagacggacggtcaaacgttaggcacggaaaccatagtttgtttttttttggacggagtgagtacgagcaaggaacatggctgattgcatgactgctcatacagtaccgtgcccaaacttttgctaccctttcacgatcgcgtcagcctaacagatcagtagtagcatatccatcgcctacagataaaggtagataggcccatatgcactcgatctcatcagctagcgtttcacgatcagttctctgtctaccaatctaaaaaaagatgacgttactgctgctgtgtactgtcaggtacgcagtacgaactcgcgccggcagggggcgagctt

SEQ ID NO: 65258 - DNA, 23822 bp, Oryza sativa
  unsure (1)..(23822): unsure at all n locations
tttgcaagtgatgctgcagcaaagtgtttttttttaacttgtatatgcaagtgcgtatttgtatttcgacgtcatgtcagctacagcagagcatgcttgcttaaacggaacatttattacaacctactccctccctctaataaaaaaacttcttactacgaacttatgtctatgtccagattcataatcagaagttgattttttttttatgagacggagggagtattgtgataattataagttttcacatgagattcatgttctccaaacatgctctggccaagcaaaccatctttcagaacataactagatgcacaactctattatacaaaaaaatggaaaaaatgcagctcataaaaaggaaacatggaaaagccaaatgcaatcaccaaaggcaaaccattactaatactagcaggctagcaagataacacttgtgcaaaggctgctatttgcaccaggttacaaaccctatttccaatctgacaagttcatgcattaacacttggtgtaataacatgttgctacatcatcagctcatggaagggggcatattggcataagatgctaataagactacaactggctaatgcattgttctggactacaatacacaattgctaatgcctaacacaagctaagagctaggagatagatgctaataagattacatgagtggcctcgcatgaccacgtacgttctcatcatcaaaggactgggcggttaaaaggcttttctcttcagtctgttgtctgagcgttggttacttccactgtcacgttgctcttctgcgctcagatcagcatcgctgtcgtcatctggatcttccaacccaaggttcaaattcagctcggtgctgccgctcttcttggtagaattttgtgccacgcctgaagcctgaaagaggatacataaatatatgagttgcatggcttttcagaaagaaaatttacatggaaaatttgaaaaattctttgacatagcaggggtaaactgatagtccctgaaaacaaaggaattaaaagaacatgagaaactgaatatactgttgagtgggaggggaataatgttcagaagcatatattgatttaattggtcacaacagatcctgtattagttatttcaacactaaggagaagaggcgaccactgaccacataacatatgtaagtgtaactattatatacaaatagttggatagttacagctcaggaatcaggatgggattacatgaaattgttccgcgataagaaattattaaaatttagagactattcaattatatgaacagaagagggagcacttctgttgtacggtttgctgagatggcatccagtcaggaatggtctgtggctctgtgctgcctacatggacaaatttagccacagtgattcaattataaaatcccataactaataggcccagcatgtcagcttccaacattttcctcttgctcccatttcctttcctctatcctccctttgtttctatgctttagcagaggaattggatagagtggggaataaacagacagtttttctctttgcctgaatctatattttccactcttaaaccattttcgtgggcttcaaggatgcttattttattagatctaatttggctagtttcagcttttgcttcctacagtagtaccgatgctgctcctctgtttaggcaatccgttcagctcatacatgttgccatcgaagatatgataggatgatgtaccaggaaaccaaatcttccataaaatactggtaggtccatggtcacgagctcaaggccgcagcaactcctgctgggattgcttctcactctgttcctggatgggaaggcagaggggaaaattttgacctggtaggagatctgtacgcagcaatggatgatgagattttctggagggagacgggaggaagagggagatatcctaatgataactgagggtgtgttgaggtttaggaactagactgaaacaatagctgaaggggataaatagatttatctactccttagtagcaggcactttttttccatgtacacaaatatctgatattccaaatttgagtgctctagtagctctgatctagatgtaacatgaacagaaacatcattggcaaccaactaaggaaagacaaataaaactaagccctattgaataaatgagtgctttcataattatatcatattacagatcagagtagaacgcatgaactaggcatccagccagtagccccgcgactaagataatgggatggtattcatgctaatatcagcccaatgaagcaatgattatattcagagatgtcatgaaccttttacattcctaactacatggccaagattagacccctgaggattcagaccatgaaattgcatagccaactatcactaaattaaactagcactagccccaaggaaaggaagaggaagaaacccctagaagattataagaaaagaattacaccactataaaccctagtaaaacccaagttgatgaccaaaccctagctgcctagcacattaaccaacagattttcataagaccagcttctcgaatctaattgcgcagattaagtgtaaaatgttcatccaatcacaaactggaattatccctccccaccctagtttttttttaaccaaaatcgaaatcctaagaaatggagaaaacctaaatgccaagcaaatcggacccaaacacaaacaatgcagcgagccaatctacggagccaagaagaagcctcaccggaacgaagcgccgcctggtggccgccaccgctgccgactcgtcgccgtcgccgctgccaccgccacccccggccgcgccgccgttcaccggcgcccacctgaacagcaccaccttgttccccctggagacacccatggggcccatcatcccggcgtaccccgccccgccggcggcgatggggacccaggccttgcgccacttcctgacgggcccgctgaaggaggaggcggtgttcccgacggggccgtaccgcgtcgacgagcggctcaggcgggcgcccacggtgtccatcggcctgccggacgggaagctcgccgcagcgacggcggcggcgacgtcggcgatggcggcggcgaggcgggtgaagtggaggcggcggtgcgggaaatgactcggagggaggagatgagaagaggattttttttttcgccgagagaatgacaagtggggcccacaagaacaaaaaggagagatccgcactacacgagatggaacgcgagcacaaatgaggaattataatatctttaatttaattaaataaaataaaaatgcagacaggagtataacccattgacaaatttgaattatatatcttaatttatatttattttaaaaatttcacagttttgcaccagaaaacaaaactatatacaatctctttttttcgcttaatcatgtatcatgcatacaagccgtggagcaaaacagtttaaactacaactctactttatttgaggatctagagatttaagaattgttaaattctagaagctaagaacatagatgctagaaactctcgcaaaaagatcttactagattatttcaagtaaccttaactgggtattttttttctaagaaagcacgatcatgcgaaaacctagcctgttcaaggccaacaatgatgatactttagggtgccacgacactctttggtgatgttgttgtgaaaacatttctctttgatggaatctttaggtgaaaatcacatcctggctttccaggatgagcagtggcaaagccagaatgaaaattactaagggccattatgctcatctgactcataaagcaacattctcagatgtccaatttaacttggttgggatgttccacatggtatatatactgtcacgtccggaaattcactagtaatttccaaacttatttgtgcataaaaccctcgtccaggaatcagccgaggtacacaaactgacaatttaatatacaaatctatcataataataacgttacatacttacaaaagaaaagaaaacagcagcggaattaacggtctagcgatggcttcagctccactcccacaggcagctcaactggggtataagccaaacgtcttctccttctggatcctttttcttcaactgagatttgattgattattgcaagaatgagcatatgacatactcaacaagccacacagcaaatatgcaagtgcacaagtataccaaaggatggcataatatagggttcattcgcgaaagcagcatttagcaaagagttgagaatttgtaaaatagtaaagtaattaatcatcaatattaatcaacactgaacagcacacccaggctgcataggcccaaccaaacctgaacaaccaaccccggtcatacagatcaaacctccaaaccaggaattatccattccaaaccaggagtcaaattaattatcacattattaccattaatgagtagtgtgagactaatcacgaaaaacattgttatacccgcccataaccgcgggcacggctattcgaatagttttactctggccagagatgtaccactgtacccacaagacacagcctcaacatcatgtctaccatgcgtcgcgataccggaaagtacccgaatagaggctgtgacaataccccctgcacaacacaactcaccacagtgcaccattcctggatcataatctataaatataactagaggcatagactccccaacgacccccacggacttctcgccgcttctcagtctggtgccccgtaatgaatcatgctatacaaaaggtaaagccgttgcctacgctggcttgtggttggcacagttaatgtttcacaacagtagctcgcgaaccggtccttaattgccatgagcacgaccttcaaaaccatgtgctcacaacccaccttaaacaggttttaattctcaattaattaacattacacgattaaccatcgtgagctaccattaaatataaccataattaataatgtaagatgatttatgatttatcccattaattagctaatgtttctaagcatggctaagcaattatatatatatatatatatatatcatttagctgaaccaaaccaatatataaggttctagctaatcaaattataacccatagaaaaataaagtcatcttcggccattaattaatttgggaaagtctcaaccacccgatgacattcgaaaataatgcataagttgaaataaaacattagctttaaataggttcaacatgctcaaagggttgtttgggatctgtgtgacttgccttgaacttccgcaaacacttccgaaccttcctcaacgaaaacgctctcctccggaacatcggaaaactaaagcaaatgaacaaaatcaacaaaacagttaaaaaaaaagcataaacagtacatgtggatatttttaacatgtagatattgattttagaaaaatttagcaacttgaaccactcgaatccgagttacgatgatttagttatgaatttccgaagtttaatcgattttcatctaaaaagaaaaccgagaaaaaagggaatatgacgtcatgatgacatcatcaacgtcggctcgacataggcgacgacctcgccggcgctaggagactcggccggacttttggagggcacctacgcgtagaggacgacgacgcgatctcaacgatactcaccaacgcgacgaacgacggatgacggccggcggcgagcttgtgcggcggcggcggttcggtctacggcggcgacgggtctccggcgaccagcgacagcggggagagggcggccgaggttcctcacctccgtgcgcacctaacggcggcgaggggaagcggcggcgacgacggaatcgacggcgcggcgcggctgggcgtcggccggcgacggcggcggcttgctcggcgtggcggcggcgctacggagcacgagagaactcgggagatgggacaaacgaaagagggcgactagggggtcctttttatagccttggattagagagatcggactccaaacgagaggatttgagccggaaaatccgagggttagttggagagataaactcgaaaacgaattcgattccgcgttgatttcttcgggataaagtccgattgttgggggaaaggatagaggaggataaaggaaatatttcccctcaactaattttaggaaaacacaagagaaaaggtcggatttggaggggaaaaaccgagcccactcggtctcagttcggctgctagaggtagaagatgaacagtgtcgagggaggcaaattagactttttaggttggctgagaacagaacagagcaacttgacttgggccggcttgggctgcacagcacgcgcgcgagggagagagatgttgggctgaaatcagcccaacggcttaggagaagatttaaaaaccttttccaattaaaataatcactgaaatgatctttgaattgttaaaaatacttccaatgctcaaataatttcaagaaaagtcctgaaaatacttggacactcaaagtacttaaaaaaattataatcataccatttaatgattaatttaatatgcggataattactgaaatgttctttatatgattaaaattaggaattgagctccgaaaaatccgagaaaattccagagagtataattaaccatggagaatttaataaaaattaaatccatccatgctttatatttagaaaattttattttccacatttaacttcacttgtaaattaatgaacatttaatataaattctaataataatttattaaataatttataaatcctaaaacgaaaattaggatgtgacaaatacatagcttatatctgtaaagaaattttttaccggtgtccaaggacccttgttggccttaataggtatgcccctgaggatgggtgacagcagcgttctcgacgtcttaaccttcatggaggagccgtttgaagatctgttcaattttagcctttccttaagaactttgtcctcttccggcggtgccctgatataacaagttgaccacgttgatggaccgatcagagaaaagtgattctatcttttttcttaaccgttccctctacagccaacccaaagacatccatggagttttggttttttgggggccttgttcccgtttgcttctcagcaattggttttaggcatgtgacatgactacttttttttttctgacttagtctcccaaggctattaaaaatattattcaaaaaatttgcccatagatcatcacatagcccttgtaaaaagaagaagaagagcccttattgtcacagtagatggcattttgacaatctacgattcgcaactaccattccatttgaacgctgagcttttataagtagctactctatccgtttcatatttttttataagcagcttagcttacacagataaaggaacaaacagaaacacaagaaccattctaccatcacatactggcatttcctagcaggaatggatatgcattcttcggacagtttgtacaaatgccaactacaaaacttcctgcatttgcattctgacaacaataaatactcaggcacagcatttgcatatcattctccagcacaggatttcctagggggcaaacgggctagcaacaaaattttacatcatggaccaacgcacacccatggaatcaaaggagtggcctcatctacaccactcccttcacaggggcattttctcaagctcaaatgtgagccactctcttggcttacaaatgataggactggggacataaaatcaatttatacatctcgaaagcactcctggcttaagagtcttgtaaagcatgagctcagctcatctcagaaaatgggagctcgcaagacttaatccgccggtgcttgtttgcaggatacgctgtacccactgctgaatctgcggcctcacagaaagtaatctggcgctggcctctttgcaggaacacctcttgattcctgaatgcacatatgggcaaatttagatgctaatcaataatgtgttcaagaggtaatgataaaggtcgttaacacatacatgtggggcagcttcaaatacacggaactgcttattcaaattctcatcaagctctaggattgcagcaacattgccacacctgacaatttcaaagggttaagaacactgtgaggggattaaaatacaagaatcacagatctgcaaaagcatagcccacacaaaggttatttttagcaacccaaacataataatatacaaaaagatcagaacagtagaaaccataaatagctttgttcgagatattaatagaacaatagaccatcttatgttatcgatctttttattttttcacacaatcagtatacccccatctgatcctcattgcctgcaagccaatccattcccaacccattttgggtagtactagtgatcaaaacaaacatggaccatctgatcattgtcaacagataaaatatacaggattgatcacttcaaaaataattataatgttagctgaataataaggtacctgtagcagtagttaggagcagaccatacagtgacaatcttgttattgaacatccacttaaacccttccatgactagttgatgagcacggcaaatatagtctatgttgtttgtgtggttaaaagaagaaacaacatttccaccaaataggaatcctgcacctcgtggacttaatccccaaccatctacagcatcctctggatcagaccaaagaaggtcacacatggccccatcatgaggtacttcttgcttgcgatctattactcttatctgttggagggtacatgatatgtcaataacagaaatagaatgcataaattaaaaataaaaatggagaataacttgcctgatcaagagttgtaatattaggagaaaggcctccatggacactaaatattttgttctcaatgagtgcagacaaactgaagggagaaataagctgcaatcagtttttgtatattttaaactaaagaagcaaaattcttaattcataacaaaaaaagtaagaaagttgccttaaatagtcgaatatatctgtgcaatatctccagacattcactgagccgtatttacgaagacactcatcatagaaaccatagacctgcagagaatgcataagctcaatgacaagatattttttttcataacattagtgtagtatgagcttaaaaggattccttacttgtgtaatctgtctgctctcatggtttcctcgtattaaagttatacgatctgggtatctaacctgtatgcatatttaccacagcagttaggatgggtaactaaataacatgaacttgaaacttcaaacagaacaactgtttaggatatcaattgtttatgttagtttttcatccttccagggttttctagcaaatcaggttagttctagatacattcttttttattttcttgttgatgactgaattatagtttcatttatatcacttatttttttagctttttcatgaatagaaatggctagtgggtggctgagtttgtagttaacatttaacaaccttacagttatacattcaatacataaatcaggtgcaaatgacattactaaaatattcgccccaattcaagctaggcattattgcaaataatagtcaacatatactctgcaaatctattctagcaaaagaagttatctataattagagatattataattaactcatgttattccacaatatagaggtttcatggaatcagcataaatttgtatgttacgatttcaatctggccatcagccattgttccaaaaacaggtttctacttaactaggtcatatacccagctatacatgaggagcattgtgaccattttccttaatttatctgtataaacactaaaagcatggtaattgcatgtgtactccttacaatttctttggagaatagcatcaacatatattgcaagatacaaacaagtagatacaccaaaaattcttaaaagtgtcaacagcatacctttaaggccaacagaagcaaaaatgtttcaacagaataaaatcctcgatcaacaaaatccccaaggaacaagtagtttgtctttgggcagtcacccccaactttgaatagttctttcatgtcatagaattgtccatgaatatctccacatatctgagtgcagcagaaaaatattacttagcgcaataacattttttctgaacttatggagaaataactaatgaaatatccagtagtaagatatttgctgtatcatacccccattaacactaggataatgacccaggaagaatgttccaattacatgatgcaagtatgctttgcaactaagcttggcattaactggttattttgggttattaggttgtgttcagtcaataaaattctaccatgaggttgggagactggattaccctacctatgtgggactgatatgctattgtgcaagtccaaaactcctctattttacaatataaatcatttcaggactctagctttgtttgataataaaagttgcttttacattaatttaccatccttccatccaatacatatcatttaaccgcaattcgtgcctaatcaatgctttcttgtgcgccaatacaacaaaaataagattagatcatgtttcatataatgcttttgcaaagagctagaatgatttaacttatgaaatcaagtagaaaaatggcagctgtatctaatcttcagaatattaagttaattcagtttgacactatttcaagagaaagaacgactgccaggctatggagcttgtcttttggaaaaatgatggagcccactgtagctttatcccagctttacaagaattccaagagaaatgtgtttacaagaattaatggaagctgtagctttaagttaaccaagtagaaaatggcagctgtatcaacataattttcagaataaaatacaaccagacagagaaagtcattacaaaaagacagcgtaaaaataacaacactactctagctttattctgcaagcaaatgctgctgcaaacaaaattgtagattcaagatttcaagttagtggaacaatctatctatatacttatcatctgcatataaactcacgcagctgtgcagtgtttaatggttggaatgttggataaacacatgtatgctggagtgaatagttgttgcatgtattcactgaaccaagttaccagttcctcatagaaataagtctccaattcctaaatttaactccaggaattgggtctgaagtggagttgtggagctgcccaaacccagctccacctctctagttcattttatgagagagcttcacccagctccactcccattttaggtagagctgaaactgtttggctgggctctagctccaagagaggtggagctggagctggagctgtgccaaacaggccctaaatcttccaaacaatgcagatacaatcaggtcggctgcaattctaaaagaagttgatttcaaggatttaatcgagtagaagttacagcctttcatgttccaataattgctgtcagatcaaacaattaggtaaacaaataaatacaacaaactaagttactaaaacatgcaagaatccaaatcgcaaaatgtggaaaaatcctcagcacttgagatctctagggtacttacacacttccatgaaccatttcaaatcatggaaagtgtgaccaattcaactagtacaccagcaatcaagcacaaaaatgcactaaatacccaaaccaccacattgctgcacacacaataccagcaattttcaccaaagccctggaactgaacaggaaaaaagaatatagatatgcctcccaataaatcgggacattacataagcataaccatcgagctaagcatacacattacagcagcattctccccaacgacgcagcaagaaagtctaacattttcctcgcaaaaccacaatcctaaggacgatgatacaagcatatccagtggatacaggcaaaccctagaaccgtaatccaagcacgagctcatcacaatcacaggggagttacgcccacaaatccagctaccgaaaccagtagaatcgaattcttcttactcctcatcagcaaagctcatcgtaatcgcccaaaaatcgtcagaagcgaatcgaacgaaactgagatggaaggggaagggtgggggaaggggggcggtcaccgtgacgggggcgtcgacgcgctggacgttgctctcctcgacgaggatctccatggccttgaggcagagcgccttgacctccgcctccgtcagcggctcgcaccgcttcagctgctcgatctgccggtccagatccgacgtccccatcctcccacccacccacctcttcccccctccccgagagcttccagaaggttccggagggcggggtggcgcgcacctggagcttccacgccgccttggccgccgcttctggaaggttctagggcgcggaggcggaggaagggaggaggcgggaggtgcgcgcgtgcggggaggggcgggtcgggtgggggacaagggtttcgggcgcggtaaggttaccaccattctgcccctttttttcttttttggggttagctttttttttttctggcccaagctagaggcggtgagcttaccagaatgctgctggttgcttactaatagtatgggagtttcacttaaaatggaagcggagctgggtgaagctctcttgcaaaatgaactagagaggtagagctaggtttagacagcttcacaacttcactctagactcaacccttataagtaagagtctatttggttctctatcctaccaattcaattgtagtgccaaaatataggcaaattttagtactaccaattttttgatagggtagagttcatataatatgtgtttggtttgctaccatttgctaccaatatgctttttatagtgaagaaaattctagagtgctaccaaatcaagtatgggcattgccaatgctttggctctaatccaaaccaatcaaactactatttgaattgccaaacaattggtatcaaaaatggccctaaatttaggagttggaggtctactaaacaaggcctatatagttgtattttcttgtgttgggagcaacttattagcacatgattaattaagtatcagtttattttttttaaaaaagattaatatgatttttaaagcaactttcttatagaattttttttgcaaataacgcaccgtttaaccgtttataaaacatgtctgtggaaaacaaggaaagttagttgggaaaggaagggaagaacacagccatacctcaaagttctcaaactcatctctctcgttttccacgcgcacgtttcacaaactattaaacgatacgtgttttttttggcaaaacatttctatacaaaaattgctattaaaaaatcatattaacatatttttaattattttagctaatatttaattaattatgcgttaattcgttaattcgtcgttcagttttgcatgtgaagggacccctccaaattaacacaaccataggatagatggagtcgtcgcagcattattcttttcttctcatatgaaagttgaaatatagcaggagaaaaggagatgtaggaatagcatatgagggctagtttgtttttttttttacctagcattctctccttgtgttttgtgaaccatatataatatcctaaatcaaacattttaatctgttcaccatttttcatcaccacctaccatattgctgtatatattgttaaaaaaaatctgaataatttctaaaaaataatgtcgactctgacaaaaacagttgtgccgaagagtaaaaacagatgctctcaaagagtataacatgtaggattattttcgtccgtttcaaattagtcacctttgtaggtttgtcataactcgaacttgttaaattatatgagtttataaaattgatggtaacagattaaaatgtttgatttaggatattatagatcgagtgaaaccaggggagcagcataagtcctacgaactgttctatagactttaaattatatagagcttatgcattttctttattttgattatcatgtttcaccttgatttgagatattttagaattaggtaagtggttttgaaatgcatgcgctgcttttttaataaaaaatggatgaaatagattgaggcctcctttggattgcagaattttcgtaggatttttgggaatactgttcaaaagatgttctttaccaaattttaccacaggacacaatatggtccttgctgaaggacatcataagaatatgaattttctcagggacactcaaaaaaagtgataatttactataggacaccatgagcattaaaatataatatttactcatttgaggagagagaaaccacgtaaattgtctattttaccctctattccttcttcccaacctctacactcttcttcatcgccatacaccgcccgcgcacggggagggcatccctaccgtcgctaccattccgtcccggatggcagcgaccccgccgtcgcatgaccgcagtgctagagctccaacgcggccgtggcgccgagagagagtgcgtggcaggacgccgtcgatgcgtgtccgaggacgtggccgccgctcccctcgccctctatcttcccaacatcgtcatctcttgtcactctccaccccactgccaaggaactgaagctgagagctacatatcatcctcctcgccatcctcctcatcgtcggccgccaagaaggaggagttgccataagtcgtcaagcagagctcgccatcatctcgatcttccctgttccttattcatatcatcatgccgaaggttttaccttatgacctcaccctctctcgtgcagtagatcgatgggaacaccgtcatgccgacgtgaccccggagcgtgctctctgcgctactgtcaagaccatctctgcgttccggccgccacggtgcatggccgggccatccaccgcgccatcgtcatcactgagaccctaggagcccttcgacccaagcaatcgagacgagataccgtgaatcatgagatcgccatcgttttccaaactctggccaacctccggcatcttcgattccgtcgtccttggtgagttagaagccgattcctcgtgaatgtagcgtctctaggtctctattaacatcttggtagcatcgaactatcagctccttggctcggccggactggaaccgtcgcccatgggcttttcgccgccaccgagctgctctacacgaacctgccgctgttcaagcatcaccagggcttgtgcacagcttggtgagtacactagagcctgaagaaaacacatgcatgcatcatctaggccggactgagcccgtaacttgttttgcaccgcagccttgaagccgctgccgccaccgctcgcgttgccgctggcgtcaattatggccacctccggctacaagacgaccatcgtcgggttcgcaagaagcctgcgcatctttctctttttggccgcatcatctgaggagtcgccgttcgccgtcggcatcgccgtgaaggagtttcagccggcaaggccatgcctcagctgctgctcgcaccagggacttgatttataaggaaaacaaaactctatgtactaattggtcccaggggcaaatatgtcattttgtgaaaattctctctccaagatagcataaaatcataaaataatgtgtattttgtctatcagcaaattaccacgttttttagtgtctctgagcaaattcacgttcttccgatgtccctcggtaaagaccacattttttgagtattctgtagcaaattttgccatgctctttgctctgcccatctttggatggttccaatcctcttatgtagcactcgctgcactcgctacgtcatagggatgtccggcgcagctgtggcattcattctgcatcggatggacacactagtgaggcgtccaaacaggctcgcgctcggcccagtcaccgaaataggacggcccgtttgaagaaagagctcgtttcctttgccaggaaaatcgggatcgctcccaattcctcgtggccatcagccgacagccggcggccgctcgtcatcccgtccggcagtctggctcaggtgcgaccagagaataaactccgtagtactccggcagtctggctcaggtccggcagtccgacagtctggctcagctatctttcgccattgcccattttgcaagcaagaaagtactccatagcatacaagtccctatgcatatatgccatgtatgtatgttcaatactgatctcaaattgcagaatcgaacattctcaaattgacaaattaatcagtctcgaaccaacgaaaacatccattcatcgcattcacatcaatttacaatctcaattgggcttctcaagcagctgtcgcctccctccagaaacccgtggtggtggtggtcgtcgtcgtggctgcggtgctgtgggcatatggcaacaaaggctgcccttcgtctcgtggcggcgcgacccctgtcactaccgccgtggaacccgtcgttgtcgaggcagatctccaggaatgaaacagggctctcgcgtgtcacgcccagaaattcacgaaccagaatttctaaactgaatgtatattaaaacccctgtccaggaccagccagagtacacaaatgacaattgctgaaatgcagatccacgtcttacgaaaatataaaagattacaaatgcacgaaaaagataaaaacgagctaagcttgaagatttgactcctgtagcgaggcgactccattccaaaggcatccttgatggcagcgacgaaacaacttccttgagacagctccactgggaagaacttcagctctggtgtggggaagagagatcaaaactgagtactaaacactgtactcagcaagtcatatcagaagggaagatatgatgtaagatatatccaaaggaggctaggggttatttgcataaagctagcatttaaaagaagtagttgaaagcagtaaaaccgttgtagtaattaatcatcactgttcaacgctataccacgttaaaacaggcccaacccaccacctgaactaactagttccattgagccatactattggtgagactaatcacggtgaatctggtcgaccgcccataaccgcggacacggctattcgaatagttttactctgatcaaagatgtacaactatacccacaagacacagccctacgacacgtttccgtgtgccgacatgccaccacggcataccggaaagaggccgtgataggacccttcgcataaccccctttaaccaatctcaccacacctcaggttttgcccccgtccccagcaggcaacgggcagccacccctcgtgccacgatgaatccgaaagccaatccaccgaacaccccagccgacccaactccatcacgctcaccctagcctgggtacgtcagctagaggaaagctacactacaagcccagccgttgtccacgctggcttgtggtaagtacgataagtttttctagggcatcccgcgaaccggtccttaatcgccatgggtgcaaccagcaaaaccatgcacccatagcccaccatttagtgtgttttaaaaatctaatactgtcatggtggcacatgtccaaagctatgctagtaaccaatgtctaagcattaatgtgattcccctttgtgtactagttgaactaagcagggctaagcaattacgaaaacaacatctaagcatattaaatcccaggttagcaaaggaatatgacatacaatttataaggcgagaacagtaggtaaatagcccatcccatgacattataaaacaatgcagtatttagagaaaagtagagtatttgcaatatgggagcaatatggtcaattaacaagcatgacttgccttgctcttgcactgatgagacctctgcaacatcttcaacgcaccacgaagcgacgaaacggccgaaaactacgtgacaaacaaagcacacaagcaaaacaggccataagtttactaaaacaggaaacaaaaccatttttaatggattatagggatttttatgaatttactaagacttgaatagacttaaacagagctcggatgaatttctatgaattttagaagattcactgtgtttttactataaaaataaaagccttaatggatttatcgcgcaatatatcccaggcgatgatgtcatagggggggcagtggcggcaagcgggccccgcttgtcaatgacacaaaggagcgagggggcgccagctggcgggccccaccaagcagccgcccaaagggcgccgatccaccgtggaccgagaccacgcgggtggtccaccgccggtccacgggaccaatggcccggattggccgagggctgatcggacggcgctagggagcggctgctaggctcagcacgaccggccatagcgatgcggcgacgaggggcgcggaaggtggcggcgcacggcgcgaagggcagcagcgcggctcggtgctaggagggagagaaaggggaaatgctcctcaccgtgggattcggccggcgtgcgggaagacgacagcgaatgacggcggcaagcggtggatggcggggtgcgcgggatggacaaggcggcccttgacctcccgaggccgacggcggcgacggagcggcgcggcgcggcagtggaactagcggtggctagcggcggatggaggcggcaataggtggcggtgcgtggggagagcggtacggcgacggcgcgcggcaagtgagcagcggccgagattgctattgcggcggcgaagctagcggctgggattgcgtggtgtggcagcggctgtagaagtggcggtgtggcagcggctgtagaagtggcggcgcgtggttgatgagtggcggcggcggctgagcttgggtgtgacggcgccggtgcgatagaggtcacgggagagggaggtggaaaggggaaaaatggagaggaggacgcagggaagctatataggggtttgggagaggcggacacggccgggaaagggcccgatttggctggcgacgtggggaggtgggggagagagagagggggggattcaaattgaatcctgcccctcacgggcgcacgcacgagcgggagaagcgggttagtgggcgggcgacgtgggcgtggggcactggtgtggagtggtggcgtggaggagagcgggaacggtggtggcgtgggcggtttcagcggcggttgctgcccggctagaggtaggggacgacttgacaggtgggccccacctatcggcgtcccagagaggagggatggggcgtgggccggcccagccgagcgggcagcgtaggagccaagtgggccgatggcccaagaagaggaaaaaggaggaaaagaaaaaagaggaaaaagaaaaggattttcctgggattagaatattgcggataattgatttttattggttaaaactatttatagggctatgaaaattctactaaaaatcccgttaatgaaatgtgacaagtggaacccaagaaaaatcccacaatgccatttccaattattgattgcatttattaattaaggaattagctctaggttaatcaaattatttcttgaggcaatttattaaacaaatttttaaagcaagaaaaagggggaaaacttcagggcgtgacatcgcgccacgtgaggagtcgagggatggtgaggagggcggcgacgaggggaggggctttgtccgagatcggctccaatagcgcctgagccggaggagacgatgagcggccgccggctgatgtcctggagaacttgggagcgacaccgatttttctggctaaggaaacgagccttctgttcaaatgagccgtcctatttcagtgacttggaccgagtttgagcccgtttggccgcctcactgcgtgcgttcatccgatgcggtatgaacgacgcagctgcgccggatgtccctctgacgtagcgagtgctacgtccgaggatctggaggagatggaacacaccagccgtacgaaaaatagaaggaaagattccttcgctactgatttcatgggaaggcatgggaaaaattttatccacttcaagctcttttttattttgcttcacaaaagaccaaagcaatcaaacaataagtaggtgtttttgaagaacacaatcggagacatcgagcaagagctttggataaggatgataaggaagatagaaaatacagggatcattgtaaacttcatacggccatacaaatgaacccatcatctatattcatgcgttttgaggtggaattggtgtgtgtgagagagagagagagagagaggaggaggaggaagagggatcacgaaagagaagagagggggaggtgaggaagagaatgggatgagccgatgaggtggaggctcttgataagggggtagctagcccgatgaaagctaaggtggtcggaggcaagggtgctgatggtggtcgacggttaactttagctctaggagctagtgcaaatctgtggtcacagccggctgttccaaaggaaacctggggagttgcgcagggagaggaagaggatgaaaggaactggtggtcggaggtgttggcagcaacgccatgccgcacttcgccggaagtttcgacttgggataagaaggggtgttctagaggcgggttttctgctccgacaaaatgctatgctgtcgaaccgttgtgtgtgcccaagccacttgcgctggggtcacgcttctgggctctgggtgatgagagctcggaggatgaagttgaccgtgaggagcatcgatcagaggaggaggtgcaaggtggttcggtgctgccggaagagagcttcgtcaagaaggccatcgatcaaggcttcaccgtggatgaaatactcaaggcgggtgaacatttactttgtatgagttcgccgccaaaggtaagttcgtgctccatgaattctgatttcgtcggcaacagaaaactggcaaagaaaatggttgaaaaggtggtgaatcaaaaaacaactacctgtaaaccttggaaagggccgttaccaaaggctagggtttcacagcctttaacctttggggacgtcataggagttgctttgaaaaaaaagaaacgagcgtctgtggcttcgccggcgaggttcacgacagtaaacggtgttaattcgccagttgctgaggagaaccttgatagggccaacaaatctctttcctctatgaggcttcctgttgcgcatacatgcagcataatggagaaggctgcggcggcgccgccggcggcggcggtgaggtctagtttggacgacaatgctaagacattgaagtttctgatgaacctcgacaaaagagaaaaagaaggaaggatagttttgatgagtccagggggacagtgcacgtcggatatcgaggcgtcaaagcggtcggtcgagttgttgtcgaagggcggcagtgaacataaatttgtttcgtttggagtaaggtcgaatttggtccaattcaaatgttgccaaggactgggccgactactctcgcgtgcgggccaacatatgtgggctacagagggagcaactaggcaaaaacgaagcgacgtgactgtagggcttcgcaccacacagttagtgcagacctctcaaactcgcgagcgcaagcaatcggtaggcgaacagagtggcggcgcccagggagagcgaagcaggcgagaagtcaccatggcatggagaggtgaaggcagcggtcgctcggatggccatggtagggagaggggagatggcttctgggaggaggaagaagagttttttggtgcaaggtttgatgctggccggctaggttttgagccgggatatggttttgggcagcagggaaatcatggttgggggcagcaaaggagtggtttcaggccaaggggatcacgtagctttggtccacgccaaggaggttttgccggccgacccggaaggggaggctgggaaaacaatcgcttctcgatgaagcgctttggcgagaggccattgttgaagaatgagggcaggccaggaggaggaattaacaaggcaggaggtggttctaaatttgcagctaagggggaggttggtggaggagtttcagggggaggcggtggtgcaagtgctgggaaagggaaggtgaaggtgggtgatatggaggtagtggtgaaccagatggatggggctgcggtggtgacggacgatccggagacaaattcagaattggctatcttggattgtgatccatctttgtttgttgatcaacatgttcgtgaggacattagcaaaactcaagcaaagttgaaggtgtgttctaggtgtacttagaaggggcacgtggctgcagattgttcgtcggagttgtattgtgatatttgtgatagtgttgagcatgtcaatcatcgttgcctagtattgaagcaatcaagacctgctgcacatgctgtgggttattcagttgatgggttaggattttatcacattcctcacccacctctacaaaaaagtaagaaagggtccaagacagctttggtcagaattgaggggggctgcctaattaaagagaaggcagtatcacaacttcagagaattatttcgacgaaatggaaatgggagccagttgaacacgaagagaattcttttgttgttcctttcccatcaaagatagagttacaacgagctattgcgtatggcggggcaaatgtgaaagaaaatggagttcttacaggggctcgtctgaagttcgaggagtggaatgagaaggaggaggggtttctgctgccacaaggtgtgggtacgggtttttggactgagaaagaaactaaggaagtaccttaatatttgggcggttggttctcttttaggcgccactcaaactatggacatgaaaatgacgagaaagaatgattttggaaggatctttgtggatgttttaaacccgaggattatcccaaaaaatttggatgtagtgattggcgatcatttttttgagctggaaatcgaggttgaaaagatgggttttgatgagaatgggaaggaggtagaaatagaacaacatgatagagatggtgatggtttggaggaaaataaggaagataagcatgatggtgatgggagggatggaagagtaactaaaagagcaaanaatgatgacatgttagtagatggaaaggagaatggtacaacagaaggaaagtatgatgcagccttgaatgggaaccaatgtcagcacaagatgaaagaaagtgagatctctgctatagctttaggaattttggatgttgcagttggcaaagtgatgaatgaggtttgtgatatggtgatggaggagacagagcagccaatagaggaggaggagttgcctcttgattcaaatctgggagatgaggagaaaggagagcaagagcaagagcaggagcaagaggagttaacattagtagagaataatatagaagaggctttcaaggagagggtggttcgagcagcaaacgttaaggagacagttatgacaccgaaacgttctagtgcaaggctgggttgcaacagtggagtgcactctgtggaaaaggcatggaagaatttagagctgcaacaaggtaacgaagttaattcgtttttgtctttttctaattcctccataacttctagtttacaaaatttaggagttcttctaggtgcctctagtgatgaaattacagattcagtttgtagccttaaaaagacagaggttgaaaggattaatagtagtttaagtctagtaagggataatttagaaaagttggatgatggggacagttcagaggaggaagatgatttgaattatcttgtccttggtcacttatgtggtgatctgatggatgaggttatggatgaggaaactagtcacct

SEQ ID NO: 65259 - DNA, 4573 bp, Oryza sativa
catgaggctccgacaaccagaggatctgctccaaagggtaggatgtttgtggggtatttataggtggctgattaaattattgaggaaagaggttaataaaagggattagtttagatttttttggagtggattaattattaatttagagttagatgcataaaataatgttgtttggtccaaaaggggaatgtatggggcagcatgcgcatgttgggaaaatatgatagaatgacttttgagaaaaagaacatcagaacatgggagtttcatatgcaggaatcgtatacatgcatcatatcataaaaaatattcatattagaacccaaaatacggctttgtagcattgaagagattaacctatggagaacctatcctgatttgtagctaaaatttaatatatttaaacgggggagtatggtttatgagagaggggctacttctcaatgaactgaaagtcctcttcaacacgttacgttagtaaggttctcaaaataaaaacttttcacccatcacattaaatgtttggacacataaatagagtattaaatgtggaaaaaaaactaattacatagtttacgtgtaaattacgagacgaatctttttagcctaattacgccatgatttgataatatagtgctacagtaaacatttgctaatgataaattaattaggcttaataaattcgtctcgcagtttcctaatggaatctgtaatttgttttgttattagactacgtttaatacttcaaatacgtatccgtatatccggtgtgacaaccaaacctaaaatttttccctaactaaacaaggcctaaacaatactttagatgttaatatgaatatatagctaaaagttactatatactttagatagagggagtatttcatgatagagaaagtacatatctttgtaattcaaattagactataaatatacctatatttgagctacaaatatgtatattttgagataaatggagtttgggagttctaaatataaaatcgaggccacatatggaacgaatttcatgaaaattaaactaagaactccgaaagagcatgtgtggggttagaaatgtgatgtgacggcctcatcgtgcaaggtgcaggataacaatgttatcagtagcgacatactactatagtaatgatagatcacacacgcatgaattgtctgttgatgatggtgttatttcggtggagataccattttgtaagcttgtgcatggaatatagtatggcagttgcgaccatctgcctgtctactgtatctcaacagtaactcgtgtgccgcacaacgcacgaacaggcaggccgttcgcacacaaacacaacggctggatcaaatccgcacccagaggccgcgcgcgcttttacccatcaaccggaacggccttgtggcgtacgtgtggcccatataagatgggccggaacgggactgtggtgtacgtgaggcccatataagttgggctggaaggtgtacgtgcgtgcagtccatataagttgggtcggatagggactgtggtgcaggtgcggcccatataatttgagccttaactggactggaatgtagctgaggcccatttgtgttggcccataagtggttcggccgccggtcgtaacgttcatccgtgtactaagcctcgcttcggctacaaaattttcgtgcggacggaaactattctgacttttctgagcatacgatcgattcgcacgtttcacatgactgcatgaatcactctccgttactgtccattacaatcagcagcgatgtgatacagtgatagtactggatgcattcttgctgttttcgtcggttgcttgtacagctgtactgaagagacgacgttcatatcaaatagtacgtggaaatctgagaagatacccaagcccaaactaaatccgcgtttgatgatacggaatcctccacgctctgttccgttcggtcccaggtgaagtccacaccacacgtacatgcaaatgcaacgcaagcgcgcgcgtacgtacaaactgggattgaacaggtcaaggatcgaaacgcgagccaaaatgttcacgacaaaagagcgcggcagttgcaaggaaagcgaaaggcgcaagcgcaagtgggggaggaatcgggagcgtatccgcggcacaggaaaacgccactttcgtggtgatcggcagcggatactccgagcaaaatctctcgtctcctctcctcgcgctcatgtcaaaaccatcgccgccctggaaagcgacgcggcgatcgaacgcgatatcatatcgaatcatctccacttctcgatcttcttcagttggccgtgccaggcgtcaccggatccgcgccttcagatttgggtgactccgcgaaccacttcgcgttccatgtgttttgccttcctactcgctgagtcgctgatgatatgataaggaaagttgctggctgcatcgccaagatttggctggggaaagttggtagcaaccgagaaatcgtccgatcaggaggatttcttggctggtgtggcaaccccatccgatccgaggatttgaagcctgattatattttaatcttgttgtacagaagatgctattttactaatcttcttgtacaggagatgcttatcaattattagcagtttgtttgtggctagatcagaattcagatatgtgccagcatgaccattagcggttaatctttaatttgttctctgaggcatggatgtgtgcagtattattcccatgcaagcatgcgacttcacataagtttgatgaaacgatgtgtgacagactgacagtgtgagtgtcaagaaatgactgtgattgtagcaatatatgtgttgatgtacagcaacaaatctgatgcagcaaactggcaggtcacacatggagaagaattttcttttgctttaccaaatcgcctaaaacgatccgcatctttcagtctttcaggtcatccaacaagaggacaacccaattaactaaaaactaaagaaaaaaaggatttgaaaaaggggatagggagcaaaagaaaatggtggaccatctttcttgctctagaatacaaagagtactactgatgttgccgggggcctattctttgtggagtcaattcctggcaagatttgcagcaaatctgcccgggatcttgctttccatgaggcaggattttctttggtcattacacctgttttccccatcagcttttcttcttttttcatatctccaagaatcctttcacatgcttatgtatatatataagctcaaccacacccaaacgcccttgtaaagcaaagcctttcatgccaagcacacacaccatctgcatcttctcttctaccattcttgctttctccttgtagtctcttctgttctttcagagaagagaaaaacatatctgtgctagctttgccttcttccatggcagtggctatagaggctccgttccatgtcctggctgtggatgatagccttcctgacaggaagctcatcgagaggctactcaagacctcttctttccaaggtattacaagatttttcttttgtgcttgcagactcttttcttctctcggttgctgtatgaattggcatctgatggtaggtttggcttttgtttgtgtagttaccactgttgattccgggagcaaggctctggagttcttggggctccatgatcatgaggacagcccaatttctactcaatcagatcagcaggtaagaagatgaatggtaccataggtgctaaccatgaaaaaaaatacggattaacaggaggttgcagtgttctttgttctgaacaagagtttctgaattgctcttttatggattaacaggaggttgcagtgaacctgatcatcacagactactgcatgcctggcatgacaggatatgatcttctcaagaagatcaaggtaattaccatctctgctctatttgattgtaccaaccatttgatttgatctactcaagatgacagtgaggtcagttcctgaatacagttttttccctttgggtttgttcaatcaggaatcgtcttatttaagggacatcccagttgtgatcatgtcatcggataacattccttcaaggatcaataggtgagcactcttatggatctaccatattatttcgaccatctattacaatacaagcatcttatgatatttggatgaacatgccaaagtcagatgtgcagataatttagtaaaaacttagagcacaaaaaaggagaacatcttcgtatgcatatagagaaaaaaggtagtggaaaccttatcatttgtgaaaaataatcaaatatagaaccaagctggtttaaggctaaacttgatatggagatctctccgaatccttaattgatttggagtcacatgcagtataattaaggaacaagccccacacagctcacgtcgtcttaatattctatctcgacagttttggtgtaaaatcaataatgaagatatggagtgatacgcaaatcaatcttgtcgatcttccatgatgtggtgtctaataaaatggtctttagttgcagacaactaactagcaccacatgtctttgtcacaatatattctattatatatgtacaaca

SEQ ID NO: 65260 - DNA, 2613 bp, Oryza sativa
acaacaaatggagcaacaagagggcactctaaaagtaaagtaaaatatcctccagatatcataagatatgaataaaaaaaagaaatttgtaatggatagtacatggagaataatcctgtgtttaatttctggattgcatatcatggtttttgatcttagaataaactctgatacagttttgattttgttatctgaatcagatgcctggaggaaggagctgatgaatttttcctcaaaccagttcggctctccgacatgagcaagctgaagccccacatactgaaaagcagatgcaaggagcactaccagcaggaacaaaacctgcaaagcaacagcgaaagcaacaacagcagtaaccccacaagcgagaacagcagcagcagcactagcagcaacagccacaagagaaaggcagtcgatgaagaaattttgccccacacaataagaccaaggcatagttgatttagcatctgactggtcatttgacactgattttttttcttgcttctgtctgatcggtttttgacatacagattcgtaaaagggatactaacatctagtttacaaaatagaatggaatccgttaacggatactgcttgaattcgaatgggtgattctcagttcatcacattgtgattttaagccagttaagccttcaaattcctgctgagattaagggccactgaaaacatcttgtgccatatttgttaaggaatatcttaaaaccactaccaaacaactttaatgggcaagtttcccaactgcattcaggtaaagttcccaacttaaatgggcaagtttcccaactacattcaggtaaatttcccaactttcatgggcaacagggcaagtttcccaactacattcaggtaaatcacgcaaagaggagtcacatagatgatagatcaacaactagtagctaataacttactacaaccttcatccataggaacacatggatccctcaaaagacgcatcggtatgccacacgcttcccagtaagttcaccgtcatatataactttaaccacggttcccttgtcaaagccatagtagcgagcaacagcatcagtctctagcatgcgtggcaactgaaagatacaagcaccatttcagcgaagtgatgtaaaggtatttcaggacagtaattttagtgttaaaaatgccatatattaatgaccggaaggagtaaaatggtagtgaaaacaaaaatgatttggctttgaggcacaacaagattccatctaccaaaacaaagaaaattgtccatttctcataatgaatataaagaggatcactggtatgtttaccacataacaaggatactgcaataacaaatatgatgcagatcaacatgtgactatgcaaataatgtagaggatcaacatttatagcaaaacatggcatattgtggatatgggaaatttaatacactcaaggggacctgtactgtacatggatgtatgtgccctttgggctgaccatacaacttactattcacattagcaaccatattttacaacaaatgtagttttacaaaagcatcacattatttgattactgacataaaaaattggtaacagattctaaagccctgttgcaaattatagacaagcatacctgtgagtcttccacattgtattccttgaagagcttggccttttgatctgcactcaacacttcatgcttgggtttcaggacatgcttagtaatgtttaccagtaaatctgtggcctaccattggaaaaacacctcaatttatgtgtaaaccagagtatattaacaaattataagacagtaaacaaaacgtatgcatgattaaagtcacgaaatattaatccgaacatagcattattggtttaagagcataacttgcagaagcatgtatatggattagatatatatagcattattgccagaactttccgttggaaaaaaggccatagaaactaaacaaaaacaaacctggaatatgtccactttaaatttaaagatctccttgatagcctctctagctctagataatattttgctctgcagtatcagaacaagcctggacaagttctcttcttttgtttggagatatatctctcggatagttgcgattttgacaggctctggtggacagaatacaagttgtacctgagtagtgattgagttagagtttattttaacccccttaccaaaaggtaacaaaaatagacactccaagaaatagcattatgcatggaaaaagatatagacataagcactctaacagcaggcgtggaagtataccgattatgtaagcattaagtttcaacagttacataataaattgaacccatttaaagatggcgctatgcatggacgataaaaccacaagaatactaatttgctaaaccataataaaaacccctaccagatgcagggtttatccacttttttgcctatttgcaaactaacaagtaggagtatatgatatcactggaacacaaaaaggcaaatgtgccatcgtaacatactctttatcatacgcattagcaatcttttagcaaacttttttttcctgaaaagtatatttcgcattccacaaaataatttaaacaaccactggatagtactataacacaa

SEQ ID NO: 65261 - DNA, 647 bp, Oryza sativa
acttagcttccatgaatatacatgtgcacgcatatgcatctaaataatgtcatctatatatatacggatctttaaaggagttttcttcacatgatcagtgttaactttcagtttccaccactactaaaataaacatatctacagtttggcactatcggtgttggaaatactaaaccggtacctataatgcttttcccgctccaaacgcgcatccatgggacaccatcggcctgaactggcaccttgctgaagacacatgtgccggttcgacaagtatcagttttttaaaagaatcgacacctataatatattataggtcctagtttattatcatccgagatgtgccaggaagatctagcatcaagttttggaatgacggacaatggtgaagtcagatctaagtatgaggggaccaacttaatttacaagtaattacactaagaaaaaatattataaaatgttacgaaaatagatgcacaacggaaacacaaattttacgtggaaaacccttgcggaaaaaaactacggacgccgaccggcaacgatcaatgtagaggagtttgatacaacgtgggggatacattgggctgtacactctcgccgtgtggcttacagggacacaagggtggatctgaatgggggccttg

SEQ ID NO: 65262 - DNA, 620 bp, Oryza sativa
  unsure (1)..(620): unsure at all n locations
ctttagagacaaaatttgctacaggacactcaaaaaacgtataattagttgtaggacactgcaaagacgtgatttggctctaggacactccaaaaaaacatgtaatatgatggaggacactgaaaccattattttattttttttcgaacaaaaaagagagagaaacaataagaaaagaccatattgcccttcggctctctcggcttggctctaggcgtgtaatgaggctacatgtggcttactctgattggctcctcatcgactcgatcccctttactcatctgtcgtcgtgccaccgcttttatcttctcaaatatgtctaaccagcagcgaatgtctccatgacgatgacctcgcatcaggtgattcccccgtggccacgagtgagcgaccttccatgcggctgctgctcctgaagggaacaaaatgaattcatggagatggacgcaacagtgaaccaaatgctgcccagcgcacgagcgcgccgattgcaccctgtgattccaacacaaacattaggtgagatgcatccttccagatcgtgaaaccgcaaggcaacacgcgggctcgagtgcaggggaatgcctcnagtgtgagtgaggaggaagactgggggcact

SEQ ID NO: 65263 - DNA, 762 bp, Oryza sativa
ttgtactggaggatgtcatttagtaaaatcacctaatctggttgcatacgaaacatgctcctgcattgaggtccatttcctaatgtttgcatcatccattgttgccccgtcagtagtggcacacgacttggtgccctttgcggtcatacaagttgagctgcaaggaatccttcaatgtattattcaatatcatcttcggatatctcgcccatcgtaccttaggaatcgtcatcgctgctactattgctcatcccttcttatctgcacaaacatggcaaattcatagccacacataaataatccatttggaattgaagagggaacacatatataaaaaaggcaacgacggtccaaacagcatgacttagtaaatataaaatgcgattaacaacttgactcatcacatagaaaattgttacaacatgaaaaccattgcacaacgttcaggaatttacgaactacacaaatcgaacttaacgagaacaaatacgcattgtttatgaaataacaacagggttcacgaggagggaagaaagtaaacaatacgatacaatattaattgccttagcaaacagttctcatcctcttcggtcaaaatcctcaaggtccccctgcaccatcaacaccatctcctcgccctcctcccgtggacatcttcgtcgcctccattgcttgtcgttgtctctgttctaaccctgtggaatcggtcttctcagccatagagtgggcctgtccatgccgccggcaccgatgtgcatcgca

SEQ ID NO: 65264 - DNA, 898 bp, Oryza sativa
agcccttagataataataaaaaataaaattgatacaaacaaaagaaattgggtgaaagtttaaaagaaggtcgtaaactaatattaccttgagcacttagactagcactagcttgtccacagccaaaagtgctctaataaaaaatatgaacaatataacacataaacaaaataacaaaaaatagtctgctaaaaaatatttagcagttaattgctggaatcattaacattgccattaaaagtaaaaaaaacaaatatataattaaagggtactacaaagcatgtatacatatatataaggggacacttacaggagcaaaatcttcagttgacaatgggtggtttccaacagaatgttcagcatctgctcatgaataaatcataaagttgatattatgttacaacaataataaaaagaatgaatgaatcttaagtcacaaaaattaaaagtacaaaatccatacaacaatgctaaccaaaaaaggaacaaataacttacaagatttactgtgaggagttcgcttttcattaaattgaaatgagtgattgttaaatccaacatgttgcttatcagtttgaaatgaagcattggctgtagctgtgtgtgcaatattatgactgtcaagttgaactgtttcagatgaactagagtcatgcaacatctgtaaaatgctgagaataacatcttcacatgacagactatcagagacatgatttatagaacagtgactggtaagcttatcgcaaaatctttcaaactatcagacaaaaaattcccaatagctgaatcaagtttgtgatggaatgaaagcatttgttcctgtagtaggacagactgaaaaaagaagtggttaatatataagcagaaaagagatgagctgcactatatgaaaaataaa

SEQ ID NO: 65265 - DNA, 4632 bp, Oryza sativa
atatttgcagctaaacgggttcttaaggaacatattctgaaataaaggtgccaatgggacttacttatatggacaaaatagcgaaagcaaagggagagaacccatgggatgaacaggaaatcttgaaggcatgttcctattggttgcagactgtaacctctggcttcacagccaacaatgtttcctctggagcctccaatggtgaagtgttctctgtttgataggttctcaagtctacgtgtgccttggttggaaaaaaatcgaggttcttggaaagaatcacgctgttgctgtcaagcgagaaacttaaggaacagaagagtccatcctccaaggaaaagaagcatgaccctgcatcaacttcatgttccatgtatttcaccgggagcacaacgatggataagcaaggatcatggttcttgtcagaagttgtgacattgatgcgataagcattgatgggcccattatcctttgataagccaaggaacacagagccatgtggggcggcgcatccggtgaaaggtagcttcttgttgtcaaccttgtgccacttgattgagttggtgtcaaatgcatacgtgccccatggctgattgaatgataccaatatgtaggcatcaaccaccacataggacatgacgattacaaccggcagcaatgtgtaatctaccgggcgaagcttccaagggaagcaaggtggatgtggtagcttaatccaggaacatccctccaggtggtagccgcggccagcagtagcagcgacgactttggattgggagagatcgagtagctcgaaccatggcgggaaatcggggtctgcaatccaggagggggacttggacatggcataaaccttgtcgcccactgccattagggcagggcaccattttgcggagttgagagcgggcccatggatgaccttctctgtcctcgtgtcgaagatgatggtgtcgccgggatcgcccccgacgccaacgatccacgcgcgatggatcgaccgcacagaggtgaagctcttaccgccggcagcggtgggcaggcgggtgatccggcgcaggcgcttccgcttcgcctgcggtggagatgaagtggcggtggcagtggcggtgacgcctacattgtatacggagtagggcttagaatacctggaccaatcccagtggcacgccacaaggtagacagaccgaccacgtccttcatccaactcatcgccgacgatccccggctggttgagatcctctgttgcttcttgcatcggctgatcgcaatccgcttgatcctcgtccgaatcaccgccgatgatccccagatgccccgactcaaactgatcggcgtcttccgtttcttctagctctggatctgtaatggatggcttgggcttgtcatagaaagccttgccccttgctccatgacggtctctcgtcttcctcttttcgctgcccatccctggtctatgctgtcgccgagaggccggaggaggaggagatgatgacggcggcggcggctgcggctgcttaggacagagtaaggcccaccaaacacggaaaggaaaacaggcccaaacaaaacaaacggctggactctgttcagtctgattatacttctgtttctcagcccatctcacaattgtgagttcgtatttttttttcatcttttgacattaataacacagaatacacggtcatggtggatattcacggaacttctctatatgcaattggtagcaatacggatggatatagctcctgaatatgcaatgacagcctatgtttgacttcttcagtgttcacatggtttcacactgaagaattaacaaacttgtatgataaccagaaagttaattgtagtgataaatttctatagaaagtacatactcactagtacatattcacttttgtgtacgttgaaacttggacttgaggagtcaagccactgctctctcttggccaattcgctgaactttcatagttactcctgccccattatcatctcttcaatacataaatagagacgaccagccagttgacgcctcatgcgtgcactataaattcaagaaccatgcagaaaccagtactctgttcacgcagtgttagtatagctagtgctacctaagcatttggttttcattatccttctttcttatttgttgttctcattcttatcactgtgtttctgcggaaatatgttcactagaagtctgctcgtccatatgacgaaggtgttcctacctctgttccagcctctgaattttcttctctgtgacaagcacaacacacacagcacatgcccatctgaacattctgaaaccaaagcaagaacagagctcacgcatggcgatgtcgctgtggtaatggcagcgcttgggctcagtttcaatgcggagggcaacgaggtagaggatgaagctcttgtactattagaagagaagcaagcgagctgggaagaactagaggaagctttcagcgtgttcgacggcgacggcgatggattcataagtcccctggagctgcagaatgtgatgagaaggttgggtttgcagcacgacgctggccatgaggagtgtgagagaatgctcaaggttttcgacagagatggcgatggaatgatcaattttgacgagtttaaagtcatgatgcaaggagttgtctgagttttgttttttttagagaagatgttcatcgccggagctgcctgagtgactactcgatctgaaacatgcacatacgcggatacgcccctatcgatcacctgaggctgttacttttgtttcttgatttgaacaagtaatggtagctgagctgaaccattttcccttggttgcctatgctggtttctgttgtgttaccaaaaaacttttgccgatgtatggccacatatcaatttaaggagttcctgtctatcatcggctcgttgcttttgatacgcacgacagtaatggatcggcatgccactttgtactgacagaatatatttggcaatcagtacactcaggagtaataaaataattaattttcactagaccttacatgtggtggtatacttgcagaaatatacgaatgggctgggaacgggccggaagctccgtcctggtggtttcagcccatcattttttttaaggaaaaaactgaaggcgcgtctcctccgttccaccgtaatcctgtcctttaccttctccgatccgaatttccttccaggtttccgtgtatagcctacacctgtgcgcctatatattccacacgacgacgacgactcatccccaattcccccatcgattcttcgccaccggcaacatccatcgatcgatctcagatcgcctcctcttaccaagcagagagttctctgcgcaaaaacgcatggatccgacggccgggacaggttcctccaccaagaagatccctagttggatggtaacggagctgccaatgctatcgacggaggccaaccgcttgccacagatccctagttggatgataaggaagccgctaatgctatgtatggaggccggccgctctggcaaggccgccgccgccgccaccgcggacgccatggagcagagctgctcggtgtgcctcaagaatttcgagaaggacgactgcatctggtcgatgccctgctcccacactttccatcagctctgcatcttgggcgaccgctcctgcagggtctgtcacccagctgctccgccgtccaccgacgagaaaccggaagcccctcggactatgcattgattgaatgaattcgcgcggaatcagtgctttgtttaactgatcaatgtcgtggccgtgcaacaaatctgcatttctctgaaaattgcaagaaacatgcaactctctgagaacttcattatctgaattttttgtctctagttttcctgcgaatcccttatggaatatattttttgtctccagttctcccatgcatgaatcccttatggaaatttttatcgaaatgtttaaatttacatagttatatacttctgctttcttgatcttcaattcaaagtctgtaatagctctttgcattatccttctttttctctgttctcattcttgtttctgcgcaaatatgttcacggtacaagtctgctcctccatataacgaaggtgttcctacctctgatctgatgtctgaattttcttcttttctgaacattctgaaaccaaagcaagagcagagctcgtgtcagaaatttcccaagatcaaactcaccaaaccactcaccctctgaatctctgaatattgtcggatgtgtacagtacactgaagaactcagaaaacagagacacaagtgagatggatattgatacctcgaggggattgtctcctcgttgtttgcttgtcactctaatagttatgaaaaaaatttgagaagatgttttaacatgtaatatatcactctataaatatgcaagttcaaattaatggtagctaagctgaaccattttcctttggttgcatatatgttggtttctgttctgttactgaaaactttgccgatgtatggcgggatgtcaatttgaggaattcctgtctatcatcggttccctgctttgatacgtacgacagtaatgcatcggcatgcagctttgtaggatatcagaataatttttttccaattaattactactagta

SEQ ID NO: 65266 - DNA, 4185 bp, Oryza sativa
  unsure (1)..(4185): unsure at all n locations
gcccaaagaaaaacaaaattaaaagcactggcacgatatatgcaaaagaaggggccatagaaataaaactaacctaaaatgtcagtataactaaacatagattcagagcacatgcaaagcgaataaaaaatgggaataaaaataattagagcataacaagcaacatgaatacaataaaaaaatcatatatttagtatgaactgtatgaaccaaaaatcacattctaatttcaaagaaatcatttgcagcactgtgggtgtgtgtgggaagcggagtactagtagaatgaatcacacagcaatgttacatacagtacactagttatctgcctataatcaatttgcagagtctgcataatacatagttattctcaaaaataacaacaatgcatagttagtttttcatactacacatgtcaaatgtgaataaactacatacaaactgcagatcagcatcaaaactacatccaaaaaatggaaaataacacacatcagaaaaaaagcatttgatccaaaagcacttgatccaaaagcatatagtactctgcatcatatgtaaacttagttctctagcatcatattataaaacgtataaaggacctgtgaatctagcatacacaatatgctctaatttgcatcgggttgctactgcataaatcaaccacgctggttgcatctccaaaaaagcaaatagtcacatacaaagggtacaaaaaatgccacaaaatattaatcctgatgctactccctatattaaacacgggaagttgcaacatcccagcgacgctagccaagcacatatccgtagatgcaaaaaacatcagatccgttatagttaatactagatcgatagttaatccataggtccaacagactagatccaagcttccagcaacgctagcacataggattcaaaaacatgaacagaaaaaatcaaaaataaaaaagcacacacatatgaaccctaaaatacaaataaatcgttgctaaccacgtcagatctgtgatagttggaacaaaataaacaagttctgcactgcaaaccaaaaaggattcaaaatccccaaaaaaaactgagaaaaaatgcaacaaaaatacctagccatgaacgagatggatcaatctccagctgacagcgagagaaattcggtggagagcgctcacgaacaaatccggcgccgaagaagggaagcacgagagaaatcgcctcggcgaggtcgctggctacgcgtcgctcgaacgagagagagagaaaaggaaaaagtaaaacggaacaacccagcggcgcggaaaccgatatcaaatattgttcaaaattggacaacctaaacgggtaagagagaaattacgggatccgataccacaattattgggtcaaagcgggtccgcagacaaaaaaaactacacgaatcacggcgtctatccgacagtcagaacaggcgactgcaatcaaccacaatttatggcgccacaaatctagcaatttcgttttttttttctgcctcgattcgctattttcttaccgttgccgcgtttttttttcatgatcgcacgatgacgcggcattgcaggcatgatgacgcgagcgacgattttatgtgacgtgagcaacggagaaacagacaaaaaaaaaattaaggcttgtatttgatacgtactcaaggccatgaatcaatcggaaatttttttttgaatgaatcggcgaactgccaatttcattgaatagagaaggagtaaactttacaagtaagaaaaccaggcctaggaccttcggtcctactgagctaaaaataaaaagcaagccagctaccaagatgcctcacccccgcccgagaccatgttttggcctccnnntaattttggccaacagacttccggtagataactctttgtgctgaaaaattctacgatttctctcgtcccagatttcccagttgaccagaagtgttaacgtgcgaagtgctttcttcggggcttccttcaagttggcggtggcctcccaccactctgacaccgattgagctggttgccattgaccgggatttagttgaccacacctagtccaatcagataacgccgcctagattttcctagtgtatctgcattctgcgagaaggtggagagcagtttcttgggtgtgtctgcataaggggcagaaagaactgttctgccaacctctggttaccagtctgtcggaggtccaaactctattttggatgatcaaccaggcaaaggtcttgcacttgcgtggtgcccacggcttccatattaggatgttgaagttggtggctgtagtacctaggagctgcgctttgtaggccgacgtcatcgtatattcaccgtggctagtgagcttccacactatcttatcctcctcattttctgtgaaatgtacgttgtgtaccgcactcagacattgattagctggctgaccagctctgttgtccaacctgaggttggaggaaggtctagattgagcagccactggtctgtagttgaggcctgttgtagcgtggtgttctttttcttggaggccgcgttgatcaggggagttacatcctttagtcttctcccttccagccaagctgagtcccaaaagcttgctttcgctccatcccctattgttatggttgttgctgctgcaaaaagtaacctatccgtgtcatcacagggtgttcccgaccccacccatgctttttccggtgatctccactcgttccaaagccaccacagtcataaagctcttgcaaattcctccaagttcagaatgcctagtcctcctgaggctgtagggaggcaggtccgtgtccaatttattttgcacttgccccctgtcagagcttcaccgcttgtccataggaactttcttctctgcttgtcgatgacctctagggactcttttgaagctttcaggcccatcagaagaaaaaaaggttgtgaagtgagcaccgatttaaccagcgttgatcgccctgccaggccaatatgtcttcctcgccagctagctactctactcatcgatttgtcgtagagaggtagaaggtctactttgcgtagacagccagtggacagaggcaaccccagatacttcatcgggaagcttgccctagttgcaggcgtgccatgcaggatgtcgtcgaggtccagattattgcatctgatcggcgccacttgcgatttttgcaggttcgtgcatgatcctgataccttcccaaaacgatttagcagagcggcgaaggcactcacgtcctctttggtcggattaatgaagacggccgcatcatccgcgtacatagatgtgtggaagcgcacagctctgcctcacagcttacttagaactcctatgtcggtagccttgtctaataggcgctagagggggtctatagccaagatgaagaggaggggggatagggggccaccctgccgcaaacccttcctgtgtctgattgtttcgcccgggattccattcagggtgatctttgaggtggaagtggacagcagcccgaatatccagtcgcgccatttttacgggaaacccctattttggaggagcgcaagtaggtagtctcatctgatcgagtcaaaagccttggagatgtccaacttgaaaaggaggatcgggcgccgagtcctgtgatatcttctcaccatattcctcacatacatgattctaatgcgatgattggaatattagtaatctgttaattagttaagatatatatatatatatatatatatatatatatatatatatatatatatatatatatattataaagccatacgacaagcacataaaacgtacaaaattctaatgcgacgattggaaaattagtaatctgttaattggtttatatatatatatatatatatatatattatataaagccatacgacaagcacacaatgcaaggcccgcttttcccgtgaccacttatcacactgatcttgactagcctctatccattttctcccctttttgactcaaccatattgtgatttcttagcaagcaaagaaacagaagatatggcggcgagacaaggcatcccaagtgaccatttgtcgtatctgcaggttaattaggataaacatagttgggatacaagcagtaaaaattcatgaacagtgctaatatatacttcttccatttcacaatgtaagtcattttaacttttctcatgttca

SEQ ID NO: 65267 - DNA, 7357 bp, Oryza sativa
aagttgaacggagtcaacgggaagagcggttgggaagatatgaatttggaagtttaatttggattttctggtcaaggaaatgatttatcggaattttctggaatacgagaaatggtttatggggtttgaagaaataatattcccaagaatattattaacagtcactgtcatgcgggaccaaaggaaatgatttgtggaattttggaataaggaattgatttatgggacaaaggaaaaaggatttattaaatccctggaaaaagaaaaggatggagggatgtcaatcagacttgtctcgggtggcattggcgcggcccgagggacttgcgcagctcgggcgagcctaatgggccggcacggcctgcgagaagggcggcccaatggggcgcggggaagagagggacggcccggtggaccgattccaccgcgcggggtcccgggtggggcccgcttgtcggtggcacggcccacggtgggatgggcgcacgcgaggtgcggcgcacgggtttcgggtgcgcggggcttaggagcggtgcaccggttggacggatggcggcgggcccatatgcagtcgcacggctttccgtggaccgcgcgcacgggagggaagtcggagggaggggacgactgaccggcttggcccagtcaaagccgaggtggcgccgacgtggcgcctacgtggcagccacgcgggccggcgggaggaggaagaaggggaggccgagatggacggcggacggcggccgtgttcaccggagcaagcgcgacggatttggtcttcggggagcacaccggagtgacgagggcgtcgagaaggagcgagccaacggctcggatttcgccggagggagtttgtcggcggtggaattcgacagtggcggccggcggcgagagaaaggggaaatcaccgaggggcgacgaggactcaattcgaggcggtgaaagcatctccggggttcaaggagtccgcttccggcgtcggatggggcggaagagcaccaaggagggctggcgacgagcggcggcctccgggagcgggcggcaacggcggcgaggccatgccgggcggcggcgggtctagggaatggtttggggaggtcctagggagctcaaggacggtggtggcgcgaggtattggcgagagggcccacggcggctcacaggcgggcgcggcggcggtgaaccagagcaacggcggggcggcacgtttaaggggacgagcgagcacccgaatggctcggggcttatccaaaatgacgcagatggcgagaatttgggcgaggagctcaccggtgtgcgggaacggtatcggcggcgatttggggatggaaaggggtggaaggccgatgacggcacgcgaccgagcggcggcgcacggcgaatgacgccgaggcggcgcggcgtctaggcgagtgcgccggggaagaagagagggagaggtggcgcccggagctcctcgtcacgcgttcacgctcgcaccggctcctccggtgctcggcgacggacgacgacgacgagagcgggacaagcggcaacaaggcggcgatggtggttcggtggtaatggcgctacagcggtggagactgaagcggggaaattgagaggagggactcggccttataggcgaggaggagaggtcggtttggaggagggaaaccgacattggcagtcaagggatgcaagggcgacgagctggcggtcgtcgacgcgtgcagccaaggcggcggcaggtgatgacgccggcggtgttgggcaaaaggaaaaagaagggggaaaggggcttggtcccttgccaaaacgagaaaaggaggagggagagtgaggaggaggaggagagggagagcagctgcttctcccactcttggacgggtgcggcgtgaagtgcggggggcccatggatgacgtcgacgatgacggcgccggtcggtttggcatgaagcggggccgggtggctgcgcggcgcaggcgcggcagggctgacggcggcaatgaccggccggtcggccacgcgcgagcgcgggaaaaggcgaaggcggtggcgggttctggccggcgacggcgggaagcggcgtcggcgcgggagagagacatcgagagagagagagaaacagcgagagcgagagagacagagagagcgagcgacggctctctctctctcggctcgcatgcgtgcaacgcacgtgcgagggtggggggaatgatgggctgggagggggagatgggccgggggaggagaatcggcccatccaaaatcacagggaggtaaggtagacttttacagagaaactgatttggatagaattggggagatttagggtttggattcgaattcaaatttgatattcgaactcgagggtttagggatgtatcaagggaaactcaaggagaagtcatggaaaagatttaaaaggaatacttgggtatttgtcctcgggaacatagggtggagtcaaggaaaggattcgaggcgggatttggataattctggattcgtagaagtatttggcgaggattcaagggaagggattgaccttcggatttagatttcggagacttgaatcggaagaggaaatttgaggcggaggattttgattttgatgagagggaacaacgggatttgaattgagatcttggcacaacttagactcgcacacaaagaacgaaaattttcgcaattaggatttttgccgaattagtttttaacgacccacgaaaagcggagcgttacagatccaccccccttacaagaatctcgaccccgagattcgaaggtggaccacacacacgaaaccaaaaaggatcttcagacttcttcacagcttcaggctctgctagtctttcttcaacttattgttgtgtgcttgccgcaaaacggtatggtactctgactcacttagcattcttcatcttactgtggctctgctcttgcctgtggaacctgttcttctcctgctccttcaacttgctcgagattcacaacttttccgtttgtttctacttgcacatggttcagacgaccttgtccgacgggcggtgaggtcaacgaggcagaaccactgtttggtgactttgaactttttggtccagatacgttgggaaggcttgttgttggttggactcgttttgacttgactttctgagggcagcaccatgaatagtgtcccatctcatggcagatgaaacattcgactcctgccttataaccacgtctttttgaaggtgtagggcatggtacggagttgcttccttcatggctattactgttgatcattgtggcttgctgaccaggttctgacatagtcgaacgagacgtagaaccggaactagttgaatgctgagatgctttctgatagtattgtgctggcgagtttgtttttcgacacaaatcttcttttgcttgaatctctagggacattactttgcgtctcttgtattcttgcatctctttcttttcttggatgtcttggcacatgtcgcaggatgcttttgctcttttgtcatcagggaaggttgaacgtactgcattaacatttggcgaatttgggcttccttggggatagaagggcatccttgaggtgctcatattagcttgtagtggtgcatccatatagggtttttgggggcagtgtctcatgtaatggccaattttgtggcaaatgaagcatatgaatccgggaacgtgtctgatcttctttgatttgagggtgggggacttgggtaagttttggcaagattgcattgtctgacattgtgggacatcttgcatgtcaacttctgatggcaaggtctttcttttgtgacaacttccttctttaatcatgctattttctcgcgatacggatttattgattgagttctgaaggttggggcaattattagctcgaagtggggttttcatccctgtaatcatcacatttaagaattctttgttcttctctttatgggtatcagtgccttctactgattgtgttccttgtatttctgcggcctcattcttactcttgtctggattcaccttgggctgtggtagtagcagttggtgttgtatagaagccaaattttgagctatttcttgtagcatctgagtctgattggctagaatctgataaatatccattgaggagtgttgatttctggttgcaacttccttgtttggtccaggaacagtattatcagtcttggcaacttggttggtgacttgttcagctagttgatttggattttctgacaaagctgggtcttccttagaaccaaggtagttgcggacacaagtctgacaggttggttgaggtgccatctgcttcagagggactgagatctgaccaacgcagaaagtagataagaagaaaaggaggaaaacaaaaacactacatcaaaacggttttcgaaatcacagaagacataggtggtgtgttccagccggtaacccaactggtctaacacctgaacacggactaccaaacaaaactcacacacgcactagtttaccacaactcttaccgagcgggtgacggtactaaggttagcctaccaacaagggcttaactaagactcctaaaggcttgagcacacctttcttcaactgggcgtgaagacaggtttactctaggatataagtcaaaacgaacgactagcttctacttttggacacaaaagatttttcgcaaaactagagctacaggggacaacgacaccttagctttcacaaatagtttttgtattcagataatgccatcctattcaggggtttcgatcctagggccaactaatgctctgataccatctcttgtcacaccccaatctgataccgccgtaaaacggcacctgacaggagcgtgtcgtagggaaaacggcgcgaaccgcttcctacgaaaccgcgatctcggtaccagtcccaggacatagtgctggtacccacggtgacaaatatgaatcatagcaatccttaaaataaatagaggacttatttatcttaacttaggttgcagctcagacagcccgagaatacaaccgacgacgcggacgaggaaacaccaatagcagcagcagcagcggaaccaacggtctaacacccaacaccacaggcgacggctgggaaccaggacgaaaccctaatcttcacttcactttatcttctcttcagggcggaggaactatatatatatttatagagcaagggtgagtactttcgtactcagcaagtcacgggaacttaggtgtttaatgctagcttggaagagaggtaaggttgttttgcaaatcttttgtttgaaatcattttgaaatcactaagtgatttatttctttctatgtttgggcgaaaagagacttgcgtctcgattcgactttaagagatgcttttcaacagctcatttagcaatgtaccgacctcccgggtcagatcattacttctcggctcccagagccattccacttgattaatcggctcccagagcctttttcattttctcggactcccagagcccagctgcccagcagcacaacaatccgcttccactcgggaagcctagtctatgatgcccgcagacatcccgaatcacacagattcgtttctgaccactcaggtcgtccatctgccacataggctgattctggttacgattcccacaccacaacaacttttcacaaagcacaggcaaacaaatctacgcaacgggaaccacctcacatccgcccatgaccgtgggcacggctgttcgaacagttagttaacctctgcagaggggtacactttacccacaagatacgaacttattccgaacacccgtcggtatcggaggttcgcaacaaagcctttccccagccgacccagggttacctcatgccacatagaaggatcaaatcctcacataaacataggccattttaggcgttcacaaatcaaactccaaccacctcgatcggtaatctggcaagcttcgcgttcttgccttaccaggaacccggtttggctccaaccgaccccgccccggcgttcccaactattggcatgcgaggtttccctgaaccgactagctacttagccagggtgtcccattccaccttgtggttgcactttgattatgttcgatgagtttctcacaggaatcggtccttatatgcgaatacgggacagtaccacataggcacaacccccgcatcgcgagtttttcacaattcattttattttcaaacacaccgacaccacatgtcgggttttgaaggcttcacaaacccatttcccaagttttcgacaaacaacggtgtatgtgggatatttagtatacgcgctcagagagcacgaataccaaggtaccacaagggtggagcgacaaggaaacagggtagtacgacctacggaaattagtgcgactactgggtaggtccgtcggtttggcatggaaaccgaggccaagcaagttaagtgtgtgattctaataatgcaagttgcaaacgaaataataatgacttttcaattataggagcaattgatcaaagggtgacttgccttgctcaaggtcttcacgaagcttcacgaatcttcgagaaaacccgcgatcgacgaaaatccgataaccgcaactatacgcaaacaatcgaaaacctaaacaaaagaccaaaagaaagatcctatttagactaattagtagtgccattaaatagatctcaattttacggaattactggaagttgaacggagtcaaacggaagagcggttgggaagatatgaattttggaagtttaatttggattttctggtcaaggaaatgatttatcggaattttctggaatacgagaaatggtttatggggtttgaagaaataatattcccaagaatattattaacagtcactgtcatgcgggaccaaaggaaatgatttgtggaattttggaataaggaattgatttatgggacaaaggaaaaaggatttattaaatccctggaaaaagaaaaggatggagggatgtcaatcagacttgtctcgggtggcattggcgcggcccgagggacttgcgcagctcgggcgagcctaatgggccggcacggcctgcgaggagggcggcccaatggggcgcgggggagagagggacggcccggtggaccgattccaccgcgcggggtcccgggtggggcccgcttgtcggtggcacggcccacggtgggatgggcgcacgcgaggtgcggcgcacgggtttcgggtgcgcggggcttaggagcggtgcaccggttggacggatggcggcgggcccatatgcagtcgcacggctttccgtggaccgcgcgcacgggagggaagtctgagggaggggaccactgaccggcttgcccaatcaaagccgaggtggcgccgacgtg

SEQ ID NO: 65268 - DNA, 1855 bp, Oryza sativa
  unsure (1)..(1855): unsure at all n locations
gtttgatgtagaatctgacacttgatgtaaataaagacaaacgactaataattgtaaataacaatataatccagaagaaaccaattggctaacaatgatatgatagaataagcactgatccgaaggttaaagaatatatcagctggaggtccgatgtcataaactccacaagattagataaatcaatgaaacctttgttatcatcggctaactccaacttatatatgcaatccttataagccgatgcaatgtccagataactcatcgcctgaaaccccgatgacacccttattggtagtcaacaagtagactagggattatggttctaagcatgacttagtagatcaaacttaactaatgtagcactaagtatgaaaagaaacataatatgtagacaatcaagcccttgactgatttttagagtggtagataccttagctaatctaatatagtaaaacaatttagccgataccgacagaaaccctaaagcgagagacaaccgatagacctaaattgagatactaaaactagattaactaagacatatgataaataggcaggcaaatatatcatccaaatcagagcaatccaagaggtcgaatgtactgatgcagccttgaacgacgccgacgtagacgatacaattgcctaggctggtggaacattggactttccctctcgccggagatcgaaaacagatgcagccccgcgtcaggttccatgttccgccggataataaaaagtagaaaacataaaaaggtggcgatgcgccaaattgtattgattgtggagagatctataacaatgaccccaggtgtacatatttatacccatggggagatactagtccttgtaggacaagaaagaaactttcctaaagataaaaggaaaacataaagtccttattggacactaacacactttcctaaagataaaaggaaactaacaaactcttcctaattaatagataaactgacatgacacatcctccttgaactctgtcactttgagataagcttcctttaacagattaatttccttaaccgaatatagcaggaatccgacnattggtgacgtgataattcacagcggccgatcccaggactcagaagccaatattgactccaggccgatgatgtcttcggggctcaccaaatttcaaaggggacgctactgtcctctccttttttagacgggcatttatctagccctctccaatcaatggcacatggaaattaggtgtttatacttgcagagaagaaaaccgcccgtcaaaaatctttacacatgtgcaaacagacattgttcactttaagatagtcgcctgcgaaatctcttttagcgggtagtttttatcagtatcttgaatatgagataccttatatttgtgtactatgcttggtgcgcccaccatataccaaattctctatggaatcaagcctcatacaaaaagtgttctagattaaaaaaaaacagccttttttttgacaaattgatctttttcaaaaagttatttcaaaactagaccgtgcaaaaaaaaacttcaaccaaaaataggccattagctcagtgccaaccgccttggcgctaaggttagccttcttagcgccagtcgcattggcactgaccccgctaaccttagcaccagccgcgttggcattaaggtagggtccttagtgcgccggcccggcattcctctcttctttccccacccaacgcggctaggattcctcctcctcacagcgccctctctcctcctcccccaaaatctcctcaaatctcccttgaatcaaaggttattttgtgggcattgctttgtagattgatttgtaaggtaaatcccctccaaaatccc

SEQ ID NO: 65269 - DNA, 27507 bp, Oryza sativa
ttcttgacagaaatatatacttttttgtttttcttttatgtatatataaaataaaatgactttctgtcattaaaactaaaatgcagttggccaagtacaaataaaatgtcaataacaataacatgctgagaaattcctgacctacaattttgtctgttgaatgtgttgttcttgaacccaccagtgtttggccaatgatgcatctatgcctctatctgagttccttatttggttgagactttttctgaaaggaaactaactatagctgaggccttatatctttgatcttttaacttcgtcaccacttttctttcttgaaaattacttagttggatgatgttgacaaatcatccctgtgtattcttgtgtatgcctgtgaaagtatttatcctcactctgatattgtgtcttcttggttgtaggcgaatttaatacttttagctgtagaaattaggaaaaaatatatcttagttactagtttactcaaaactcattttactcaattaatgtatgtaattttatttttgagcataatacaaaggtatcgaaagggacaagctgtttacatagagagccaaagagagttctctacaccatctagcgaatacaggtaccttacagcttgtctttctcatgtcttgatccttctatgcattttcgttactggtttgctcacaaccatcctaaaatgacatcttagttattactggagatatgacatgaaaattttaactctctgataaggtgcctctatggccctggagcaccaaacatatttatttgatcagtatgcaaattgtctgcattggaattaaaatgaaagaaaataaaaggacaatattaagatctatctagtaatagttctggtcaatgatatgatatttaagttgccactatgggtagttacttatttcaattgctagaggcgttttgggttcaatttcccatcaatttgtacatgtccactttgtttgaatactcatttttgtatctttctgaatagaattgaataacccttgaaatgtcattctttggttgatgctgcatttgaaaaatacatttgcactcatcacttgttctgtgccacatttgaaaaatacatcttgatgtccttttgcatgatttttagattttgtcttctacttttctgctaaacatagaaatttgcactcatcacttgttctgtgccataaccattctatgatgaattgtccttagcggattccgatgaacctgatgttaatttggttctctgagaacatgctatgacatgtctgaaataataaaatttctgagtcatgatcacttatatctgactatgtaaaatggttttgagccgatgggttcacaagtccatttgttctgcattagttgtcagcagtgcatttagctttgcaacgtaaaattcttgatgctatttaaggcagggatttacctcttttttttttgctagtttgcattttatggatcacttgtgctttctacaatctgattccagtgttttgtattacatcttgtttccgctcatggtctgatcagtgcagttattatgttatcaacttctgtttggcacatgcacttcctctgcttcttctctcttttgggatgttgtgaatcagaggttttccaatgtgttgctttcatcgaagatctgtggttttcacttctcttagtggtaacctcagcgtgagcttgagttgccatcatcaagtcatttcattctttagaatatgaagattttttgtttgcgttttttgttctcaacatggtttttttttttggcatgtcctatatgagtttggtgtcccaatggttatgacaaaatgctaatgaaccaaggctgcaatgacggttcaaaggatgaacttatttaacaagagaatattgaaatcaaaactgttgtttcatgtagaatgttttatgtgcagaaatgccttattgtatcacttatctgatcatgtttgttatttaaaaactaagacataacactggattggtgtactaagacatggagcctctaattatgatatagctgatccatttctaaaacttcttgttaagaaaacttatttcctaaatgcaaagttacattgattcctgagtatgtgctttctcagaagaaataaacaggtgccaatgcaaccatttagcacagcagaattcctgtgcaaacgtagtcttatatgactcaaaaactgagtaaacatggacacttggttgcagagcattatctgtaactgcatttgttcctagatacaaaggatttacctgtcttttctttctgaaggactgaacaacaaccaccgcaacggtgcatcacgcgcggcggaattactccgtgatacacagctcctactcccacgaacacacagagttacagaactgagcataccagtggtgataaatccaactgggcagtgttctcctgtatcgcaaccatcaaccgagaacaaagaagctaaattattcctatctataaataactggccatgactgacatctatttcttgtaattaagaaaacttgtactcctatttttttcaaaactctgaaagcttctatttcttcctgattaatgcgcatgtgctttctagtttctactaagaatcgaagtacaaatgcaactgtgcagcaaaaaccagaatgtcgctgaaactgtaagcaacatggacattgagtagcagaggcggtggccggagttgagggcgaagaggcagcgtcggcggtggtgactacgatccaaggggggattggccggcgagacttgatggggatggctccgccgttggggaggagcctcaccgtcaccgggagcggcatgtgaggtcggagacggcggcgcgcgataggactcggcgcgtccgacagaccgaccggcggcgactcgctagagaacaaggcggacagaatgtacgagcccagattttttgttacggcccatggacagaaatttttgtcagttttggtttatttcttaatttcctaaaagggtaaattgtaaagtgatttcgctaagtccacgaacttgtaaaacgtgtatagagattcttaaattttatttatagtactcactctatccgaaagtttaagaactctttcatttttttggtttttccaaagagataagcccattttacaacctccaagcttcgtctaaaatacaccctcgtccattttacgggaaaaaagagagaaaggagggagaaagagaaaggagggagaaagagagatgagagctgacatgtgggtccaagggcatttttgacatttcacgtgatttctctctcctcacccggaaatcattattctaatcggcgcggtgtccattggcaaattaccacgtttatggagtgtttttccccaaaagtgactttgggcagtatcccacggctaaaactacgaactcgtagtgtcctgtagcaaaatttgccaaaataaaaataaggagagtcaccacttcttcctccatctcttatcccctttctctccttcctctttctctctctctatccttattcctcccaggtcaggtcatccccgagctaacatccccgaactaaaaaaaaaaacctgaattaccccctttgtggctaacggggccattgctggcatctgattggaatcacaactagcggaagtaagtcacggaaggtcggagatgcactatctcaggagcaggaggcagccgacggcgaggtagcagaggcggtggccggagttgagggcgacgaggctgcgccggtggtggtgactacgatcgaagggggggattggccggcgagacttgatggggatggctccgccgttggggaggagcctcaccgtcgctgggagcggcgtgtgaggtcagagacggcggcgcgcgataggactcggcgcctccgatagaccgaccagcggcgactcgccggagatcaaggcggacagaatgtacgagcccagatattttgttacggcccatggatagaaaaattttatcagttttggtttatttcttaatttcctaaaagggtaaattgtaaagtgatttcgctaagtccacgaacttgtaaaacgtgtatagagattcttaaattttatttatagtactccctctatctgaaagtctaagaactcttttattttttggttttttcaaagggataagttcattttacatcctccaactctttgcttcgtctaaaatacaccctcgaacttcaaaaccgggtatttgacaccccctgaactttcaataccattcattttatcccctctagtggttttcagcctgattttcacctatctagcgctgatgtgacggtccagtcagcaaatataaataaaaggcaaattttactagaagacactacgagttcgtggttttagccttgggaccactgcccaaagttatttttgggggaaaacactctataaatatggtaatttgccaatagacaccgtgccgattaaaataataatttccggttaaagagagagaaattacgtgaaatgtcgaaaatgcccttgggtccacatatcagctctcatctctcttcctctctttctccctcctctcttctcccagtcacggtgaggtcgagcacgtcatcttcgtggtttccctggactagccggcgcgcctccacatcgccgccaaggtcgccgacggcatggcgttcatgcacaacaccctgtgcggcggcggcggcggcgacgccgacgacgtgaacgaaaacttgtcgttctcatcctcctacgaggaggacgaggcctcctcgttctgcggcggcgccatcgtccacggcaatctcaaggcctccaacatcctcttcacgggcaccatggagccctgcatcagcgagtacggcatcactacgccgccgtcggtggcggctccatcctctggcgccgctgtcctccgcaccgacgtgcgcgtgtacgacgtgctactgctggagctgctcacggggaaggccacggcggcggacggcgccgagctggcgcggtgggtgacggccgtcatccgggaggagtggacggtctaggtgttcgaccgcgcgatgctctcctccgtcggcgccggcgacgccgtcaccagcgagcagcggatggtgcatcttcagcatgtcaccatgagatgcatcgacgcctcctcgccaccgcccaccacgagagaggtcgctgcaatggtgaacaccgtccgcgaggaagacgacgggtcgctctcctcgaaggcatgagtgacactgacgcggacggacaccaagcacttgagcggtgtgtgcagcaatacaaaattccacacaaaattcccggtaacggtgaggtcgagcacgtcgtcctggtggctctcaaggacgcatgctggctggtcggtgactgcgaacgccctgtcggggacgacgaggtgctccgggagcatgtcctgccgctcttccccttcaccaacttcttggacagctgggacagcgccagcgtcgtcgtcatcgacgatgacgtcccgtccgccggtgtggcgctggggggatgtggccgctgagcaggccgcgtgcactcagggcgttgccgccaccgcctcggcgagcaaaccgtgaccgggagaagagagaaaggagggagaaagagagaagagagatggagagctgacatgtgtgtccaagggcatttttgatatttcacgcaatttctctctcctcctcaaccggaaatcattattctaattagcgtggtgtctattagcaaattaccatgtttatggagtgttttcccctaaaaatgactttaggcagtgtcccacggctaaaaccatgaactcgtagtatcctgtagtaaaaatttgccaaaataaaaatcaaggggagtcacctcttcttcctccatctctcatccccttctctccttcctctttctctctctatccttattcctcctaggtcatccccgagctaacatccccaaactcgacgaggagagcggtggcggaggagctcgagcagggcagtcgggcgacggcaaagctcgcggacagcaaccacattccagatctggcggtggaagtggtgcgcccatgcgggcgacgacgagctcgcggacgccaatgccatagttgtcggcgagctcatttgtggagccacccccacccccccaacgcccagagctccacgcccttccgtcgccgagcctgccacaggcggctgcgagcccgaatacggcgcaggcggctccaagcgccgccgccctcgcagctccacaccacagccgcagccaccgcactcgcagctctatgccgacgccgcagtcgccgccctcatagctccatgccgccgtcgccaccgccgccctcgcatctccacgccgctgccgccgccctcgtagctctatgccgacgctgcagccgccgcccttgtagctccacgccgccaccgcagccgccgccctcgcagctgcacaccgccgtcgctgccctcgcatctccacgctgctaccgtctccctcacagctccacaccgccgccgccgccgccaatggtcacgagggagagaagaacgaatagggcagggtgaaggagagagagagaggggcatccaacgtggcaaaaaccacagtaaaaacaacccagggggggggttaagtgtccggtattgatagttcgagggtgtattatatccggtttttgtagttcgggggtgtattttcgacaagcataagagtttgagggtgtaaactagacttttccctttttccaaaagtctaaatcctatttgtagtcactatgtgctaaattaatttttttagtggagcccaataagttattgtactatttattggttgcatattcattggttttgtcatatgatgaatgaatgaattaatcattggtatagatagccatatggtccgaggcctgatggcctgacccatggcacggccatttggcccggctcaagcacggcatggcacgactggtgtcgggcctgtgctggcccggcccgatagttgggtcatgcctgggccgatgccttggcacggtggactggcctggcactacacaatcgaataaaaatagttgagggaccaaaaaaaagacttaaattaaccatataagacacggtccaaagagtatagggatacataatatacttattccagccatataaggcacagtccaaacagttgagtgaggaaaataaacttattctatagagaagcacgatgggctatcgtgccttcaggccggcctggcacgacccgagacttattgggccgtgcttgggccgtgcgtgcagcccgtgggcagacacggcacgggccggcgtgttggtcgggccgtgccggttcaactaacctcggcccaggcctggtcgtgcctgtgtcattccagcccgggcggcccatttggccatctatactcattggtcttgaggaaaaaaaaatgtcttagacttttggatagagcgtgtatcattctggtccaaaatccagccaattcgagaatggcacgtgtcccgatgtcccccggtgtcacaggtacaaaaacagaggcgaacgatctggtccgtccgtggggcgcagctgctacgcagaacgaatcaccgccgtcagatgaatgaacaagtaagtgcatagttctagcattgtgcgtttctttgttcgagattggttcttgtttcgttcgaatcttcttcttcctcaaacagattcatggttgctctctgctgctgcagtgctgcacgctctgtgttcttgatcttgtgctctctgctcaaacagattcatggccgatgatgatgtatacgaacaagagattttacctgctctgcgaccaccatccatgatgatgatggtcacgcttggcagaaaatcgccctccatatgaggctctccacatttgattttctttctttgctgattcttccattttccctccatatgagcctcgtttctatatgatcttgcctacatggcaggccacatttctattttttttgttagttatttttttctaccttctccctccctttttttccttcttcctctattcggcaagaggcagcattggcaacaacagttgactctctctctctgccgaccagttggcacagttgtcgtcgctatggatttctcacagcgttgcctaacggatcgcactcgtacaggcctccgttagcacccatgttctccaaacttgaactcctccactaactcagccccctcctccgctccacaggcccctctgcctttggtggtcggcgccatcactctcgctgcctccttctctctgcattgcttgtttcattaaggattcctccggcctgccaccgatgctaccgttacctgcggccgcagtcggcacatctagcggtggaggaagaagaaaaaagaaggcgagaaaaaatgggacaaaagggaattttgccatgttatcatccacgtggcataacacataggtaaaaccatattcatatgagactttgggctaggacgatacaataaacgatgtttaggggcctcgttgcacgctttgcaagttcgtggatctaggtgaaatctctttacaagttgaaggactgctagtaccatttacatgtcataaatagtctttattgacctagctcaaatatggcggagtctaattttctccctctagcgcaaaatcactctcctcaactattagaaaaggtttatttttgcctccccgaatgattttggcaatggtttttgttcgctgcggcaacttgtgtcaccacctatgttcgttgtagagaagcgccatgctcacctttaaatagtccgagtaacccttgttggtcgtgctcgtagcaaacctagccgctaccatataacttgctctctgcctcacgttgccaagccaccattgtctcctattctacgccttgatgccgccattaagtttctatgtgccttgtgaccccaatttcacccttgccggagctcgattcaagcccgggcaaaaatcaagaatttggccttcgtgaagtaagataccgggttggtgacttagtataggagcagcaattctgtaataacgagctaagaaagaatgagaaaatagtcaagctaacaaaccctaaacctactctaagttgtcaagaaatagcacaattccagctcaacgacatctcaagatgttttagtcgattgtgtacgcactaatcctactaaaccgaccttatgatggcattgacccataattacgtgataatttgacaacatattccctccattccccaattgatcatcatataatttttttaggttattcccaaatgatcatcatgttagtatccactccctaaatctaatcattattagtgtattagagtaaatggacattggtgcatgcatccatacacataactctttacaaccaacatataatgtcttgatttgttattggctaggaactaggagggatggtgcatgcatcaattttgttactagagtatattttatatgagagagttattggctttccttgattttggtacatgatcaattcggaacggagggagtaatcaactacttgcatacatctataataaaaaccatatctctcatgcaattagcttgaaccccaaaccctaaattagtagatatgtatgcgcaatcagcttggaccctaaacaggtagatctatacgtatgcagccagcttgaaccctaagccatagccagcaagcaaatgagcaagacaacaaacaactttcatcacccaagcaagcaaccgagccagtgtaaattaactttgaactctgaaccctgaaccctaaacttgtagatatgtatgcgcagttagcttggaccctaaagaagtagatccatatgcatgcagccagcttgaaccctaaaccctaggcaacaagcaaatgggcaagacaacaaacaacttccatcacccaagcaagcaatcgagtctgcatctcgaactagcaatacattcaatatccatggttgggcgtctcacttggatggaaggcatgtaggtgggagatcagacgagtcaagagctcacctggatggatacgaccccttgttgcagcacatatgtatgagatggaggagaagacgtcggcaacagcgatggcgttggcaattttggactgtgtactccactactcttgtacttagaacttacaactatgggtccatttaatatgtctacacgatctacatgggcaaatgtcttaagacacctcccgcaaaaagtgtttgcactggtagacaacttaacaagttgactgtgtaaattattttcatgggtgcctcaaaagacaccacctatgtttgaaatatttaaaagtttgaaaattcatatgaacttcaattgaggtagacaacctatcaccgtgctcgtgctaaacaaatcaagctaatgataaaccacttggcccacttgtcatactctaggcttgtgctaaaaaataatagttgtggtgggccctcttcatcaccgccgagaaggaagcactaatggctaaccctatcatggagcacatgtggggcctcccgcaatgctttatccgccaactccacttccgctgacacctcctctttgtcttccgatgcttggcctagcttcagcctcctatgcctcgaccatcctagcatctctcgtgtttcctccttgatggcatctctcgcgttggctactgccaacaccgttgtggccacgcctgctgggcccgtctcctcggccttggcctctgtctctgtgccctcctctcttgcctatgaatccatgccctcggcctcatcgtcgttgtcctttggtggggacctgttatagcatttttcctagcggagcacccgcagcgcttgatggtggtaggagcggcagcggcaacatactctctctctctctctctctctcacgcgcatgcgctcgattgccgaggaggaggcacatgcgctcgacggctggcggcagagacggagcatgaccgtgcggccggtgttggaggcgggctcgccaccatcgccgcctgccatgccacgccgccgcgccatcgccccacgcggatgccgcaactctgcacggctgcgcccaggagcacagcagccacgtcctcctgggctccgcgcctctgcctgtcctcttgccaactccggcgaggcgggccactcgccgccaaccaaagcttcgtccccgccgctcctatcgccccctacagcacactcccagccacgccccctccccgccgctctcaatgccgaccggttccccctcccatccaccaccttgctgctgagcacccgcagccgccggcgggcacctccacagtctcaatctcctcctgcccggtaaggaacaacaggatgtcgccgctgccaagcgggctctgccaccacgagctgccgttcgcctcttgtgtagctccatctcgtgcgtcgccgctgtggacgcggccaccgacactcgtgcgccgcgtccgcagtcgccgcccaccctccccgccgcgtccacagtcgccgcccgccctccccgccgtgcccaccgcgcccccagcggcaaagagagagggggtgaggtaggaccgtgggccccgcctccgcctccgccttcgcccccacccccgcccacccgccgccggcctcgactcctcgcccgtcgcccgtagccgcctccgcccacgcccgccaccggcagccgcctccgcccccgcccgcccgagcctagctcctcgcccactgcccgccaggcgccagccgcctcctctgtgcggatagagagaggggggggggagagaaggagagagaaaaaaagctgacaggtgggccccatcggttttatttattttttgctgattgtatcgccacgtgtgtgccacgtaggctaaaaaccgcttcgaatcgagttagggggtatttcatctggtttgcatagttggggtgaagaatgtcaggttttgtagtttaggggctatttcggacgaccgcgatagttgggggtaattcgtactttttccaaaaaaaaaaaaagctaatcaagcactatatctatttgtgctaagctactaatcgacaatcttgagggtaaagaaaggaaagacataaaattggcttaagacaatttacttagccaacaattatccaattaaccaatcacgtctatgcgatcacgctacaagaattggcgcggcgaccacgtaagtacgacaccatggatcgagagccggccccccaaatcaccaatctcaaagcaagagaggggagtccctcccattgtctgtcccaaactacccctatgccccacctgtcaggccacgtctacacgtacgtacagtcgtacacaaacaaaaagcagcagaggagaggcttcttgcccgcgacgaaacgtgccccgggcctctcgatctggcgccatctcggccgtccgtccgatgcgcccagatgatctgcgccgtccgcggcaacaacgtcgcgctatttatagaccaacccacacagcttgcttgaccaaccactattcctccctctctctcccactttggttatctcgtttctgcttgcgctgcatgttccagttgcagtatagcaggtagaatagaactagtttttggttggttttctatagcttttccccttcttggttgatgtgttcttggcatctttgccatatggtcttgggtgtgttcgatctcctcgatctccctggtgtgtgcttcgtgagaagatgtggagtggcatgccattgccatgaggagagcttgtgctgcatgcgttcgtgtgtttgttgatctcgattgcccaagttcttgctttcttgtgtttgttttctctagatctttgctgtgtttctgttttactttccgagtgtgcatgcgtgtgtggttcttgctgtgatttggtcacaaagaaacgctcagatctgaggcacgcactggtgctccatcgggacacacgttgctcgatccgtcttgggcttggatgaacattttgcgtcatcggtacacacggcgtgatttctttctttctttcttgtgcgtcttttttgctggtccgtgagaaagcatttttccgttgctgttcttccacgatcggtacgattcttgccaggattgtttttaccttccctgcgtgcgcgtgtgtatgatcatctcctggattttttttttgtgtttttggtttcttgcctttgtgctctgccgctcgcagttcgatctgcagctctggtttacatttccagaactagtaacgttgttcgcggcaacaacttgtctctcttctttgttgctttattttgccattcctaatttcttcacaacctgtctcgcatcttttagtctgttcttcctcttttcttcatctctcttgttctctctctctctccaggcatgtacctggccaagccgccaataggtgcatgccatgatgccatgcgtggtcagaggcacagagcagcaagtttttttttggcttctcttgcactgtccgggagatcaggatcagtaaagctgctcttctttttttctccctttgggtctctctctctctcgttcttctgcaggcaaaactgcagtagtacatctgcttgctcttttcttaccacctgcttcttttgtatccctgatccctgctcttctttttgtaacttgattatagtttgtgcatgcaaacatcagcaccacaatttgctcttcttgccagcacaactgttgttctgttctcccattttttctgtgatttactagttgatcttgttcttggctgcaatctttcaatgcaagcagctttaatttgttgctttacattccttgattcggtttcttagcagtaaataatcttggttccgtttgtagttcttgggggcagctatgattagttcaaaatatactaggttgaataatgatggaccagattgatgttcctgtgtggaataacatgtacggtccagacgattacaaccacattgttcctctcgatatgagatgccctttgaaataaaatgccatcttctctgctttctttcttttttttttctgagttaatcaaatcaattaattggttctaggttgaattctgatcgacgaaccgtgtttaacttctccggttcgaacgatgaccacctgtgcaccaacacccacagttatttctaatcctttccaggttatttcgtttcttgaattttatgagcccagtgatgaacaactgatgctttgatcctccgcacaagctgcgctgtggaaatgatgtgtttaatttagattgttctgagggtgcagttgcttaattttctgcttttttttggccttttcatctgcagaaataactgcagctttgaacggtgcgtgccttgggcgtgacgaaacaatctgggccgttggttgtttgcgcggagcaatctcaggcgtccacgtgtcgctatctgtccagctttactgttcggcgccttgtctgtactctccccgttcttggtttgctttttgatcggcttcctttgtgccagaggatttgtgaccaacgttctcgggttttccctgtaaatttcttgattgatttgcccgcaaattttgattgcagcgccgatgatgagttcacaaatgtactaggttgaattctgatcgaagaacctctcttggttcgaacgatggccacctgtgttcctctcgatctgaggcgctgcgcgtgactaatcatcaccaatccaatggattcagtttttttcctttttctgattgccatagtgtgctgatgaatttgtttccctgtgattcccttacgttgaagaccctgaagcaccttttggccgcgtttgaacttgattcagtttttgatttttcaaacaatgaatttgaaaatccagccaattcgagaacggcacgtgtcccgatgtccccggtgtcgcaggtacaaaacagaggcgaacgatctggtccgtccgtggcggcgaagctgctacgcagaacgaatcaccgccgtcatatgaatgaacaagtaagtgcttagttctagcattgttccatagtgtcctgttgtccctttatccttgtaaataacttttatttctcttaatagaaaaaatgtgctccttgcgtattcccgaagaaagttctggcattgtgcgtttctttgttcgagattggtttttgtttcgttcgaatcttcttcttcctcaaacagattcatgtttgctctctgctgcactctctgtgttcttgatcttgtgctctctgctcaaacagattcatggccgatgatgatgtatacgaacaagagattttacctgctctgcgaccaccatccatgatgatgatggtcgcgcttggcagaaaatcgccctccatatgaggctctccacatttgattttctttctttgctgcttcttccattttctctccatggatgattgctctgatgaaacggacgaggccgatgatgtttatgtataaaaaagcttttacctctgatccatgcgaccatccatggtggtcggtgttctgacagagaacacctcccgttatgaggccctcgttttcatctttgtctgatcaccatttttcttttttctttttttgccttcttcttaggccgatgatgctaatcatgctcctatggtcttgaccaagaagctgaggattctctaagaatgtttcccaagagctgaggcccttaattactctgcagttctagttggctagtgagatgaatcgacgaagaaaggtacagtgttagcagtgattgcgaaaccaaagactttcctgagatgcaagcctgtgggtttgcgtttgtgacgtctctttacttggatgagccacactgcatctttctcttgaacttgctatgctgttgagctttcatgcctgcctgtctgtcattatcctctgttttaactgctcaagggatcaactgtttttgccgatgacggatctcttcgcactgttgagattctaatcgtttcttttggactggccggtgatggatgaaacctgagttgtacagacactcttaagtgagttgaatgaagtgcactgacacacactcacattgcgtctctgaggccatggataagcttccaagtttcgtgttacatttagccattcggatgctaacttgtttagcataatgttttcacttctttctgtactcattgaacagttttgatgcaaggatcaatctcgaggagccagctacaggtatacttttgacataaagtttattttcccgagcatgctaatgagaacttgccttttgcacagcggcaatgatgagaatgcaattctatgatgtactttgatttttctatgatgtactttaattctatgatactctgagccatgcatttgttttgattttttaggctgaacttcccctatctcgatctttttgattttttaggctgaacttcccctatctcgatctgttatccatgcgtggttagtagctacatattttttaccttgaccgatgacaattgcgtccattcatgatggtcgttgaacactgttaagggagtttttcagtcatgtcagatttctggcacgtttgctgtacttgatgtgcgctgatcctaattcttctatattttgtgctttcacttctatatttctttatgaacaacggatgccaaatgataagaaaaggatgcaatgatgaacagatttctcgaagttatgttgaggcatttcaatttttcccgttgtcattgcagttcttgatgtattgtcctgctcctcaactgcttcagtagtatcattgagacattatgcccagattttggttattatcattaacttgatgtttgccaataataatattagtcatcattaatttgagatagacaactgcaactcttatctgtcaatttaatcagatttggattttagtctggccaatgaggcgacatcgttccaaaatttaatcaagtggccaagtgctcatttgaagtgtaattttttgttttgtttaggccaataatgatgactatatttctgtattcagtagaatatatttttcttctgtttctgttgctagacctgcatgttaagtccactacgctaactctggtttggtcctataattgttgttgatgaccatctaacttgtatattttccagagcatgaatcagaacacttccatttgggcacattgaaatagatggtgcaatttatacagtaactcagttaactgtcatgatcatttattctgtaaaaatggcttgatgtaactgatctgctcaatcccttataccaatatgcttgatttgcttccttcttgggccgatgatgcgaaccatgctcctatggtctagacctgtgaggaggatttcctaaacatatttcccaagagctgaggcccttagttaccaaccttctttctgattttatgttcttaagagaatgtagttgctttgtgcttcattctctttcttgacaggtttgcaacctcagctgcaattccttgtcttttgaattgtctgtgcagtgggcaatgaaaagaaatccattcgatgatgtagaaatgaatataacctcgcaatgctttgagccccacatttactttgatcttttgattctgaactttcatcctattcttgcaaaatgttaatttcttgtacttgaggtattgcagttgctcagggtgcactaaactggcttctcaatgaactgctgagagtagctagtgctctacttgttttgccctctagaagccttgatttgtcccacaacttcttgtggattagccagtgatgaaacaaaatgaagttcatctaagaatctctcaggccttgaattagcttatatgatactttgcaattatcatgttaaaatttgacagctctgccctgactttcttactactctgctcaatagttgtttgtttgattggcttgaaagcttgttcttgacatacttttttgtttttcattttatgtatatataaaatgaattgactttctatcattaaacgaaaatacagttgactttcttttatgagtttctcagctcttatttttatgcaactgcaactgttggagaatttatacagtattcagcaagtgaataccttctgtgccttctgtattgtttgcaatgatgacaaaaacgattggatgatgtactttgattaactcataaatcgcaatgctctgagcgacacatttgttttggttgtttttttagtctgaacatcccctagctcttgcactgcagaccaaaaatgcataagagcggtttagtagctgcatatgtttgctttgataaaatggatgaggccaatctgcaccatttcattgatgtcacctccgatttcgggcacatttgctgtacttgatgtcttggcgaaattatacagggtgccctcatatggaaggttgatgaatgaattgggaatcaccagtgctctactcaagtatctttttcggttcatctttggtttatccaaaaatctttgtcggatcgcctttttcatttttgccttcttcatgtggggtggatctttaaagaatatttcccaagagctgaggcccttaactagatttggcctcattaagattctttctgatttatcttcccaagaaattgtagtttccattacaaaaaacagagattgcaacaccgccgatgaagtgcttcttgagaaggtacatgtcttcagttcttggcattgcatcgattttatagagttcttggctgttattcactttgtgcaagtttgttcatgttattcacttggctgttattcaccttctctactcccatttcgtcttcaggctttcagctctgtgctcttgccggcgggcaatctgagctttggtcgagtgacaggcggcgcagagctttcgtggacctcctagcgcggtgcagaccaatccacacagcacctgagcctttcctctgcattttggtggtcactgcagttcatgttgctctgcttttattggcttctttgttctactttgtccccgtgtgtttgtgagaaatatgcagtgttttgccagtgatatgaataaaaaatattggttgaatttttgaggtgcaagcctgtaggtttgcgtctatgatatctcttgcgtttgttggaactgtatgaggtacactgcgtcctttcttgcacttaatttgtataaaacaagttatgtttagctttcatacccgatcgaactgacgaacccgttgaacgggtccatggatctcttggttttcttcactttatttgagccatctctgaagaaatgcagcataggaaacatccagagtcatgaaaaataaaattctgatttttttaagccttttgtattgcaccaaagtcttttggattggccagtgatgaaactttagtttttttagtctgaactttcccagctcttgctgctgcatatcaaaatcacatttgatgtaattgatgtctcaggaagagtccctagttctcttcctgagctcattcgattctgtactagggactcttcctagtacagaaaatatagtgtccatggaacctgttgtacggttcgtcaattcaatcaggaaatatagtgtacactatattttccgtacactatggacctgttgtacggttcgtcaattcaaccagtcatttatggaactctagccatacatacactataggcggaaatatagtgtttgacagtgatatgaatcaaaaccttggttgcttcttgcactcaatttgtaccggactagtagttcggtttactatgctgtttagctttcttgccagttattgtcctctgttttgccgatgatgaaagaacctgattgaattgacgaaccgtacgacaggtccatggatctcttggttttcttcactttgtttgaggcatatctgaagaaatgcagcataggaaatccagaagtcacaaataataatctgattatatcttttgtgggccgatgatgcaaaccttgctcctacggtctaacctgtggggaggatttgtaaagtatatttcccaagagctgaggcccctacctagttatcaaccttctttccaatttctcattttccaggtgttcacataacagttgttagtaagtcaatgccttatgtatcttttgtattgtttgtacagtggctatgatgaggaaaagattcaatgatgtattatgattactcacacattgcaatgctctgagccacaaatatactttgattttttgagtctgaacttccccagaaattgccgctgcatatcaaattcacatttgatgtaattaatgtagttagcattgcatcaaatgcacaattgcagtttttgatgtcttgtcatgttcctcactttctcccgttgtagctttcttcttaaattattaatgctagagtatacttttaggctgacgatgtgccatttatttgcatatcgggcatttgagttcaatagtatctggctttcttagttacagcaactttctgttatgtctatgtagccatagtttctttttctttcttttttggattgaccagtgatgaactgtgagttgtactgatactctggtgagttaaatgaagtgcatttgacacatgcgcgtctctgaggccttgaataagtttcaattaactctgatggatagcataccaacttgactgcattcttcacagtagtctcacttccaactctatgcatttgttcaatagttctgatagtctgatgaagctgatacatcaacaaaacactgatgataattcaatgcttaggtaccggcagcaggtaaacacttgattccttgatctgtatcgggagttattttcacggtattagagaaatatgaagtggttttttccattatccaaagtgagaacttagtcattatctaggtttgaggcacaatttactttgtttttttttccaatctgaattccccctagcgcttgtttgctcgatttcatctttgtttgtggcaatcactctgcctcgatcgcgggccgatgatgtgaaccatgctcctacggtctaaacctgtggggaggatttccaaaccatatttcccaagagctgaggccttagttatcaaccttctctctgatttcacattcttctatgctattccttgaccggttttgcaacctcatctgcaataccttctgtgtcttatgtattcgtttgcatagtgggcaaatgaaaacaaaatgaatataacctcacaatgctttgagtccccagattgatcttttgactctgaacattccccctactctgaactaatctggctttgaatgaacttctatgatatttgcactacactggccaaatttctagcacacattcttctgtgttttgtgctttcatttctatcttccttattgattgaaatgttctgattgccagtgataaaactgacacattaatgaaccactgactggtagttcagtgatctatgtataaatctcatcaattttcttcacattttgaggcatcaatgagttggctctgataccttttttctttggttttcttattggctatttggactggttttcatgcacccgactgcttatgacccatcttttggtttttgtgtgacgataatgcaaagaataacaaatgtagcctgaatagaacttctgttcatgatgatacaccaatgctgaggctccagcaggttgaaaactatcagaaagtattttttttcttgagcatttaatacgaacaattccattagggcacaatgatcagttgttatttgccattattagacttctgcatcttttgatgtgtttgtatacttgccaatgataagaagacaatgcaatgatgaacaaatgagtttaatcttgcactacaagattcccgaagttattttgaggcacacatttactttgaattttcccaggttgaattttgtgccaagctctctgcccagtttgcattgttgctttacagtaaaatagtttttcttgttatgatattaaggttttcaatgtgtgatattttaagcttcttttccatataaagatatatgatttttccttttaagccaatgatgcaacacacacagttcgagattgaaacaaattggctaattgcttatttgatatgtgtaaacttcagtttcattgaggcctacaccgacagatgattcttattccttaagttgccatattggaatttacaatgaagtgccgatgatgactatcttattgtactttttgatgaaccttgagaatttgttatcctatgtctgaggtgcttttcctatatattcgtttttttttactttctatgatgtctatataaataaaatggctttctgtcataaaaaatgaaatgcagttggtcaagtgggataataagtgtactatggctttctctcctgttcttgaccccgccagtttttggccagtgatgcatctatgcctctatctgagttccttatatctgtgattgagattgtttctgaaaggaaactaaccatatctgagttccttctatctgtgatctcttgatttctttgcaactcgtttttcctcttgaatagttatttagttggatgattttgacatatcgttattcttgtgtagtgtctgtgagaccattaatcctttgctctgatatctgtcttctccgttgtaggtgaattgcatatttttcgatatttcagcataaaacaaaggtctcaaccgaagagagttctacaccatccagcgaatacaggtgttcacatagagagctgaagaaacacaggtatcaactggaactagctggttacattgagagtcgaagagagtctccttagtaaagcttgatgctgcatttgtaaaatacatttaaatatcatgatttcatttttcttgatttttggaaataaatcttttctgtgtgttctccttatctgctaaagatagaaatttgcattcagttcagtgcaataaccattctatgatgaattgtccttagtggattctgatgaacctgatgtcattttggttcaatgagaacatgctatgacatgtctgagacaataaaatttctcagttcctgcatttgacattgtaaactggctttgagacaatggcctaagtcaacttgttttgctttagttgtcattactttgttcttgatgttatttgaggcagggatttactttgtttttgtaagtttgtaatttaccgatcacttgtgctttctgcaatctgattcctatctgctgtcttcatgttttcgctcatggtctgaccggcacagctgctatgttctcaatttctctttggcacatttaccctctctgctctttttggattgtaatcagaagtcttcatctgttgctttcattgaacaacttttgtatgtcttatggagtttggtgtcccaatgattatgataagtgctgatgaaccaaggatgcaatggtacatttcaaagaatggacttatttaacattaaaagtgacacatgaatattgaaaccaatgctgttgtttcatatggattgttgccacgcaaatggctggcattacattgtcactgtttggaggactagtgctcttcattgaaatttggaaattaaactttgaaatccggttttgccaatgatatcatctttgtaaatatacaaagataagagctctcttgtacaaggcataatgggcaattgatacttattttcgggattgtccttatgtgcaattatttgtattgcttattttgggattgttgtattagttaaatgttgatactctaattgtgatataacagatccatgtctataacatatatcatgaaaatttgtaactattttcatagctcaggaaacctctatttcttcctaaacgcagagtcacagtgattcatgcaaatgtgctttcttcctaaaccaacatctgataaaacatggtcacttagatgaaaagaattttacctgcccatattttctttttctgaagaactgaacagcaaccactgcagaattatgcccgcgatgaatccagatggttgtattgcatcacaaaccatcaatctttggcaagaacaaaaagagataaattaaattaaaatttactcctgttggccatggttggcatccatctgttaggggtcacaaccagagtaagtaacggaggggtacgaaacgcaccatacggcgaggcatgaggcacccgacggcgaggtagcagcggcggtcgccggagccgagggcgaagaggcggcgccgccgcgtcgggcggtggggggcaagagggggatcggtccgtgggatgtggtggaggcttggttgcgaggtcggaaactgcggcgcgtttgagtactcggcgcctccgactctgagagacggcggcgcacccgggaacaaggcacatggaacgtacggccgtatgggcccccttatgtgatacgctgcaggcagtccgacagggaagcagatcctcttgcttaaggatgtaactagtgcctcatcttttcccttatacttatacttatcagccaaattttaaatttttacctttaaatttggatctgattttgaggttttatcattgaagtttattttttagcatttgcatttatatcgttaagaatatacatatcttaatcttaactaattaaaatattagtattttttctttcgtcacattattttcgtccgtgttagtaaggcttccgggatgatttttcgtccatctcccgtcgtttgcatgattgcatcacgcgcaacttctctctacttgagtccgattataatttttgctggtcatccgcatcacacgcactttcccaacatcatcggactcttccaaaaatctcaaaagaaacacatacatacaaacaaatcataaaattctctccaagacatccaatccaatctctagacaaatcatgacttcaccaggcaaagaaacataagcaaaacttcaaccaaacaaatcgaggcaagaacaaaaaccgtacagatagctagagcctgcacttctccttcctccatatcatcagccacccttcccaaccttagcattgatgttccgctggtcccaccacccacgccagactggccagtcgtctcctccaagactccctccatggaaccgcctcctcctccgtggagccatcgtgctgtcctcaccatccttgccgtctccgtgccgtcttcaccgtcctccttgccatcgtggcggtctcgagctcgggggttgttcgatctggcctccgccgccctgcgcctcctcctccacctcacaggagaggagaggcctcactgcacaggagagagggccggagaggcgccagccgccgcccagggaagagggcgaggcgccagccgaagcgaggagagagggattagcactggccgccgcgcaagggagaaggagaggcgctggtgcagcgctagagggagagggagaggcgccggtatagcggtagagggggcgccggtatagcggcaaagggagaggagcgcggacacgaagggaaaggagaagtgcgaaaggataaggggaagggctcgctccactccctcgagagtagggatgaaaacggatcggaaatggacgaaaactagctttatcatattcgttttcatatttttttttcagaatcgaaaactcggatacgtaaatgaaatcgaatattatcgaatacagatacggagcgaatacgagatggaacgaatacggtagcgaatatttaccggtatataaaaaacccctcaaattgagtttattgatcaaggaagagatatcgcttattattttagttcaacatctccaacatttatatcgtcaattttgtagacggtcccacaaccctatgtgaaaattgattttcatggctattccttttagagatccatatgcaaatataattatcattttctattgccaggaccttttactagatgtataacttacttaccattgtataaattggagttgttatttattttacttcacatcttcgaaacttgtaatatttgttttatactttaaatgcttttaaatacaaatattataaactacaaagtggtagatcccgttgagctctacaactttgatatggaacacatctccatcagatgtcgtttgaattgtagatatgagattttgtaaaaattaatatggtatattataatgaatatttatactccttaaatgacctcaaataataaaataatcaataagaaagttgtagatctcatcgagctctacaatgttgatataaagtttgtctccatctgattccgtatggaaaagttatgtatatatacgtgtttttttctaaaatttgctcaatgtctgcggatatccgaaaaaaaaatacggatagtttccgactgttttccgattccgacagatagtacccttactgtattcattttcgtttccgagaaaaaaaaatccgaattcgtttctgaatccgagaatttccggatagttccgaccgaaactatccgaatcccaaaaatggtccggacggacggaaactatccgaaccactttcacccctactcgagaggataagtgcaagattttttttttgctcatctcgtgctccacgtggctcctacacacggccacgcggcttgaccggctcggctacatgagcgccggatttcagcaacacgaggccctgtttagttcacaccaaacttctcccaaactctcaactttttatccatcacatcacatccaaaacttttctactcacataaactcctaactttttttcaaactaccaactttccccaaacttctccccaatttcagaaactaaacacagccgaaatcttaagaaataatcgtagttgatgcaagccctcataaactccgaactgtcattgctggcctatatgcctgttccagtcttataatattctgtcatgctactttgttgtaaacaacatctatactaatataaaaaggaggagttcacccctccaatcctacaggtgaaatcgatatgttcaatccctaccaatcctacggtgaactcggaaacccggcccaacacgcagaatccccgacgcagcataattcattagcgcgatgacaccgtcgccgcaaaatcctccgcgctaaccccgccgccgtgccatcatccacacgatgagccaatccaccaacattgccgcacatatcctaccactgcagtgcgcctcctctcgtgaaatcactttctctcgctgcaaaccgcatcctcccaccacaaatcgcatcctcccctcgcctggtcttcctcaaccgtagtgccggcgagaggcctcctccactacactgtgctcaattctctggtgaactctgccaaacccatcacgcaaaggcgcaagggcctacttggtgtctacaagaccaagaggtaggccaaaccaagaaacccacccatcgttgcttactggaccttggatagatgagaacctcctctagaccaacggtggcattctgctctatctatgcattgcattgaaggatcctatgctttaccttcccatgtactttatgtcttcttgtgctctttgtttccacaagtgtgcaatgcaggcatgcatggaaagtgctcgatgaaatgcttactcgatggaaggacgccacacagaggtcacagctaggagttcaaca

SEQ ID NO: 65270 - DNA, 2852 bp, Oryza sativa
ttagcctggttttcttgggccaagccaataagagaaacaaaagggatcaacagatttgagaattcgtaattcagtgtatatatagttcctgaaaataattcagggagggtgtccataaaaatgttacagccggtgatgattgttatcattttttttttaaaagtagctatgcctattttcattgtattactgttttatgtatgacaatgacagtgtcccaatatttcccagaaatgctctagtttaactaaacgtcaggtttatacactcagtgtgacacacatgttgatgtatggtcccttgcctgatgaacatcagtgttcttggaccatatgatcttgcctgacgaacatcagtgttcttggaccaaatgatgccattctataaagttcctactgagctaacaaattgctgtcctgacacaaagctgcatgaagcaaatgacagatttatatataaccaagactagcacaatgccgatgctaaagctagaaggcaagcagagtttctcatctcagttcagccaatactatcaggtcagaatactagacatttttttagtaacacagttgctaagctaaaggctatctccaggtttacaaaattgagagcagccacaacatagtgtacatcttttcaggacaaggtgtcaacgggtatcatgtattcgttacccatgaaagcttacaccaaggatatcagtttttcatcttcacagaacccacccatgtaaaatgactactcagttggtcttcatagaatcttgttttgatgcttcatttggtatcgtcttgtaactgcagaatatctcactaggactaaccattcaaactgacaactttttgcagatccctgaaacaagaaacaacacctataacttcagataagacatcatagttcttatgatctaaaatatgtagacttttttttctgaaagatatgcaaggaagtttgcgtaatatattaatttcctatgagctaaagcatccacactgaactttatcatagcagccagttttaccttcatatccaagtaccacaaaagttatcctctttcttcaaatttatcctaacgtttggtgataacctatcaaccttctcaagcttctgttttgcttgagagagtatgtcatccgcattacttgttgtagacataatggtaagattttctatggaagccccatgttctagcaccgcggaagcaatagcaatttcagtttcgcctccaccatagtcaaacaacttgagaacttgtagatgtgactttaggcaagctatgtctttcaatgcagatgaccaatcatcagaatgaacgtcacattcctcctcaaagtataccttatcttctctctgtaaaatcagtaaatggttattggtaagtagaatcaaatcaaacaagaacaagccatgaatttcaaatgcttacccaaaggacaagttctttcagttctgtacaagatctgaagaaattcaacaatgcatgtctgccctttctctctttgaaagcaatactcagctcaagttttctaagacttgtaataggcacatggccccacaggaaatgcaaatcagattagtttttttttgagaggtaaagggcaggagcaaaacagattagatttgaatataggcagacacatgcttcacaacacaatcaaataacatcatcaacttaccacatctaagtaaacattgtcgatgcttctagtctgacttgacaagttgaaccatacttctcgaagcataggagctccaagaatacttatccatgtggaagacgatgtccgacttgagaaagatttcattccctgtgctgctccaataatgaccttctcaagttttggtgcccattgaattgtaatgtgactaacactggaccgccaaatttggaggaacttaaggctctctgatcggattcgctcctttccctcactgaacatgccaatgtcaagctccctaaggctgacacattggcaaactagagcaaacaaattctcgtcgcttattctgcagcatgccaaatctatgacagcaagacttgaaacatgatcgaggtacatatcagggatgttgaaaaagcagagatgcagagtcctaaggcttgagcaattaagactttgaagtgggaactcaatagggtgggatggccattgacagtttgccatcaccactgtctccacatttttctttcttagaacatcacaccactcctcaatcttctgttgagcaccattgttgatgacagatgaatcaattctgaaataactaacagggccaggatgagagaggagaatcgatgttattttacctgacaagtcgattctttcattgggcatgccaccttgatctttcattgcacgaacaaggtccagatcatgaaagatgagaggttttcccagccatagttcattccaaggactagagacaactgatccatgtagagtgagctctttgccaacctcaaacgcgatcatcccgtcgctttcatccacgctgctgggaagttgctgaactgagctcgaaccggctccctgatcctccacgcatgcatccccatgggcttgaaccgaagcagcgacatagccatcaccggcgcggttcccctcctcgagcctgcggccgcggccatcctcacgcgcatcgcggcggaggcggacgctacgtccctgatcacgcccggcgccgatgcgtagttggtgggttggtgcggcgtccttgcgctggccaacgcagcgcgcgtccccaaatccatagccgcgggcattctcatcatgcgcgctgccaccgctggggccttgatcaagtccaccgaggccgcatgcttggcctcgcgcggcatgcctcccctgatc

SEQ ID NO: 65271 - DNA, 9484 bp, Oryza sativa
cttgacgtattaacgttgcatagcaatttcaaggcgtagattgaagaatatggtaacaatcactctcgctcctctaatttctcagcatctgtacacgatatcgtggatgagcaccatatccaacgatgagtaatttcgaaaggattcattgtacgactttttttctacacagtacatgcatgtgactatgagatgttttctcatgtttttttcatctttttccttacgaacttgcagagattgaaaatatactttattcatctgcatgattatttcatatgcaggatggctttcattagccataccaacaattatgtaggatgatgtgcagcaatttcacctcatccttcaaaggtaatttgttttcctcggaccctagtccattaaagctataataaagattgaaacatcagcttaagttaccggcaaagcatatgcatggttatagccttctatccgatctaatgattgtctgcttccctttatataaaggtacagagggatttcccttacccaaatgggttggaactaatcaactaattagtataacctatggaccacttcgtgcaaaattttaaattctagtttgataactgaaatagttaccctccatgtgtatttggttaattcgatgtagcaagttgtggtgtcattaagttaacctcatatttctcttccatcatttcgacaatggcatctgtacaatcttccaggtgtggacaagggtcaagatgtgcaaattatagcttgtgatggttggtttggtatagcagttagagttggacagttggtcatttatgttttgacaatggctatttgaaggaaaacaaaatgcaaattttttgctccacaaatgctgttttgttgtgtaacactgtaacctcacggatgtgggcttctttggtgaactgatattgtggcataattaatctccatgtctttgctactgaattgaagagagcaagcttgtaattgtgacatttgagttgataacctttgcttcagctatcttccaatcacaactataattatcttttatgtctgtgtacatccaacatagatcatgatattaatctaccctttatgacgatctattataacatgatcatatattagcatgcaaaccagattactattcatctatcatttagcttcctatcaacttgtctgctggaggtcacatgctagaccatttttaaattttaataaatgcttcctaatcgattggaagtcctatttgtgatattttttttcttttctaggctagaaataagatcaataagtatatatacacatgatggcatatagatgaggacttcttttgttgttgtgctgttgaatgcagagtaccatgaaattttagacaaccggttctttctttctttttagcccatgcaggagaaagagtgaagtatgacattggcccacattctagggactggagccagagtcaaaagtgattggaagatagctaaatctaaatttcaaaaaatttgcaacatgaatgctatattttaagtattaccacatgtttcattatgttattatagctaaaatacatctattatataacactggtttcactcatttatatggttatttgctgttcacacagaagatgcacagttgaaataaatgcccctacatggatatgaaaatttgctttgtcctcctttatggttcataaggtcatgtttacagaatatgtccactaggtcatgtgtacataatatgtccattgagagttgcattttcagtatgcatgtatggaggaataatagatcaatatgctaatgttgtaacactccatgtaggggcatttggacctcggagaaccaaattaatgtgtgccatatttaccacatcaattgaaaatccagaaaatgcacaagtttcttgggaatttagactttcaattaatgtgtttatgtttactctcatggggcatgtttgttgtttcctttttaggattcactgatgtgaatgatttgaaatcaacttaggaattatggtttttgttttgatttagctgaagataagtgtaatcttaggcttgaggtcatcttttgacccatgtagtaagcagacagtatgttgatgaaaaagtcgaacacactggcctgggagatctgcttaacttctgtgcaggtccaaagattgatgagatgcgggcgtgccagtcagtttgatcctgcaactgacaagttatgtaaacaacagataaaactgccgatcggctaacaagccgatgtagtgattccagctgatgacgataccggccgatagcgatagggtttaagcaatcggctatatgtccaatgtagatgatgatatacaggcaatcggctgatgtaataaaataacaatataatcgagtagaaaccaatcggctagaaacaatatataataagcactgatccgaatggttaaagcacacatcggttggaggtccgatgtcatgaaatccacgagattagattaaacagtgaaacctttgttgtcatcggctaaatccaacttatatgtatatgcaatccttgtgagccgatgcaacgtccaaataactcatcggctgaaaccccgatgaaacccttattggcaatcaagaagcaggctagagattatggttgtaagcatgacttagtagatcaaacttaactgatgcagcactaagtatgaaaagaaacataatatctagacaatcaagccgttgactgagttttcagggtggtagatgtctaagctaatctaatctagcaacgcgatttagccgataccggcagaaaccctaaaacaagaagcagccgatagagctaaattgatatgctaagactagattaacaaagacatgataaataggtagacaaatatatcatccaaaccagagtaatctaagaggtcgaatgtactgatgcagctttgaacgacgccgacgtagacgatacaactgcctaggccggcggaacattggacttaccccttagccggagatcaaacaccgatgcagccccgcgtcaggtgccaagtcccgccggacgataaaataaagtagaaaaggtaaaaggtggcgatgcgccgaattgtattgatcgttaagatagattacatagaccccgagtgtacatatttatacctatgggttgatacaagtccttgtcggacaagaaagaaactttcctaaagataaaaggaaaagataaagtccttataggacactaaacacacttttctaaagataaaaggaaactaacaaactattcctaattaatagataacttgctatgccgcattctctttgaactcggtctcttctagataagcttcctttagtagatcaatttccttaaccgaatatagcaagaatccgacaactgacgacttgacaactctcatcagctaatctcaggacttcgaagccgatgctgactctaagccgatgactactccgggcttaccaaatttcaatgttaacacagtataatcagtcttttttttaatttattctcttgtgtgtgcttccatatatatgatgtaggtgttgtttcttttttctgcaccaaacagtcatattctattcttttctcttgaaacatatagcttggctcatagcctgccatctgttggaactatgttacactggtgttaattttctgatctagagtcatcttgatgaaacacaagacataagggtgtgtttggataatgggaaatagagggtgggattgggattgggaaatgaatgaagggttaggattaaatagaagagagagaatgaacggttaggatttaaagatatcttttgatgggtggtaaatcatttccctttcccattagccaaacattacctaaaagttgattacttgttttttttacatgctaatatataaaagaagaatgtgcattgcacgtgcatgattactagtttaagtagtaaaggtgaagttgttttgttgagattcatgtaccattaaagattcgttacgttaacacattaatttttcgtcagtgtcctaaaaaaatccctcatccacaacatccgagatgagagtacaagataaaaagaaaatcatccagagtccgcagcaacaaccaaatgcacaagcgattcagcgaaaattcattgcaaacatagatacaaaatccaataggacaatcaagcaaaagaggaaaaaaaataaaaacatcaccggaagccgccgccaccttcgtagccgtcggattcgatgcaggaagcagccgccgccgccgccacgcacgtagccatcgtcgctgtcggatccaccgcgggaagtcgtcagcaccgtcgtcaccgtcggatccaccgcgggaagccgtctctaccgcctcgggccacgggaagcgaccggcgccgttggtgctgccggatctacccgcaggaagccgccatactaagaggcgccaccaagaggggaggagagggggagagggagtagcagagagggggcggcagaggaggagcggcaccactggtcgggagaggggaagggagggggagaggcaccaccaggaggggtggggaggggtgcggcggaggaggagcgacgccgctggtcgggacaggggaggggaggaggagaggcgccaccggtcggggaggggccgagcggaaggtggagctcacggtcgggtgaaggtgtgattagggttagagtgttgatggatttagaatcaatctgagctgtccatcaaaacgaatggctcatatcgatcccgcatcgggccggcctccatatcgggccacagcaccacacgcgcttcatgtgctggacgcgtaatagcaggctgatagggtctaatgggccttttttttacaacttattttatttctataaggaatttttttaatggctcatatcataaaaaactaaatcctaatcatctaataattttatatttgttataattttagtttacccgttgcacacaggtatttacttattaaaattgtttacataataaaaaaattcttgacatgtcccctctgctcttttttttctatgtccttatctgctcttttttcaattattatttccctcattgtctaatcttctttcatttttatgtctacttattaatatttgacctcaaatacaatttgtaaatcaaaaacaatacttactctcacaaaattaataagatttattaaactccacacattttcctcagataacaatacacaggtatattcccacaatgcaaagtgggtatagtttaactggataggtttcttatggtggaaccagtcaacctggattcaaatatttgatttgacatgggtgctcgaggcattcgtggtaacgtcgtcaatctcaatgttcacattgtgagcgcgtttatactatgtgtttctaaaaaaatttatattctcgcaattcaaaatacattgagtatgaaaattccactcgtatattattacacttacctacataaaaaatacatattttcattcatgatacaaatttccatccgtcgccttttgggcaaagacaatcgcattgttcgtccatccattttctctcgtgctacgaatcatccaaactaacacatcatatatattccgcaaatatatagcagattatttatcggacatatctaaaccaaacaacacttcttgtcactgtacacactccgtaatcaccaggtgcaacgcacgggcacttttgctagtgtgtgtgtgtgtgtgtgtgtgtgtgtatatatatatatatatatatatatatatatatatatatatatatatatatatatatatatatatatatattcttgtaaataggttcaacatgctcaaagattagtgatagattaatatgattttttaaagcaactttcctatagaaactttttgcaaaaaacgcacagtttaatagtttgggaagcgtccgtacggaaaacgaaacaacatctccctttctccagctgccggtagttgatatacggcatgtgaagacatgagcgcctcattgtcatgacattgatgaaactatttgtgaaagaaagttaaaaaactaaacaaatattttagaatttggcggctggatgttttgggtggtgtccgataaaggctagtgtcgtccctggtaaggaccgagccatgaagttaagcatggaacgatcctagtacgaccgtacttctcgtatgggtataaatctagcagagtaaatagctgcgcggaggcggtacccaagaagtggtggtttcatttagatgtgtgaataggcggagagcctacgatggataagcatatgtgggcaaccaaattaaaacctaacttaactataacttaacgcatgtgtgagttttcccttcccagtaacactagaactcctctcactgctagaaactgtgtatgcctgcatgagggatcaagttcatggagcaagtactgccaaagtgaggttattgaaatgctttgctgtgacgcgtctcattcgttgggacttcggatcatgtgttgggcaagtcacgaagtatgggtaaaatgtacatccactacagtttgagtaaaccaatctatttgaaaagccgtgctcgcagatattgagcaccgggacatgtattacacttggctagactcttaacttttaaaatgatgaaacggatgttgcatgatgattttgtactagtagatcaacttctcgggaagcgagaaggggtaaccccagaaaaccatgatgactcagtggcggaaagctatccttaaaaacacaatagatggtggacagaatgtcgctgattaatgaacaatggaactaaaacttgattagtctatgctttcttaggcttatgaaaagaattgcaaaattggtggtggtggcttgaatatcttccatatgcattgttgttgcagtgacttgttgagtacgaacggttggtattcaccctttctatttacaaattaatcaggagtactatcaggaggttgccgaagatgatagcgttcagtaggtcttagatacggtcgttgcctgtgacaataacaataccgctgcattaattctgctgccttaccttaattctgcttttgaatacattccaaactatttggttctatgttccagtctatgcctgtgggctctatgatgtaataaatcgcgcaagacactttatgtatgtgcacttgacaaaatcagctatgtaatcgtgagtatcagactactattaacatgaatgattcttgttataaaaacaggggtcgtcaccactattcctttttcttgggtcttttttccatattacaaacttaatagctgacatccttttctttcaaaatctggtcagaagcaagccgttgatcctttacgcacaagagaggaaactcactaggtatggatggagatcgttggaaaacagtgtagttataatattgtgaaacctggtaactaagcagcagctaattggatcaaattaccatgttagtggcaaggcaaagtctacgttgttccattgcatgtagcatatacactaaaacagagatgcacgagaagggtttttgcataataaaccatttttcatgacctacagagagaacagacatgaaaacaagtacttactcacagtttactacacctgtagcaagagataaaataatcatatcatggttattttgatctgtctaaacctcatcgagtaagggtcgatcctgaactgcaaacttgattatgaagtttcaggaataagtacatgaatgtcttcaggttgccagaaaaccgtacatagattgcaacagcataggacaataagtgcaaaatattggatcatgacaatgacatggcacaaatcgttgggataggatattctcagtaaccagcagtaaaaaaataaaatggcacttcctgttcctaaccttttctctttttttatctgaatttaaattaggaatacatgaaaaacttcacatccaggacagagttgcaaggatgatacaattacaaatgcacataaagtactacgtttggatccagatccaaattcaagataaatacaggatatgactggtaatctagcattgaaccatgaccaacatatatgtcctcaatacaacaggcaattcaaaattgaacaataattaacagacttcttttcaaataaaacgaaaggcagaaccattaaaagctatctgcaatctttcccttcagcaacagtaagataccagcatgggagcaacgttgaatgaggctaaatcctcagcaaagcacaaccagaaatgctccctcgacaatgtgtcattggtgatcctggtagccaggttggtctctcactagtaacattcaagatatcaacatcagatagtggcttgatgcactgatttcttggcccaggtccaattactccaccaaccagatatatgttgtctcccaaaccaatcatcccaaaacctatcctgctttggaattcagatgcacacgacaccatcttatcagggaaattcacaccacgctgcttcataatgcaactattgctcagcacataaagctccccacgaaccattgccatcggaccttgcagccaagagtagtcctcaacagcccaagcattgccatcttcaagaatctgcactgttggtaggcctttgtgcaatacatgcatcttaccctttatgacaagtccagagcatgcagagctgtgtgcttgacgtaggtcagggagaggctcccacgtgtcagcttcagggttataaatctcagcctttgatattgatttgcggcaatttgtgaagcccccagcaacaattatgttcccatccagtgcacaacaggcaaacattgcgcgagctacaagcattggagccctctggacccataaacgacagagaggatcataagaccaaacctcattgcttgcaaagatcctgtcatggtctccagtaagtgggtcaactcgatcactgccaccaccaattacatagagcttgcctgcaaccgaggccactccaaaacgagcaatattcctaatctgagatggcatgacaggaagggttatccacttatctcgaagagggtcataaagctgccacatgttttcaggttcaaatgctaacacacataacaggtcttcagtcgcactaatctgattcctaactttggaaagctcaccatttcgaacagatgctctccaagaatggcagaccatttgaagaacaggatgggacaaaaatggcacccgtgcaaggcactgaagagcaacttcattagggagaccatcaattagtgttgacatcattgagcactcaaagatatgatctcattatacagcaagaaagtcgcaagactgagcctgaaaaataatcaatatatgaagttatgattaccgtacatgaaaaactgccaggattttcaaataaatgatcagagtttcatcttaaagatatcattcaaactgatactcaatgaaaaatgatatgatgcaaacaaaagcagcactcaaacttgaaaccaacacataacaaacaattaaggcaac

SEQ ID NO: 65272 - DNA, 6758 bp, Oryza sativa
tgggggggggagcgggagagttcaaatgaatgagatgtcgtgaggaggacgggagcggacggggaaaatgcaacagaatttattccagctggcaccgctctttatctcgtcccgagttcgttagttttgcttccagaagttactaaaaatgcattgataggtgaaaactgaaaagtattttcaatttggactcccagaaggcgcacgttggcattttagttttccaatagtattttgaattactttatgcaaccggggaattcaagcaatactggaaggtgatcactgatattctttttcaattagatggtcgctgcaattctggtacatgcaggagagccttggcgacagcgtgaataacagtgcttacatatcaccgatttattaagcaatcacaaatgcgcatggcattgagcattgcaaaatgaaatgcagcaaatgtggattgggatgtagtattacaggaacaactactactaggagcacgcttgcaggacagcaagagagctggagacaaaaattcagatactaaaatcttcagggagatgcacacttgcaggagcacggcatcatttgaacaaagcattgatcctcgcattcactcgatcactgcatgctccggagggccaccggcattgtgcataaacctgaatccagtattccagtgcatactgttttgagggggaaatttaactatttgccactcttgtgacatgtcaattaacgatttaccacaccttgtcaatgaaatgccctcatgtgtttatgacatgtgggcttagtggcaaatcgttaagcaccactcgtaagagtggcaaatagttaaaagccccgttttgaggcagtacctatgtttcttcaatgactcacgaattcacgataaagatcacatacttgttgtatagcctcatcctctccatattttgaggtaaactttggagtttccaccttgagggaggattgcattggacaacaacgactgtagcggtatatggaatccataagtatttgatatgtttattttcagaaagcagaaaagatgggggtgaaatttcagtcagttttctccagtatagaacaaaaaaacagataaacaaaccaatcccagacatctatcaagtggtcagaattgaatgagatagcatttcttgtggtttgtttcatctctagccgcggcgtatcctctcagtgcgattggtcttgggttggcatcgggaatctgcagagcgggcagcgatggctgaggcggagccaatccaagatgcaggtcgcatggaagcaatgcgagcagggcatcttcgtcagcttctctcccgcctcgaaatcctccaggcacacagcgcacccgcgttccctggcgtcgcttgccatcgcctcctgcagttcgaccatggccttgctcgacgcggggacagcgccgaacccaccgttcctgtacgcatcctcctccagtactccatccatggcaatggcagtggcagtgccacggcgctgacgctgaagaatatgatcgcgaacctgatcaacaagctgctgcaagaagtcggcgtccagttctatgcgcccccgacgaatgtcagacctcaagcgctcgcgaatgatctcatgagcttcttcctgcgttaatagcgtccgactacctgggcggtacatcaagtcggtgttagaatggtgggattaaaccacaagtgtaaaagaggcacccaaaaaggttctacgctccctaacgctcctagtcgcctaggagatctagaatgaaagaaatcgcagaacattccagcataaggagctcccaccgagtggtcttctgacaaaaatcaaggacgaggccaagatatgggccttagcaggcgcgcatcatctgagaaattggcttgttccttagttgactagggccaaaggtcttgagtatttttctttccctttacgctgtacagttttctccttatatattcgatgaaattggcggctcgccgattcattcaaaaaaaaaagaaagaaagtataacgggggaagccttggaagctcaagttctcgatgggagggaaatctcttggtagtgctcttgcgaccgcggaggcatccacctccatcgatctgcggcagcaacacacgccggaggcgctcaccgtacgtcccctgcagaagagatcgccaatggtggaggcgagcaaatcaataggcggccgggtgggggggaatggatcaggattcacgaggtaaacgaaaccaagacacgatcgagcccctacctgcagagtttatagacgaagaaatcgatcggactccgtctccgcgtcccgatcgaaatcgagagtgaatccgactcggatccacccccaaatccccaattactggtgaagcttccgtttcacgtattgaaaaatttgttgccgtgccgtgcgtcatggggatgattaggtcagtcaagtggatgctgttagtagcctgtttccggctagcagcattattcacgtgattagaggatcagcaattcagcgttaggatttactaatacacacgattgcggaaaaggcaattgcagatttacagtcttaacagatacttgcatatttggatgtgacctgagattgtctatcctaatttctgccctgcggcctgcgcccctactaactttgtgctcactgtcctacgctcctgcgagatcagatgttgaagtttatcttgtaatcttgttttcttggctttcatatgtcgtagtgtcacggtgtcagttgcatgcatagaagcggtttaagtacaagcaattatcggacatggtgagtttgatcatcgattcatcgtattgttttttttggttcaaattcaaatttaagaaagagggcgtctgaagacgaggaaactacaagcaaaacaatggagaaagaaactggaattagtatcgtgatcaaaggagagcatcgacgtaatcacacaccgcttcaaaattaacaagttcaacttctccaaaaaatttggagaagtgcatttgaaccaaactgcatcataggtacattgctaaacttgatctttacccccataaataggaggtgcgcggtcaattagcattgttgaatcgtagctgtaagacctgtatccattgctctagctcagcgtgcagctcctccaaaacatcgttgtacgaggacatcgccgagcggcagacggggcagttgtctctgatcgcaagccaaccgaagatgcagcgctgatggaacgagtgcgagcacggcatcatcctgagctcctcgtctttctccccgaaatcctgcaggcacacggcgcacgcctcctccctcgtctcccccagcctcggccggtgcagcgactccagtcgatggtcgtcgatgccggctcgtgcctgtagccgtcttcgatccatctcttcgctaacgctggccaagtaatcccgtagccatcttcgctgccgcatctccctgtgaggaagctgatgatagcgagtgtatcgctgtgcctccggtgggctgtgcagtagcgtgtatcttcttccccgcatcatggtctccacgcggatccgattagcgtcccggagaggcggccggttagaatcgacacgtcgtgtgcgctccattgattggtttgcactttgcagcttagcttccgtcctagcgatggatacaagattaacgatgagtcgattagagacaacgggtagatgaatctcgatttcctactgttttgttataggcagaataaggcagtatagtatacggatttgattcgtcttcagacgtgatcggcatggtatgtcgaggagacgaacaaaaagattgatatggaggtagactgcacgtgttgggctttaatttccgggcatgcagcccatgacggacattaatgtcggcctgtttagcccagttcgtagaagcatggtgcagcccggcagtgggcttccagaatgggctggcttcctttgatctccgaaccccccggccctctgtttcaagctcccgagaagcgggaaaatggcgatcgagttggttgggtattttgcaatgccgtgcgtcacgtcgatgattgggtcagtagatgctgttattacttgctaacagctaaaactcacgtgcttataggatgaggattagaatttagtgcacacaagtaatctgaaaaaggcaattgcggatttacagtcaacagatgttgaattagaggaaacgtacagtgtattctattttgacggtgatgagttcatatgttccttagagttgcaaaatgtgatgataaggatgctaggtatgaggactgtgaaaagatgattcatgtttttgacaaagatggtgatggcaggattagcttggatgagttcagagctgtgtgactaaaacctctttcttgttcagtttaactggtatagaactagtatgattcagctcaagtttattgttggttcatgttaatggagattcctaaaaagtggagcattactttacttatcttcccatactagcaatgtatcccaaattcacaattgagcttcataaatgaaaggcgaaatttgaaagcacccatatattaatagtctgatttgaaacactactagaaatatgttattgaattttatgcaatgtaaatctaggatagaataattaatattagtagttgaaaatattcgtttgttacagtaaattcattttctaattttatattctctaacctcattaaaaaagaaggccccacccccaaaaataggataggcactagcggtcggagatcaaaaccccgaacccccattgccctctttgattcttgtttcagtggtatgtccgaactctatccttactgaacacatgaggtcctgggttcgactccccatgggagcgaattttccaggatttaatggcattgtgctttcagtggtaggcgacgtacccgtcaacagcgaggtgcctgtggtgacttcgtcaatcttaaggatttgccggcccagtcttcggagatgctcatagggttagagtttacgtacgtgcgttcataggggtgagtgcgcatgcgttgtgagtgtctccgttgtactgagtaattcttaaaaaaaacatatgctgaaaaatatgaaacatatgtttataaccaatctctgcaagattatctgaaataaatatatagagatgaaacatttgcacttcgatcgaagaacagattaggctgtcagatttactactgggagtatgaaccaggtatatgaagcccaacaagtgaagagtacacaaactacacaataacatgaaagcaggaaaaaaaaagtgatcagttttttatctgaaccaaagaaagaaatttctgttgcaccatgacgtggaaagtaagtgtatgtgtgttgtgtggtgtgaacgagtcagtcaatgcagtcaacattaacaaaccccacactgtctctactagtcttcgtcgtcctcgtcctcgggctttcctagtccttgccgcgacgaaatcaagcacatgccgctcacagaatcagtcttgcagacttgcactccagtactcttctgggaatttggcgtgaaatccaccgagcgacgccgacgcaaccccaacgtctacagagaaatctcaacgcgcagccgcgcagcgcaggcgcaatttctcagtacatcaccacgccgactggtagtgaagacacggcgagtgatctcgatcgactggacagtctggactgcgaagaacgcttgcacttgtgtgcagcgacgcgcgaatttccagggatttgttgctgccacctaccggccggagtccatggagacagcactactagtctactactaccaccgtactatgaagtaagcagattagtactctgcagtcgccgccgtccccgatagggacaaaatggcggggactcctgtcaggtcaggaaatttgcttgaaatcttcccgacgcgacgcaaacgcggcaagaaatttcccaaaacgcgggtgcggtcactattaaatcaccaccatttgctagtgaagttcaagaaaacaaacacatcgctagcaacaattcggatttagacgcgttaggaggggggaatggccgctgacgcttacgctgacgccgcgccgccgcggcgagctccggcgccggcgacttcgacagtggcgaaggaggcggagttcctctgggagcttcgcaagtatgttctgctgctggccacgctcgccgccaccgtcacctacacggcggggctggacccgccgggcgggttctggacggacaacgtgggcgagctcctcgccggcgacccggtgctccagaagacctaccctcgccgctacaaggccttcttctactgcaacgccaccgcgttcgtcgcctccctcgtcatcgtcaacctcctgctcgtccgcttcctgtgccgccgccggtggtggctgcgcgcgctccaggccgcgatgacactcgacatgttcggcctcatgggggcctacgccgccggcagcagcagggaggcggccatgtccgcctacatcctcgttctcgtcatcttggtttgctcctacgtctccgcccatgtcctgctctacgggctgacggcgcaggtgagcgcgccggacgcgccggagcgggtggagcgcgcgcgcaagtacctgctcatcttcgcgactctggcggcgaccgtggcgtaccaagccgggctgagcacgccgggcgggttctggctaggcagcctggacaaccagcacctcgccggcgaccccatgctccgcggcaaccacccgtaccgattcatggtgttcttgtacttcaacacca

SEQ ID NO: 65273 - DNA, 25978 bp, Oryza sativa
tcctgcaccccaacatgatgcatccagtctcatgattgtctacctagcccacagtagaggtagcaatatatatgtgggaggtctcttccaaaatatatttttaccaaaagtagtttattttatttggaagtaagttataatgcctaaggatagaagggattttattccagtaaacatgaaagccaatatcaaccatgacacttaatatgcatctaatatgttcttcaaatttctgactgtgaatgcaatatatgatgacaaacaacaacatggcatcaggggaaaagattagccaattgattatgtacaaaagttgatgaagtggcattgtacttctttaaaactcaatggattttcactcatgttccatatatatcctctaagacaaattggtgttcggtcatctccatttgacgaggaaaagcagatagcatataggttacactatcaataggcattcatccacagtatttctttcagtggccactaagttatactatgaaggaaaacagtgcattaaagaatcagaataaggtcattttgcgtcaaagttttcaacttttcactgaacatatcaaattacaataaatagaataaatatatgcataaacgaaacagaaagcgtgtaatctaaaaggcccactaaaatttggcattctcccacatttcatatccgttactaacatgaaattagaaacaaactaaaccgaaaagaatccaagatagggcaataaaagattgataagaaggaagatttctcgataaataaggaagagggtaaattacagttggtgtacccacaatactagttacatttttcagatagagaatataagctaggtataaagaaactaagaaataaggtcaggtagtacagatacaaaagcaataagaattaggaaatgaattgcatagcatcttccagaatggttctttcttcgtaacaaccaaggatttttgacatggatagattactaagagactatcctagtacacagttacagacaaatcaccggaaattgaaaagtgcaaggtgttccaaaccagggggcggatccaacttgggacatgggggttcacaaacatttcggggaacaaacaaactgttacttgtattaaggttaaggctctgaaattaagggaagagcttcttccagatctagaatagaagctagggttaacgaacgaacgaacgcaagcaaattccagtcccgatgggagagagagagagatgaatcagaaagaggctcaccaggatcccctcccctcccctgctctgctcgccagatggagatcgccgcccccgactcgtctcttggcggcgcaaggagcggaggagacgaagagacgggagattttcttttcttttacgccacaaagggaaggggaagacgctgcctatttctttcgtgcgtgtcctgctcttactcacaagtctctctatagccttatgttatgtatatgcaaaatcatcctgggcccactagctagctgaagcatatcctggccttttcttttctcatttagactaaaatctaccataaacaattctattttatacatgtaactttattcgtataaagtttacatatactaactttatttacatagtaattttcagtaacattttatatgtaaactttacacaggtaaacttttcacatgtaaagtttatatatgatttaaaattccttctctaaataatagagaaaaatattcaaagataaattttgctgttgtgttatgattcaaaaatgaatacatattttgtgatcacaaaataataacaaactagaataaaaaataatttcacaaaagaaataataaaagtaaaaacaaaaatgaatgcatacgatgtggaggcattattgcgagtgaatttgttactttcgaatgagcatatgtggaaggctatgagtaaatgaaaaactccacgaagtaaatttgttacttttgaaacgtgcggagatactagaaaaacggaaaactcagaaagaaaagctagacggtaaatattttactaaaatgcgaaaacagaaaaactatatagaaggaatgaataacagaaaaatcaggatggttaatattttgccgggccattgatgaatcacggatgagatggaaaagagaaaaaagaaacacagaaggtgaggtggtaaaaaaaaatgaaaaaaaacgaaccgggtaggatgcggaagaaaggtggggtggcaaaaaaagggaaaaccggaaggagagggcgttgtgtggcgctcgaactattattccgcgctgtagcgcgcggaatgtaaaataaaaggtgtttttgattattattctgtgatgaacaattagcattggagattattggtgttgatatttggaatttatttgtaaagtggttttggagatgattgaaatttacaggtgattgacagggactgctgtctgttgggtccggtcagaccggcgcagcccacggtctcaccggccgactctgtgtcggtttcggtttcgggttgtttgtttggatatccgtgattgtttcatgattgtggcttctagatggatactatacgtatgtaatactgttgtttgttaacaatgagtcaagttggggatagcttgatctcggaatatggtttctttgttctttctatgtgtaggtcactcgagatgccgggagagtatttgcggcgatggaccgggagtcggcttggggataagacgaagtccgtggtggtcagagatcatgcgggatactaaggctagagttcaatgcacgtggttggtgaagtttccatatggcatacgatggatgtattctgtgcgtatggaatgcggagttgaatttggaaggagtccaaatttggtatgattggttatgtaaagtttatttcttgtacgagaaggtttcctatgaggattaggacttctagtatgagtttggttcgtggctttaggctgcctacctcatgtataaatagacagggagcgtgaggctttccggtatcgcttttgagagcaattgagttgatagttgagttagggtttcgagtttagtcaagatttttgtaaggagtgttgttggtgcacttcgtaaacacagagagaatcaataaagttgtcatccactttaagagttcttcgatttatgtttcatcgggtttcagcggtctaaccggcgacacaccggcggtcagaccggcggcatcgcggcggtccgaccagcggcattagggcgatcagaccggcggcggcagtagacgacaggagctgatccaggcggtcagaccggagttactacctctgtcagaccggaggtattcaggcagtcagaccggtgcaattacttcggtcagaccgcgatccatcgaatttgagggtaacttttatttccgctaaaaattttggtttttgggtatatcaaccattcacccccctcctctggttggcttagttattgtgattcgatcctacaagtggtatcagagccttgttttctcctttggattttaaccgatctagagtttttgccatggctgctaagttttcaactaagccttatgttttcaatggaacggatttttctcattggtgtaataggatgcaatcttacattatggctgaggattatgatatttggagaaaagtttctcatccttatgtggtccctgaacgaattaatattgctgctttaaaaactgattttgaacaaaatagcaaagctcacaatattcttttgagtgggatttctcgttcggattatgattgtgtttctcatcttcaaactgcccatgagatttggattgctttgagtaattttcatcaaggaacaaataatattaaagagcttcatcgagatcttttcaaaaaggagtacattaaatttaagatgaaacctggaaaagctttggatgactgtctttctaggtttaacaaaattttgagtgatcttagtctgttgattcttcttatgatgctaattatacacaatctgagatttctcgccactttttgaatggtcttgacatgtctatttgggagatgaaagttacatctattcaggagtatgttgatatgtctactttgactttggatttgctttacacaaaactgaaaacacatgagatgaatattctttctcgtaaagttgattctaagttgagtgctttggtttcttcctcaacttctttggatgttgattcttcttcatcgaagtcttccgtatttgctttgtttaatgccatgtccgatgatcaactcgaatagatcgaggaggaggacttggttttgttatctaacaaactttctcgagctatgactaatgttaggtacaggaaaagaggtggaccaaatcgttgctttgaatgtggttctacagatcactttcgttcgcgatgtcctaagcttgggagagcaaggagggaagataatggtgatgagaagaccaatgacaagaagccgaagggtactttcaaagggaggaagatcaaggagactctcaataaggcttttgatcaagtctacgctgcgtttaagccactaagcgatgtagatggtgatagtagagatgaagataagggaaagaacatctccagtgtttgcttcatggcgtgtggtgaatcggattcagggtgtgaagacaatgaggtacatacttttgaggaagctattcttattttaagtgcaaaaaataagaagtgcgagaagatgtatagaaaataggaatttttcattgaatctcttaattatgaaattgttagattaaattctcttattcctaatgatgatgattacaaaaattgtgaggttttaatgaatgagatttcaaaaattagaggtgtcaatgctgcacatgatttgaaaaataagtcttctctggctcttggatttgctttgcacacacacactttggatgagttgtttttaactaaaaagttgttgcaaaaatatcaaattgcttttcatgctagtttgatgtttaacatgatttgtgctaaaaagttaaaacaaccacatgatgttttggattgctcaacatgcacattaaacaagattaaactaaaagatgttttaggtcgtgttgagtacatggaagatgttgtgaaaaacaatgaagtgctttcttgccccaaatatcgtaaaagcaaaggtgtcatggtagattgtgaaaattgtgctaatttggaaaaagaggtttcttatttgaaaagttctttgcaaagattttatgaaggtaagaaacaacttaacatgattttggatcaatctaaagtgactagttacaataggggtgttggttttgatgttcatgattatttcaccaaaaatcaaccaaatgttttgagtggatcaatctaaagtgactagttacaatagtggtgttggtttagatgttcatgattatttcacaaaaaatcaaccaaatgttttgagtatgactgaacgtggtgaaatttatacaaaaccaagtgaaaagaaaacagtttttaaatctgctggaattttgccttctctttctgcaacactaaaagtaacaaaaacaaatctttcaaaaccatcttcttctaaagaaaagtatacttgttcttttttggcaaagatgacatattgttggtttttgtttcagattggctcataaacaaaaaaggagagagaaattgcttttacaaaattaaagtggcaaaaatctggttttccctcgaggaaaccggtctgaccgcagtgggtcccgcggtcagaccggctactgagcggcggtcagactggcttcggtcagaccgacggtatagcagcggtcagaccggcccccggttagactggctgtactcggcggtctcaaattgtttttgcacgtggatatatgcctattggatctactggtcgtgtgtcttagtactggattcctaaatttttattatcatctaaccccagtactgaggcttcgacttctgcttgtgtgtacgctttggtggcaaggaaggagaacgtgtggatcgtggattccggttgttcgcggcacatgaccggtgataaaaattggttctcctccctcaaaaaggcatctaagactgaatcgattatctttggtgatgcttctacgagtgttgttctcgctaaaggtttggttaaggtaaatgagaaatttgaattgaagaatgtagctttggttgaggactaaaagtataatttgctttcagtttcacaaattgttgatgaagattttgaggttcactttaagaaaactggaagtaaagtttttgattcttgtggtgattctgtgctgaatatttctcgctatggaagagtgtttaaagctgattttgataatcatgtttcacctgcgataacatgtttggttgctaagtttgataaagatgtgatgttttggcatcgtagacttggacatgttggttttgatcatctcactaggctaagtggtttggatcttgttcgtggtttgcctaaacttaagaaagatcttgatttggtttgtacaccgtgtcgtcatgctaagatggttgcttcttcacatgctcctattgtttttgtgatggtggatgcactgggacagctattacatatggacattgttgatccagctagagtgcaatctgttggaggaaagtggtatgtgttggttattgttgacgatttttcttcatattcttgggttttcttcatggcaactaaggacgaagcttttcaacactttcgtggtttgtttcttcgattggatcttgaatttcctggttctttgaaaagaatccgaagtgataatggtggtgagtttaaaaatgcttcatttgaacaattttgcaacgaaagaggtcttgaacacgaattttcttctcctcgtgttccgcaacaaaatggtgtttttgaaagaaagaatcatgttttggttgagatggctagaacgatgttggatgagtatcacactcctagaaaattttgggcggaggcggctaacaccgcatgctatatttcaaatcgggttttcttgaggtcaaaacttggaaaaacttcttatgagcttcgatttggatgtcaacccaaagtttcacattttgcgtgtttttggtgcaaatgctttgtcttgaaatctggaaatttggacaagtttgaggcacgttctatcgatataatgtttcttggttaccctacacattctcatggctatcatgtacttattttggagactaacaaaattgttgagacttgcgaagtttcttttgatgaggctagtccaggtactagactcgatattacaggtacattgtcacaggttcagggggaggatagttgtatttttgaagacgatagcgacgacgatgacgacaaggtcggctcggccggtcagaccgggcgccaggccggtcagaccgcaagcacacctccgggcagaccgcctcaggacgagcggtcaaaccggccagggtcgtcaggttcgggttctgttgacgctgatcgagattgtcctccagaggctacaacttcgaccagtactggtacagaacgtgaaacaactttagaagtcgctgctactttgcatattcaacgacgacatccaccggaacaaataattggtaatctaagtgagcggaccactaggtctaagataacgactcatgatgtttgtgcaaattctgcatttgttgcttcttttgaacccaaagatgtgtcacatgcattaattgatgaatcatggattaacgccatgcatgaagaacttgaaaattttaagagaaataaagtttggactttagttgaatcaccttctggacataatattattggaaccaagtgggttttcaaaaataaacaaaatgaggatggtttgattgtgagaaataaagctagacttgttgctcaaggttttacccaggtggagggtttggattttggtgaaacttttgatcctgttgctagaattgaggcaattagacttttgttggcttttgctgcttcaaaaggttttaaattgtatcaaatggatgtgaaaagtgattttctaaatggttttatacaggaggaagtttatgtcaaataaccaccaggttttgaaaatcttgattttcccaaccatgtttttaaattgtctaaagctttgtatggtttgaaacaagcacctagagcatggtatgatagacttaagaactttttgcttgcgaaaggttgacaaaacgcattttgtttttaagcatggtgataatcaactgttcattcagatttatgtggaagatatcatctttagttgttcaactcacgctttggttgtggagtttgctgagactgtgcccaaggaatttgagatgagcatgatgggtgagttatcgtactttttaggattgtaaattaagcaaacacctcaaggtacatttgtgcatcaaacgaagtacacaaagaatcttttgagacggtttaagatggagaattgcaagccaatttcaacaccaattggttctacaactgtgttggatcctattgaagatagtgaagctgttgatcaaaaggagtatagtagtatgattggatctttgttgtatctaactgtttctaggccagacatacaatttgctgtgtgtttgtgtgcacgctttcagcttctcctggtgcttcacatcgtcaagcggtcaagcgaataatgaggtatttgaatcatacacttgagtttggaatttggtattctacttcatcttctatatgcttgagtagatattccaatgctgattttgctggttgtagaattgatacgaaaagtactagtggaacatgccattttcttggtacatcattgattgcatggtcttgtaggaaacaatctagtgttgctcaatcaattgctgaatctgaatatgttgctgctgctaattgttgttcacagattctttggcttatttcaactttgaaagattatgatcttacttttgagaaagtacctctcttttgtgataatactagtgctattaacattgctaaaaatcctgttcaacactcacgcacaaagcacattgatattcgttttcactttttgagggatcatattgagaaatgagatgttgaattgcagtttttggacactaaattgcaacttattgatattttcactaaacctttggattctaatcgttttgcttttcttcgtggtgaattgggaataattcatcattttggcatgatttaagggggagttttgcacctcatggttttatcaagcaaaaatatgacaatgagaaaaattgaaaaaagagagctttgttctatacatatggcattttcttgtgcatgctagcaatactatgaaggtttatttgtctctagcatagcttgtatgtattctagtctttttgtgagacttagattttgcttttaagggagatgatgcatgacacttaaattttacttgaattaagcaaatatgcaatgttgatgctagcatatggtttgatttataaatgctttatacatatgctttattgaattgttattcctcaaatagcttgtaattgctcattgtgaaaagagaataaaattatgaaaaaatgaatattgaatccttggaaacagtcttgacgacaaggacgtattcgatgtgagcaaaataatgggtgtcgaatccctggaaacagtcttgatgacagggacgtacccgaaataaaagagaaaaatatgagcaaacatgctctagaaaaagaaaaaaaaattctcttagttgttttgtgcaaaagctagtttgagaaagagtgatagatgcaataggtatatgtgtttagtgtttatttttcaacctatgtgcttgtaaagatgttgcattataaatcgtatgaaatcatgaattttgattgttgattcaagcttaattgtaaaatctttggttcatatttatactttaatgcatgcttgttatattattgatgggttcatcttctttttattacaacacatgacatgatatgctatatgtatgctaagctcctgaacattaatgaacataattcctatgcttgatgaaatcattgtcaaaagggagagaagagaagaaattttttgaaaaagttgagagttgagaagagcatgtttttgttcgattgagaatttctttcttttcaaaagtgagagaagttttcttttggattttcaagcacgatgtgtacatttgtacgaagtgtgctttttaccacttttgttttattttttccaaacactaaaatatttttgatgggtttgccaatgtgttcattgagggggagattgtaaaatcaaaggtgtttttgattattattctgtgatgaacaattggcattggagattattggttttgatatttggaatttatttgcaaagtggttttggagatgattggaatttacatcggattaacagggactgctgtctgttggatccggtcagaccgggcatgtgtcgccggccagaccgacatgtattgcgcggtcagaccagcgcagcccacggtctgaccggccgactctgtgtcggtttcggtttcgggttgtttgtttggatatccgtgattgtgatgaaccctgagttcctttcgacactcaaggcagttgtttggcccaatctttcggagagttgatgataactacgatttgagagaaacgttgacgacccaactacaatcgtacaagacgttgtgttgcgcctttgcgatcgatacacctctctgtgggttgttgatcttgccggtgcagatcaaccttattcctgcaagcaaatcgaagaaacaagcaagaacaagataaaatcaatctgaattgcaaataggaatgaatacacataataagttggggtttcgaatacaagcagatggacgggctagccgacatgcgcgctgcaaggaagtagcaatggctaaactttcatctaaacaaaacccaagaaactctaaaggggtacctagctaattataatggtgggaggacgaccaaagggaccctagggtcgtgatccacctggttggggcgcaccccacatgggccccacttgggccggggtcccagatgaagttacatgcctataggcccatgacaggtgacgcagctccttgtttctttgattgcggccaactgagatggagtttggtgataaggctggatccgttggaaggaggactccgaaacctttccatcaagtactcacgggcccaaaacggagctcgaatgcaaatttggcggctgtttgaagtcaacagtgtagtaggtggccgaatcggattccaacacttggaggacttgatcttgatatcatcttgttcatccatgatgtgagcaatggttgtatctgtagtagccatggtcacatcatcctccccttctttacggaaaaccgtcctcggtttttccatatggttctcatcgcgtggtcgatttaaaacaatctgttttatccaatcaaaacaagagaaactcgaagtaatatgattagaaataacgtgtcactcttgcttgcatgttttatccacatgtacaggaggttctaaatccgaacagatgtaaactctatgcaccaaatatattcctctatcattacattggccaaagatgtgaaaaataacattacgaggacttggcaaatcagaatgagcaaatattttgtccttcaaataattgagctcacaagaatcatcaaacagaatatagcccaatgtatttaaagaagattgcaattgaagttcatcattctcgatggacgtgtgaataacatgcttaaattcagtacatggagaatcaagattaaaagtggcatgttgattcactagttgtggaatggatataagtgaagtactatcgcataactcttctttatcacgaggaacaaaatgcaaatcaacttgtgacaaagacaattcagaagtaggttccattaaaatttgctctaggtcggcatggaaagtggaaaaatgtaattcatcagaagcatactcaccttgagtaatttctgcaccatttaatttatcttttatgcactcttcagataatgtaggtgcatcagccttctcttcattcgcgagtgatggaagtgacatctcaaacatatcgttcttctcattttggggactgttctgaacttcctgcaaaacatcagtgataggaggcacaagcatagcttgttgctccgttgggttctccaaaattttgcgctcaacattgcaagcaagcatgaacaattggcctatatgattatatgtcacattaataagcccagcctaaatatcagaattaagccctctaaaaaatctagtcattgtgttctcattgctttcttttaaaccactataagtgatacaaattttaaagttatgaaagtactcccgcacggttttgtcaccttgttttagatgttctaatttctcaaggagagtacgtttataatatgaaaacacaaaatttttcctcatcattgttttgcattcatcccaagtttcaagcttattgccaacagtgtaccaccaaaaagatgcagaaccggtacatttattagtagcagccttaatcatttgagcattagagaaatcatactcatcaaattgtttgtctactgctagctcccaattaacataagcggcggaatcatacttaccatcaaacactggcaatttagattctacccttgcaagatcattatcatatacctcatatgtgatgcgtgaagaagtcgctatatcttgttgatggtgaagatgttgatgttgagcatgaccatctcgtttccccttgcacaatcctgccatggttagtagcaaataagaaacatacacaagaatatgcacgctcctatcaactactaggtagtgacagctgaaatatcacacacactcaagcttttcaccaagctcttacaagttcttaccaaagcaagtggaatggtgacgtacaccgactcaaccaagcaccccaatggagtttggatgtatcgatgccttggcaaacacttgctgtacagctgcaatcaaatctatggagctctgggtaggcttaaatatatagcaaaggaatagcaaatgctcaatccaaagaatgcaaagttgattgatcgttcaaagtcaagtaccgtgctggtccaaggctagaatgtaatagagacgcgagcctagatacaaacagtaccacaatataacaccagaaacaactcaagcacactcttaatatatgaaaccaaactgattttttttgccttctttctttctttctttctttctttctcttttttttttattttctttcttttccttcttttttttctttttttgtgtggcttttcttttatctttttttatgcacctttctgccttttcttctctcctttttttttattttttttaacaaaaaccgactcaaggatcttaatgtaagattacagggactcaaatataaatactaaaattacagggactcaaatgcaaacccaaaattagaactatacaaaaatgaaatgctctcgttgcataggttccgtttttgcaaacatatcttcaatccgacgcacgaaaaattttcacccaagtgtatgggatgtcacggtatagctgtgagggagggaatcggactcagaaatctcggcctggtggtggtgggcggcaaaggaaggacacggcacacggagttcgaataaaaggaaaaatctcatgcaaggaaaccgaatccggttcaaatagaaaccgatccaatctactaccaaaaaccgatctaatctaatctcctccttccttcttcctcacgcacaacatcacatgcgcaccataacggatacaaccacggcacagccatcgaacagaaaccttagatgcaactcaagaactcaaaaactaaccgacagaaacttctgaaaactacaaaaatagaaccatggcagcgagccgattccgttttcgtaggtcccgacgacaacagagacacggaggcaacaacaactgtggtacaaaacgtgaccagaactcgaaattctaaacgaactagacgctaagaccagcaacacgacgtgacaatgcaacaaaaattcaacaaagcaaaaactgcatagaacaatgcaatggcacaaatgtggctaggtaatgtatgaaaatttttttttggctattttctggttataggtaaatgaaaactcaccgagcaacgaaagctctgataccacctgacgaaccctgagctcctttcgacactcaaggcagttgtttggcccgatctttcgaagagttgatgataactacgatttgagagaaacgttgacaacccgactacaatcgtacaagacgttgtgttgcgcctttgcgattgatacacctctctgtgggttgttgatcttaccggtgggttgttaatcttaccggtgcagatcaaccttattcctgcaagcaaatcgaagaaacaagcaagaacaagataaaatcaatctgaattgcaaataagaatgaatacacacaataagttggggtttcgaatacaagcagacggacggtctagccgacacacgcgctgcaaggaagtagcaatggctaaactttcatctaaacaaaacccaagaaactctataggggtacctagttaattataattgtgagaggacgaccaaagggaatctagggtcatgatccacctggttggggcgcaccccacatgggccccacttgggccggggtcccagacgaagttacatgcccataggcccatgacaggtgacgcagctccttgtttctttgattgcggccaactgagatggagtttggtgatgaggctggatccgttggaaggactccgaaacctttccatcaagtactcacgggcccaaaacggagctcggatgcaaatttggcggccgtttgaagtcaacagtgtagcaggtggccgaatcgaattccagcacttggaggacttgatcttgatataatcttgttcatccatgatgtgagcaatggttgtatctatagtagccatggtcatattagattgtttcatgattatggcttctagatggataccatacgtatgtaatactgttgtttgctaacaatgagtcaagttggggatagcttggtctatgtgtaggtgactcgagatgccgggagagtatttgcggtgatggaccgggagttggcttggggataagacgacgttcatggtggtcagagatcatgcgggatactaaggttagagttcaatacacgtggttggtgaagtttccatatggcatacgatggaggtattgtgtgcgtatgggatgcagagtcgaatttggaaggagtccaaatttggtatgattggttatgtaaagtttgtttcttgtacgagaaggtttcctatggggattaggacttctagtatgagtttggttcgtagctttaggctgcctacctcatgtataaatagacagggagtgtgaggcttcccggtatcgctttcgagagcaattgagttgatagttgagttagggtttcgagcttactcgagttttttgtttggagtgatgttggtgcactttgtaaacacagagagaatcaataaagtcgtcatccactttaagagttattcaatttgtgtttcatcggctttcggcggtctaaccggcggcacaccggcggtcagaccagcggcgtaagggcggtcagaccggcggcggcggcagacgacaggagctgatccaggcggtgagaccggagttactacctctgtcagactggaggtattcaggcggtcagaccggtgcaattacttcggtcagaccgcgatccgtcgaatttgacggtgacttttatttccgctaaaagtttaggtttttggatataccaaccattcaccccctctggttggcttagttattgtgattcgatcctacacggaatagtgctaccgctaaattatttggtttggaagacaaacttcaaagtaatttaaatgacatgtaatttaaaatggtgggatcgggatagctctgtcatcacacggggaaaactattttgatatctagagacttgaggggacatcccctcatttatttaaaaactatccggacggttatgagaaaatccaaaaaatttatcaacacacacataaaaatgttatataagttgtatcaaaagtcaactcacacatcgacatatagcgaaacaaattcagcgtataaatagtaaaaatactgttcaaatctgaattgtttttttctcagtgtgtatgtcgaatttaaacttgatttttggtggactgagtactgtcaattgtttttaaaactttccacgtctgtttgtactgaatttaaaagaaaaagatacatgaggagacatctcctataggtcttgtttggttaatcccccgagagagagactgaaggggatttatttcacatctattatgtggaattattttttctcgatcttctctaattctctgtaatccttttcaaaccgaacaagacagaagggattaaattcccctccccgtcaaacgccgcagcgcgcttcacatcacgacggcgagcagcagcagcaccacccaagccgcagataggaagacggagggcgtcagcgccgccgccgaggaccgcgacgccgttggtgacagcgacgacgactaccgcaaggaggacgacggtgtctcgaagtcgaacgtaagcgtgttctcgtcgaggtcgtacgccatcttcctgccggcctgcagcatgctgccgaaggggcgggcccacttcaattcatgggtattcaatgaatacctaagatttttgtaaaaaaatacatatataaaatatatattccatatgcatatctctactacttaaaaagttcgtagtggtggtcttgattcctgacatagcagatgcatctgatagacacgcataatctcaaccatccgattgccatgtccaacggcgtcaatctcctccccatcacgcgctcgctcctctcttgaatcgacctcctccccacgcccactcctcctcctcccacgccgcgtccttcgccctcctccctgggcgaagctcgccccgccgccgcatcgcctcctcaccagccacgcccgccggcctcctccgcgatcgccgccgccctctccaacgcgcctccacctcgcatcggatcgatcatccaccttcgccctcctccctgcgtcgcctcctcgcctcgccgccgcatcgcctcctcagcagccccgtgccccgcgccccgcgtcccgcgtcccgcgccgccctcgaccgccgacgctgcgacccgcgccgtctcctcgctgccgtcgccgcgccccgagtcccgcgtcccgcgccgccctcgaccgccaacgcgggagcaggaggtcacgccgcgtcaacaccgccgaggagccgcttcctcgccgccgtcgcgacgacccacgccgccctcgactgccgccacctccgccggtcacgatcgccgtcatctgaaggtatgtatcccctcctgtcccaccacttctgtcagccgccgctgccgcaatagccgcacgccacaccatccccgacctgcaaaccggccattgccgcccgcacgccacaccacgctgctgcgaatccctggttgctaggtctaggttaccatctccgtcgccgctgcccaatccccaaccagccatcgcagcctgcacaactcacaacatagccgccgaatccccgctgctaggtcaccgtcgccgctgcccgatccccaactgaccattgctgcctcatccctagcctaggtcaccgggactactgctcccccgtccccagttcaaagcccccaactaggttctgtatattgttgatcacgagatgtaaatgccacttttcaatcccaggaaacctagatccaggaggaatcaagcaggagttcagggacatgcacttggcatctgctgaattttttttggcattgatacggtgagtctgtctttctctaaacattagaaaaaatggagaaagaaatggtttatgtatgcctttcatgcttttaccatgtttcgatttcagtcttgatgttctgcccctgtccgtttgtttgctcctgactcctgctcagagattgataaagggttcttccatttgcatatttcagagtaattttgaaaactgaattgaaatggtgtgattttgtgtgagatagcaaacaactcttctgattggcacattgtaatttaagtgcacagttgttataagtaagtcgatagtgtattttcattcaatgttctgcagtttactagcaaatcaaactcagatttttctgctgagctgattgctggggagatattttctgtcaaatggcatcccattagatgaatttgtgtactatgttcagcaggatttggcaggagactaatgtgcatgcatgtttaaaccactgggaattatcatgtgatggcataaagtatttttcttctgcctgtttaaaccactgggaaagaattataatcctcatatttgcttccaatttccaatttaagattgtttgtttggataacaatggtgggagttctgtgccaacatcgtcaacaagatcaggtgacattttcatccatctagctaatgttatatttatcgctcaattgatatattattgcttgctaatatgaggatcactcctccctcaggtccttttgctgatataactaatgtaattgatgccaatttgacgaacaaccatcccgctgctaataaaaatggaactaatgtgccaaaagatcgtgagaattgccagcacaacaacttggactctacaggttgggcgtagcactatattatatgttttgtttctttttaaggcttttgtattaagcacagtttttgtgtgcatgcactcttcaagatgttacaaaactaagtgcgactaaactaaaaaggaagcgtgctagggagtggtatgcatcattgaccaaagagcaaaaggaagatagaaacaagaaggcacgagatatcaggaagcggaggaactttgaatcacaaggtttaaatctctactgcagcatatctaaactctctaaacagaaaactttattattaaattaattgaactttcagataatgggtctcaagctgcgacatcaaaaaaaattactactacggcctcatctgtttcaggttgagttgtcatatggtcactgctaaaaatatgtttgtaaatttgtgccaaaaacattttttaatatgtttgcatttcaatagcagctccgtttggtgatattaaaattgcaagcactgaagatcaatcagtagggggccggttggatgttaatgatgcaggcactgaaaatgtgggttctattgtaacgcctgtgcgtctaccatttactaacagttctgatatgtcctacagtacacccagcgagtataccatgcctctccaggcagaaggtccattcaaataactcaagtataaaatgacaatttattatatttatatatgcgtatgtgtgaacctcagattttttgtgcagatgctcatggagatgtcactaatctcagcgcgtctgaactaaaaaataagcgttctagagagtggtacgcatcattgaccaaagagcaaaaggaagatagaaacaggaaggcacgcgatgccaggaggcggaggaaggatgaatctcaaggtttatatataaatatacgcatatatgtctatatccaaattaaagctttacgaatatcttggctcattattattattttattaattaaactctttcaggtaatgtgcctaaagctacgacgtcaaaattttctactcctactcctacgcttggagatatttctattgtcaccgctggagatcccgcaggaagggaacaatgggttagtaatgatgaattattggacacccctacaacaaagggaacaggtaatgtatatccttacgtgcacttgcaatgaatggtttcacaattgcaattgtttatagttcaatgtactatgttcaaacaggaagtgtatctcaacaacccacgatcacacctagacgtctcccatttacagtgataaacaatatagcatattatgatcttaatgaaggatccgaagaacctttgagctacatagttcaaggagagacacagaacaataatgaaactgattttctagctacgaattcaggtcaggatacacaaagtcgtagaacatcattagagaattcacgaaatcctgtatcccggagcctttcacaagaccagttgcagtcacgtcgtgctggggatagggccaagtatgctgctaaaacaccagaacagaagcaagttatgctagaacgtcagagatcacgacgtcagtctatgacagcggaacaaaaacaagagatgaatgcacgccttagggttgcaaggcaaaatttacctgatgtggacattcatgaaatgaatgcccgtcgtagatcaagacggcaaaatgtcactcctggagaaaggactgctcatctcgcacgacgtaatgcacgctacgctgctcggcgtgacaaaccatgcgctgaatcaattgcgttggagtgccctgagggtagcagcccgtcgttattaaatccaacgccttgcttggaaacaaccgatgatgtgccagctacatcgagccggccaactgagcatgctgcagatcatcttgcacgatcatgcacttttgatgatggtatgatatatgtatgttttcattcatactcgcaattttgtacccttccgcacactaacttttcattccactaaagatgatatggattccttcatggatgatgacacggacgatgaatactacatgtttgctgggctaggtaccatcgtcctcatacttaaatctctctttcacttgtatagatttttgaaaactaaactccttttccgctaaacaatcctaggcgatgatgacgatgacgagatggtacaatctgatgacgacgacacgcaatcaccgacctcttcagttcctgatccgttcgactgtgtgtatagcaacattccacaaagcacaaatgttctgaaggctgagcctgactgtaaacactgtggcgccaagaggttccagtacgaaccgccaggcttctgttgtcgggatggaaagatcaagcttgtagaaaatgaaacaccccctgaactgatgaggctctggacaagctcggatccagacgccaagcatttccgggataacattagatattttaacggccacttctcattcactacccttggtgtaagccttgacaaggcctttgcaaacatgagctcgggcgtgtacacatttcgggcccatggttagatctatcataacatacattcttttggtcctagagagtctggtccagagcatcttgagctgtatttttatgatgacgatccaaccttgagtcacaggtttcgtcgttctccgagccttgaccaggatgtgatcaggactgtttcagacgtccttcggaacaacccgtactcagagacatttagaagtctagggcaggctgatgacctcgcgaactaccgcgtgacactaaatttggatcataggttggaccaaaggcgttacaatgtgccggtgacaactgaggtcgccgctgtctgggttgaaggaaacgagagaaggaaatttgagcctagcgtgacaatatacggtaacgactgtacccgtaaatgcatccagcctttctacggatgttacgatccactctcgtatcctttgttcttccctagaggagagagtggttggcatcaaggtcttccaaaggacaaaataaccatgaaggctgcaaacgagcgtcatggcgatgatcctggtaagtttatctttgtactatgttactaagacaattgataatgccccattacgtgactgcactaacccaaatgtttctcacgtgcagattgtaacagcaggatacgggtctctgtaagggactactactgctacaaattccagatgcgccgtgggattttcaatcctatacttcacggcggacgcctattccagcagttcgctgttgacatgtacatcaaggttgagagctcccgtctggactatgtgaggaacaaccagaaggagataagggccgacctgtatcaaggtttaatggacagcatccaggctggggagagtcgagcaagcgcggtcggcaaacggactgtgttgccagcgtcgttcgtaggtggtggccgaaatatgaagcgccgatacatggatgccatggccttagtacagaagtatgggaagccagatgtattccttacaatgaccagcaacccaaagtgggatgagattactcgagagcttgagcctggccagacaccacaagatcgtcctgatcttgtggtccgtgtctttcgagccaagttagaggacctaaagaagcagttgtttgagaaacatattcttggcaaggtcattgcacatgtttatgttgttgagttccagaagaggggtctgccgcacgcacacttcttgttgatcatgagtggtagatacaagctaacatctgcggaccaatatgactgcatcgtctcggctgagcttcccgacaagaagaagtatagagagctctatgatatggttgttaagcatatgatgcatggcccttgcggtccactcaacggtaaatgccaatgcatgcgagatggaaagtgtaggaacaactacccacgacagttcaaccctacaacctcacaaggcaaggattcatacccattgtataggagacgtaatgacggtaagagtagagtggttagaggccatcctctcgataataggtgggttgtctcgtacaatccatatcttctacggatgtacaactgtcacatgaatgtcgaggtctgttcgagtatcaaggcagtgaagtacctatttaaatacctatacaagggacacgacagggcctcgatatcaataaacgaggcagatagcaacggcgaaatcgatgagattcagcgctacagggatgcgaggtgggtgacccctccagaagccttgtggcgtatatatgggtttgacatatgccacatctcgccgtctgtgaggcaattgcaactgcatctgccaaacatgcacatgttggctttcgatgcagacaaggatcttcgtgatgttcttgataaggaagacgcaggcaggtcgatgcttacagcgtatttcgaggctaaccggcagcatgtctgggctcgagatatcctttatagggatttcccaatgtggtttacttggcagacagcaggtaagtactggaaaaaaaagagagagaggtgtataggtcgggaggattgtgtgtgcccacctggcagagggggagcgttactatcttcgggtgctgctaaaccatgtggcgggctccacctcattcgaagacctacgcactgttgatggcgtggtcatgccttcgttccgtgctgcagctgaaagaaggggtcttatagaggcagacaacaccctcgacgagtgccttatggaggctgcggtcttccagatgccagcgtcgctatgcaggttattcgctaccatattggtgtattgcgaacctagcgatgtccgtggtctttgggacaaacatctagatgccatgtctgatgactacaggcgtaacaacacatgccctcatgttgtccaacagatggtgctgatagatatctgaggcatgctacaatcaatgggaaaggaaatcacatcgtttccgctccctgaaattgacgaatcacatgatagtaccagaggagatcccagagagattattgaggagtcatccattggtgtggagacggacgatatgaacctctcagaccagctgaatgatgagcaaaggtccgcattcaacaaaatcatgaatgcagttggcagtgctcaggggggtgttttcttcgtagatggcccaggaggcacgggaaagactttcctgtatagggcgctgctagctacggttcgcggcaaaggagatatagcggtggcaaccgcgacgtcgggtgttgcagcttctataatgcctggaggccggaccgcacattcgcggttcaagatccccctcaacattgacgaagggtcttattgcagcttcaccaaacaaagtgggacggcgaagcttctccagatggcgtcacttataatatgggatgaggcctccatgacaaagaggcaggcggttgaggccctcgatatgagcatgagagatataatgggttgtccgcgttctccgtttggagggaagacgattgtgtttggaggggattttaggcaggtgctcccagtcatcaggaagggcactaggtctcagataacagatgccactctacgcaggtcctatctttgggattgtatggttcaattaaagcttgttcgcaatatgagggcgcagagcgacacgtggtttgcggactacctccttcgagttgggaatggaaccgaggaggtgaacaaggaaggactcataggccttccttcggatatttgcgtgtcgtgcaaagggaatgaaacggacctcgaaaggctcatcgataccgtgttccccaacctaaacgataacctgacggacccaaactacatcacatgtagggccatattgtccactcggaatgagttcgtcgatcgaataaacatgaagatgattgagcggtttagaggggatgtgatgacatatcatagttttgaccgagcagatgatgaccctcataactattacccgccggaattcttgaactctctaactccaaatggcctacctccgcatgtgcttaagctgaagataaactgccccatcatgcttttgaggaacattgacccagccaacgggctttgcaatgggacaaggctggtggttcgtcagtttggaaaaaatgctattgacgcggagattgttgtagggcagcatgctggaaagagagttttccttcctcggatacctctatgtccttctgatgatgagatgttcccgtttcgcttcaagaggaagcaatttccggttagattgagctttgcattgaccatcaataaggcacagggtcaaaccattccaaatgcaggcatctacttaccagagcctgtcttctctcatggtcaactatacgtcgcgctgtctagagcaacctctagaacaaacataaaaatactatcgatgccggtagaagacaagaaacaaaataaaaagtctaagcgtactggcgtgaaggacaatgagaagaaaggaaaggatttgtctaaacagtctgcaacatacacaaaaaatattgtgtttagagaggtcctcacagattagaagaggtatattatgtgactaattaaccgtccacaatatgcttgcttaaattccattcttactgctgagtgcttcttcatatagtttagttcacgtatggctttgtatgcattaggtgttttctgaagacggtgaaataaatcacctataagatctgatctttggatgataatatcttatgttgagtattattaaactgaaattctgcgattgctttgcacctttgttccctacaatatgtgattcacttgaatgccattgattcctagcagtatttgtgcaactggctacatcgaaaattatattttgtaagatgtttacatctgaaacccctgtacataaaacttgctattggaatcactgttgcaaatatattgtgtcactagcccgattaggataggataattgcacaaatgttttatttttccaagttataactgaagtatattaggttaatttgaaacaacagtgactaaatgaggtccacatttaataatagtggatcatgcaatttacttgaaatttatctgaagcattccatggcttgcttaaatatgcttgcttaaatatgtatgtactttcttagatagctgtacagataacggattgcatctttggcaatggggtgctgtgcctggattagcagcaaaacattattatgctcttgatctattattgtcaggttgacaaagcaatatggactatagacgcagtggaagcattgtaggcgtgtgcaagaaatggtgaagggatgcatctagcacaaatttccttcctgatgcacattcattgttaacagtaggtaat

SEQ ID NO: 65274 - DNA, 7942 bp, Oryza sativa
ggaccgtgtcgcgccacgggttccggtcgagcgcgctctgggtgtgcgtgggcaggaccatggtcgggctcatgggcgccttcgccgccggcagctgccgcagcttcaagacgtccatctacgtcatcgcgttggtgggcgccgtcctgctctacattgccatccaggccatggtgttcttcagcgagcccgtgaaggattggctccaccgcgccggagaaacgctgcagaagtgcttgaaattggatgaactggagcagcgaaatcagcagcagatcactctatccaaccaaggcaatggcgacgcctactttcttctcaagaaatctcgcatgtacttgctcctgcttgggattctcgcggcgagcgtcacataccaagcaggactgaacccaccgggaggcttctggcaaagcgatggcaccgacggttaccgccattacctcgccggcgatccggttcttcacatcacgtatcaccggcgatacatggtgttcttctactccaacgccaccgccttcatcgcgtcgctggtcatcctcatcctcctcttgagcaacatgattagcacgcaggggatcaagtactgtgcgctgcaggtcgccatgattctgaacttgtttggcctgatcggagcttacgccgctggcagctgcaggcaggcgtccaaatccgtgtacgtctcggttcttgttctgccggtgttcctatatgtaggtatccatgtcttggtgttcatgctcgaggtatctccgacatgggcgacatggcgaggacgggtgagggagaagctgaagcaacgtatgcctgaatggctcaagaatctgcttgagttggagaagcatgtcgaggaggaagaggaggagtggaagctggagaagaggcgaaagctcctgctcctcgtcgcgattcttgcagcaagcctcacctacgaagcaggcatgaacccaccgggcgggttctggcaggagggcaagtccggccatgtcggcgacccggtgctcaacaacgacaactaccggcaccgctacctggcgttcttcttttgcaacacgacggcgttcgtcgcgtccttggccatcatcatgctgctggggaaccggaagctctcggcgagaggaatccggtcgtacgcgctgcgggtgtgcgtgattcttgtcctcgtcgggctcatgggcgccttcgccgccgccagctgcaggaaggtgaaaacgtccgtctacgtcttcgtcttggtcctcgccgttctgctctgcatcgcgttccaggtcgcactggtcgtgtcggggtcgctgcgacgtctcgtcaacagcctcctctccaagctaggggcgccgcttgaggaggacgccggtgagcggctgccgcacacggccgccgacgagcctcgcgatctctgggacgagaagctccccaaatacttgctgctcctcgctgcgctcgcggcggccgtcacctaccaagccgcgatgagcccgcccggtggcctctgggatgacggccaaaccgagcacatcgttggtgaccctgtcctcctgaccaactatgcacgtcgctacaaggccttcttctactgcaacgcgacgtcgttcatggcgtcgctggtgataatggtgttgctgctgatcaagagggtgagcaacacccagccggcgctcctggcgctgcacgccgccatgatactggacctgttcggcctcatgggcgcgtacgccgccgagagctgcaggagggtgacgacgtcggcttacatcttggcactgctcgtcggggtttcggcgtacatcgttgttcttgtggtggtgtccattggtgtggcgagatggatgaagaaggtgatggacaaggtgggggagaagctcacacactgcttctccttcgaagatttgtagagcctaagcctgactccatggcccctgatatggggcatcttccattcttcccagatggatggtgatcctctctgtacagtcacaactctgcctgcagagagaggggtttttcctaggatttgtaggaatttctagtttagttgttttcttttctgtacattgttgtttgtttttgaattgttgacagcttccagttgcaatgtatggaaccttttgtactcattgtactagcataacttgtaatgatttgttttttagtaacatcttgtaacttaactaaaaaaatcataattatcttgaggagaattttggaagtcattttattaaaaggaaaaacaataccgactactggacggtaaaattgatttaagtatttctcgcataccaactattttgctacaagaggaaataagtaaaacaaaaatgaaagaactgttacatggtcaacaatttctgtcctacatccttttcaagtcaattgacatgagtacaattacactacttctaattagtaattacacatgaaaagatttgggaaatgtacaaaatctatacacccatcaggggcagaaaccgtcagactaattacgtattgccatctacaacataatgaatgaatgatcttacctacaaaatagtcctggaaatggccaaaaaaacatccatcagctggtcgttatgctttcttcagttaagaattaagagtgttcccttttgttaatgaagtatttactgtaggtcttcactaaaagccctgtaaatgaaatccctgaaccttttgcagtattgctttggatcaacagccgatatggagttgggatcatattgcatggatttgtaggcatgctcaagcttcttgctgatatcatagtcttgtaggatgtcaatgattccaaagaacaggataacgtcctggaattcccctgtaggttcgccaatgagctgggattcactttcaggattcttcacaacattctccacccttgagggcatgctgatccctagcttgactggtgcttttctgcaaaattataagtagtgtgttacttctttggaatcaatatttctctgtactaactgtcaaagtgcatataatatagaggaggccgctaatgcagtagaacagagaaactgctttgtgaaagcttctttagtggtgtcctgaaagatagaagcttcttcagatgaaagcagtggcactttttttcaattaaaaatttattgaagaatagtatctaatatattagatgaaaaagttcaccatgttctaaaatcgtcaggaaagcaatttgtttacctttttgaaatacgtatgactgtatttaactgaaaatagcctattataaccatgttttagacacaaatgcgtcctgaaaacacactaccttctttcctcatcttcaagagcagtttgagttgtctcgttgtcaggactgctgctgtctgtaaccatgaaaaaagtattttcaggcccatgaattaaaatgcatctcctcaaaaaagattgtaactgtaagtattcaaaacaatcactatagtgtgaacatatctttgcatcggtctttgaagtgaacgccaaccagaagactgtaatccataattctctcttgctccagaaactcacaatccttgtccaattgcctggtatgaaaaaaaaatgcttgcatatatttaagaatgtctgctggcacagattggctttggaacctcaaatacacttatacttttttggagaaataattttctagtacaagtagtaaatagagaaaggggaacattctacatatgcaatttggggagagcaaaagtacctgcagaaatcttcataccatgatccctctaaccggaaaatgaaattgagatcaaggtccttcaaagtggtagtctcatcgatttgatcaatgggtttgtccgttgtgcgaccatgtgatgatcctttcaaatcaaagcgtctgtggattgaatagttggagcagaaaagattccccattataacaaaccgaacctgtagttatcaatgataccaaaatatgagcaattgccaggcatcattttttcttattacagtttgatcaattgatcatagcatatgctaacctttttctgaatagctcctgtaattttaacacaatgcaggccgaaaaattttgttactagagtattatcaaaagaacgaacgtgtttataataggctggaagcatcctcagaagtacctgatcataagaaaaaagatacaaatgcaacaggaaatgttgaatctcttctaaattagctaaacaaggaagaatggagcttactttaacttctgctttcttcattgttttgatcatgtacttgtcatcattggtgaaataaaagaaacttccacttttaccgggagatgaaagctccagcagtgcatcatccccgcaaatggagagcatgtagtctcctgggtcaacatcaaagagcttgcgcaaagtcctgtggtaaattatacacgaacaaatcaacaccggttttgaagcttccaacaacagttaagagaatgaagtttactatctgtagaacaaaataaagaaggaacatttaatgatattgcatcctggatgcagagactgggatgtaatttgccttccttatctcaaaaacgaccacatattttaccacagtagcttaatatactgacctgaaaaccaatggacagtagtccttccaccggaaatcacatgactggtgaggaggagtatgctttgatccttcaggaggaaatcttgtccacaccttctctttcggatcaaatgctgatgatttaagatccaatgaagcaggagctgactgccttcctacagcatgtctgtatccccaaataacatgatcaacaaatgtcaaatgcatcgaatttacaagaccaattcatcagcattcagaaaacaacaataaatcaaatggcaatacgtgtaataacattagtagacaacatgaagcaaatcatcccacctgatacccagctgcaagttgagcatcagttcgtagttcttgtgccccttggagatggtctccccctgcttcttccccggcttcggcagcgtcggcgcgcgcatacacgagggtgtccgcacccatgacctgtcgttgcgactctcctcgccgccgtcctccccctcaaccaggctgtcaatatcggacgacatgctgttcctcccttggtcagctccgacctccggcggccgccacatcccttggtcggcggcgacctccggcggccgccacaccggcttcttcgtcacgggctccacccctggccatgtcagcaccttctgcgacggcagcagcgacaccgtcttcccctcggacatctccagctcctcgagcagcttcgtgatcacctccttgggttcccggggcaacggcaccgccgggccaccggacggcgggtagtacacgcccttgccctgcgtctcgccggactcctggcaccacaggccgatgtacatcccgccgtcggaccaccggaacgtgccctgccccttgggcttggcgtcctcccacgcgccgtcgtaccggtcgccgtccgcccatatcaccgtcccgcggccgtgcatctcgccggccttccacgtcccgatgtactcgtggccgccgcgccagatgtaccggccgtgcccgtcctgcagcccgtcgcgccagtggccgtcgtacacgtcgccgttgacgtacgcctgcgtgccgcggccgtgccggaggttgttcgcccacagcccggcgaacgtgtccccgagctcgccgatgtaggtcccctggccgtgcatgtacccgccggcgaggtcgccctcgtagatggcgccggacgaccacgagaacttgccgcggccagccgcgcggccgccgcgccacgacccctcgtacatgctgccgtccgtccagagatacttgccggcgccatgggggaggtcgccgcgcaggtcgccctggtagaagtctccgctgggcagcagctggtcggagtggctgggctcgccgagcgacgcctcgtcgacgtcgtcgtcgtcggtgtcaacgtcgtcgaggacggagtcgatgtcgtcgtcgccgtcttcgtactggtagatggtgttggaggtggaggagatgacggagaggcttggcgtgagcgtgacggggtcacctccggtggccgccgccgccgccgcaccatcgaaggtgccgccggaggggacgacggagccgcggaggatggtggagtacttgagcttgcggatgctcgcctcccacagccggctggccgggggagggagcgggttcatcttcttcccggtcgccgtcgtggcgtcctcctccgagcgtagctcaacgtgacagggtggtcagagcgagggtgtgcatggctggcgatggatgggtggcgcggtggagggagcaggggcgggcaagaaaatgtgtttggattggttggaggctgggaggagttgtcggggtggatggcgctgcgccgcgcacgccgaggagagctcggggggcgaagcatttggaaggaggcagaggcagcggtgaggcagaaagacatgagtgctctaaaaataggcaagagagacaaatagcagtagtagcatcaccatttctgcttcggtattggggacttttgaaatgtttttccatggcaaaaggcatcatttgtcttcccaagattcagcacgttgacttcagttttggggctagcgttgttcaaatgctcaggtcaaacagtagatactcctttccaatagtactactccaacatgtgcatactagcctacgatgaaatcgcagaccaaaactgatgatcgaactgctatcaggacaggatagtgggagctaaggaactgaacctgataataactaaattatctgtctcaacaacaatctaaaacagcaaccacgatattcatgtacagtgaattacgtagtatcaccaataatccagtatgcaaatctaatagatattacaaactaacagccagaacaaaggtaacaaaacgacttgggtcacctcgcaagaaattttaggttgtgtctagttttcactaggtcagagctcatatagtggcagaaaagcattacatcaagcaagagaacattacaaaagagtactgtttggaaatctaacccagtaaaatcatagatacagctccaaaacaatctgacatcagtaaactgcattcaacccacattctgcttagaaatccatcttcaaccggctcatatttctgtccaagaaatatcatctccaacttgcatgcaaaagcaaaactcaagaacatttcccaatacctgttgctgctcaagcaactcttcaagcatctcctgccctctccttctcttgatcacttccaaaggtcaaggtcacataagttgcaaaataaaaaggagcacaatcagtaagcaacaagaccaaatgttttttgaacccgaacaaaaccaaatgtcatgccactaatacagtattataaatgtcctgcacttcaaacaaaaatctgcactccacggcattttgttcataatcaaacgaatgaaagaattgagataatcagggaggtaatatcaacctaaagcatttgtttcttgtaattgaaaaccatgtttcacaaaagtcataactcatgagtattcttgtgagcatctgcctacaaaattgaatactacttgatcagtaactcacatgtattgcatcaaggtaagaatatgccaagtttgacatgttttatagtggaattgctagctacagcagatgatttactgtataactagcacatgtacagatatacaggtcaatcttactgaaactgaaagtaaccccacaggggcactaccaattgtcatgccctttagcccttacaatatttatcataaatcctctaaaagaagatgatcaatacagtgctctagtctaggccactacatttgtaaagttctgtacatgtgcatctgaaaaacatacatagcaacattccgaacttatacgaattcaagaaataatctgaactagtctgaccaaatatttctgaacatttcagaaataatctgtacaaat

SEQ ID NO: 65275 - DNA, 17408 bp, Oryza sativa
caaatttttgtaaagtcttatgttccaaacaagccctgaagctaacagatggcaagtatgtgatgtgaactttgtgcggtgaaagcaacctggagcctttcatctgcatatgtagctgttgattttatagatcgaacccatttatgccttttgaatgcatgatcaattttttggtcaaataagggcatctatatagttaatgtggactgatggcatatattatatattaataatatttatttagtcagtgtttgacttgacatacactctgaaactgcatgtataatagaacctgtagctgcttccgtgatcacgtcaccgctgcccacatcgccgatctactccgcggatgccgtttcatctatacgaaatttgacttatgaagcatagcatactgtggtattgcctatgattttacttgtaaggaataaaatatgcaccgacaatagtgtatttaggcgccattgttttgcagttgctgctgctttccagcagaactagcctgatgcttataagcatcagcaattccattgttttgcttatggctgattactggatcttctattaactgatgcattgcctctgcttgcctacctctgtgtgtgttgtgtgcttgtcagcactgactccagatgcgtgcagtcagcatgaagctattgtgtacatactagatactggtgttggattgagagggttgcattttgaagttaatttggttggcatgaatctattgtgcagatactgtatactgttttttttttataaaaaaaaagttggatactggagttccagtgactaattgaaaatcatagctctcttggattgagccttccaagctttgacaagttagatttgagcgtgtttgcatatttcgtacgagtacaggaaactatgcattacatttccatgatactataatatggagtaatctggaattagatggttcacgaagaatgtggtgatattttatattaatctttaatctttctcgtggattagcaactgaaaaaaaaactttttatatgcgtgtctttaccgattaaaaagggcatactgtaaaatgaactacgacaaaatacaacaaattcaactccaatgccacaaccagccaacagccagcgattgtgactcaatgttgaattaattgataaaggaaacaaactatgggccttatgggcctaatcgacccatatgacctgactgttagagtccaatgccactgccacaaccaaccaacagccaacgatttgtttgggtgtttgtgggtattttgacgtgccagaaccagccaacagccagccggcgatttttttggtatttgattcgattttgacgccacggcaagataacgctaatcgtgattagttaacaatcatcacataaatggcgccagcagctcttgttgccagccgccaccatttccagcagctctggttgccagccgccaccatttccacccattcttccggacgtctcttccgaacggctaattaccacgcaatatggagaatgccgtagtcgtgcaaccatggaggtcactctttcttcattctattatttcttctgttgatggattgtgcaatgctatcatatcgtgtatattatcttccccatgcagaattgttcggttccacgatatacaaatggatcacatacactggaaatggtggattgtccgtgcgagggtcatcaagaaaggacatctgcaagagaattattacggcgatctacaaattcgactaatactaattgatgaattggtaagtcaaaatgatttttcaatcttctttttcagaattttagatctaatatgtagtttatttccactgtgactcactgtatgtagcaagcctctcagtgcacctcagccaatcaaatcacgccgaagctaaaatctttatatttattgattgattgattttaacgacaataatttttttagtgtcttatagtcttacatctcataacatgtgtagggcactaagatggaggcaattgtttaccgtcgtcaagctgagcatttcaaccagcttttaagatgtggatctgtttatgatttctataacgtcgggtttgatccgacagaaatgatcgtgcatctaagatttaagataagatctcagttctgcatgattctcaataatgtaacaactacccgcacgcctcatggtcctgtccacatgctacgttgtccatggcgttttccagaatatgatgatattttttggcaaggcacaattctttagtagatatattgtttgattcggtactgacaaaaataccaatctttgtttagttgctagcaaatgaaaaactaatgtgtctatgagttgtgcagatgtcattggattagttgtgcatgtcggggacattgagttcaggagtttgtatttgcgtcagacgccgacaaggataatcgcgctggttaatcctaggtacgacatgctccatttttttacatgtattaattaattgagatcacacaacactcatgttgcatataatttttgtaaatcaggttgcagataattttcgttcgtgtatgggaccaacaacttacccgcaacttgactaggtggcgctcagcacggacacatttcgattgttttgtggctacgctgacgagggtggacagaagagcaggtaaggaagcccccctctatttctctaacatatttgccaccgtgataaatcacatattttaaactaactgacattttccttttgtagatgaactatcaactacttatgagtctgacataatttttaatcctgattcagcatcagcaaatgaattcaatgttttgcgccaggcattagcagtatcaccttctaatgttcaagagcaggttgaagagtctatcggtagaagaaaccttcataattatcaacgccaaaactagaagatttaaatgaaggcaactatagttgcatttatttcgcatacatataatgatttttcgcttccaagtttttatagtgtcatcagctttgttgcttactcagaataagcatcacaattttataatctcaatatgatacaaaagttgtatgccactcatataaaatgatgtccatgaatctctatgaaaagcattttttacgtgcgatcaagatgatttttccgagcggaggatttgaccgtatgtacctgagtgtctggaaaactatatattttcacgtgcgggcggcccaaccacattgtataatcgattaacccgtgcggccaaatcataccgtccgcatggaaacaaattaaaacgcaaaaatcactgcctgcccgccggccagcacgcatccggccaccgcaactcgtcgtcgccgtcgtcgcaccgcatcacgcatccggccgacgccgccatgaccagccgcggccgccgcacacacccgaccgccgccacactgcataatcgattaccccgtgcggccaaatcatacagcacgctcagaaaaaaaaattaaaacacgaaaatcgctgcccgccttccgccccgtacgcaaccggcgaccgcaactcgtcgtcgtcgtcgtcgcacagcagcacgcctccggccgccgccgccgtgaccagccgcggcagccacacgcacccggccgccgccacaactcgtcgccgtcgtcgcgccgccgcacgcactcggccgtcgtcacgtcatccgaaaaattgttttatatctaaatcgttcgctcgttgcttgcttctggtacttcaaaagctaagtgctttgatttttttgcatgctactatgcactcgtcctattaataactgagaaaggatgtatacaagctatgggcctgatcggcccatatcacggtgcaatgaaacatgacgagctgcttccgttttgtcgccgcgagattgccgccgcgcgtgtagcaccgaccttccgtttatcccgtcggttcccacccaggcatcccatccactgcattccaatcgccgccgcatccaagcgcctttcatcggcggtcggctgccgcgaccgcgacgacgctgccgccgcaagtgcaacacttcaaatcgatcttcaactgcaactgaattttgaagaggtgcctttctactgcactatatgtgaaataagaggtgagagcaacaccaccacgttcttgtggtatactctcgtttgttgcaaattgaatttccatgttatctgtttgtctaatattacaattttttttggcaacttcaatgattcacttccaatagagtgtcaattacaacaacatgatgtcggcaaattatcgcacacacatctccaaccgggttcatgcccccgcgtcagaacagtcgcctgatgcatctcaacctgtaacaatcaaaaaaccatttaacaggaaaggatatttcacatgtttgttattcttcttttatttgtcattttgtgcaaaaatttttatatcaaattttcgtaagttgagggtacgtacctccttttgtatgtttaccgttactttatgcatggctgcaggtcagtagagttcgatgagattaagatggaacacgtcttccgaacatgctggaaggtgagtgcgaaggtggtgttcaaatctcccatgcagcaaaacaaatttggtgctcaatatattcggtttatcctaaaggacacaacggtatgtcacaccaatcacctctctcctcctaattgctagatataatggagcgttgtgcacaaaagttatggaaattatgcctttattctatatgtacaatttaaacgtaggatacaaggatggaagcactagcgtatgaccagcaagcagatcgttttaatggaaccatacagagtggcttagtctataattttactaatgtggggttccaaccgaccgatgtgcctacctatgccaacctaaccatgcaagctaagttttgtatgattctgacaccaaagacagccctacgcaagcctcgttttgtagacttcagtgctatttttaccgacgcgataagtgatgatatgttcataggtaaagcaacaaccttcaataactattttcatccctttttttgaactctatagttatgttcattacataaatattcgttcagatgttgttggtgtgcttatatacgtgggagaaatacatcatcaccaactttatggacaaagcttacctactagggatattgccttggttaatcgtcggtgagttcattttcagtttttcctttacataacatgttctcatattgtgagtggtccctaatccacttttagtactacagatataaggtaatctttcttcgaatttggggtgaatatgcatctcgacatacagtgtggtggcaagcacttgcatcatagtattactgcatgtctgctacatgtctcaagaaattagatattctaaccggtaagtaacaaatcatcctaataggaattactatttgaccattttgtttgcgaggtaatagaactgaacactgtcagactgacttgcttatcgtgcagagacattaactactacggtggactccgaattgaccaactctacagattcactcagtgcacctgagttgggcgtgattcgtcgtttattcgttagttctcgtgaggatgctcaacggttcactcaagcagtcgtttccttgagagcgaaatttattactattgcttcccttttagaccgattggatcctcaaggaatcatcagacgagatgtgcctttgatacaacaagaggatactatcgcccgttttaaaaaagcttaagagattgcttttagattcatgattttcgttatatgtttaacatttgtagggatgctctggtctattaacgttgttttttgggtcgtagaaacataaattaaaatgtcctattatttcgattatgatgatttgttatgtccggatttggtccggtatgttcgaaccagataaaaaaacacatggttttccgatgatgcatatgttcccccttgcaatgcacgtgttattttcatacacaaattaaaccagaactataatattatgaaaaaatattttacgtcctaattaattgcatccggtttgttcagaccgtttcgaccaaaaaatttaatcgtgatacattccctttattttttttaacgagatatacttacgtgcacggtccaacaattttgttctctcaatttttttccttctaattttaatcgtacccatgatatcggatttattcagtttcccgaagattgatggacaaaataatcgaaggaaggaagaagcgtgaaactgcctcgactcctgcgtacccaggacacgtgataaggcccatcaactcatccagattaaggcctatataatattagtcagtcaagaatcactttcgacttgattaggcccatcaactcataaagattaagccctatataagataagctggtgccctgtttccttgctaagtgttgccgtgatattcagtttgatctgctcgtcgtatcgccgccgcacaactcgccgaataccaaggctggtaaacaagcgccgccgccgtcgcaaaatccaccgaaaccagactacgcgaccaccacacgatggatgcatcgccgtcaaatccgccctcgtcgactccgccacatccgcagactcctccgccactactgttgttgacgacgccgccgccgccgccagtcccgtcgtcgccggctccgccgccgtcgccgccgctgccgccgtcgccgccgccgccattgccgtcgccggctcctcctccgccgcccttgccgtcatcttcggcgccaagcaatgtcagcacagatattgatcctgtaagttaagcacccagcttaattagtccatgaagactatcgatacatatatatatatatatatatatatatatatatatatatatatatatatatatatatatatatatatatatatatgtgtgtgtgtgtgttctattgcgatttgggttacttatagcaggcagtacattagctagctaatgttaatgcatggtactgtagattaatgctatacactgtacgttacttgattattaattaaagcacctagctcgccatccactattatattaaaaaattattacttacaaatatgtcaattgcattaatatatactcctacactagcttgtgcgtagtgctcagggttgcttctttacttatatgaggaactcatctctcgcactcgcaaaaccgagggactcattaacgtatgattaattaaatagttttcaattagaacaaatagatttttatggttttataaaataactctaacaacataactcaacataaaatcaacctggccctcagcttattttacaaataatatataatactctgagtggtatggttcaccaagaaaaaaagattaatagctatgatcgagcaaaataaagcattgcaccaacttatgcaacaataatattgacatccctgccgacgtgttttttgtttagtgttatatataatttccatatgcaatatagatatccttgcttaatctcatgtggtactcaggtcaatcaagacgccattcatgctgatatgattacaaccccaccctcgaagaaagcaaaaaattcggaatccgaggagcatggagtatccaaagtcagcatgccaaatattgatgtaccatcaaatttgatacgatctatgtttggccagacctacaagtatctccctcaaggtacattattgttttcacatactcccttcattccacaatgtacggcaaaattactttttcaagttgtttcataatataaggcatatatgcatgcatgtcattaactaacacctcttctccactaaaatattattattttaactctccactaagacctctaattttattgggtgcatgcataattatctcttggtctttggtttaagagtggttgtgctttatatataaaactttgtgatatcagaattcatttttttttgttttacagattatgaattaacaaatgaggatgtaatggccatatttttaattgaagattcggctgaaaattgtacactggtggacatgggtcatttttataacaagaaacgtcacttaacgtgccttctctctggagataaatttttgaacgatgatgtaagtaaaactgcctatgatgaagcaacgttacaatttaattgccaacatattctttagtaattgcagatttttaattgaatcaacaggtcatcagtgcgtacatacactgtttgagtgagcaagcaaataacgataagaaagtgaaatatgaaaacccgtttctttctgacatgctgaaagcggctggggtcaatggagtaaatgaagatgaagataactttattacaaagatagtgaagaattacctacaccatgaactggtattgtttggctctctatatttgatagtatttaagtttattatttatttatatatatagatataatataatataatatatgtcctaactccatatgtcttgtttagatttttattccaataaatatgaaagataatcattggtatttagcggttgtcaacatagaaaaaaaacagatacaagtacttgattccatgtgtatgacattcaatcgtgctgacctcgcaaatacggttagtgtatatgacatgtgaactctcttttttttttaagattgtaattcatttatgtatattgctgactgtaaatatgataattgagcagctacaaagactacaatatcatcttaatattattggacggcaacaggacttgcctagccacaaatggggtgacctcaatgttatcaagtggccaataatagaacaactaaaagaaagaattcaggaagacaggtatactacaaataaatttttcatgtaatataatattaatataagatgaatgatatatttcaaatggtgtacggttgtttagtttttaatagttgtacttatactttaaaacaatgcagttcttcatgtggactattcatgctcaaacttatggagaattggacaggagaatcactttctcgttctattacacaggtgtgtttcttaataaaaaaatagttgatcaaatatcttatctatttaaaattaaataaatttactttttaatgcgcaggaggatattacactttttaggtccaaactagccagtgtattattacgttggaaaacaaataaggcggtcatgacgaccggggaacaaatcgaagataccaaagatagtgatgacgatgttgttatattaggtagtcatcaacggaaattcggctctacaagggacatcaataaaactaaagaagtaaacaaaaaatatagttcactactctctgtagtatctaagatgagtaaacaagagttgataagcggccttctgcactacatccaacagattaattgtgctgaagccatggagtaagccactgcaatgcattgtatacacaatcgtaattcatatatgcattaacttattttctttgattgacaggaaaatatgggtacaaagttcaaggccgcactatattagcttgagtctcaaacagcttcaaacaatactaaagaaggatgagccattggaaagtgattgcttcaacatggctattcgtaagttcatgtatgaaaaaatcgagatgattcataaaactaaacaagcaatatcgaatcattgcttggacttgcaattttgggtaagtttttaaattctaatgctcatgtcattctctattgctcatgttattacctataatcgcaatatcgaatatattgatttatctattgcttatgtaattgaaccattttttaaatcatgtagagtgctactggctttggtaaagtcccggtccaccatgacaacataaatcttgcagagaccgtcggtagttggtcggaaattcattacaaactttcacagtgcaaagcggtaagatcgctaagataccatcctatatggccgtgttttatatattatcttgacggatgatcttttgtagattcttataccagtacgccatgctcgaagttttatcgtgcttgtagtggaccaagaaagtcaaacgctctatgtgttagacccaaatccacttatgccagaatataaaaataacccaaatatgagatacaccagaaaactgataactatttgtgatcacttcaacaaagctatgagaaaggcatgccctggctctaggtggaatgaagacatcaacttgtggaggcaagtaattgtcaataatccggtttacagcaggtaagttatcttcttaaaaactcgttcaaaccaacaaatttaactgtgtagagaaagggaagctaactcttcaatttccttaggagtttatcgggttttcttgttcatctcttcatgtgtacatggaataataaagaaccacatttgccggcaattaatgtaagtcttgacaggcattaattattcatatattacattattatatatttaccaaaatttaacttattaaatacatgtgcaggatggtgacgagctaaggaaactttttttgctaaatctactgatgtaccaacaaaatgagtgtgaaagcaacatccctaacggcgtacaagattttctaaagtgtataaagaattcacaacactagggtagttatttaactatatggaacaacattagggtttaactataatatggagtgatttaatttgaggtaatcatccattagaaatgccgtatctacaaatgctggatgttctatattttttgtttgtgctttatttgtatgatatcatcaaattttcatagatgtcttctatctatgttactttttataatttatgtagtaaacgccatgagattgtttcattacgatgccatatttgtcttttcaatgccagatcttatccccgtgatcaacaaaattccccgtagcaacgcacgggcaccctactagtatgaaaaaaaggaaaaaaggcctacctattcaaaaggagcccaactaaaaacgatttctatccctcccaccatctatctccccactatttcaggcccattggccaataaaaaaaagcccaaacatctaaccctatctctccacctcaccaccatccaactgcccggaggacatgacgcgccggcgcgccgccactcgctagtctgcgctccgctgccggcccgcccgaggagacgacgcgccggctgcctccgccctccagcctccagcagtctacccttcggccgcggcgcaggcgcgcacggcgccgtcggcgccttggcggctcgggcgctcggcgcatccggcatccccccgcggcgcccgcctccatgctccagccgccgccgcccgccggtgcggcgccgcggtgacgagttgccgcctggcgcctgcctgcctgcctacgctccaccgaggcaccgaccacggcagcctgctagcccgcagtcgcaggggcgcagggccccgcgccgcgtcgccgccaccggccaccgacctgccgctgccgtcgacgacgaggtgacgaagtcgatacctcactgagacaatgactcactaactcttccctagttggctagttcccttcatcacttcatggctaattggtacgaagtaggaactttggattaggaatttatgatttaattcatacttgaatgactgaatgtctgaatctagcatggattgttcatggttgaacattttttatttaaaatttgaatataggaatgatttatggttaatatagtatatagtatcaactactatattagtgatgtaaggatgagaatttcacaaatttgatatgttttgtctattaatagtttagtattatactctaatatgcttaacacattcaatttatgatcaattctatccctgcatctatgactttatgaaatcatgttcataccgttatatattatacaaactttgggttgaaaatttttttcttcctcttctaatttcgaatacccaagttgaaaatcctgggcccgccccttctgccgatgacgaacaccccgccgtgcagcggcgagcgcaggatggagaggcacacggcgccatcgctcctcttgtacgagtagtgctccggcgccagcttcatggcggcgtccttgccggcgaacaccagcgtgatcgccgggagctcggtgtccttcgtgtagcacagtacggatgagcccttgtctgctagcggcggcagctgcttcttgaggtggtcgaagagcaccgggttgaggaacgtgtaaagggtggaaacggtggtcatgatcgcggcggccttgtcgctgacgatctcgccgctggcgaccttgatgccggtgatggcgacgaagtagaggttggggtcaatgttcggcgccttgtcgacgccgacggggatgagcggggtgctggtgctcgcgctggcgccgcaaccgcgtcgtcgtcgccgagccatgcgaagctcctgagatcgccgtcgatgaagtaggcgaacctccggaacgacgcggcgaggacgctgcgcctgccgaggccgacaacggcggcgtccttgcgggaggaggaggcggaggcagaggagcacatgtacaccacagtgtctattcccctgcttgatcagtctctcttctcaccgacactcgaagactattgacgattgagttttaagactttgatcaccatgcttaggcagcttagcttaaaacattaattgaatatatatatattggtcagggttttcttcgacatggttttaaagatggactagtgggtcacttaatatacgtggaaaattgatgaggacccaactagttcggatataaccatgactaccttatgtattgatcaaccaaagatgcatatgttctatattagatttacttgttatatatttgaactaacgttgttacacaatgagtttgacgtgttttcgtttgtagacgtactttgattgtgcgaaagaaaagagaagcgtaaagaatgcatggatgattaaagaagttgattggggaccaaaccaagaccttctccaagtccacttccatttcaccacgtcacttttgatccatagaagataagagatcaagttttacacattttggattcggattcgggcctctagacagcatcaacttcaaacggaccgagctgctaatctagaaggaatttcggggcctatgagtacttgttggaaagcttatggagtctactttcaaatggttttggacccacgtcaaaatttttatcgagctgtcgggaatctgcaaaataagtcacgtatctcatccagtccgaatttgatttgagttttgggtcttgtaattgtgtcgcggggttagcccaagagggtatgcaccctagggcaaccctagaacgtccctaatcatatttattcagtagccgtcatcgttgagagtcgggttttgcttagattaatctgtcaagaaccgtttcaccgccagatcggtttgtggaacaccaaatttgagtgcttaatcattcatatgcaatttggttgcaatctatcttgttcttgcttgtgttcttcgattcgcatgcagggattagccttctcggcgagggcaaccaggtttcggcactgttgataaccagaggagacgtggtgctgcgattgcggggttcagtagcgtgttcgttcagaagccggatcgaattgtgtcgcgactccgcccaaatcgactgtttatcaatacatatcggaagatcgggacctaacatccctcatcagttagtatcatagcgcggttgcccgttaggtaatttatctacccataacaagaaaattgccacacaaaaatattgcatccattacctagccaatttgagccgttgcattgttctattaatttttgcgtcgttgaattttagattgcatcgtcgtgtcgagtgctggtttagtttcagatttaatttttagttgtgagtattgcatttgttcatcactttgggttagtcatgtccgtcaatttgggtccagttttgcatctcatcggttgttgctgggaccttgaaaaatcgaatctactaatcatcaggtttccgtttttgtggtttggaggagttttctttgagcggtttctgtgttgccatgtcggttctgtgttcgtgctttttgtgcacacgttgaggagagaaacagattggcatatcggtttgttttctatagggggtttatctgatctgtgtcgtcaaacggaagaaaatctccacatattttccaatcttccacagtagtctgaatccaactcgtccttgtcacggccgacccccacctccacctcacgggtttcttccatgcctcctcctcgatcaccacattgttaggtattttggtggttgtagatttgagtttttttttaaaaaaaaaggaacctacatgcatgatgtgagcattccatttttgagctggtccaattttagttttgcactttgcatttgagtccctacaatatttatatttacatttgagtccctggttgaggtcattgattggttcctgctgaaaaaagtaaaaagaaaaaagaaaaggttgaaaggtgcaaagaaaaaaaaaagccgcacctaaaaaaattaaaaaaatgcagaaaggtgcttaaaaaaagccgcaccagaaagaaaaaaaatcaatcatcttttgagtatggtttgagagtgcagagttgtgcattgattcatatatagtccttaatgttgtcgggtgcttgcttgagctagagttgagtctaggttaggccagcacattgactagtactttgaactattattcaactttgaattttctgattaacacaattgcgttcttttgctactatatattgtgcctcccaagctccacatatatacttctggtcagcaccactttgatccttgcaatcgctacatcaagttcttcaaggtgtcacgaaccagccaccagttgtaccgtccttagcattgctggtaagacacttattcttagtaagctgctccatttggctgagttgttgagaggcaccgctacactgtgtagcagattattagggataaccttcactgtttgttgttgtttttgtgtttgcaatgacaggtatgagtggcactcaaaatcagcaacaccaacaaggtaacaataatcgtgtgcccgatgattcttattctaaggttaagtttaaaataccatcatttttggattattatgatgctgagaaatactttgattgggagatgacagtagagcaaaagtttagtgtctaccttgtgcctgagcaacatagaattcgacaaactactagtgagtttaaagattttgcttttatttggtggactgggttagctgtagggagagctttacctactaattgggaagaacttaagttagctatgcgcgatagattggtctcaccatcttatcatagagaattaagcaagaaactgatgtgtttagaacaaagggataaatctgtataggattactatggtcagctacaaaagggattgatgcgatgtagcatagtggagggaactgaggattttatttgtcgtttttacttgggattgaggcgcaaaattcaggacatagttgagtataaggattttaacattgtcaactagttgtttcaatttgctatgcttgtagagaagaaattgctagggcgtgatcaacaaagtcaagaacaaggcgagcacgtacatgccgcgggcgaagccatctttggggctgcccaagcccatctctttccggacacccccaccagcaagcaagcgaccagttgcgtccggagtttctgcagcgccaaaaccacctccccccacgacttttagattcaggtaaaggttcttcgcaagtacccaccaagagtgcctcgtccgtcgctttgacgggatgcacgcccagcattcagtgccaccgctgccatggatttggccatgtgcagaaggattgccctagtcaacgggcatacattgctatggaagatggctacatcagcatcttcgacgttgaagatgatgaggaggaagagaggaaaaatggagagaaagacctatccatagctatatgcatgcttgaggaatgtttaattgaccaagcgcctataatttctgaagatgagaaagaaggtaatgataatggtgctacaactactcaaggtatgcatagttatgatgtgccaactatatccactacttatgctacgttagagaaacccatggtggaaacaattgttgaaatacctttgtcacaaaacaatttgcttgatttttttgataaagaatagttatgcgatgcttcacttatatctatgccataactagtgaatgagcatgttagttctatagtagagccaccatgtgttgaatttaaacatgttattcatattctagcgagaatgaagagcttaaattgctatcttctttaaatacttggggatatattcaatttaatgatctttgtccactcaattgtttagagaagaaattatttgctagatttgaattgccatgtccttctgatgtgattttttatgttattggcaattatgatagtaaaggagaatataatatgtatcgagtatatatttgtttgaatttgactatacctcattttcatgatgaaatgtattgtctagaggaccgcatgcatataagtaattctttatctatttcctctagttgtttaaatgagttacatgttggtttgcaagaatgtgagagttgcggtttttttactacaaagattttaggatccaaccatatggacatcaagaaatgttctttaccggatgttgtgatagataaagataagttcaatacgctccatgacaaggtgaaaccgaggacagtttccaatcaagaaggggaggatgatgaggacacaactagctcggatataaccatgactaccttatgtattgatcaaccaaaggtgcatatgttctatattagatttacttgttatatatttgaacaaatgttgctacacaatgagtttggtgtgtttttgtttgtagaggtacttgcttgggcgaaagaaaagagaccgagcgtaaggaatgcatggatgattaaataagttgattggggactaaaccaagaccttctccaaatcctcttccatctcaccacgcggaaaggctaatgagcgatcgatcgctggcagcgatcgttttttttcttttttttcttttcctcttttagtaagtttatacatctaaagtttacacatctaaagttaatccacctaaactttgtaaagagaatgtttataagtcaaaagtttatatacccgattcaaatattttatattttcctcttttagtaagtttatacacctaaagtttacacatctaaagtttatctacctaaagtttgtagagcgaatgtttataagtcaaaagtttatatacccgattcaaattcgaattcggattcaaatattttatatataaaatatttctatacacaaagtttatgcgtgcaaagtttacggtacaaagtctatgcacatgaatgagag

SEQ ID NO: 65276 - DNA, 3218 bp, Oryza sativa
ccccgcacgcgctacctccaccaattccgccaccataatatccgtgattgccgccgcccaggccattttttcctctcttcatcctcgctctcgcccctcgccataaaaaacgaggtgatcgtcacagcggcaatcctccccgcaacgaggtggcacaggcatggcggcctcaacatctttgtgttgcttccttttctttatttggtgcactcactgcattcgactattaaactctcttgtttttatttttcactaattatttttagagattatgcataactttccgtttggctaatattgtgcattgttttaaatgatgtttcacatttcagttacaaatggttcatcaaacatctagtgtgatatgccaataattaatttttttaagtaatgtttccccctccatcactaatgttgcatgtatattacaaaactttcatcattcaattacatagcatggatcagatgttctgaaccatagtctcttctattaggtgttgtcatctcatattttataaaactgatttaccttaatcatgttttaaataaataaacccatgaataatgaaaactgagtttccacaaaccagggaaatcatttttttaatcaaaaactactccatgctgtttttactttttagccattgcttcgttcgtccaccccacctcatcgctagcaccatcaccttcttcaccaactatattcatccttctaagacaagagccagtggaccacagcagcattttcccctccatgccacgcattgcgctcccaagtcattcctcaacagctttggcagcatcaccatcaatgtctaacatctttgtcaacaatgaccttgattgtgtcaccatctccatccttagtgcaaccttacatgcatgggcttttgctaattggtgcgcgcgccagatccgtatctagcgcgagcgccctccacccgctgccacgggtctcttttttttagcgattttttctgtgcgtttttccttttttttggcgatttttttcttttcattttgctcttttttattattctttttaaaaatttcagcacaagtgcttttaaatattttgtgttataactttttaaatcatgacttgaaaatttttaaatcttaacttgaaagttttcaaatttagacttgaaagttttcaaatctcgagttgaaagtttttaaatctgggttgaaagtttttgaaatttgagatgaaagttttcaaatcttgagttggaagttttcaactctgagttgaaagttttcaaatctcgagttgaaagttttcaaatctgggttgaaagttttcaaaattgagatgaaaagttgaaagttttcaaaatttgacttaaaaaattcaaaatttcgagttgaaagttttcaaatcaggtttaaaattttgaaaatttgacttcagatatagttttcgctgcctgactgcgacatactccgtactactatagtttagataagacatgataatgtttttagggagtgttacgagatgcaacgagtaactgtatggagaaggagcaagcaagatgacagtgaagaggaagtaaaaccttgcttgccgaacccttttgcccttccaacccatcttctggagccgacgttggaggaggtgagctgcgtgtcgacggaggcctgctccagcacctccgtgtcgaggttctccgtcgggcggtggctcatcggcagccggaactcctcaaaatcatcatcctcctccaggccgtacactccatccccctcctcatcctcctccaccggagctccaggaaaattcttaatgctgttgccgcgatcgagttctccatcaactccctctcgacatacttgctaaaatcatacccgctccccttcttgctgaacccgcgtagctctgtggtctatcctgaacacccaaaaggcagaacaagctggatcacaggatcggtcagatggatctggagccgagccgacgaagcaactatccgagcggatcgaaacggcgaggtcttggttgtggatactcaccatgggaaagaggggaagagatgcgtgctagggttttcgtcggagacgcctcgccgccgagaaggagtgaggagaggggatcggaggcggttgtcgtacggttgggcctgaacagggttatattgtgtgcggaaaaagtacaccgaaggcccctcaacttgtcatcaaaatcgtcccctaatcttttctaaaatgacactggacccacatttcatagacacaaatgggcccatttgttatccactagaagtgtcaaaacagcgaagctccaatgtttgcctgaactcttactctcagaatgcctttatgcttaaaattgatctttctaaagcttttgatagattggaatgggattttattgactctgctcttcaaaggaaagatttttcatcatcatttaattaacctggttaaatcctacattagttcctcttctttttctgtaatcattaatggtcaatcttatggttctttcaatgctaacaggggtataagacaaggctgtcctctttctccttatcttttttttcttgctttaaatgaactttctgatcaactcaataaggttcttcataatcaacacatcaatggcattaaactaagtgattctggacctgttattcactctcttctttatgcaaatgacctcatcattacaggtacagctaatattgaagaagcttgtcagataaagaacatcattgaaaacttttgcaggaactcagtgcaaactccaaattatgataaatccagtataatgttcagtaagaaaaccccttcccacattcaagaggctataaggctcattttccctatcaatctcatggatgccaacactagacatttaggtcaccctctttttgtcaccaatagaaacaagtttgttatctataaattcatcattgataaattcaaagccaagctgaccaccttgaaggctaataatatgtctcatgcatgccgtctgaccttgattaactctgtctttgcttctttacctgtctactatatggctactattcttctcttaaaaaatattcttaataaaatcacagctattattagaaaactttggtgggcaggtgttagagaaggacatgacaaaaatcctttatgcttgagagcttggaaggacatttgcaggcccatttcaaagggaggtcttggtattagagatatacaagctgttaataaaagct

SEQ ID NO: 65277 - DNA, 1077 bp, Oryza sativa
  unsure (1)..(1077): unsure at all n locations
tctgtattttcaaaagagaacgaacttagaacttgactcaaatacagatctacatttccaaaagcaaacgaacttaaaaaccgactcatatatggatgacttaccaaagtaccggcaaaaaaacaacttcaattttttataatagtagagatataatatatatataataggtaaagaaatacaaatattacatattcaactggtgaatctgtcaacgggtgatacccgtagaccgaatatagaggatatcggggtatgttggtacaagggtctacgtaatcngacatccagcaaacaaaagacgaagattatactagttcaggccccttgataagtaatagccctaatccagttgatgtgggatatatgacggaaaacacaggttacaaagggaacgatggaactcgatggatccggcgagatcgtagtcgagttggttcgactagatccccggcgatttggctcctgcaggctccgacttcgtaggctgtgggggttgtgttggctctgagattcgatcccttaggtcctccccggggggtcccttttatatcgcaggtcaagcggttttcaagtaaaactcggagacatcagaccctacacgatacattgacgacccagtcttgtccgagtaggactcttttcgtccgtaaactccgtaaaggatttccttagtgtatgtagagagtatccgtatgcgcgtgggtatgccataccgatatgtgacgtatatcgaaaggtaaagggtatacctaacccgtaaccccgaatacaaatattacatattcaactggtgaatcaacgaaagaaaaacaatgaatacagtaaaagtggcttagtgaaaagatgcacaacacaaacgtacatgaaaaacgcatgagttgataaaattatcaaattcatcataaatcatgtataatatcttatcccatttatttataccaacataaagatgagaattcaacagaaaaaataataattaactatttagctgggcaggagcagaaccagccaagacaggaaggagcccaagaggcctacggcgatggacagatggctcaactggtaaaaaaaaat

SEQ ID NO: 65278 - DNA, 4448 bp, Oryza sativa
tcacccgcccactagcaacccccctcaccacgtcacttttgttccatagaagacaagagatcaagttttacacgttttggattcggattcgggcctcctgacagcatcaaatttaaatggacctagccgctgatcttgaaggaatttgggggcctatgagtacttgttggaaagcttatggagtctactttcagatggttttgttcccacttcagaagtcctaccgagctgccgggaatctgcaaaacaagccacgtatctcatccagtccgaatctgatttgggttttggaccttataattgtgtcgtgggcttagcccaaaggggtgtgcgccctagggcaaccctagggcgtccctaatcatatttactagataataccccgcacgttgctgcgggactcaatgattattgtaagtgcaatgcggaaaatacaaaaggtattttgcccacatataatgcaagtgcaattatctaatgtgttcacataatattgtagcattgctaaaaaaatatgattgaatatgcattgtttttggttgaaattgcttgttgtccaaatttcaaatgaaagaaaggaaaggctacataatgaaaaggtttattattgttattgccagtcagcaatattgtccaaattacatgcttcgctttaaataaacagatgctgaaataaaattaacaaattattctcgaaagtaacaaactcatcacatctcgtgccttgattacttatcgttgcagtggaacaacttaaagaattacagttcaatctagtttctgttagtgttaagaatgtgatagtgaagtaactctcttgcattagttgagtagaaaatcatgttcccagagtgaacctttcaaatgcaaaactttatgatcataccaaattttaaatcagtgatcttgcacaccaatatgtagttagcactttttcaggctgaatgaagttactatgttaacaaacaaccttacctgaatgtcttgatgcagaccaaatgaccaataggctgaaactcatcgaatagtttcactgcgcagcagaaattgtgtgatttcgtaggaacataataaatactccacgaactacgaaccaaagtgaacttacacgttgaactcctgtaattgcttaacccaaatacctgcaagtgaaacaaaaaaaaaaattcagacctatactgttgtttccaaataggtgatgtgtatggaagatgaatgattaaaactccatacaatgtgcactacctttgccgttacatcctgcttaagttccttggcgattaatacaccagctgttacaggatagcaggagcctattggaccatactggagaaaggaagccaatgtggctgttgagctcggtaattatgggctggttgaatagttgatcgatcatgagtgtatgagatcagtgtctaagatcgatgtgtggctgaatcgaacggctgaaactgatagatgtgacgtggctcactgagaagcaaggaaaatagttttaattgcagttagtggggatgaattgtataggtatataggattcagtagccgtcatcgtttagagtcgggttttgcttagattaatttgtcaagaacagtttcgccgctagatcggtttgtggaaccctaaattcgagtgcttaatcattcatatgcaatttggttacaatctatcttgttcttgcttatgttcttcaattcgcatgcaaagattagccttctcggcgaggtcaactaggtttcggcacggttgataactagaggagacgtggtgctgcgattgcggggctcagtagcgtgttcgttcagaagccggatcgagttgtgtcgtgactccacccaaatcgactgtttattaatacctatcggaagatcaggacctagcatcctcattagttggtactatagttttgaatctgaaccgttgatcagaaatatggatcatcagttggtactgtagctttgaatctgaactcttgatcagaaatacggatggctagagtagtgtgcagttattaacttgcagatacaagtgtaactgtaccggatccgaattcctccgtttggatttgcttcattgcgaccttctacaacttcttgtggtgtttgaatcaccgtcaccgtcaccgtcagcatcaaaatacccgaatgccttttctatttctttttcatatccttctttgcatatttcaggagactatggttaatttggttatccatcaagggcctctctgtaaaactgtttgtacttgcagttgtaaaattgcattagcctcggtgtttggtcttcaaaatttttgtaaaaagaaaaaaaaatgagtcccggggcccgtatgtaaatcgtacacgtctccacctctcgccgcaacgtgacgatgtcatcgttcgatcggagccgtccgtccgatagtctgctcccaaaggaggtaggacccggatcgatctgagccgtccatgccgctatttatacacaccctctcctcctcgtcgtcactgctctgcatttctttcttcttcctcccaccccacgactgcactactaccagtttaattagcactttagcgagctgcgatgatcgattagtatagcctctctctctgagtttttaattaatttgttctttcttctctcgttgggaatcgaactgcggtttctttctttgcttttctttttgttttggtgttggttttggtgcttgcttgctgggttaatttgctcctctgctcgatcaatcgatcgatctgttcttggcgtggcgatgagaccagtagagatcaattgccatggcgtatatcgatttgtgctggccggatctgttcgaggcaggcaccatatatattttcgttcttgtgtgtgttcttcgtggaaacacacaacgactctttggatctaaactttgctgttcttttttaatttttgtttgggtttgtttgtttttgctgcttcaattcgtcgtttggttatcgttcatgcgagagagtcttggcgtgcagatgagatgcaacaaccataacctcacacgcatatatgcatgcattatctgagggcaagatcatctgcctttggtccatctcgatcgatcgcttcgtcttgggtcgtcgtttcctctttcttctgcttgaattgcttgcacagatcgtttaattttcgcgtccttttcgttctttttttcattttctttctcctcgttccattggtttttctcgatttttcacccgggccgagatcgatgctgccggccgacgacgtcgatctctctgtcgttcttcttttccttcttgccgtacgcggctcgccggagttttggttctttctccgccgctcgccggagttgcgccggccggtcatgtgccgcgcggctggtgagtttccttcctcttttttcacccggcagcaactgcaacgctcccctgcagcagcagaggtggtcggtcggtcccttcaaccgccgcgccttgcgcgcgacgaaaccatcgagaccgttgggttttctgacgggaacaatccaccccgtccacgtgtcagattctctttttcgtctcgttgatcaagtcgtgactcgtcgtctcttttctgccgtgcccgacgaccttagttactcatttattactgttactgctactttactttcttcagcttaatctgttgcttcgttctttttctttttggatggcgcacctgctagctatctggatctcttgcttcttgaagcagccgtatcttggcctgcttctgcttctgctgtgtgctcaactgctcatgtgcttgtgccgatgataataaatttttgtcacttctgagcgatgcaatgcatctatgatcgttactacattggagctgaaagttgaggcacataatgatttgatttctctattgcccaatggcattcttttttccctttctttctttcaagaaaagctttgctctgttttcaggacagtgtttctttgggtacacagaggcacttgtatgaattgaattgtgtatgcatataggatgttatgtgcgtgttctgaggcccttgaattgcaatggtgatacgaatcgaatcgacgcaaggctgaaacattcgtgttttgtttctttgatctgccgctttggttacaactcagtaggacaattgttagctctctgtttctggtaattattgatcttcagtttggacacgaacgattctgcttttgtattttgccttctgttcccttttgttatggctgcagaaaagtttgtgatgttagtgtactgtgcctatgatgaatgttgaacctgtgtcaggatttgaaccactgggcatgtaaatctcactaggttttttctgaggcatgttttgctatgatgaactgtaaatctcacgggtttaccttgtctcatcgattggccagtgatgatgagctttacatcttactgacactgatctgtatgaagttgcaatacaacagtgcgagcggct

SEQ ID NO: 65279 - DNA, 723 bp, Oryza sativa
actcccttgcattaattatgcatctccggcgtggcttgctgagtactgtggttgtactcattcttgctctatctttctcccccctttcagtaagagaagctttggagaagaagtcttaggtggagtcttggcttataccccagttgagcgcctgtaaagatggagccgtaggccgctagtccgctgctgtttatttttgattgtcaggcctgaagcgcctttgtaataatgtaaatattatcgatgtaataaagatgtgtcttttatatcatgtttgtatggtgtaccccggcttttcctgggacggggattaatacactagcgttcgggaaaaggcaattttcccggtcgcgacactatttatggcaaaacggtgaagggcaagcaaggctccgctacaatggaccatgcgtggggtgaaggtcaagcaagaggcttggcgccgatggaccgaatccggtggtgaagggcgagtgaaggctttgtcatgatggtcgtggtggaccgtgcgaggccatttgaagctatgagtaatccgtatcaattataagaagaccgcaagatggaatgccgaggatcaagaggatttggttcttcgatgaacatcaagtcaaaatccaaagtgggcattgatcaaagcaaaggtataatttatttgggactaatatgcttaatgagtgtaggtgagaatagtcccaatagcgaaatggaattgacgttgac

SEQ ID NO: 65280 - DNA, 11084 bp, Oryza sativa
tatataaaactaacagacttaatttgttgatttttcaggattctgtttatttccagcaagtatgtgatgtgtcgataagaactccaggctctagtattaacacatttgaaggtcacctcatttacctacttctcgttttcctacaaactcactgcattctcctggattttatcaagtaaaggttttgcgttctggatcttgtggatcgaccagtgatgacaagctatacatcacactgattatatgaaggatatatagcataacagtgtgctgtgcggtctgaggctttgaaatagtcatttctttgtattccacgttcttttttttttttggttcagttcaatgtgatcaccagtttgaatcatttagcatctgaccttctgcttaactgcagtattcttgatcttgtcgattggccggtgatgacaagaccattgtcatactagatattgatcatatgaagtatgtaatgtaacattctgcttctctgaggccttgaattgttcattgccttattctgcatcatttagtatttggctttctatttgcattgtttcaaaaaatgtctaaggtcaaatgtttctcctctttaggtcatattcatgagatatgcagaagctatgaatgcatctttgtacatggccacatgatcataaactctctctgatctgccacttgattacaactcgcaataactgtttgctctttgattctggcgagtaattaatttgcagtttggacacacataattctgcttccgtatctcgccttctattattccctttgtttatagctcaagaaaaggttgtgatgttaatgtagtgtgcctatgatgaaatgtttcgacctgtgtcaggatttgaacaactgggcatgtaaatctcagtaggtttttttttgctgaggcatattttgttagctgtttgaagggaacacaaattagtctatgatgaaatgtaccaaactagtggaacttgattaataaaatgccttttaattaactgtgttctcccgtgttatgtcaagtacaggttttgaccttctcgatcttggtggatcagccgctgatgtcaagtacattctgtttgatcttattaacctctattatctgttatgttgcagtgtgtgtttttctaccttatttgacttaaataaaaatgaggactcgttgacttttccagattcaacctatttccagcaagtatgtcaatcctttctttgttttctacaaaattcagtttactcttctgcgttatatcaagtgcaacattttagggatgagaagttttaccttctctcatggattggccagtgatgatgagctttacatcttacagacactgatctatgtgaagtatacagtagaacagcgcgtgcggctctgaggcattgaattagttagtgtcattgtggtctacaagattcttttatcccagttcaatgtcatatgattatcgctctgcatcattagtatttgtccttctatttgaactgcttcaaaaaaaaaatgtctaaggtcaaatctttttcctctttaggacacaattttagtctgtgtattcaaatgtatgcagaaactattgaatgtatctttgtacatggtcacatgatgtttgtatcaccacccatctaaagcaggcttaatgtcagtctgctttgtacatggtcacatgatgtttgtatcaccacccatctgaagcaggctgaatgtcagtctgcatgtgcagaaatgtgattctgatggctaacatgatagcatcttttcaacattctgcttcagtcttattaccaacccacaactagcatttggcttcagatatgttgcagagctttgtttattttcacttgatatctaacttgtataaacctgacagacttaatttgttgatcttcaggattatgtttatttccagcaagtatgtgatgggtgtagataagaactccagactttagtgacaactgagttgaaggttatccgatttacctactactctactaatagaccaaataggcatagtaacactatattctttcacttgataccaagagatgtgatgtacaaaaaggaaaatgtatctgtcattttgattttttttttttgcacaagatgttgcagatattatctagagtttaaacataaatttcgtgttagatacagtaaatggtgtatcatgtactttgattttctgtgagagaggccagtggaagttttcaaaaatcatttgtacgtcatattaccaaataacctgctgtagtgtttgaaagcatttggtagaggactccatggtattacaaatcaggctacaataggaaaattatagtaaactgctatggtccagtattgaaagtatcaaggcattgagaaaccataggagtcccctctttattttcactgagtcctgttttctactgtgttctaagcaattcacaaatagaagtcacaaagtataacctttgatcacttgagtagttagttcctaaggaaataactactgaatgccattcaattgagacagtcataatatctccgaaacctgccatagcaaatgttttcggtttaggccacaagagcatgtcatataacaagtaaaatgatgatactcttgcatgtatcttacatgtattggcatctccgcaataagcagaccactggtttcttctagagccttgagagtggctacctcgccaccaacaaccatgttaatcacgattccatctgcaccaacatagatcatcagcaacagtaacactcaacaatatgacaaatgatgataaaatgatattttcttgacgtgcctgctgccaagcatgtagacatacgtctgaagtaagcttcctgaaaaatctcaattgaaacttctagtgagcctagaattaaaaaaatcaaaccagaggagttcaaagaaactgcatagcgcgtactcaacagacatcctgaaaaacaagagagtggctcaccttcttcgtgggaagctcatagtttattagcacgcgagccataaggggagcctctcctagtgttgcctggggcaagcaggcatctgttgctactacgatggttagttttgaatctgcactttcagtcttgggactatccgcaatatcagcagcagcagcttttgtatgattccattggattgttgcttgccggaacttgtcaagaacagatgctcgctctgattcagcctgatcgctgtactgtattgacaaaaaccattaggaatgaagttggcaacaaaatccaacacaggaagtaggtagcaaaatccatgaacacaataaagagaatttagctatatcaggggtacataaattcagtttgtctaattgcacaggcatatctgtaattcgtttgggtacataaattcagtttgtctaattgctcaggcatctctgtagttcgtagatgcagctacattattccatatccacagtttttttgatgaattgaacagctacctaccaacacaagcgattaacgtaaaatcacagaaaagtgtacatcaatttgcagcacaaaacgagcataccatatacagctacattgtgccatatcacagtttttttttctgaattgaacagctaccaaaataatcaattaacactaaacggcttcgtaaaatcacaggatcaatctgcagcacataccagcggcgacaatgacacgaaggggaggctggcgacgtcggcgcagacgagatcgagctcgtcgcgggaggagacgccgacggcgatcggcagcgcgccgcggcggtcggcgacgacgccgaggagctccaagagcgtcctctgcaacacaggcacggccacagatttaaaattttcaattcacgcggcgtgtgccctccattagtcggagctgggcatggcatggtcaccatcggagagagagagacgaggggcggtgaggcctcgtaccatcttgaactggaggcggtcgacggcgaggtagaagtggcggccggagctggggaagaagaagagggggaggaggaggtggattactgattagccaacacgagacgagacgagacgagacgcgagggtgggcgacgggggagattgggggggcgctcacctggggtgggatggcgtcgcggcgggagaggtcggagatggcagcgcgtcggagaactccgcggcggccggagatctcatggcggccggtggtgagaaggcggcgctcgccggagagaggagggaaaaccgaagcgggcggagagggagagggtgggggaatattcctttcctccatggtggaatattccaccaccgtggaaagcccaatgggccatatgggtctctcagcccaaatgaacatcggaaattctgaattaaggcccccatttagttcccaaacagaaactttttaccctgttatatcgaatgtttaggcatatatatagagtattaaatatagaaaaaattaattacacaggttgcgtgtaaattgcgagacgaattttttaagcctaattgctccatgatttgacaatgttgtgctacagtaaacatttgctaatgacggattaattaagcttaataaattcatctcgcatattacaggcgaaatctgtaatttgttttgttattagtctacttttaatattttaaatgtatgtccatatatccgatgtgacatgtcagctcaaaattttttgccaactaaacaaggcctaaattcatcttgtgcccatgatcttcttcttttttttcaaaaaaaaaagggttaaactttaattccagttttgaagtttgtctcccttttaagtccaacgggtggaaaactgaagttgtcgttcttaagaaggaggaaatattttttaggggaaaaaaggacatatatttgacacatagaagataaacttgtttggtttgatccctacaaattttcggtaatgtaatatgagtgtgacaggttgtgtgtgtatatatgtttacagaagcaattgcctcgtacatatgaatgtttatttacatttacatttttttataggcattcataccaccggatgaaattgaagccataatcaagtggcgcactcgagcgcctaagaaaagagagccatgaaaagcatcggtcctggaggaaagggaaatggtgttccttgaaaaaaaaaaaagcttactatcaaattgtagtaggatatagcagatcaaaccaatgttttcttcgagtaataacaatctcgtgtttatttgatctaccttggtatctgtactgctgtacaattatgtacatcgtctcagtcaccaaaacaccagttgcaaaacataaggcggtatggtaccaacttaacctacatatgtacatagtgatagtatgccatccagtcggtacatcatgcctaaacctccccaaacattattttgtgtttactgaagcactagtgattaattagctgcttgctgagctaaaaaaacccggccccaaatcctatcctcttcatcatcttgagaaactcctcgtggtcgacctcgccatcacctgcaaaaccaaaaattcggattattatccatccgtcctcattcgatcaagtttcgtgcaccaactagtccatcaattatggcagcatatcacatgcacataagtttcaatttagctgtttaggacgtattgagcgtattaggtgcacataagtttgggacgtattggtggtatgcaccggctaacaaatgctacagaaaaaactataaaaataatgtttatacatctccatctacatgcaaattttcacatttaaatttattatctttcagtgataaaaaaatagaaaagaaatgcgacagttttaagggtataaatttattaaaatatctcttaataatactctatatatttgaaatcaaaactttatatacacatgtcgaaaattaaggaaagtattttaaactcttgaggggtattgaggaaatgtcttctcatttgttcaaatgctatccaaatagtcataagaaaattatgaaaaagaaaattgacaccattcataccatatacatataaactacttaaagaattaaaaaaaatcaaggtaagactcaactcacacattaagaaatagacaaattcacctttggatttgtcttatttatttctccacgggtagattgaatttgaatataatttttggtgtagtgaaagatgttagtatactctaatttgcaaaaaagaaaaaagaaattttcacaaccatttacattaaatttgagaggaaaaattacactaggggacgttcccttgagggaatagaatcctatcctgtaaaattagatgcacatgtaatttgtgagtgtggcgaaagcacctgaatcttatgtgcacagaatatgtcccagttaatcgcttggtaaaatccaagccaattacagaaaagaaaatgctgggggtgtgggagaaacaacaaatcagaccgttctcgtcggcggcttcgatcatctccctgacctcgtccagcgtgaagggctcgccggtctcgatggccagccgctggatgtccacgtccgagatcttcccctgttcatcatattcagattcagattcagattcaaattacgcacaacaacgaccacaataacaagaacaagaacaagaacaataagaagaagaagaagaaggaaaggacactgacgttgttgtccttgtcgatgatcttgaaggccttgttgagctcctccctggcgtcgcgctcgcccatcttgtcggtcatcatgtgcacgaactcgtcgaagtcgatcgtcccgctcccgtccttgtccacctccgcgatcatctggtgtatttgctgcatttgcacacgaaaacgattctcatttgcaatcgtcgtcatcctctgctttttttttactgtcagcttagcttccagcaactgatgaacatatcggttcgttgcttccctcgtcggagaaatggattcagaaaaggaagagatatatgctcaggcaggttttggtacctctggtgtcatctcaaaccccagtgctctggaaacacacagaaaaatgaacaaaatctcagcttgtagccacagcttataattagtactaggatttaggactgtttcggcagttgctttggacagttcccatgttatccgttatcacgtttcatgaattgctatagagcgagttttgtaaaaaaacaaaaaatcaaaacaaaaaaaatatacatatatcatataaatatagcttttaaaattttaatatttaattaatcatgcgttaacaattcaatcttagccacaatagtattgaaacatatgtacctcatggcgacgttgagctcctttggatcaatggtacctacaaggatgcagcaaagcaagcaagcaagaacaagtgagcaattaccgagtttcagttcatcgatcagtgcaaagaggagaagaggcatgaggaaaaaaaaattcagaacctgatccatcggtgtcgaagaggtcgaacgcctccttgatctccttcctcttctgcgccgtcagccgcttcttcctcacctgcttctccctcctgtacccgtcgccgccgccgccgccgccgccgccgccggcggccgacgatgcctcgtcgtggtagtagcctctgtatttgctcgcctgcatgcgtctcgtggttatttcagttcagagtttttcagcgaaattttttggttatttctgctggttcagactcttgctctgattctctccacagtaactgctgcttctgtttatccttatcctaattgacttcagagaagcaaccactgggagcaaactgaaaatgaactctaatttttttttcaacctgaagtatgtacatgtttaggatcacggttacgttgttctaataagcaattcttgaacttatttaaaatattcagataacaaggtttcatgcgcaaagcttacaaaacgatatgttgctaacgaaattcagctacttggtcagaaactaatctcatcaagaaaccggatgaaaaccagacaccaaaccaacaaagtaaaattaatctgaagaagtcgacatagccataggagaatcagcatctcaatcagcatatctgcagagggcaagcttgcataccatggtcaagtggtaatcggagctgaaactctctcaggcttcagagagatgatgatcgagaccaaactcctccagagcacctctgaagtctgaaacctcacttgcttttcctctcctctcctctttcttgatgcttcgtttcttgaaggaaccaaagtgagatggactgatggaggaagaaagggcgagtgattaagaatggtttcttgtgccgtgacgaatgaatcgaacagtgcaaagtaaagcgagaggaattgaagaaaaaaggaggagaagaaagcgatggggatttggaaagaacagcacagcacgtcagttgagtcttatcactcatcaggtagtcgtcagggattattcctgctccttccgggtccaaatcactttgccctgggtcctgggtcgcagccagttctcggcattatttgcacccaaaaaaaaagggttttggtttcttttgttggctgaattctggtgtttgtaccgaccgaagctaattttggattttatgactcgtttggatgggaagaaatttgtaggaaaaatataggaaaatatttacaatgagagcctttgaatgatggaaattgggttaaaatgaattttaaaggataggcagattttctccatattttggtacctcatgtttacaaatgctatgagaattccaatgcaccttctttctttctcgctctgataaatcaatatgtaaatatttaaaaaagaattgtttttttctgtgagacatccaaacaaacaattcatgcggtttatttcatgtagtatttaaccaggcatgatatttcaatcatgtttttttttccattctttgtttcaaaggaccccttaaattttaaaaatacttttaattaaatcatttgtttgccttcttagctattattagaaaaaagaaactgacaacgaaagtgacaaaaaaaaccctctagtactaaatccaagctcagccaatcacacatactgaatgtaacgggctcctttgaaatgtacgaattgaaaatttcatagcaattagtttaactcattcgaaaatcctttataatatttttttcaggaaattagttaaaatatctttgttctaaaggaggcctactactgaaagtaactttattgacatacatccttttgatttcaggagccttcatgggttgctgttttatctggcaaatacagaagtgagcaccatcgttggacagcgtagtctctctcttttggttgaattgctgattgaaagcaatgttatgtagtggaagcatacatctcaccagcacgaaagcacacaggctgtgttctttcgaagaggttaaaaacccctcccctccacacgtaaaacggagcaatggattaacgtataattaatcaagtgataacatttttttaaaaaaaaggttaatatgattttttaaaacaacttttctaaagaattttttttgcaaaaaaacacaccgtttaacagtttggaaagcatgcacatgtaaaatgagagaggtgaggttgagaacctttactaaaagacagttgaaagtgacgtgtataacttcatacagaatggttcaattatgatgacggtacaactacagatagaagatacatcctctaaagtgtatactgtaacctaaaacggaggtagtagatgctggtaaggtgtataccgtgttgtgcatgtgtgtgatggtgtacgcatgtgtatatgttgtatgagcgaaaaaaaaaagtttacccatcgccaacttatccaaaggagcttctataaaatagcatcagctctaactccatctttcgtagagctgtaggccagtcaaacaatttctttcgtagagctgtaggccagccaaacaatttcaactctacttaaaaggcaatagagcatgctaaagttctttcccaaaataaactagagacttggagttgtgttttggctggttcacaaccctacttcaaatccaactattttaagttaaatttagaagttgaagaccaagatttgatcaaactttttagtttggaagaaaatctgcctcaaaaggtaatattagaatatcaaaattttattagatgtgatttttaattataaacttgttgttggtcataatattagtttggtcaatttttgctcctatgtttgttaaatatttgcgattaaagtggatattactttggtaataatcaaaccttacgtaccgttaatgaccaatactttgcacggatttatctcaccaataaccagtcaaaccccttatctcgtgcgtaaccaacggcgtcacgatagctctagggttcgttaatgaattgcgtccctctatatattcagctcgatctcttcctctcttccacgccggccgtccatcgaatgcatcgattcaagtggcgaatttgcaaaggtttgatctccgttggaatcagattcgtgtggaatagcttcttcacaaatataatatcttcttcagatttgaatttgatttttaattccccatcttataatttgcttttcgatcggtttcgggccatcgatcgatctctccctctctaatttttttcctactactagtcttgttcgtttgactgttttttcaagattcatggatatggatttttgcacctattttggcgtgtgccagtacgagacgaatcccggatgaaacttttggtgaattttggctggatttgctgtcacacattcacgtgacggttcatgtcaagaacaaattaatctctcggtaattttatttttgtttttactcaaagttaaaaaccaccgttttaaacgtcagtttaaccccagcgctccgtgtactactaccaccagacaacaaaaagcaatctgaggataggatgatgcgataggcgatcgtgagcagatccagaccgtacgttacgcggctcaccgtatcctagccgtccacgtgtttagctggctggtgctggtccatgtgtgggccccacctaactcgtgacacgcgcgcgtcctttctcatcttctttttccaggtaaacttcctcatctccttcat

SEQ ID NO: 65281 - DNA, 3274 bp, Oryza sativa
atgtgtattactcttgtttgagacatgttgtacctctctatggtttaggcttccttgtgatttaatttacttgttgtgaggtgcttgaaatagcaattcacaactgctaggaagttcctaggaagaacctcggaagttccgggtagctttctctgcttgtgagaaaaagctgccaggaagttccggaccttttgccatgaagttctgggccctgattttaaccgctgtgatttgaattaaattttaggagcgcctattcacccccctctaggcgacatcaaggccgtttcaattggtatcagagcctaatctccggattggcttaaccgcttggagagaagatgttgggggatggcgagaaaagtgtgaagggtaacatggttgatagtcaagatgctacaatgtcaacacgaggtgaaactttccttgaacttctcatgctagatggttcaaattacatgtcttggagtactcgcatgctttatgtgtttagggtcatgggacctcaaatatagcgagttgtagatgtgagcatttctcctcctagtgatcaaatgatatcatttgaagcataatagaaatgcatacatctcaatgctcaagctactaatattttgtttagtgctttgagtgaagatgtgttctaatccatcatgccacttgaggatgctcatctcatttggaacacactcgaggagagatatgacaagtccgagtgtgatgaggcaaagctcgctatagaagaaccacttgtggagtgctcaaattcatcgacaatttgtaaagagcctcaagtgattctatccaatgagcaagatagtcttgccacattcacctcctcaccaacacatgtctccattaaaggtaatgaaatggtgagtagcgtcaatgtggatacttctacttcctatagtgcttgtcgaactaatcttttgaaggtagaagtatgtgggaaaaaatggccaagtgaagaatttacatctccaagatgctcatcttcacacttggatgaatattcttgcatcatggagaaatcatatttggagaaagaaaatctagagcttaaagctcaacttgtggagctcactagcaagcatgtggacctacaagaaaaatatgatgagcttttgtgctctcatggaaatcttgtggattcacatgccatgctagaagtaactcatgaggtgatcataataacggtaaaatcctatgtgcctcatgttcaagttgactttacatgtgctaactcttgttgctctcaagcaaatatttttctgcgcactacatgtgacttggattatgtagggaaaaaggataaatacatcgatcatggatttgtttgcaatgctcaaccttctcaagataaccgtgaaagcatgctgaagaagcttgagaagggatcaaccgtagcttgcaccaagttctatcaagaagataacaagtccaacaacaagagcaaggggcaagatcaaagcaagaacaaagcttccattacttgcttcaagtgcaagaaaatgggacatcatgtgagagattgcccttggaagaaacagaagaagttgagcaagaatgaggatcttgctcacaagttcttcaaatccaccaaagagggacactttgcctcaagttgtccttgcaagattgatgatgaagccacacttccaagaaagacatcaagaatcaacagaaggaagtgctacggttgcattgagaaggggcatgaaattggattttgtccgcacaagaaggatgatcatagcaatcgatcaagcaagaggcaaaccggcaacaagcaagtcaagaagcaagataaaagcaaaactcaactttgctacaattgccgggcaaagggacatattggtaaaaattgtcccattggtaaaattcctaagccaaacctctcatttcatcacaatttgcttaggaaggccaaaaatggcacttgtgctactagggtgattagttcgctacatgctagcacaaaggccatttgggtccctaaatctcttgtgactaacatccatggacccaacgtgatttgggtaccaaaatatgcttagattgtcaattaggtacttggaggtgcattggaggctcaactcatccttgaagaactaactttgtgcaatgagcaaaaaatggaatcaaggatgtgaataattgttctacattaagaaccaatgtcatctcggtaacaagtatttacattgaaatttctatatcctaaccttgtgtaggttattacttgtgtataatgtctatcctttaatggtgcttaattgattggcaaatttgatcttgagtaatgttttggttatctcatttagggggagtgttataacttctcatatcatttgcatcccttaaatgtgttttgattaaattgatgctataatagtcttcaaaattctattttggttaaaaagtaaaaatctataaagttagttgtgaaaacttggttttgtttgttcaaaagggttccttcacctaattgagaggtattttaaaagttgattcaaacaaaaatgagttttggcaagaaaattgtcacgaccggaattaacccaatgggcgttccttacgtgcgtgtattattccttgtcccaggaggcaaggtacaccaaaagttgatacatttcagagtttatcaagcggaagcgtaaatagttaaattattacatgggcagcgaaggcccagcacacacaaagacaaacgagaagcagcggaagactagggcgacgaccacatgcgcttgacggctggcacgagctagacaccaaagccttcatcttctaggggctcctcttctgggtttgggaaaaattgagcaagactgagtacaaccaccgtactcaacaagacacacccacaagtacagaataaatgcaagggagtacaaaggagttatactataaagggttagggttgcagtaaacagcatttaaagatatttagttgctcaaagctattttgtaaacacgattctagaactatacaatattatttatcaaggccgtgaacccacacgaacctgccttaacccaaggcctacgatgattcagaccgaactggcaacccgaccctgggtcccagctcgtcccaagccaacccaggccaaccattccacattttagttgttaagcaggttttaagaattaaaacactaacttgggtacattgctcggcttgcccataaccgagcgcgcggctattcgaatagattatactctgatcagaggtgtacatctttacccacaagacacatcttcctca

SEQ ID NO: 65282 - DNA, 2481 bp, Oryza sativa
agggatctttttagggttttcctttttataaagccattttaactttgtttatttcttcttaaatattatttgtgctctgaaaattccactaaaatttatttacgcattttaggtttttaggaaatataaaaaaaatcctccaagccttatttgacttttaactttgcacattttaattgttggaggctttcacaaggattttaattattctaggcataatttcaaggatgtattttagagtcgttttgggacgcgacaaaaatgattttagcctctaaatctagatgctaagatcttgtttttgcttttaaagtgtgtttatgtcaaaatgtatctgaaaaggtttttgcaaataatccttttgacaagccactagagttggtcatttcaaatctttttggtatttatatctattttatatgataaatgatttgaaattatttgatctcaaaattcacatgaaaatttatattgaccatatttggtcctattatagcatcgagtgagtttagccactagaaccatatattgtgatttatattggttcatggacgtatttcaaactcataaaaatcaaattgtctccaaaacatctcattttgctcaaaattgcatttgggtcattttgttggaacttcaactttttatctttcttcgagcaaggaattaaacatgaatcctttaaaagtgattttattgatgctaggtcaattgtgaacgaacatatggtgatcctcaaacaaatccctcacacgagcaccatggattttgatggttttccaaaaactcggtttttacctttggttttccaagttctttaaatttggtgatgaaatattaaatattttggttatttcttgtttcatctgatttcccatgttgttgtgagctcgtggttcaaatttcgtgaaattccgagtttgtttgggtgattttgagcaaaatcttgaaagttctcgcgtgctgattttgtctgctaggaagttccagacaaagtacaaggaacttccggtcaggactctctgtggagacaaagagggccgataggaacttccggacaaattggtaggaagttccggtccaacttgcctcaaaacattgttttaaaatatgggtttaaccttaaagtttgttttggcccaaaaacgttagctcaagcttccaaaatttaaaagttcaaaagtttagatgacatgttttctaaaagggtttcctttgggtaaaaattcaaaaatttttattggacggttccaaaatttgtgaaaaatgtttcaaagggcttcatcttttatctcaaatgttctaaaaagcttttggagtgaatttttgtttttggacaaaatgtcatttatccaacatgttgttttgatcatatttggtctatatttgcatatgggggggttaaaccatttgattaatgttctttgtgaacatgggctcaattgggtatttctaacccatcttaagtctttccaaatgtcaaacttcataaaaaatcttttggttgaaattcattgttttaaaagtcattctctttatcgaaaactcatttagtgaaattaattttggagaagtttctctcaagttcaaagatcttttttgcaagcttgaattatttcagactttttctctcttttctcaacttgtagaaattttcagtaaaacttgactttgagctaatttgtgatctttatatctcaaaatgggttgtgttgttgtgatttggaaagagcttacattgtgactttcgattctctatagttggacttcactgccaaattttgtctaaattatcaaaggtcatttgaatgtcatttcaatgctctttctaagttattttttgagtttccgaaatttgaacatcttcaaattttcagctttcttaattcttttgatccttgtacatgcatgttggttgagacatgggcaatgctcccgcaatgaaaattgtgcattatcgtgtaatctatctccaaggtttgttgtagatttttcagcccatggattggattaccttcatgtatgaaccgaaagtttcggtctactaaggacttgtatgctccaatggtaaatcttttacatcatctctacatatacaagcttcaagtgtcatgaatattctttcttatggttgattgccatctattatcttgtggcaatttacatgcattattactacccaatgtttggcacatgtatattcttgcaaatcatttatgtgcaaattgttgaaattatagggtgtactcctcatttcttttcattagacaagtgcatgcttctatcaagtaattcaagcttgcatgcactatttagggggagcatgtcctatgttttgtatttttttagactaacttcttgttaagtgtattttatgtttagtctcatgagaagtgaaccattctcaaaggtatgctattcacaagtggtaattcaattaacttttcatcttatattttatctagctaccgggctgcagga

SEQ ID NO: 65283 - DNA, 7003 bp, Oryza sativa
cggtgctcgcgtgtcgctgcgtgcgcgcgcgctcggccgtggtgatatcccttgctcagttcatctgaggcacgcacgaatcgaatcaatcgaaacccattttatttccccttaagagttctttctcgcgaaatcgaattcccccacctaatatatagttagaatttcagccttacgggtggcgaatcctgaattttgtctctggattttgctggaaccatggacagtttctcacttttttcttggtttgttaatcgatctgtctgccagatctactacggtcggattgcttctttagtttgaatctgtgaaaccttttgttttcgatttttcacgtcggctgcttctttaatcttgattgatttctgatgacttccgtttcgattgtagcgtgccgatgatgattaaaagagctaacaatggtgaattcgatgaatgtgcttgcgtgccgctgggtgcgcagctatggtcagggtttcacttatcgcacgataatcgcgtgattatcgcggttatcgcgcttatcgcgggggtacggtaggggaaactggcgatatggtttggatgaattttgaccaaattcaaaattctggaaaaaaatcgaaaaaaactgaaaaaattcatggatatagttcttgatttgtaattgccaatggtgaagaatttttttgaaatagagtaagctaaattcaaatttgagggcaaaaccaaaaatggtttacaaattgaaaaaggaagaggataatgagccttaagtatcctacatattcttccaattattctcaatttctagttttctacacatattcaaccatatttttgatttttttaccctatttattttacatttacatgatttcagctacacagcccgcgataaccgtgcgaatatcgcggttatcgtggcaaaccgtgcgattatcgcggtgaaaccgcgaaaccgtcgagttttgaattcaaatttttagatgtgatttttgtgcgattttagacgattatcacgcgattatcgcggttatcgcgctaccgtggggtggcgataaccccggcccaaacgataaggtaaaccctgatggtgatatgcattcttacgcagaggcacacataaatcgaaatcgattgttttttttcctcctctcatgtgtttgttcccctattatgtgtttcttctcttctgttactttcgatgcaaccctcaaaatctgatgttttatgttttcctttttggcaaattcttgatggaatgagaatatgtaaacacggatgtaaatttatgtaaacacggatgtaaatttatccattaaccagtaatacgtactacgtaaattgaaacaaatatcacatcaaggtcgttgctctctaagaaattgaggaaaacacctgtgaattaatacggacgcatttgtacaggagacccatgatttgggtgaataactggagagctcttcgttttgaaaataaaatcggcacgaacaccaacggtggtttctggtttgtattgaatggtctaacaaacctagaaaaagtagaccatatgggatcattgtactaaactccatctaattaactactactccctccggtttaattttaattgacgttttggacaatgacacggtctacaagatatatctttaactttatttttctattataatatatataataaataaatgtatgtttacttttattatagtgctttaaaagacaaatttatatatgttgttctagtttctttaaactaaatatttttaaagttgttgatggtcaaagttataaaagtttaaccttaaccttatccaaaatgtcaattaatatggaaccgaagggagtatgtgggaagagaaagtttgaaaggaaatcacaaactggaagagagttttaaaggaaatcgcaaacaagaaaaactgatactctagtttggaaggaaattctgtttgcctcatcagttgcaaaccacacatcaagattacaggttgaagagttgcatcttctgttcagcttcagtacttccaagcaactgcgacagtgagccaaatgcacaaagcgtaacatgacgaaaaagagattctacataattgaataaacaccttgatctgatggaaaagacaccagattctatttgctattatcatcacacagtacatctgattgtgcacattacttttgaatgatgtacagaagcatcctaatgcatccttggacacagttctaatgctaggcctattgtaccccaaaggccttctggatttcagctatgactcggtctgcgacatcgggaccaaacatcctcggcaaatttgaagtcaggtcaacctcgattgacttggaccttacaatttggtccctctttatcatgttttctctctcgccttcttccatctctgaagtatgatcagcacaactatcaagccaaatttgaagaagtgccctagcagctgttgctagttgaccacgcactatctcttccaaggtaccctctcctccttgcccacagtcgatgctcatcagtattgctgtcagtgagaaggcgctgcgcacgaagagggatcgcgatcagtatggacgggcctgcggcaattcttcgaccttctcacgctgtttgtccacctgagtattttcatagtatctctctatgtattcgggatggagcgcaaggtctttccgtgggagaaggtccagaagcaccacgatcgaagttgggctaccttgtataaattccatgaggaaatgtggagcatctgtcgaggcgttcagaaagatgagaagagatgtaatgtcgattgcgccatttgggactttgcagtgtagtgaggactggagcatgaaatcaatctgtagacaagaaaaataataattcaaccccacttgtcattccttgcagaactcaagaaattattatactgtgctaagcattaggcagcttgattcaggtgttcaagtggtgagattaataacattgtttgaatgccattgatcattttggccactccaattgtatctgttcaattggtgagataccttttctttggagagtaaaaagaaatctttgagtggtaggaaaagatcacgaatgaggcacaaacgcttgagcagaccaattgttgccatttcaatcttggatgtttcgcagcactaataaatcaactaatttgagcattactaatctaacaaacaatcataatttgctccaaagagttggattgtggatcttggcttctcaaagcttgcaagttcaccttgatagggcaatcacgaatagttcggcagcaaattttcagtgtaaaacagtttcagtaaactgtactgaaacagtttcagtgtaatttactgcatttcgtcataggattgctctactctacctgcctgtcactacaatttcactatttcatatgactaattgtgctctagaaattactgcagtagaaataatctccaattaacagaacagtaaattttaattagcagcttatacttcgtggggagagaagctaagccaatcgcgcaggcacaagctaaaatctgtatgatctgacgaacaaatgtgagagaggaagggggtgccattaccgtcgatcccggcgcgccgcggcgcacgtcgagcgagcccacggcgttcccggcgccgccgccgccgctgcggaacttggcgacgtcgggcggcacggcggaggggagcagccgcgcgcccagccgcgcctccgcccgggacgcgagctcccgagccacctcccggtgcgccaccgccacctccacctccaatggcgccgtcgcgcccggcaccgacgacgcggacgcgggcgcgcacgcgcgcacggcgcccctgagctggggaggcgccgcgcgggggagccggaacgcgccgcggtggcggaggggcgggtaggagatggtggagtgggccggggaggtcgccggcggcgagcggaggtggtgctctgggcggagcatgaacgacgcgaggtgagaggggagtgagattttcctctttttttttcttatagaaaaatgactctgtgttacaaaatccatcgaaaggacatttctactgcaaaaagaaatctcgagacggtgaaaatatgagataattggcctgtttcggcttctttttgctgcggcatgcagccacagcaacgccaacaactgaacattcataattgaacttttacgagcagttcaaattaaggcactctgtgattaggtttatatgctagtttttgaaaaaaaattaagcctaaaagacaacattttttatttggttttctttaaagctataagcatttttacattgctatatatgactccaaaattaccgtttataaaacaactaagctgaaaaattaaattaaaactataagcttttaaactatctgagtgagtgtagctcaactagtttgtattttttttaaccaactcacctaaaatcaaaatctagatttgacaccgttacggctaattgatcttccaatgagatatgttgacacagtttttcaaaggtgttcataggggtagggtatgtgtgtatgggttcatagtactacctctgtcccattataagtgcagtcgtgattttccgtgatcgtccatcttatttaaattttttaaaaaagtttaaaaacataagtcacgcataaagtactattcatgttttatcatctaataacgataaaaatactaatcgtaaaaaattttcaaataagataaatgattaaagttgggtacaaaactcatgactggtgactgcacttataataggacagagggagcatgtgttatgagcatatatgtttatacttttttttgaaaagcatataaagagcacctaatcccagtgttaaattcacgtaccagggacaacaaaaagctgcctgaggatgagataggaggaaaacgatagctgatagggatcgtgtgatgggggcgtgagcagatctgtgccgtccgttccgccgcccggcgcatctcagccgtccacgtgctcgtctagctgccggtccatgtatggggcgtatggctttttcttcttcctcattctttttttgagctttgagtgtcctcatctcatctcatcacatcagctctcgccttcagttcctccccgccgcatctcccatctcgtatttcccatcctcccttcgcgcgtctgggtgaggattcgggcttgtacttcttgttaatccctagtccttcagtccttctcccatcaggtgtcgatttggtctattggtttttcttttttactttgcttaattctcgtttttttttttaaaaaaaagggttgttctgttggatctccagctggagccaaggatacatactagtagtaatttctgttggtttgttttagtgatttatcttggtttttttagatctggtatacatctcccgtggttcgattgggctgggtatttgttctttgaagattggtgttttcagtttttcttgcgtgctagtgatgattaaagaagttaaaaatggtgaatcctggattaatgtgctcgcgtgccgctgtgtgcgcgcgcggctggagattttttttttctctctgttcttctgtgagttcttctatggaaaatatattttttttcttctaacctctccttaatttgactcgtgtgcgtagttacttgcaggttgtcagaattactaggttttgaaattacgactggtactccaggctggtagagcggcaaggtatgaaaatgtataaattcatcattgctgggctgcggctctatattaaagagagatgggggattgcaggttttgcccctcccccccccaccccacccccccacaatagatggaattcagctctatgcctagttcgtttaatccctcccacaaggggattgagggagatttggaggggatttattccacacctattgttattgtggtgtggaattattccccctcaatcccctccattcattctctcttgggtttaaacgaacaaggctagcaaatccggatttttgtcagaattttgccttaaaggaatggtagatcctgattttttttccagaatcttgctggagcaatagacaattctgtttgtttgattgatctgtctaccacatctaccgtggtccaattgcttcttaatatgatttgtgaagactcgtgtttcaattttcaaggccgattgattcttttatttgatttctgaagacttccatttcgattctgtcgtgctggtgatgattaaagagctagcaatggtgaattcgatgaatttgttcgcgtgctgctgggtgcgcagcagtggtgatatgcatccttacgcagttcatatgaggcacgcataaatcgaaatcgattaaaaggccggaatgttattccattatctaaaaaaaaacaattgcttcttaatatgatttgtgaagacttgtgtttcaattttcaaggccgattgattctttaatttgatttctgaagacttccatttcgattctgtcgtgctggtgatgattaaagagctagcaatggtgaattcgatgaatttgttcgcgtgccgctgggtgcgcagcagtggtgatatgcattcttacgcagttcatctgaggcacgcataaatcgaaatcgattcaaaggctggaatgttattccattattaaaaaaaatcgaaatcgatttttttcctcatgtgcttgtgtttcttctttcctgctgccttcgatacaactccaaaattgctgttttattgattttgaaaaggcttatgatagagttcaatgggatttcctgtatgaggtgttgcagaagaaaaactttgaccagcgggttataagttggattaaaaagatcagtgaggggggtaagatgagcataaatataaatggggcagatgggcataaatataaatggggcagatgggccctttttttaaaactttcagggggttgagacagggtgaccctttgtcacctattttgtttaacctggtgggggatgctctgtcagctattttagaagaacctgccagaaatggggtcttaag

SEQ ID NO: 65284 - DNA, 2111 bp, Oryza sativa
aatataggataattatgctcaaggggaggaataataacttgccttgctccaacgcaaataaatccaagataggcaacctgattatacgattctcgaaataccataggttgccatccaaaagacaatagtctttactgagaaagaggaagaaccaaattcaataaaagccataaaataataagaaaacgataaacgactaagagggctagggtttaaggtataacctatctcttttatagggtatagggattatggggctagtatttgctagtggtaggttttggtagtataatagctagggtttagttatatgggagtcgactgtggagtaggacagtatctcggctaggctctatattttatgtggaggctctcgtggtttggacgataggaaatatactggatagttgatatggttaaataggcatgtggctaatatgggttaaggttggctttgatagaatagtggctaaggtttagttgtttaggccgatatcgaggtaggataaatatcggctagggttttgggtgtttgctagtcgtcgctagagttggacagcatgacgactaggtttggtatcatttctagccgtgtcgatagacaacatatcggctagaagaataggaggtgggtgcaagtttagtggggcggaagtgttactccgacaaccgtgagtggcggcagagcggctaggatcacacagagctcaagagctaactgtgcggcgtgcaatggaggtcgaggggatagtgaagctccgaccgctgtacgcatcaaggcgtggggtgccaggagcagcacttcgaccttaggtttggtttttgccgggctttacaaccaacggtccgacgttgaggtccgtagaccgcgcaaacgtccccatggaaggcgtaaagttccaaccggcggctttttagtggctaacgggcattttggaaataaaagaaaatatttgaaaagcaaatataagtttaaattgtaaattcaattataagattaaatcaaatatttattcaaatggcatttgaataaattaaggaaattcaaataaaatcttaaaatagcaaatttgatatcaaaatgaagagttgaatttagatgaatttaggtccaagtttcactagaatcggatctacggtttaggagatatgtgcttctaaagaataggatttgaattaaatctagaaaatgagaaaagtcactgtgcaggggcccacctgtcagtctttctttttctttttcttctccttcttctttctcccgtcatcttcttcctctcttcttctttttcttgccggctacacaggagagggagagagtgggcgccggctctccggtggacgaaaggcggcgacgtcggcggccacacatgttcccgagcacgacgcacctggggtgggcggtggctggcggagagagtgagggagatggctggaacggcgagtagaagagcttatcttcggcggcaaagagaggtggcggtggtggttgctatggggtgggggagaagggggaaacaggaaaaatggaatcacctcgtcgaggcgaactcgatggcgcgatggtttggcttgcgaagctccggtgagggagatcgggtggtggcggccatggccggacatgggagagaaagagagagagatggagctctgattgtatgtagagaaggggagggatggccggctatttataggggagagaggcggtggtgaaaggcggttgtggaggagatcgagaagtgcacgggcgacaatggcgtgaagattcgaactacggcggccggcttcgtttccttagcggcgaaggaagaggagttggcggcggcgtgagccgtgcacgggaggagggggcggctcggttggggtgtgggctggtttgggccggctcggcttagctgggccggcagctcaagaaggaggaggaaaatagaagataaaagaaaagggattgggccaaaaaggaagaaagaatggagtttcggcccgatgacaaaaagaaagaagcctaatttgaatacttgatttggataactaggttttgcaaagaatttgaatttggaaagaattcacaaaagagatttcctaatttatttgagtgcaatatttagagg

SEQ ID NO: 65285 - DNA, 792 bp, Oryza sativa
ccactgccactggactgaattacaaatagacaaattatattcagattagtcacataaaaaatattcagacaaagaagttagaatcaaaatactatgagttacacggagagttggggacttgatcccacattaaaggtaggccaacaaaaaaaaacaaacttacactgtggcatcgtctccaaacatgctgccaaaggttcttaagttcattcttacgtataggcttcactagaaagtcaactgctccttttgacaaacacttaaagactgtacccattgagtcattcgaagacatcactgcatgaaaatgacatcagcatcagtcaaacatattcagactaaaaggttatgtagaaatgtgtcacagtatataagtgaaaaatgtggttgagcaagaatgctacttactaatcacgggaatatccttgcaaattttgtggcttgtgatcttactaagcagaccaatgccagacagacgtggcattacgacctcggtcaatacaaggtcaatgtggttttgcagatcttcaagacattgccatgcatgtagcccattttcagcagggataactagaatgaaagagatacagtagatgccaaatcaataaactaacataatgcaaaacatagttttagataaaccttcagtgctaagagaaacaagcatgcataattctagtaagacatataacatacaataaacatactttccaggttaacaaaccaatcatgatgcaattaacatgtttacgatccatagaattcacttcaagatgtatttaattattcctc

SEQ ID NO: 65286 - DNA, 575 bp, Oryza sativa
gtgggaatcaaatgagagagatagacttaaaggaaatttttcaagaggttaaaatggatgttaatttttttacatttttcctctaaaatagtaggaataggaaagtttcctatgttttttcttttctcattcctacgaattaaaggtatggatagtgtaggatttcagttttttttcctccaatttaaaggggctaagctttggtggaaagatggctatttcccaggcacaaaataatgataccgaccactatagcgaaaaggcaaataaaaagatagtaataataatgccaaacaattccagctccggaagaaggaagaacgcggcggtgctcttgctcacaaatcactctcaaggccccggcttaaacgccgtcaaaccatgccgtgacgatctttcccaccggagcgtgggccccgccgactgctggccccacacccaatcctcggcccaaccagccccacaaaggcccagtccacagcgacccagcaaaggacgcggccacgtggacggaggccatctccgctgcgggggtggattccgggccaactgcgggagcgcgcggctttagattt

SEQ ID NO: 65287 - DNA, 2153 bp, Oryza sativa
tattgcaaatctccaagtgggtccgttgagcagtattcgatgaacatatcgtccatcgcaaagagtggagcgacatcttctgggagaacattgaggttgctctttggttcaacaggagcctggtgagaacttgcaacctcagggagctcttcatgtgtaagattgaagtgggcttcaaatcttgggttctcagaagattttttgtctttgagggatttttggtacaagagaacaagatatttcgggatgcggcagtctttagcgacatgagtgtcagatccacacctgttgcaatgcttgtttccattgctacgaggttgtggtgccttacccttcccttttcctttctttcgacccttgaatttgcgcctgttgttgttgcgtttgcgctttccagtcagattcttaggattattcgaagaatttcccttgaatcctttcttattctcagcattattatgtacattgaagtgcacctcaggtagtggagcagagcccggggggcgctattgggcattctttaaagaaagctcatggtgtctttctgcctgagtcaatgtatgtataagcagagaatgtttctggaaattgttagcgcgatactgttgagtaagtatcctgtcctccggaagcatagttgatagagttttctctatcttctctgcctccgttggctcttgttcgcaaaacttcaacctggagcaaatgttatgaacagcatggttgtattctgccacagttttacagtcctgtaggcgtaaatgaacccactcataattagcctcaggccaaatgagagttccttttgctgatcataacgctcttttagagctttccaaaggttgagagggctcgtctctaacatgtattcatgtttgagatccttgtgaatgtagagcctcaaaagaaaaagggttgtatttaacttcctgttctcaattggcgggtccccatcattgggttcctcaattgtatttaaaatcccccgagaggcaaaatttattttgatatcgaaagcccagatgggatagttagtcccatcgagggcgagttcgtcgaactcttttgttgccatgtccctacaatcatggttaacattattaatttacagaggtaaattaataaaaacatgatattaaggttgtaatcttaatgcgaaatgtaagacttcatattttgtaatgtttcgaaaagatgtaggtaatagacctgacaatttgagttagaattcgaaattaggtggcacaatgtggataatctccaagtaattaaacagtggagtagatcccttaatagtgggcaagttatacttgctgcctaaaacacggtctccaggcaaatatattctggtgaatataccgcagccaatgtttagaactccactaccttgtgctcaaccatatttcaaataatctcatttttcaaaacatattctcggaaagtaacacatgtgggtaatcatcataagatgtagacctctgtgagatgggcgagatgctcgctgcctaggttatgaccagtgcggccaatttgtaggactccatcgggtaatcatctcaaaatgtagaccacttgatgataggcgagatactcgcggcctaagttatggtcgtgatgaccaaagtgtaggactccatcaacatgtgattaatttccaagtcaaaatgtgaagtggaacattcattaaatcctccattaatcatgttgtacataattaagagaatttgctaaatcaaagtacaaaatttatagaattttgtaaattaataaagcgagaaagtagagtgtgtcttgaaataatatgcaagaggcatgttattaagacaacaaataaatttagtgaagcagggtatttaaataaacacctatgttaagtaacatataacatcagtggtctacaggaccattacatagtaagttgtacaactgatgaactgcttgtactaaattaaataaaacacagggacttagatgaaaattgctgctaaattaaaattaaaactaaatttaaatggtaaattaggtagtgcgccgaaatctaaagaattcggcccaccaccgtgtggcacaggccggcaggctaggggggcggtgggccggcccatccggcccggcagtaaaggggcacggggtggggcgtcgggggagggggg

SEQ ID NO: 65288 - DNA, 3296 bp, Oryza sativa
cggaggcggaggaggaggcgcgacagggacgggtgggggaaccacaaccggagttgcagtcacacggcggcgagggtagtggcggcggccaccaaccctagccctgcctctgcgggatccccggagtgtcctcctcatcggtcggcgaagaagatggcggagccggcgtgcgcgctgatgtcgagggaggccaagaacggcatccatgattcaatgaaaggtaggcatcgtaccttctgtttttcctgttcgctttttctgtagatcaaaaagtgatgtttccttctttcacttcgcgatctccttcgcgagagcgaaaagtgctgataacgtattgtaaataagattgattgtagcgagagagattgagcgagagcgagagattaagggaatgaatgagcggatcctttattgataacagtgttacaatatataggagggagaaaggcggcaaccgaaggcgcgatggtttgggaaccatcgcgtccgttgctagaattgccgtgaggcgagaagaggtgtggggcacaaccaaccgtcgtgtccctgaattggttgctgctctatccaaatatatggatgagatcacccaaatatttcataacaggaggacgctccctcctggaaaaaaatagaaccctctaaaaaattgaaactgcattctttttaaacaaaaagatggttttctacaactatgaattatactactttaattttgtacctgtcgaaacatggattcggcaataataaaagggggtagcgcacgagacctaaaagtggatggatgcggagacaaaggatttagacaggttcaggccctctcaatgagaggtaataccctactcctgtttggggatttaaatccgccgggtgtgtattgatctgacgatcaggttatgtcatcatgccccctagagggcctcctgcccaccttatatagggtggggggcaggattacaagatagaaaccttaaccaatacggtatcggtttcctaaatctactttacaatattatcaaaccaggactttaggccgttccgtaatatataaggaaacgtaatacccgagtcatgatctattacatattccatagatataagttatcccctatgactagtcggataaccatgccgtatgggtatggggtacccataatatccacagtagcccctgagaccttcgcagtcaaaaagataatcttctctcgaaccagattactccaaagccgagtgcttcaatcatctttgtcatggtctcccgagtacttttaccaaatctgaagactgtggagggctggaaaataaagtcaggtgcaccgactagatgcacctaataggtgtagcccccgacaatgtggttaattgaacaaaccaagcatatagtcaaggaataataatccaaccaaccgagtggttttgataatcgtaatcaaccaaagtgacttgatatcgatatatagcatatgcggtgtgaatcctccaaataacatgatctgggtgatataccaactgctttgtaaaatatgatgagtgatatagcaaaatagctataaagaagcttgaatgctgtgaataaagaaatttccaaagtattgggcatacgccatgcgcacactgctttaacagatgtgcttaagtccctaaaagacacatggtttcaccacacctggaaatatatggcatatgtggtataacatccgagtaaataaactcataaaggatttaccaaccgcctagaaaatgaccacaatatataatcagcctaagccataatattggtcaataaaaatgcacacttacgtggcaaaaagcaatgatattgtatccaatcaattgcttgataaacccaaacagcaccttgactatataaaaaagtcagcgggacagctatataaagctttactgtttgacaccttttaagatgcattgtaccaactcctaaaaagttaagtaactgcggtataaaaggattttaaggtattgggcacttgatcacgcgcactttggcctaagcaaaaagtgcctaagtccctaaaagaacgtgacaggccacacctgaaaatatgggctgcagacatattaggcctaggccaaaaaatatgccttcgacaccctttaaaggatgacgcatgtaacatgctcccgagtaataaatcttccgggtaatatagaccaagtgtagctcatatgaatagcttctgatcggaatgattatcccttatgggatactccaaaataaatataataattgaatcccgactggcgcaagtattcggttgatagcccttacggagaataataattggtccagtctttgagcatagaaaataaactcatgactatgaatccatgtggaatgtatccggaacaagtccaaattggagatataatcctcacgcttgagttgatgagcccctgagcatatagcttgttcttctgtcatagtcaaaattgtccattgatggtagctgacacagttggcatagagacaagacgaccaacatagagataatattgcccaccagaggtggcaaaaatattggtggtagtgaagataatgataccaatcaaaagtgatgaagttgcacagccgtggaggcgaagaaaccagtcggcaacagtcaggtcagccatcaatgaagatgaaggcgcccagcgataaagttgtgtagccatggcagcgaaataatcagtcggtgacagacaaggcagatcaaaggcgatgacgaaatccaccaatcatgaagatgaggaaaatagtcggcgacgacaaacgtaaccgacagcaatgatgataagcatcaacagatgatcaaacatgatgacgaagttgcctatcaatagcagtagagtaagctatgataaagaggtttgacaggatgttgatgaagatgacgatgtcggtgatccagtcaatagcggtgtaatagccgatgataatgacgaagacgctcatcagcgtttgcatagtaggtcaaccgtgaaggcggaatagcaagttggcaaagtcttagtcatccattagcaacggcggaatgtcagagctgatgaagcagatgtgctggtgatgatgtcagtgacaataatccatcaaactgttgtagatgcttcacttggaggaaagtatatgctgttgttcaactcattgaatctgatatgagttgattggttgatgactccaaactcccagacatgtaaatttaatcttgacctactgctctgaagcgaagacaaaattgatgactcccagagttgacttgttggctgattaattgattgcttcagcttgacataaa

SEQ ID NO: 65289 - DNA, 4828 bp, Oryza sativa
tccactacagggtgagtaaaccaaatctattcaaatagccgtgctcacggttattgagcaccgggacgtgtattacacttggctagactctaaattcttaacttgtgtgggatgggatattgcatgatgatttttatgctgttggagctacttcctgagaggagggaaggtggacgacctcagaaaaccatgacgactcaatggcgggaagatatccttgggatcacaatggatggtggacagaaccgtcgttgtttaatgtgaacactggtattaaaatttgatcagtctatgcaaggtcttaggcttgtgaaaagatttgcaaaacttgctttgcgcaaaggaacctgaagccattccttaaaataccttctatcatatgcatcgttgctgtggtagcttgctgagtacgtttggtactcacccttgctatttatatatcttttaggagagtgttgaagagaagcccttgtcgctacgcttgcgtatccaacaagatgatcggagtgcggtcttgttctaggtcttgttccccagtcgactgcctgtggcatgttaatcgggcccttatattactttgtcttccgctgttgttctctgatagttgttggcctacctggccctaatgtaagtatttaactcttttagcctgaattaatttgtgatatgttgtgatccaactatgtatgtgtgtaccaactactgatccagggattggtacggataaacacagaagatttccgatttccaaaatcgggggtctacactcaacttgaggagtgcaatgccgaactagatcttgaaaaacaaaagctagccgatcttccaaatgccattgaagaacagaagtccagattgagatcggctatcaagaatgtggctgacatgactaaatctctcaagatcatccctggaaccgatgcccaagacatccaagccatcgaagaagtagatcaaatcaggcaacgagctttgtcggctatccagcgctatctttctcaatgacattttgtgtaatagactaggaattttgtaatcggctaagaaactctgactctttatctaactcatcttaataacttttatgccgattcaatataactccatatttcgctcaaaaatttgcaatttttcatatatgtgcccccctaattttacgatgtcaaaagtattgataaaattataaaaacaactaagggcgatataacaatatcggccattatgcatcggcaaaccacaccgattacaatatgaaaacaactaaggacgatataacaatatcggcaatctcaaggcgatgcaaatacatcggctatcatgtatcggcaacatcagccgatcatgcattaacccaaacacttgggtaatatttcttcaagtacttgccatttagcgctcgtccataaacttctccatcgagtccttgcaacatgtaagctcccttagacacaaccttatagatttggaactgtccttcccaattcggcgaccacttgccgaatttgttatcccgtgtcccaatcggcaaaatcaacttccacacaagttcaccttccgaaaaagtcttggacaccactttcttgttgtaatgccgagcaactcgttccttatccttggtaacctttgcaagggctcttaatctagattgaaccaagtcttccctttcatcagccatgagattataatattcatcggctgtcaaatcattttgcaactccgttctccttgagccaattctaacttcccatggtaaaacaaccccatgtccataaacaagcttataaggaggaacttggatcgaaccatgactagccatccgataagaccacaatgcttcggccaatcgagtatgccactgccgaggataatcaaaaatctttctcttaatcaatttgatcaaacttttgttagatgcctcggcttgcccattagcttgtgcataatattgtgaagaattcaacaatttgatacccatgctatcggcaaactgaacaaactcatcggacacgaagattgaatcttgatcagttgtaatggtttgaggaataccaaatcgatagattatatgctcttgaacagattgtatagcatccctagaatcaaccttcttcaaaggaatcgcttcttcccacttggtaaaataatcggttgccaccaatataaacttatgccccttgctcgatggtggattaatcatgccgatcatatcaattccccaacctctatatggccatggtttaatgataggattcatagccgatgccggtgccctctgaattgctccaaatttctgacaatcttgacatcccttgtaatatttaaaacaaccctccagcattgtcggccaaaaataccccgcacgtcgaagcaactactttatcttatgagccgattgatgagtaccacatattccttcatgaaccttaccgattgcaaccttagcctgatcggcactcaaacacttaagcaacaccacatcaatcgtccgataatagagctcatcatccaataaagtatacttcaacgctttatatcgcagtttccaagaagccgattgagatggattctgtaaatattgatgtacgtcatatctccaatcatcggctgttaatgcaacaatctcaaccttgacatctttgatcatcggcttatatcccgatgccccttgggccaaatcattagcttcaatattttgctctcgagatacatgcttcaaggttaccatccgaaactccttcatcagctctcggcacttctcattataaatcattaacgtataatttttgcactcatactcccctgccaattgactgatcactagcaaagaatcttccataatttcgatagcatcggcttcaacttccttgagtaactgcaaccctttgagaactgcctcatactcagcttgagtgttagttgcataaggtttaatagtataagcaaactcaaaacttgccccccgaggagaaattataaccaagccgataccacaaccatgagtgcatactgatccgtcaaagaacaaagtccatggcacaacctcaaccgagccgattgaatcatcacgatgaacaacaataaaatcggctatagcttgccccttgactgccttcggtgactcataccgaagatcaaattctgttaaggaaaatatccacttttcaacccttcctttcaaaattggaccagataacatgtacttaacaacatcggctttgcagatgacagtgcattcgttggacaataggtaatgccttaaccttgtacaagaaaaatataaatacaagcatagtttctccacaggggaatatttggtttccgcatccaagagccgatgacttagatagaatacaactctttcttcccctcaagctcctgaatcaagactgagtcgattgatttctcaccggccaatagatataatctaaaaggtattcccttctgtggaggaattaaaaccggaggagagctaagatattccttaatactatccaaagctttctgttgctctgtcccccaagtaaacttttgatcggctttcaatcttaataatggtgtaaaaggctttaacctcccagacaaattagaaataaaccttctaacaaaatttatcctggccgatcatgtcctgcaactctgtcttattctctaaaagctgaaatttcttgattgcattaacacttctttgaactatctcaatccccctctcatgaacaagaaatcccaaaaactggccagctgatacaccgaaagcacactttgtcgggttcatctttaggccatatttcctagttctctcaaaaaccttcctcaaatcggctatgtggtcctctatctctttagacttaacaaccacatcatcaatataaacttcaaccagctagccgatcagatcatgatatatataattcatggctctttgatatgtagctccagcacttttcaagccaaaaatcattacaacccactcaaacaagccgattgcaccaggacacctaaaagccgtcttattgatatcctcttcggccatgaaaatctgatagtatcctgcatttccatccataaaactcaatatcttgtaccctgaagcagcatcaaccagctgattggctactggcattggatactcatcctttggggtagcttgtttaaatccctgaaatcaatgcacaccctaaccttgctgtttttcttgataacagaaactatactagaaacccactcagcatatcggcaaggacgaataaaaccaatatcatataaacgtttaatctcagccttgataggttcgatgtcacgaccggaaataacccaacgggcgttccttacgtgcgtgtattattccttgtcccaggaggcaaggtacaccaaaagttgatacaattcagagtttaacaagcggaagcgtaaatagttaatttattacatgggcagcgaaggcccagcacacacaaagacaaacgagaaacagcggaagactagggcgacgaccacaggcgcttgacggcaggcacgagctagacaccaaagccttcatcctccaggaactcctcttctgggtttgggaaaaaattgagcaagactgagtacaaccaccgtactcaacaagacacacccacaagtgcagaataaatgcaagggagtacaaaggagttatactataaagggttagggttgcagtaaacagcatttaaagacacttggttgcgcaaagctattttgtaaacacgattctagaactatacaatattatttatcaaggccgtgaacccacacgaacctgccttaacccaaggcctacgatgattcagaccgaactggcaacccg

SEQ ID NO: 65290 - DNA, 31292 bp, Oryza sativa
tttctgggaggatgtgtggctgaacaaagtgtctttaaaaacctgcttggctgcttcccatctctgtattcagcaagttatcaacacaaggcactgtgaatgagttgtgggatgggggggattgggatttacatttcagaaggaacttgaacagtcaagatagactagagttggataaactgcagagggagctggagggggttactctaaatggagagagagacatggtgatttggcctcatgacaaaaagaaaattttctccacaagatctatgtatagggtgctaaaatttggaggggtggtagatcaagaaatccaaggggtgtggaggtgcaagatacctctaaaaatcatgcatttcctctatatgacagggagaaacaggattccatgtacagagcaagctttgtctaggggaagaaagcactacacatgttttatttacttgtcccattgctaaatttgcttggagtgtaattgctatagttctaatttgcataatgtacctatctctttctgggattgtatcaaggttgtaaccaagaaaatggggtttcaggggggaatggtggtttttgcaggaatgacctggggtttgtggattaccagaaataattgggtttttaacaataaactgatcaaatcacctttgcaggtcgtgtacaggtctttgtctttgatgcaaaggtggaaggtgctgctaaaagaaaaggagtgtactagcttggatgtctttcaagcaaagataatgctgacgttggaagtgctgaagccgactgataatcttcctgatgatataggatagttcatgggaatgggctctgaaaatatttggtcttttgttgtgggtgttaaaatgtctggaagggggctaggtttagtggatgtccaagcttttgttgagctggtttggaaaactggaatccccagttttttgtttccttttgtttcgtttttctgtaagaactctgtttcgtttgggctttttctaaagccgggtaatatatgcctgttgtcaaaaaaaagatgctgttttctgtttacattttttccttttggctttgccgttcgaactctccattcttgatacaataattgtgtatttcaaccgaaaagagaaggcaaaaacaactctccaaaaaacttggagtttatgttttgtgccatgtgtgcttctagagctgcgagtagctgtagggagccaggattagtatggctggtagttagtgaatttctgattgatagcatttcaattttgtcataaactggtgcgttgatctatgaaattaggcagttagattcatcgcaaatttttaatgggatgagaatatgtaaacacggtatgtaaagttatccattaactagtaatacatttgtaaaataaaataattgactgtcctttctctttaagaaattgaggaaaccacccgtgaaatcagtttactggtacttataaattatattatctttttgggcactttcttttaatgagggcatcgatgtatctctagaggaggccgagatttgggttgaaacggctagagtaaaaaatcggcatgaaaaccaacactacattggtttgtataattgtatagacaaaattatgacatctgatggtatttgcaattataaatttataatcacacaatatatctgattgttcaagcaaaagggacaaaagactactaacattactttcgaatgatgtacagatgaattcctggtcacagttctaaagctaggcctcttgtaccccaaaggccttctggatttcagctatgactcggtctgcgacatcgggaccaaacatcctcggcaaatttgaagtcaggtcgacctcgattgacttggaccttacaatttggtccctctttatcatgttttctctctcgccttcttccatctctgaagtatgatcagcacaactatcaagccaaatttgaagaagtgccctagcagctgttgctagttgaccacgcactatctcttccaaggtaccctctcctccttgcccacagtcgatgctcatcagtattgctgtcagtgagaaggtgctgcgcacgaagagggatcgcgatcggtatggacgggcctgcggcaattcttcgaccttctcacgctgtttgtccacctgagtattctcatagtatctctctatgtattcgggatggagcgcaaggtctttccgtgggagaaggtccagaagcaccacgatcgaagttgggctaccttgtataaattccatgaggaaatgcggagcatctgtcgaggcgttcagaaagatgagaagagatgtaatgtcgattgcgccatttgggactttgcagtgtagtgaggactggagcatgaaatcaatctgtagacaagaaaaattaataatttaactccatttgtcattccttgcagaactcaagaaattctaccacgctaagctactgagcactagggagcataattcaggtgttcaagtggtgagattagtttcataatttgaatgctgttgatcattttggccactccaattgtgtccgttcagttggagtgattttgtttttttgtttttggagaggaaacaaaatctgtgagtgataggaagaatcacgaatgaggtacaaactctagaacagaccaattgtttccatttcgatattggaagcaaatgaactaatttgagcattgccaatataatgaaaagtcataatttgctccgaagagttggattatggatcttggcttctaaaagtttgcaagttcaccttgatagggcaaatcacaaatagttcggcagcaatttttcagtgtaaaacagtttcagtaaattgtccaagtcttttgacatgccattgatctattctgctctgtttgtgccagcctgtttttaccagtttaccactaccatttcactacttaattagttaattcatatgattcactacttaattcatatgactgattctgatggtgctctagacattaccagtttaccactaccatttcactaattcatatgactgattctgatgttctccaatcgacagaacaggtaaatctgtacgatctgacgagcaaaagtgagaggaggggtgccattaccgtcgatcccggcgcgccgcggcgcacgtcgagcgagcccacggcgttcccggcgccgccgccgctgcggaactcggcgacgtcgggcggcacggcggaggggagcagccgcgcgcccagccgcgcctccgccagggacgcgagcgcccgcgccacctcccggtgcgccacctccaccatcacctccggctccgtcgcgcccggcgccgccgccgacgacgcgcgcacggcgctcgacgttttgcccccgagctgggaacccgcgccgcggcggcggcggcggagggggaggaggcgaggagcgagggtcgggaaggagacggcggaggacggcgagctggtcgccggcggcggcgagcggagttggagcattggatcacggcgaggtgttcgacgcgtggacgaacggagcgagagatgaatgtgagcgagagggagtgagaaggattccgtgaacgtgtagaactatccctcttttacttttgtaactagtgcagtatatacataggagatgattgaaagagagatctgaaagctgctgttacaaatccatcagattccaagacattatctattgcaatttgcaaatgccttgttttttttacggacactgcattactgaaatgtgagataatgccaattgaggtggtatttgggaatcacaaaaatgactagtttagtccctccttcgcaaacaccacatgagttggtttttttcttttatacttcctccgtttcaggttataagactttctagcattccctatattcatataaatgttaatgaatctagacacatatatatctagatttattaacatatatatgaatgtgggtaatgttagaaaatcttataatataaaacggaggaagtaccatgctaatgactgggcagctcaccatgtagcgcataagcttgggaaccgaggtgatacttatgccctattcttttctccaataaaagttggataaacttttggatactcgtgacacgtttttcaaactgctaaacgatacgtttcgtgggaaaactttttatatgaaagttgttctaaaatatcatattaatccatttttcaagtttgtaataattaaaacttaattaatcatatattattactacatcgttttgcgtgaaacacttaatcttcatctttatatttatcttcaggagattaaacacaccacctaaaccttaatacacttgaggccatctgctactgctgatcactcactgctgttgctgcttatcgctccatgggccaaggcccaaagctcacaaaaggccagatgctgcacactagctttcttcctcagtccactagctcttcattttcctttttcccccctctaattattgtgggggccatattactgaaggagaattcgaaacatcttgaatcttctcagagagcttgagagtgaaatgagtgggccggccaaagaagaccactatagaagtgaaaggggagggcaagagcggtttgaaggtcaatgaaatgggttcagttcccttgtcaaataggggccccgacccatgtttaatcactgaagtgtggttgagtgagatgatccgcaaccaacaaatgatttgtcattgtctctaaatcactgaatgaattcgttttttatttatatatgagaactagagagttcacaactcccttttcatttattttgatcactttttagtttctgcgaatacttatcactaaacgtttaaaaggttaataggatccacgccaactataaatatgccatttcggataaatgccactactattcatgatattggttacgtgccactgaaatttgaggagttagaactacactatcaccgttgcatttcccgtcagacccctaggcgttagacccacatatcagttccatctttctccatcctccctcttctttattccctatctcttcctccatcttctacgactgctacaagggacatcgacggcggcgaccgagccctcccactgcggatgggataaggtcgatgacgacagtggctcccaagccctcccaccgtggatggggttgaagacgacagcgttggcatctcctgagccctcccgccacggatgggagaagattgacaacggcggtggttcccaagctctcctgccgtggatggagtcaaagaagatggcggtggcagctcccgaactttcccgccgcggaggtggtcgacgacggtggcggtgacgatgagcgccggagagagagagagatagggggtaggggaaagagaggagagtgaagggaggagaaaaacctggaattgacagctaggtcccacgtgcaattgatgctaacgaaaagttttgatggatatagcgatagagtgacacggttccgatttccctaaatccgaatgacacgtcatagccgatattgtgaatagtactaatttttatctaaaattacatattcgtagtgatatggatccaagtaatcatttatcaaggtagcgttttgtctctagtggggcctaataataagaagatattagaacatgccaaacaattatctatactactcccaatcttaaatttcgggtgtttaggtaaaaaaaatcagcatccaacagtagcactatacaaacactcccgaaaaatccttatgcctatatgcagaaatctagctctccgcaagtttgaagagggtctagctcccaatcccatcaccgagcgagtttgcctgcaccgagaggatggctcgtcccatcagaatagaaaaaaggatgctgatttaattttgtttggaagttttgtagttgggccattgtttttgttgttttgagaagttaaaataggctatcttggaggagagcatattttttttcttaaatctgattagagattcccaaacaaaaggtttaggggattatattttgatactaagttggtgatgctcttatgtggcatatgtatttagaaacttataaattatgtataccacttaatttagggttattttggtcattttacctagaaaaaggtgattgtgttgttatgtgtgatggtcaaaagtgaaaggtagataaaaatggagggagtattttatttattactctatctcaatgttgcttaactataccacaatccagttaatcacaagtttttccataacccagttagtcacaaatgtggcaaagaaagtaatagtacagcacgtgccttcagtgtcaatgccagaactcacccacgaaataattagtacaaaagtaatttgaagtggaagcactactggagaaaccatctttactcggtcagctaaaaaccacaatagtttcggttccaataaaaaccaagactaaatatatcttttagtcccagtttataagcagaataagattgtgttttttagtcctggatatctatctttagttccggatttggactcccggttgtataaccgggaaacaggcaattacgaaccggagataaagatgacttgtgcagcatgaagtccatagaatgatttgaaagcatgcagttttaaataaataaaatgtactgtatactagctagtgtttgcactttgcagacatacactgtgattaacgttgattattattagctctatttcacaaagttattttcactttttgctaatcaagcttttttaagattaattaagtttacaaaaaatataacaatacttttaacacaaaaggaacatattattaaaatatattaaaatctaaagttgatgtcatagatgttgttaacttttctataaatttaattatactaataaaaaatttgactaggaatacgaaacgaatggagtagtaattagtactccctcccaaaatatttaacgccgttgacttttttttaagtaatgtttgaccgttcgtcttattaaaaaaattaagtaattattaattctttccttatcatttgattcaatgttaaatatacttttatgtatacatatagttttatatgtttcacaaaatttttttgaataagacaaacggtcaaatacgtttaaaaaagtcaacaacattaaatatttagggacggaggaagtatataattaaacttcctatcttcaaaacaaatctacaaagattagtttagctctagcttcttgaaagtaaataccgaaatgaactccttacgtaaaaaaaaaagaaatatatatacaaagataataagcggatggatgtggtggcgagagaaacctctagagccatgcaaaaaaaatgcttaattagcttcccatgaacgccttgcggatctcggcgacgactctgtcggcgacgccggcgtcgaacatcctcggcaggttcgccgccaggttgacctccagctccgccgccgccaccttcctgtccctcgccaccatccgctccctctccgccgcctccatctccccgccgccgccgccgccggcgcagtgctcgagccagacgccgagcacgtccatggccgtggcggcgagctcgccgcggacgatcccgtccagcgccgccgcccctccagggccctcgccgcactggacgtcggccacgacggccgccggcgaccacaggctgcggacgagcagcgacggcgagacgtaggggcgggactgcggcaccaggccggcgacccggcggcgggcgcgggcgtcgaggcccgtggcggcgtagtaccggtggatgtaggaggggtggagcgggaggtcgacgcgcgggaggaggtcgaggaggacgatgagggaggccggcccgccctggatgaactccatgacgaggtgcggcgcgtcggtggcgccgttgaggttgacgatgagggcggtgatgtcgatggcgcctccgccgccgccggggagctcgcggtggaaccacgcctccagcatgaaggcgatctgtgtgcaaaggacgaaataaataaattattactacaaatttacggttaaggagctgagagctggattataccgttctatctatgtcccataataattgtatttatgggatatgaatttgtcccaaaataattgtcataatagagtaccgatggtcctattaatcacttcttattaaatctctccctatttgatcctcaactacacttcgactcttaccaatacattatttaaataagatgtatcatagcctttcttctcaatccttaaggccttaagggtgtgtttggttgggtggatgagcctcgatgggagatgaccgcccgatttttcgaggtgtttggttgaagggcagggtggatggggcggcccgaaatagggaatattccctcaatatgcgatttggctggatgaagccatccagttttggtctagatgatgtgtcatattctgattggctgtggttggtttgattttctgttaagcaaggtctaaatgatttttttctcctaaaccgtttatctaatttatgatttgattacaccattatatatatatatatatatttgttacaattaaatctttaaaacaagatatcggatgattatattttgataaaaatatataatgacaaatgggcccccactaacttttgcatttttccattcatgggatatccctccaatcaaataagaaattggatcgctatatccatacaaaccaaacaaaaaattagatagccatatttaacaaaatatgatggacatatcccatccatatatgaccgtgaaccaaacacaccctaatatatgctacacaacctagacagtttatatgggaaaaatgtagtaaaagttttcaaactattaaacggtatattttatgcgaaagctttcaatatagaagttgctttaaaacgttagataaatttatttttcaagtttgtaataatttagatttaattaatcacgcgttaatgactttctcgttttatgtgcccgcttttaacctacatccttttaggagattcgaacggggccttagctttaaagatatttggaagtgatgagatttgtagatttccatgcattttaaaactttgtgcttccaaattttcaactcagttctaacaaccaaaatttgactatgaagccagcacacgtgcacgtactccctccgtaaagaaaaaaaatcagcttagaaagagatgtgaagtacatatttattatactagtaggtgttatattttcatttaggtgagtgcttttgtagacggagggagtacatttcaatgtaacccgaccaaaaactactatgttttttttcttcctcgaaaacccattcaaaacgtaaggaaaattcgccgctttgatctttcgttctcaacgatccatccatcgaacggaaaaaaagaacaaaaaaaactcgcaacgcgctgctgtgtgtgtacgtaccgaggatcccggcgcgccgcggcgcacgtcgacggagccgacggcgtccccggcggcgttgccgaaccacgcgacgtcggcgggcacctccgacggcagcagccgcgccccgagccgcgcctccgcctcgccggccaccgccagcatcacctcccggtgtgccagcggcggcatcctcgccaccgcctcttctctgctcacccgcgacgccgacgccgccgcgctcctcaccgccgccatcctcctcctcctcgccgccgccgccgcggccggcgacaggcaggaggggcgagacggcggcggggcggcgcggcagcagctggtcggagcaggaagcattggtcggtcgcgcggacgatcgagctcgatctacgtactccgagattcagcatctcgcgccgccgcggtctcgtcaccctagctactctcgtgtcacactgtgtgtacgtgctcgtcgagttgggctatataggcagcttgggttaggcttggtttgggtacagttgcttccaaatttggttttactgtttctgtccaatcagccagctataacctcaaccagtcaatcatagcgaaatttcttgaaaatcccatcaatatatttcatttgacagaatagctcattaatttgtttgctagtatgcattgaataaaacaaagtcaaagtaagcaacacgaacaaaattgtctaaattacatatagtggagacgttttaaatatttagtgagagtataagaataataatactcctaggcttctagctagttaagtagtgagacctttgtttttaaatatatttactataattttttgaacgaccatttaccttaagtactaagcactacctctatcatacaaatactttatattttttatagttctagacttcaaaggccctcttttctatttttttcctaaatacatatactttatacatattttttttaataaaagtcttgggtattattttgaatacccatgaatcatggtgggtccgtcttaggcataaatgatgctttctgggaattgagatatatatatatatatatatatatatatatatatatatatatatatatatatatatatatatatatatatatatatagtaccatttattttgttttggcttgtttacttgaagtataacttatattttcttatatttacactcagttttcaataagagaaatgataaatattactagtagttaatagcatcatatattttaaaataaaggaagtatgttcgaaaatatcccacacaacaaacgttacccattttttcttggaatctgtcaaaaagtcttgtttcacctatactgttcacacaccatatttttttaaaaaaaatacaagaaattggaaaaaggtaagtcaacgatataaggttttgtgattttcccatgtcaaatattatttggaggatatatatatatatatagaacatagtttgatccagatctgaatgtgtaagtttaacaaacattcacttcatcaacatacagcccatgaaccatgaggaacttccaaactatttgaaaattgttcacgaccaccttttatttagataaacgaaaagcgttacattttcaaaagttcccgtccatccgtagcatatacacgtgacacaacaaagaacacaagacaaggcacaagcactataaaccgtgggatccgagtttcgctcacttattaactgcatgggtaactgtgttattggaatgcgggccataacaaagtaccagaacctactctctccataaaaaaatctctccatccaaaaaaaccaaatctacttagagataaaacacaagatagtaaggcagaataattgagatggaatgttatgtcctacatttaaataggttaggttttattggacggaagaagtatcataagatttgcttccatagactaatattatatatgctagtttaagataaaaaccggcacctatagtatttgtactttctttttttcaaaaaaaaaaagtagcagctatgctaaactatagatgccgatttttcttaaaaaaactgatgctcgagccgagctgagccaacaccccaccacgataaaaatcgtgccccgccccatgtctcctaaccttatccactcccatcgccctatctcactctcgcactctcctcctcctcctcctcctcctcctcttcttcttcttcttcttcttcttcttcttcttcttcttcttcttcttcttcttcttcttcttcctctccaccctcctcggcatctcccctcctctgcatccacctcccccacttctcctcctctagatcaagcgacaacgaccggatggtggagaaggaggctcggccctcctctccgtccgatgatggcagtggtggggtagaagtcagcgcgaagggcgaggtggcatccgatgtatgggaaggaggtggaggccatcacaatccttccctcgtcaagctcctccccgacctcgccgagcgcctcaccaacagcccactggatccaacagcgtggaccgtggcgtttgcctagattcggcgatggtagtggtggtggagaaggctagcgcggaggcgcgaggtggcggccgatggcctcgaaggagatggaggtagaggccgtcacactcctccccgacctcgccgagcgcctcgccgcgaacatccggatccagcagcgtggaccagctactccgttgggccttttcttttcttgattaattgaatactttaggtgtcggttgtgtggtaagaaccaacacctatgcccaaaagtaaaggtgttgataaattggtgccggctggaaaaccgacacctatgggatatacggatgaggtagtagttacaccaggaactgcatagctaccgcatccgtcggtggatatgtaggggttgttcagattgatgtcatttcaaaccataccaatttttagtaaagttgtcaaatatgtgcatctatttttttttaccatactctagtaaatacataagaaattctgtcaaaacttagcaatattaccaaattaccaaaatatggtaaggtttaatctctctaagcgtggcactaccatttgtaagatccgacggctacgagtgatcgaagtagcaacatccacatgcatgaattgtacttccttccagtagtcaccactcatcatcagcacgagccagtcactctcagttagccttagcttacccgttgcgtcttcctgttggtgcttacaactgtacgatcggtacgtgaccagtaatagttgcagtatcgccccaaaagcggccaaacagtccacaccaacacaagaaagtttgcctcctacttctctttctttctttattcttaaaaaaaagagagaaagagcatcgaatggattatataaacactggtggagaaacgctttgttgtcccggttggtaacccctttgtagtcccggtttttcaaccgggactacgaatccgggactaaagatcgcaatctttagcgccggttcaaataaccgggagtaaagatcgatttttagtcccggttggtaacaccaaccgggactaaaaatatggtcccggttgttgttactaaccggaactaaaaagttttggtttttttttcttttccttttatctggttggcatttttccttttttattgttatttagcttaagctagtggatcgaataaataaaatcaacaacaaagcctaaaccatagatcgaatgaataaaatcaaacaacaaagcatccatattgtttacacttgttcagaactacaacatctcatcacagagggcattcatcacagagaacaaagaaaggaaaaagaaagttcacatctacgacatcattcatcagatagcaaagagaagagaaaaaaaaaagttctcctgccgctgcctcccgaccggcgccggccgccgccatcccgaccggcgccggccgccgcctcccgaccggcgcagctggccgccgccgcccccgacgcagcccgccgccagcccgccgccgcctccatctcgccgccccgcgtcgggccgccggcggcggcctccatcctgccgccccgccggaggggaagggaggggaggagggggaggagaggggaggaggagatggggtgagagaagaaggaagagaaggatgggaggagaggaggagagaagaagataagatggagatggctggatgggagaggaggagattaggatgaaattaataggagactttgcatgcgcgtgtactggatagaggttttgttttaccggttgtttaacaaccgggactaaaaatcctaactttaccaaccgggagtaaagatcacggtctttactcccggttggtaacaccaaccgggactaaagttagaatttttagtcccggttggtgttaacaaccgggactaaagatcacgggagggcctgacagcccctgacaacatacgaaccgggactaaagatcccggttggtattaccaaccggaactaaagatcaaatatgcctactgtagctaccaaccgggactaaagatcatctttagtggaaccgggactattgtggattttggttgactgaccaaagatggtttctccaccagtgaaataataagaaaattgcaaaaagaaaaagtaattaaaaagatttgatgtgtctgcatcctggtcacttccaaaagtgtgacaagtttcatgaccaaattaagtaggcgttctggtggaaaaatgttaatctgggtttgtctgttagataactagatactatatactccctccgtttcgaaatgtttgacgctgttgactttttagcacatgtttgaccgttcgtcttattccgcagatttaagtaattattaattcttttcttacatttgattcattgttaaatatatttttatgtaggtatataattttacatatttcacaaaagtttttgaataagacgaacggtcaaacatgtgctaaaaagttaacggtgtcaaacatttcgaaacggagggagtatgtcccaagagggctaaacaccccaatccatgtcaccagaatcagaagatggtagcctggtatctatctaggcattggttaaagctgaaagcctgaaactaatgctttgcttcaggttacagagcttgaaaagttatctgaagaacaaaccaggcccccagaccccaagcctggtatgacgcaacagcttctgcacgcaatttttaattgagtccatttccatccaaacatcatgaaaaatattaacgagaattcacaaaacagtaagctcttattacttctgttgtgtaatgacaaagcatggatactactgaatccacttgcagatcacaacagccgctgaaatacaacacaaggcatcacagttcaattcaattcaatcgtggacagtctttgagcctgatgttctaccagagaatcgatttaaatatgaactaggaaacaaatgcagccctctcatacacaccacaagaacgaacgatacatttcagttagtcaactgaggactagcagcagcacaagtgcccatcaccacaacaagttgagcaagattccaacccaacccatgttctccaatcttcctttcagtctcgacgaaactcctggtcttcgctggctttttgtcgctgcgggtgattttccggatggaacaacctgttaggtaaatacatagatatcatgaaactgtgcagcaaaagtaacagttttcactagccacttatttcagtgcttacaacaaatgaaggtgattgatcctgttatgttgtctggtcatgaggtgtagcagtggaatttgtaggccgcctcctcctcttgcatggctctgaatcgacttcgacatcttcgtcaggaaaattctgatcagatacttctggacaagcaaaaaggaacacgaaacatgtgttaattccaggtttcatggctatgagaacttgagaaggatgacaattgatagtattaatcaatgaagtttgctgacacaagcaagaaacagtgcaacaccatacgcaattgcagtttactgatctgtttctgctgttccattatttgtaaagatccaaacacttgcttgtttgttagctagttttaggaaaataagtgttgaaaaaatctttttacaagttagatgtgattacacataaggtaataaatacgatgaatctatgaacaaagttgttctcgaaacagttaaaagtcaaaggcaaaagggaaaatttgtttggtgaaccatgatgcaacttgttgagtatatgcagaaaaaaacatggttacaaaatttgtgcattgatcaaacatgaattgaacacaatagctacttcaactcattaattttttttacatttgcagcaggggcaaataagatccatattatgtataacttttcatttaaaactgcaccatttcgagcatacttatttaccaactaaagagtctaactgcacagtcaagactgaataataaacatatcctaaactcgtatcaaaacagaagcaagacttgcactgaagaaagcgatttgcaaataagatgaccaaagtagtaacctgtgcttttatcagcaagaattcctccagcacaactcttcgcttctcttccatgcacccgaaccctctgtcggaccatgtcagtacccgactcatcgtcatccacagaaaaccccaccgcatcattcttgcggttcacaccggcatcgcgtggtctgaaacgccttatccatggattctcagggaagcagctcatgcctccatcatgagcgtgagcatcattcctctcagaccttaggttgtcgcacacaccctcccggtgcaccctgaacccaattgcgccacccgcatgactcctattcctgtcaagcccatggtggtcatgcctatagagttgttccatgaaggatgcctccatggagcttatgtacaagctgtgcctctcatttgtccatccatctgacatcaagtccaggaattgatctccctgccaagaagaatcacagcataaagttttttttaaaaaattcagggtctgcaaattgcttagctcatacaaaaaaattgactgaatactgctgttacatagtaggaaaggaagtcctgaaagcaaatgtccaagatcatatatgtattactatgttcttaatcagaagatctgatcatagacacaggggtggtaaatgatcaagtgccaatcttaaggagtggaaaaggataaattattcaattttagtcagttttttttaaaactgaaaatgtatatcttccttcagttttactatgacatcatcagttgccagttggttgcagtgacagaggatgccctgaaggaaatgttcaagatgttcattctccagtttcttaggcccaaatatgtgcatacagaaacgagaaatgtgtccgtacatcaatttgcaagatgtgatcaaaacgagaattttaaatttgtatggacaaatggaaatcaggtgcgcagaacgcatggttattgcagcctgcatgagactacacaaacagaaagtatggacactcccaaccaataaatttgatacaaataaattcgatcgtttaccttggtcagcggctcggcgttgatcggcgggttcaacgacacatcccccatgacaaaatctcccaagaagcaggacaaaaccaaacaaaaattgaaaaaaacaattaaccctggaatccaaatctctccaaattggacacccccccgaacgaagaaatcacaaggccctggattactacacaagcaaatcagaggggaacaagtgaacaacccacaaacaaatcaagaaaccagcaaatactttcttcttttctttttcaaaaaataaataaataaccgcgattcagagcaagaaaccgtaagcagagaaaacccagaagaacagaacgaacccgcgacgatctcgccttgcctccccggtggagggagagatcagagacgacggcgagatatatagtctagcgcgacgacggatcggagaggaggaggcggaggcggttcatccgggcggcggagaggggaggggggagaagtgtccaggtgggggaggtggggcccaccgcacgggcttttacgccgacgtggtggtacttttccacgtggcagccgcggggctttgtcggggggagaaatatctcggcgcggcgccccgatattttttttcgcgggggtgtgtggcaggtggggcccaccgggggtgggggtgggggtgcggaaaagatcagtgggcgggtgacgtcactagggaggggatggggtttgacaggtaagacacgctggccgagaatgggaggttgatggggggtttgccgatttggggattgaaagggtgatccgggtgggaatcttttcggggatattattgttttgatgcgcggatacatggaatggtatgcattatcgtatatatatacttccttcgtccttaaatataatagattttaaaaggacgtgacacatcttacatcctagcacaatgaatctagatagaatgtcggttcaaattcattatactagaatgtgtcacatccataaaaaaaatccctgtcgacgggggatacccgtagaccggatatagagggtattggggtacgctggtataaggatctacgtaatacgacatcgagtaatcaaaagacgagaattatactggttcaggccccttgacaggtaatagccctaatccagttgatatgggattatatggtggaaaacacatattacaaaggaaaagacggaactcgggagattcgacaaggttgtagtcgagatgatccgactagctctcgtcaacttggctccttgtaggctctgacttcgtaggctgtgttggttgtcggggctctgagattcgatgccttgtggtctccccggggggtcccttttataccgcagattggatgttatctgagtaggactccgatataccagacctgacacgatacgtaggtaacccaattcttgtccgagaaggtctctccttatctgttgtctttacgaagagtttccttaaatgccaaaggatttatccgtgtacacgtggatataccttgtcggtatgtggcgtgtatcgtggggtaaagggtatgcctgacccgtaaccctgacagtagcccccgacttctgctcaaaaatgaattcgtgtgaccgtttgcaactccgggcgtcgagaacgtgtcattcctggtgcgagaaccaaagagatgatgtgtagtcgagcgcaccgtttgaagtccaacggtcacgaatgaattttgaacggaagtccaaaaaaccgccatgcacaacggacttaaaaatctccggcggggatttctcctgtttcttggaattcgcaccgtcgggagtgcgtctatttaaagggatttagggcgtgagctttgaggtccgcctacttcattaggcatacactgctcctttgcattcctcgccttactcgccaccgcaaaaagcccttgcctcaccgattcatcgtccgttcccggcgatcttccggcgatctcccaacggccatggatcttgggaaatcgacctccaccgctgcgaccctgaagaagcttcaggaggagggcggcctccctggccgcgacaaggcggagagggaagcaggaggtactactccccaacccgtcctaggtcgcatggttgcgattgaggattacattgtctgcgggtttcttcctcccccctctgaattccttttgctagttttaaacttctatgggctttcactttgcacttgaatcccaactccatcgcgttcctcagcgttttcgtgcatctttgtgaggcctacattggagtagagccttttctagatttgtttcgcttttattacgagttgcgttggatggaatccaacaaagtgtctggctgcgttgggttccgacttcgtgacggaatgaagtcgcgctacgtccccttccagtgcccctcttctcgcaacaaatggcggaacatgtggttttatctcgagatcaaggactcggatcctgccctaattgttcctgaggagcagccggacaaaattccggtttggaccgccaagccccctttgaccccatctctccaatcgtttatcgacatcatcgatgatctccgagaacggggcttatcggggtatgaagtcatcgcagacttcgttggtaggcggatccagccgcttcaggctcgggcccacccggcatataactattccgggccagatgacgcgacccgggtttctcctcggggtatctttcttgtattcattttgatatgactgtactcgcgttcgctttcgacttatcggaaattaattcttccttgacagctctgagcagcgacggcgtggagcggcgcgttggtcaagtgatgatcatcggcccgtcaaccgcgagcaacatccccgcgcccctttgtgacaagggagcggtggaacgcgacgaggcaatcaatgtaagtctattcaaatgtctttttcctccttcatttggaatcagcttgtgatcggacttagcgtaggcccttcccttgactgatgtcatcggaccgctcgcggatcaccaggtggcggcttctctgaaggagaaggtggtcgaggaggcgtccgacgccgctgctggtagtggcggcaaggctccgagtaagccgaggaagttctcgtccgtgctcggacaccgtcgcaaggcggagacttcgacggtaacattcgcctcgtcgttaagctgagcgactaggaaggttcttgttctcactggcgactttgcagatttccgatgcatctcctcctcttgcgcgtcgtcaacgccttgtgacgatcggcgagaagtaagtcgcgaaacttctcagattctcaagtcttcttttcgaaccgaactctgatccgtcggtgttgacagggaggcacgagcgaaagcggctcgggccaagtctggggggacttctagcgcgtcccctgtaacagcgtcgactgacgtcgttcccgtgatcgggagtcaggaggcgacgccaagcggcccaagcagcgaccccgtcggaaaccgtggcgcgccagagtccatcctcacctgggaggagctctaagtcgagatggggcgccttcttgaagccggcgctcgcggcattggtcgcgaggtctcggaggcgagggcggagacagcggcggctaacgcgcgcgcggagcggctggtgcgggagctggccgaagcccgcgaggacctcgtgaaaatgagggaactagtggctggcaacgagcgtcaacgcaagggactcgagaaccgcatggcggaactcggagataacctctccgagatccgtggttctctgagggtcacatacaccggcctccaccagcttgccgcggagtgtggggtcaagtcgacgatccccaagaaccccgacgagttctccctaacctcttctctggaggagctggcgacagcgatgggagagatccccgcgaagcaggcggcccgacttgcggaggagacgtccaacggcatttataccggggcgtgtcacgtcctcgcgtgcgtgcggttgtcgcgtcctgagctagatctccgcgagatcttggaccagggggcggcgagcgacgcacgtaagggggtgatggaggaagtcggtgacctgggggagtctgtcgtccccctcttcgaagagtaggagtacttgtatttttatttccttctcatgatttgtgaaccccaaactttggttgtctagctctgttcatctttgatctcgaaaattcatcttatcgattgtagagaggtcgatgatgaggatgtccagtagcgcgggcaacctgaatcgatggcgataaccccggtactcgagttagaaccgagcgcggcgcatatcgtcgatggccagattgctgatgccggagccgaaatgacggcaactgacccgagtgagtgatctcgtcagccttattgctttttggtggtttccgagttgtcttaataaccatcacgtttggcagatctcgaggatgcccttgcgactcaagatcatcgtatccaatactagaagacgaaatgtgaagtggcggaactcgagagggcgatgctagccgtgaaaaaagatcaagctgtggaaacactccgaggtcgagaggtgtggttctcatcttatctgaagaattgctgcgcctctatggcgagggtgtgccgggatcttcgggtagcccgcggtgatcctgaagaatcggcggccgggtacatctcgtggctcaacggggcctgtgctcaactcgacggcattggtcagcgtatcgacgaggccttgaagcaagagtgtcgtcgagcaagccgatatgccggggggcatgtgttggcctgtgtacgagatcaccgcccgcgcctggaactcgaatttctccgtgagggttttaaccgttctcggagaaatccggcagagattgaccatctcgcgagatcaatgtcgccgctagccgagaagattttccaatcaatggactggcgttggccttcttggtagaatttgtaccttgtaacaagatatcttgggaaaagacgtaatgtgacaaaatatttatgtgctaacagtaaggaatactttgtgaataaagaaatatatatttaacaaatgtttcttactctgggtgttgtttgtaagagcgtgttctcagttaacgaccttagttagccgtttgagttgtacactctccctagcccccagccttgtcgtcggagggatgtccttgggtgacaaggctcttggacccttggcctgtcttggttgaataagctctgatcctagcccccagccgtgaagttggaaaagtcaatttctgattacacggcttggttaatacgcacggcgagaactcttacacgaccagatcttacatggtctttcgtctctgaaggatctgacaaggccttatcggctctgagcgtccccagccgaagatcccttgggttcctcggaggccttgtcgagacggcgtaaagggacataaggacaggtttcaacgctaggcgttgtacagagtgaggggttgtcaggtgaagacactttggttgttatatgggaccaaaaagtagtctttattgatactgtaagggtgcttacaggtacaatggtattgactcatacatagaatttacgtagttggtcaatgttccatgaattcgctaattcgcgaccgtcgccgtctgcgattttgtatgcgcctggccgcaaggcttgtgtgatcgtgtagggtccttcccattttggtgagagtttgtttcgccctgcttgggtctgaactcgtcggaggacgtagtcgccgatcgaaagtatgcgtgctcggatgcgcttctcgtgataacggcggagggcctgttggtagcttgctgctcgaacggcaactcgctcatgatgctcctcgagaaggtttatatcgatgtctcgctgttcatcctggttctcgtcggaatgcttctgtactcgagtactctgatgtcgtagctcaccggggagcatggcttcagaaccgtacacggggaagaagggtgtttcctcattggacgttgtcggtgtggtgcgtatggcccatagtactgatgggagctcttcaactcattttttgtcatgtgacatgagtctgtcgtagacacgggtttttatcccttgtagtactatgccgtttgccctttcgacttgtccattgctttgagggtgagagaccgaggcgaagcatattttgactcccaagccgatgcagtaatcttggaaatcggcgctgatgaattgggagccgttgtcggttatgatgcggtgcggtagtccgtatctgcaaaatatccctctgatgaacttgatggcgttatctgccttgatttctccagtaggtgatgcttcgatccatttggtgaacttgtcgattgctacaataggaatttgtagccgctctgtcctcgtgggaatggcccaagtatatctagcccccagcacgagaacggccaagtcagagggattgtttgaagcgcttgtgcaggtagctttgtgtgtttgctgtgaaattgacaggcttcacatcgctggaccatgtcgcatgcatctttgagggctgttggccagaaaaatccttgtcgaaaggctttgccgaccaatgtccgtccgacggcgtgtgacccgcatatgccttcatgtatgtcgaggaggagttgtctgccgtcgtcgatagagacgcacttgagaagtatcccgtttggcacctttttgtataaatcgttgccgatcatacagtagatttttgctttacgggttattttctcggcctctgtgtcattttcgggtaactcctcgctgttgatgaatttgattagcggggtgcgccagtcatctgttgtttcaatgtcagccacggcgcgttctacctcgatgacatctgagctgatgtcgggggtgcttgggacgacttcgccgctgacttcttttacggagggtttcgtcaggacgtcgagaaaggtgtcgggctcgagcggttctcgtctggatgcgcgtcgggctaggtcgtctggctcgacgttatccttgcggtagacgtgtcggacctcgatcccgtcgaacctcttctcgagcttcctgacttctgcaaggtacttggataactcggggttagagcatttgtagtctttgtgcacctggttcgcgactagctcagagtcccctttgacgattagtcgcttgaccccaagtgcggctgcggctcgtatcccggcgagtagcccttcgtattctgcagtgttgttggttgccctgaagttgaggtggattgcgtgtttgaattgatctccggatggagatgttaagataagtccagcccctgctccttggctattgagtgcgccatcgaacgccattgtccatgtctcattgtcgccttggttatctgacttgttatctggcatggtccaatcggccacgaaatcggcgagtacctgagatttaatggctgtttgcggcatgaagtggacatcaaattggcttagctcgactacccatttcgcaatgcggccgacaacgtctttgtttctcacgacttcgccaagagggaaggaggaaacaattgtgactctgtgggcttgaaagtagtggcgtagcttccttgatgtcatgatgattgcgtagagcagtttttgaatctgtggatatcttgtctttgcgtcatggagagcttcgctgacgtaatagactggtcgctgtactttctctcgctcaacgacaataacaatgctaacggagtgtggcgtagcggcaatataaagaaataattcttcattaggttggggagcaacgagtacaggtgggtttgataggtagcgcttgagtgtaataaatgcctctttggtttcctgcgtccatacaaatttgtcttgtttcttcaacaaggcgaagaaaggttgtccttgttctcctatcctggcaacgaatctgcttaacgctgccatgtatccggttagcttctgtacttccttgagtctcgtgggcgacttcatgttctcgattgctttgatcttctcaggatttgcctctattcctctgccagaaacgaggaatccgagtagcttgcccgacggtactccgaacgtacacttctctggattgagcatgagacgatatcgtcggaggttgtcgaacgtttcccggaggtcatcaatcaatgagtcgcttgtcttggttttgacaacgatgccgtcgacgtaggcctcgacattgttgccaagctaattgctaagtgcgccctggaccgtgcgttggaaagtgttgccagctgttatcaatccgaagggcattttgacgtggcaaaatactccgaacggagtgatgaacgctgttttctcctcgtcctccttcaccatgctgatttggtggtagccagagtaagcgtcgaggaagcttaatagttcgcatccggctgttgaatacaccagttggtctattcgagggagagggaagtgatccttggggcacgccttgttgaggtctgtgaagtcgacgcacattctccatttaccattggctttccgcactataactggattggcaagccactctggatggagtacttccctgatgaagccagctttgagaagtttgtcgagctcttctcgtatggcttgttttcgatctggtgcaaatctccgcagtctttgtttgactggcttggcatcgggtcgcaccattagtttgtgctcaatcacctccctggggacccccggcatgtcggacggttgccaagcgaacacgtcggcattgtcgcggaggaaggcgatgagcgcgagttcctatttctcatctagtgtagccccgattttgacattcttgtcggggttagcactagagagcggaacgatcttgacggcgccgttcggcttcggcgtcttgtttggctttctcactttcttgggtggctcagacgtggcgggtggagtgggcgtttgctcgaccatgtcgaggcttcgcttgtcgcactgcaccgccagttttgcgttcccttgaatagtgattgtccccttcggccccggcatcttgagtacttgatatgcgtagtgggatgcggccacgaacttcgcaagtgcagtcctcccgatgatggcgttgtaagctgtatcgaattcagcgacatcaaaggtgatttgctctgttcggaagttgttggcttggccaaaggttacaggcaacgtaatcttgcccaaaggtctggatgatgattggggagtaatcccatggaaaggttgatcagttggcgtcaactcactttgtggaattcccattgcctccagagtgctggcaaaaagaaggttgatcgagctgcccccgtcaatgaggacccgtgctaccttgatgttccgaatagtaggttcgaccacaatcggataccgtcctgggataaccgcggtcttgggatggtctgcttccgagaactccatcttctgctcggaccacttcatcttgggtgcagccccctgccatgtcgagcaaacttcgcgttccactttcttgtattctcgcttggaggagtacgtcgtggaaccgccaagatgtgcgaaacatggaggtcggagtctgggtacgcagagtccgattcgtgaggaggcgactcctcgttcttctcgacaacgcgtactcgcttgcctttctcaaacgccatgtgcttctcgagcgactttttgaaaacaaggcaatcctccagagaatgtctgtctgttttgtgtatggggcaccatgatttctttgtgtcgctgccttgtgggtccgggcgcctgggagggttcgcgtactctgctgcgagaacttccgcttgagctttccttttcccgtttttgcgatttttcttcttgctcgactcagatgtgtctgcggctgactttttctctcccccagtcttcggcttgtcgttcttgcgtcttagtgcgtcgtcgacgtgggcgcatctttcaacgatctggaataaccttcgagtagttgtgatatgccttgttgccaactcctgggtagtgtagcgatctctgacgccagacttgaaggcgcgaattacagaagcgtcggtgatttcggggatggtattcctgcattcgttaaagcgccgaacgtattccctcaaagattcacctgagttctgtgttaacgcgtgaagatcgtcctcgatcgcgtggcgcttgtatgttccttggaagttggcgacaaactgctgccacaggtctgcccacgaagaaattgagtagggggggagatgcatcagccacgaacgtgcagatcccttcaacgcggttggtaaatagtttgccaccgcgttgtcatctgctccagcggcataaagcactgtcgagtagacttgaaggaattcttctgggtcgatgctcccatcatacttttcaatagctccgggtcgaaatctctcaggccatcggacatcacgtagggaacgaccgaaagccctgcacccagcgctcggagcggtgggttgtcggtggtcgcgtgaccttcgtggatgtcggtctgacaatgaagaggacgcagaggatgatgatgatgacgatgggtcacttggttccggcgtgcgattacgagggtgacgacctggatctcgggaatcttgtcttcgtctctcgttgttgtctcgacgccgatctcctccatcttcgtcgttacggcgacggccgtgactagtgttgtctggccctcgccgatcatgatcatcgtggtctcggttatcgtgtgggcgacttcctcgatcatggcgtcgtgaggagacatggtgccgagagcgatttgcttcatcccgtgtgcgtcgtgcttctcggcgcccgttgatttgatctcgaaggtcacccgtgccacgaggtgggggggtagctcgttgaggtgattctctatgttctggaatttcgccgttagcatcgctgatgggtaatcggttttgttgcgccgcggtggcggcttcttcgaacgcgttgctgaggttagccaccgatgcccgtagtcgttccgtccaacgctcgaggtcgttgttcaggacaggatcgtaaggtgtttccctcaatatggcttgaacagccctgatatgttgggctggggtggtcgattgatccgccgtctccgcgtttgcttgtgctaacgtgccaacgtcatcgatagccaacacctcccgcgccgcgtctgatgtcgatgacccataatcttcgaggagatgtaaaacagatggttcgtggggattaagatcgattaccccaatgaaccgatctggggccaaagtcgctccttgttccttgccgttatcccggactgggacgtatgacttaggagacggagtttttatggcgccaagtagaactttgcaactcgagaggtcgtgattctttgtcttatggatgggacaatagacgttccgagttggggaagtacgctggattccacgttctttgcaggcgcggatctcagcacgagcgttgacgaatacccagcaatcttgaagagtatgtttcttggttttatgaataggacaccaagacctgatagtttcggaagtcatctttgctggcctgcggtttgtgtcggagggacaaggcctggtcgcatcagaatccttcacgaacttagatgtagtcagcaatccgttctccgtttcaacgggtggatctttcgacgtagaggcgtcttggtttgtaaccaccgcgttctcgtacccagtcattggaggactggttgagatcggcattgtggtgtaaaccggacagacgatttcgccgacttgagtccataccagcattgtcgaggtgggaagaacttgaccggaactggtgttgacgttgttgtcgacgaagcttgatggcataatagtagaaccttgaataccaaggccccctaactggcgcgccactgtcgacgggggatacccgtagaccggatatagagggtattggggtacgctggtataaggatctacgtaatacgacatcgagcaatcaaaagacgagaattatactggttcaggccccttgacaggtaatagccctaatccagttgatatgggattatatggtagaaaacacagattacaaaggaaaagacggaactcgggagattcgacaaggttgtagtcgagatgatccgactagctctcgtcaacttggctccttgtaggctctgactttgtaggctgtgttggttgtcggggctctgagattcgatgccttgtggtctccccagggggtcccttttataccgcagattggatgttatctgagtaggactccgatataccagacctgacacgatacgtaggtaactcaattcttgtccgagaaggtctctccttatctgttgtctttacgaagagtttccttaaatgccaaaggatttatccgtgtacacgtggatataccttatcggtatgtggcgtgtatcgtggggtaaagggtatgcctgacccgttaccccgacaatcccctatattatagaacggaggagtaatactttctccatcccaaaatagagtataagggattttgaaggatgtatcttctagtactgtctagattcgtaataataggagtacattctctaaaatctcttatatttttagacgtatggagtattatataagagcaagtataataaagcttatattcagcgggtgatatgaaatccaaatcatactaagtgataatctggatgagaaaggagaaaagatggtgcaagcggcgcacttgctccaaggcatcacaatactttgtcactgttgcaagagaaaagagagaaaatagcaccaaagagaaaatagcaccaaagcaccgcagagaaagtgattgatgtggttcaaaaataataaagcttttacttgtttaccgtgcttattatactctccaactattatgtttggaggtgggtgttgggaacccatctctcatacacggaaaacggagcggtccattaacacgtgattaattaagtattagctaatttttttcaaaaatagatcaatatgaatttttttaacaacttttgtatagaaaatttttgcaaaaaaacgcaccatttagcagtttaaaaagcgtgcacgtggaaaatgaggggggagtgttggaaacttgctcttgcaaacacaccctaagttgcttttagatgacgtggcacacaattatagctagcaatcgacgatactattaaacccgctctaagcatgaaataaatcggtgatatcttttttctttttaaggaccgagcaagcacatcctcggttagaaagtttaatggtatagtttactgtagtctatcttaaaatcaacatagtatattccccgaaaaaaaaaatcaacatagtatataatatatttgctataagttttgccttcatttttttcctattcctctctctttctcttactaatgcattcaatgtatttatcttgaagcacgtgtagaactagctctagtatgagagccaaaaccttcattttctattatctctctcctcaacataagcttatagctaacttataaggagttgtttggttcaatgccacactttgctatgccaaacgttagacgcaccacagttttttttggtaggtgttttgtttatgccataattgtggcttgctacactgttatcccacatgttatgggaccaaaattcctttgccaaatctggcaaagtgtgatggcatctaaacaagcctaaaattttcatatttcccatacataccatactagactaaaaagatcagaatacccacacttctcaaataccatgcaattattactctttatatattgtcaatgcatttattttctacttttaccaactctgatgcaatgactaattaaagattaacttattttggaacaaacaggagaaacaaagtaaatttattttaggatggagaaagtaggtagtagtaggagtgcaatttagatgtctttcttactccctccatctcattttaagtgtagttgtggatttccgtatccaacgtttgtccgtccgttttatttgaaaattttttatgattattgtttttattgttattagatgataaaacatgaatattattttatatatgcgtgagcgtgacttattttttatttatttttaaataagatgaatggttaaatgttggatacatgaacctacaactgcacttaaaatgggacggagggagtaatgcgtaatgtcatgttggccctagaatgataaataggcaacatatgtagccattgcctcacatatttacactaatttttttatggccaaattcgtacatgcaaaattatctagagaattggtgtatgaaatatgcaaaaccttctgcacttccattatttgtaaaaaaatatttgagggaaaagtataatcttttagagaggctggcggatataagtgac

SEQ ID NO: 65291 - DNA, 9658 bp, Oryza sativa
tgatatgaatattcccaaagtctagagttgaaaaaccacctaatgttacctaattaaatagcgaagcatctacctaaaatcatactagtggtaccatgagaagagtgtccactagttggggttttgtttaatctagggtgaacaaggtaataataccaataccaataataaggtcataacaaaggtaagtaggcatggctagataaaactgtgataacgcgggaatttaaataaagcgataatgcaataatttaaagcaacataattttataaactgggattcaatatgctcaaagatgatgtgacttgccttgctcgctttcccaaacgtcggcttcaacttccacgaagagcggatcttccgaagctgcagcgtctacacgaccaacggaaaagaaaaggcttttactctaataaactccatataacaagcaggaacaaagcacaaaaatgggttcttgacttcttaaggaaaatttagagacttgaacggtccaattccgagttcaaattcttaacaagcaggaacactggcctctccacgtaggtcaagtcttcgcgaacttcaatttgctctgagtcggcctgctcggatggcactcgaagacatttcttgagttgcgacacatggaacacatcatgcacgttgcccaaggcggcgggcagctccaactggtaagcgacttctccgcgccgagcaatgatacggaaaggacccacaaaccgaggtgcgagcttcccttttgtctgaaacctgtgtacacctcgcaatggcgtgacccgaagatacacaaagtcatccactgcgaattccaggtcacggcgacggttatctgcataacttttctgccgggactgtgccacctttagattatcccgaatggttctgaccttcgcttcagcttctctcaggatatcagtcccgaacacttggctttccccaacttggtcccacaagagcggtgtccggcatttgcgcccatacaacgcttcataaggtgccatttgtatgctggcttgatagctgttattgtaggagaactcggcataggggagactcttatcccaggtcttcccgaaatctaggacacatgcgcgaagcatatcttctaggatctgatttagacgctcggtctgtccatcggtctgcgggtgatacgcggtgctgaaatttaatcgggtacccagctcttcttggagcttcttccaaaagtgagaggtgaattggcttcccctatcagatacgattttcttgggaacgccatggagactcacgatcctagcgaagtagagctcggctagtttgttccctccataggtggtcttcacaggaataaatcgagctaccttggttaatcgatccacaactacccatatagaatcatatccaccttgggtttttggaagtccggtgatgaaatccatcccaatttcatcccatttccattctggtacttggagaggttggaggagtccggccggtcgttggtgctctgccttgacacgctggcacacatcacaaagggccacgaactctgcaatttcccgcttcatactaacccaccagtatttctccttcaagtctaagtacatcttcgtactgccagggtggatggaataaggactttcgtgagcttcctgaagtatcagctgtttaagttctctgttatctggaacgcatacccgatttccgttccatagggttccgtgttcatcctctgtgaaaccagcggctttaccctgtttcatattcttgaggagtccatgcatgtccgggtcgttcttctgagtgtcacgtcctgataaatccattccgaattaaaattcgttttcctaaaaggaataatagaattaattaaaattcgaaaagaaattggcaaacactaaaatacgtgcaagaaaaattcaaatgtgacccggagaatttttgttaaattctccttggtctaaaatgagccctcaaattttacttgaattttcagagcaccggaaatatttattaaacaacaacaacaattatcaaagttcaataaaaagaaaatctaaaaataatcctcctcttcctcctttgggccaagcccagcccgaagtccttctctcctccctctctttctctccctctccttctctccctcctcttgggcccccttcccctcccggcccactccctcctcctccctctctctcccgggctgcctcttttccccccccctcccctcccggcctgtccggcccaggccgcctccccctcctcccctcctgggccgtgtcccggcccagccgggcctctcctgcccgagccgcccctcccccccccgcgcacgtgcgccgcgcgtgcgctgagagcgcgcctggccgcgcggggcccacgcgccaggccgccgtcgtcttcttcctccgcccggccacctctctctctcttcccgtgaaaccctactcccttcctccctcaaatccgtgtgattcgctcatgggattccaaaattaaataggggaaattaaaccccattgaatcctcttcaattcccccttaattcctccttgaatggtgcccccaatcgccgggaacggccgcgccaagtccggccgccttcctttgccgccggccaccattcccgtcgccgttcccgctcctcccgtggccggctccctcccccatcctataaaatgggatcctcatcccccgttctctcgttttagccccatcccgagcctccccgtggtccctagctccctccccaccgtcgccctctctctcccacgtcgccggccgcctccagccgccggtgccgcctcgaccgtgcgccggccggccgcgccgtcgcctcctccagcgtcgccgccacctcctccaccccggcttgccctccgtttcgcgaggtgacccccggagctgccttcccgccgtcgccctcctcttttctccgcgccggccacctccagccgcacctcccgcctcacccgtgcaccctccggctgcgccgtcttctccctcggcctcgcagccacctcctctccctcggtcagccctccgtttcgcggggaaagcaccggagacgcgtcctcgccggcgtccagtggcgtcgccaccacttctccgtctccggccggctgctgttcgtcgccggtgcgccgaccgacgtcgccgtctcctccgttgacgtcgcagtgccgtcctctctcccggccaggccacggcgtcgcccgaatttcgccggaacgccgtcgtttccgcgccggcctttccttcctcctcgtcggctcgtcgccccgctgcaccaccaccttcaccaatgtcgcagcggcgtgttccacgccgtcccctcctccgctcagccgctgctgcctgccatcatcgtttcatcgtcgtctccgatcgttctcgtcgtcgacgtcccatcggtcgcccggctcgtcgtctcgcggcgccgcctccgtcgtcggcatcgcagcggcgtggtcctcgtcgtcctcgtccccgtgcagccgctgccggctgtcctcgtcgcctcctcgccggtcccggttgtcacgcccagaaatttagcccaaatttccagactattttgtgtattaaatccctgtccaggaccagccagggtacacaaaacgacaagtaatatacagttccgaacgtaaataaagcgtaaaatacttacagaagaggcacttagtcctcacaccgaaacaaaagcagcagcagcggaaaaaggcgatcctagcggggcttcagctccactccacaggcaaaactcaactggggtctgagccttggtcctctaactccatcttcagctcagaagcactacacttctgaaaagggggaataatagcaaggctgagtacaaccaccgtactcagcaagccacaccaacgatgcagacgtgcaaggggaacacaaggacggtttgtggctatttgcataaaggcggttgtaaaacattttattgagcaaaacagtaaaacagttgagtaattaaagtaatattgaatctccactgatcaacgctacgccacgttgaacaggcccaaccaacccacctgaactacagtgcattgggtcgatttattaggggtgagactaatcacggtgaatctggtcgatcgcccataaccgcgggcacggctattcgaatagttttactctggccagaggtgcacaactgtacccacaagacacaacccaccgacatgtcaccgcgtcatcatgtgcccatgatgcacacgtcaccatgtcgagtgattgtgacgagacccttcgcataacccttccctaaccatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaagggtcgagctatacttcagatcaagcagttacccattcccgcttgtggtaagcactgtaagtcttccagggtttcccgtgaaccggtccttaattgccatgggtgcgactcgcaaaaccatgcacccacagcccaccattcagtcgcattttagttggataattacgaccatgaaacatggccagatgtctcgagcacgcggctcaacaagaaactagaatgtctaatactgcaattatcccatcgactgagctagtggtaattaagcatggctaagcataaagttctagctaggtcatcaaagtaacacaagctaggcgatttattacccacggctgacaaaggacagatatcaagtaaacatggcacaagcgagcagataggtaaaccctgatcccgtgtaattagcaaaacatgcatatttatttgcaaacggtaaaacatttataaattgggatcaacatgctcaaggagaatgtgtgacttgccttgcttcttcactttgatcttccgaactcttttcctcgcgaccgcggacttccgaaacgacgggaactacacgctggcacgcaaaacgaggaaaaactctaataaaaaccaaggaaacagtacataaaaactaaacaaacatgtagagctcaattttagatgaattttgcaagttgaatggctcaattcggagttcgaatgaattagatatgaattttagaagttttgagccatttaaatggatttatataattaaactcgatttattgcgcaattattatttatttttacaaaggaaatggacctcgctgacgtcatcaaaggggaggggcggcgccggcaagcgggccccaccggtcagcggcacaagggcgccggtccaccgtggaccgggaccaccgaggcgatccaccgccggtccacgggaaccgacggcccggatcggcccaaagccgatcggacggccacgaggcggcgcggctggggcacgggcacggcatgaaaccggctcggccgagccgtggtgctgggcagcgtgcggcctccggaggcagcagccggcggcgccgaacggcggcgagcagccggaagacggcggcgctcacgggcagtggcgatgcacgcgaaagggaaggggagcgggaggaggggctcaccgagcgtgcgggccgacgaggcagagcgggaggtcgccggcggcgggaagaggcggcggcgctcctcggggaggcaacggcgacggcggttcggcggcgttccgtgaggaggaaccggcggccgatggtcggagggacctagggaaggaaatgaagaggttaggagagggtagggagttgcggtgcggcgggaaacgccgaccgaaatgacgacggagctcaccgggaggcacggggagatgagtccggcgacgaccggcgaacacggagggattgctgagccacggatgatggctgcggtaccgcggagggcgacggcacaacactgggcggactgaagaggcggtgcggcgcggccggaggcggaaatggcgacggtggctctggatgcacggtggaagggtggttgcggtggtggaatggggaaacggagcggaggccggggtagagcttggcacggcgttgccgacggcgcaagcggcgaggtgcggcgacgactaacgcggcggcagcggccggctgaaggcggtgtgtggcggtagtggctcggcctcgcgatgggaaggtggttccggcggtggaggagggagatggagtggatgccggggtgcggcgaggcgctgtgatgctataggtggcggcggcgcagcgcggcagcgacgggagcggcggtggcgggcggctggagatcgccggcgagcggcggcgaaggggatcggcgtggagagctcggtagagggcgtgggggactcgggaaaacggggaaaaaggaagaggagtccacggggattgattttatagctcaagggggcgaggagagggccggggagcggcggatttcgaggggaagtggggcggcgaagtggagctcgtggggaggtcaaaccggcgccgtttcttgcggggtgagtgggggaaaaggtggaggacgtggagggggtcgtgtccatgtggttggatgcgagctcgggtgcgggaggtcgccggattttgcggcgacgtggggcggctcaggcggccatggcggttgcagccggccagccagaggaaggaggaggagctgacgggtgggaccgccggtcccacctgtcggcgaagggagagaaggagggacgcaaaacagacttttgcaagcgggccaaggaagaagggagccggcccgagagagggaggaggcgcgcgggccgcgggagaggaaggagggggaggaatttgggccgagcccgaaagggaggaaggggaagtttattttgttttctttttatttaaattgattcaatgatctttgtgctattaaaactatttctcgagctccgaaaattcacggaaaattccggagagtacattagggcacaaagaatattacaaaatattcccggccattgatttttaagggaaaatttcaagttctcccattatttcacttgattaaattgatttatcttttatttaatttctagaaaatgtattattaatgatttttaatcccgaacgaaaatcggggcgttacaaatctaccccccttacaggaatctcgtcccgagattctgggatggctagaaagaaagctggtgctggtgggcggtttgactgatctgcacattgaactgccacattctgcttcgaactgattgattgactggttgatcaaacctgcacgattgaactggctggattcgacctttctgttcctttgctttgcgaaaactggaccgactggttctgcatgaactgacctagactagaactgtggctgctcacgaaacttacttatcttgatctgaactgttgatactggcagtttgataacctgacaattcaccaggctggctagagaagggtgaagttgttcctaagacttgcatctggcatttgtaactcattgatcctacgtccgcttgaacgggtcctggctcgaatgacacgtaattccaggaaacctgcttgacctgtcttttgtctgaactgcaaccgtccctgatgctgcctctcaaatctaagctattgacctggcctcaccggtgtacctcagaattcaatcagatttcttgagatcggtgtaactctgctgacaccttgcaactggcttcttcaagtactacccggattgttgcactgggttgaaccttcaactaaaacagcgatgaggtgagccaaaactcatctccgagacctaccccccttacagtgggtagtcttactttctcctgactgagaacctttgaactgttgtccttgaaaaataaccaacacttctctgatttgccaagagccctgactttgaaaactgaaaacttcatcggtccatcaaattgaagcaatggcgatgcactttcaccccgacaagatttggaacttaacccttagttgatgataggaaattccacataaaagtgactctcatttagctcatgaacacactgactcttgactaactttcccataagttctaactactggcatgactgtcctgcttctatcttgacttcggtgtcgagtttcaaaaactgaactaaccgactctgcattggaactgacacaactcgaggagttggggtgtcgctaacaaagctcttgatgtgatgacgctgacgccttactgtggaacaaccctctgagaggtgccctgtcatacatcttccatggatagttggacactttgcaaaaactgcgcttgaaaaccataaccacaataggtagcatatattactcctgggattggtggtggcttagctgtgctgatttgctgaggacttggtggcgtactatctgaggttgcgggtgcttcctctttgaaaacaaactgactatcgctctgatcctgattccggcttgcatctgagcttgtacttgttgttggagacactgttgttgcatctgttgcatcggactttgcatctcccgcatcaatacatccatcatctaatcttggacaccaaatgttgatcacgagcagggttcttctggcactgggataccttgtagctttcaactgaaccattgattggtgactttaatacaccgtcgttgctcttctctctaacactgactatcttctgccagggcggaagagaggaggaagagaggggttgctaaagataaggtactaagccacttgcctactgatctgttgtgagtagatttttatttttcaagttgcttaagcaaacaacctagtatggtcgcatccccaccaatgatgcaaaccatacccctacacacaagcaaacaacacacgatctagaagctaacgaaactactcttcagggaaggattgggtttaggtcatctccgggaaaactccacttgatcttcgcggaacgacgactccgggctgaacttcttgctcctactgcacgaagcttgaggcttgaattgacttccgaacagacatgaagctggcggtttctcctccatgtttgacaactaaaagagttggagggacagggaggaaaaattttaataaactgtttcgcaaagaaatgccgaagggcgagaggagacacttcgcaaataggattttcagaaaacttgtccttacggtttgaccatttggctcaacctacagtcaagttggctctgataccactttgtcacgcccagaaatttagcccaaatttccagactattttgtgtattaaatccctgtccaggaccagccagggtacacaaaacgacaagtaatatacagttccgaacgtaaataaagcgtaaaatacttacagaagaggcacttagtcctcacaccgaaacaaaagcagcagcagcggaaaaaggcgatcctagcggggcttcagctccactccacaggcaaaactcaactggggtctgagccttggtcctctaactccatcttcagctcagaagcactacacttctgaaaagggggaataaatacaaggctgagtacaaccaccgtactcaacaagccacaccaacgatgcagacgtgcaaggggaacacaaggacgggttggtgcttatttgcataaaggcggttgtaaaacattttattgagcaaaccagtaaacagttgagtaatttaagaatattgaatttcactgatcaacgctccccacgttgaac

SEQ ID NO: 65292 - DNA, 525 bp, Oryza sativa
gtcaaattacacattcaaaggctaacacattataaattacttctctttttgcaagcattacaccagtgaaagttgaacatatcgtcttacatcagggagtaatgctggcccttcgaaattggtgtcaatgtacttgaccaaatccaagctttctcctttcacctgattgttgtgctcaagtgaaggtacctatcaaaaagtaaaagtgcatacacagacccggcaaaaaaaagtaagtgcacacctatagcaaattaagctgtaaaggatttttcttttttattggagcagagttgagacttgacagtaacaaggtgttaggaaacgataggcgaacaaacgataaataataatagatcaatcatataagacacgagatttaacgtggaaaacccttccaaaaccggacagaaaaaaccacgggcgctagccagcaaaatatcttcattatatctggggtgagattacatcgccgcacggcggcttacaagaggtatatatatggtggaaccctaaaaagatgac

SEQ ID NO: 65293 - DNA, 3129 bp, Oryza sativa
cccatcaacggtggtgtgaccaaccgaccgtataggcggggacaccagtcggcggcgacggaggcaggccggcggtgtagatgacgatgcccatcaacggtggtgtgaccaaccgaccgtataggcggggacaccagtcggcggcgacggaggcaggccggtggtgaagtcgtagacgcccaacagcggcggcataataggccagccgtgcaggcggaaacaccagtcggcggcggcgaaggccagccggtcggtgaagacatgaacgcccatgaacggtggtgtgaccgaccaaccgtataggcgatgacaccagtcggcggcgacggaggcaggccggcggtgaagtcgttgttgctatcagcaatggcggtggcgaggacaagccggcggagtggactcgcggccgatcgaccggaaagctgagacgcctcgagtccatgaccagcatcaatcgcctcaatagtgccgcgtagttatatgcgaacaacaacaaaaaatagcaagaaattaatctgagattaaaaatcaatatgataaataatgataaaaatcagattgagtttccccctgactgatttggatcaagtcagagaagaggagcttgaagaagcggtcgacggaaaggaagtgaaaacttccaaagcgaaagcgaagtcggcgactcatgaaattgattccatcgcgctcgttgataggaaactcgacgcaacccctacctggcgcgccaactgtcgaaacatggattcggcaataataaaagggggtagcgcacgagacctaaaagtggatggatgcggagacaaaggatttagacaggttcaggccctctcaatgagaggtaataccctactcctgtttggggatttaaatccgccgggtgtgtattgatctgacgatcaggttatgtcatcatgccccctagagggcctcctgcccaccttatatagggtggggggcaggattacaagatagaaaccttaaccaatacggtatcggtttcctaaatctactttacaatattatcaaaccaggactttaggccgttccgtaatatataaggaaacgtaatacccgagtcatgatctattacatattccatagatataagttatcccctatgactagtcggataaccatgccgtatgggtatggggtacccataatatccacagtaccatcaaaaaatttcccttaactttcattccatcgatttttcctgtattctcttatgtacacgtatcatgacttttttctcttttaactttacttcctctatttctggacactattcatattaaaactttgacaactcacggtttttttaaataaagatgctataataatatcggtggcaatatacattgcacttctctaagtcgtctaaggccacacttgcttttcaaacccccatagggctcgttcggcgaattttttttatttataattttttttattaaaagttttacaaaaataatttttcattttgaaaattgacggaagtagtcgcctaccgccctctgggagggcgatttttaaaaatcgccctcccagagggcggcgaaaatgacgtggcagccggccgttcgctctcgggcgacggccgtcaacgaaatttgcaggcggcccccttgccgccctccgctagggcgattttatattgtgcggggggccgcctgcaaatgggcggcgagggggggcatggaattttgcaggcggcccctttgccgccctccgctaggtcgattttgtactatgcggggggccgcctgcaaatgggcggcgagggggcatggaattttgcaggcggcccccttgccgccctgggggagggcgattttatactgtgctctatatttttgtataaatatcaatagttatcaaatctttttatattgaaaactatacaagattaaaatctccaagactggtaaaatataattttattattttttagggcatatttggattgttaccgtacaaatattttgttagtgccaaaatataagcaagttttggcactaccaaatatttggtaaggtaaaattgcatttgatcatatttggtttgctgccaaaatgtaaaattgtagtgaagaatgttctacataatctcaaatctagattacgtattaccaatgaataggcttccattttcgtgtgtggtgtgctagtgggaaagaagatatgaagaggttgccttcagattgtcaattatatagcgtcgttttcactgcaatatatgtgaactcaatgagatacattattcattagatgtgacaagacgatcacgcgtgggcgtgattcactttatgtcaacaggcagcgccgaaagttgatagtgataactcgagctgccgcttttcatgtgtgctgttgtggactgtgcgcgctactggatctgacactaccgtgaagcgccgaaagtgtgttgtcgtgagcataagttgttctagcaccatatgaatgaaaagaactatgtagacgagacaaacacaagtagtactgcagtagtaatagcaaaagtagtactgctttacaagtttgtaagccaaaagaaacggtcacataaggactgaagaggtagaacactactgacgaggcctctacccctgtccctcctaccctgcgccctaatgtgcccctgggagtacgtgagtcggtccgggggtacggcacggccaacccgtcctgcctgtacaggtgtgacctctggctgctcctgagtgtgcgcctctggagctcctccaagctgagaggagcctagtacgtcgtggtggtgtgcaccgtgcaagtcgtcgtcgtagaactggctagtaggaccagtcctactggcgtgagacgaagaggccccagtaccgaagatcccggctgcaaatcctgctggacaaggaccatcagtttcgtacaagtatttaacagtagtaataaaaagtaaagtactgtgtgggcgagggatcgacgctccgtgagaggaagagctggcgaacgcgcccgaagaggtggcgaacgcccttgcggagctcgcggaagcgccggtcgtgcctgcgaacgcgctcgaaggcagacgaggtcctgcgatgaggaaacgtgcagttaaaacatggtgacatattcgtgcaaaagctga

SEQ ID NO: 65294 - DNA, 21366 bp, Oryza sativa
cccggtcgtcgtcgtcgtcgtcgtcctctcgtcgttcccggtcgtcgtggcgttcgtccctccgtcgagccgttctcgtccgtcgtccgcgttcgtcaagcgagccgctgcagccccgtcctcgcctccgtcctcggctccgcgtcgtcaagcctcgtgccggccgcgtctcgcctttgtccaaggatcgccgccgaagccgtcccctcgccgttcgtctccgttgtgcccgtctgtctccgccgcgcccgttcgtcgttggcgttcccacgcctcgtcgcgtggtggtaaggatccgtcctctcgcttccccgccctcgtcctttcggtgtcgccccgtacccgttgtgcggttgtcgacaccggtacccgtgtgccggtgtcggtagtcgttcgcttgtgcgtgtggtgtccgtgttagtgtgcccgctcggtagccgcgtggtttctacgtgtgcatcccgtgtggtgtctagtggagtccgtttgttggccactcgcctcggttgacacacggggtccgcttccgtcgacccgtggaccgtctctgtgtacccggtctaccgcggtcctttaggttgacatgtggggtccgcatgtcaacggcgcagccttcctgtcttttccaggctagcgcttacacatgttttatagttgcaaagcttaattataataatccgcaaatctccatataacagcattaaacttcggatgatcatatcttggtcatacgaactctgaatcgacccgttcaagtctcctaatgtttgttataacctaaagaaccctgtgctttctttttatgtattgttattgcttctttataggtttgtagctttgcttgtgtgcttcgcgtagcttctgtcgttccggaggttcccgaagcgtggttcgcggtcgtcgccgaaggttcggaagtccgttctctctgagcaaggcaagtcacatcatccttgagcatattgaatcccagtttataaaattattttgatttaaattattgcattaccgctttatttaaattcccgcgttatcactgttttatttagccatgcctatttacctttgttatgaccttattattgttattgttattattattaccttgttcaccctagattaaacaaaacctcaactagtggacactctactcatggttccactagtatgaacttaggtagatgcttcgctggttaattaggcaacattaggtggtttttataactttagactttgggaattctcatatcatatggacactatggaattgttggtttatggtggaattggacatacacctctcttcccctttcaaaacccctaaaacctgttttcggtggggtttgggtgcatgccagttgtgggaagtagcaccccggccactataaggattaagctcgggcctctgttgcaaagcactaccgtacttccacatgtctagtgggtaaggcttagtttgtggctcagtctagttataaacaaaagtacacggattggagatggatgaagtcgggggtcgatggacattctccagggcaaatgaaggctacacgagctgcggcccggtagtcgagatgtcatggcagagggttggtgccctgctgctaggggctcagtctcgcctgcctgtcccgggggttccggccgtaggcgggattgggtcggtactcttgtctatggctaggatgggttggaaactatgtcacgtcttccgtctgtataccgtggtggtatgtggcacgtggtaacacgtgaggaagatgtgtcttgtgggtaaagatgtacacctctgatcagagtataatctattcgaatagccgcgccctcggttatgggcaagccgagcaatgtacccaagtcagtgttataattcttaaaatttgctcaacaactaaaatgtggaatggttggcctgggttggcttgggacgagctgggacccagggtcgggttgccagttcggtctgaatcatcgtaggccttgggttaaggcaggttcgtgagggttcacggccttgattaataacactgtgtagctctaggatcgtctttataaaatggctttgggcaactaagtgacttttaaatgctgtttactgcaaaacttaacctctatgttattatccccttgtactcccttgcattaattgtgcatctccggtgtggcttgctgagtactgtggttgtactcattcttgctcaatctttccccccctcagtaagagcagcttcggagaagatgtcttaggaggagtcctggcttataccccagttgagcgcctgtgaagatggagccgtaggcccgcaagtccgctgctgtttatttttgtttgtcaggcctgaagtgcctttgtaataatgtaaatattatcgatataataaagatgtgtcttttatatcatgcttgtgtggtgtaccccggcttttcctgggacggggattaatacactggcgttcgggaaaaggcaattttcccggtcgcgacactgagcctcgcggatttgatcgagcaaggtgggcttggcttccaacgcaaccaagaatccacgacccactatgcttagattcagggcttccatctgttggttaagttcgggtggaatgccacggacgttaagagtgttgcaatggctctttcgacttagagcgtcggcgaccacgttggccttaccaggatggtagtgaattcccacatcataatccttgatgagttctaaccatctcctctgccgaagattcagatccgactgggtgaagatgtatttcaaactcttatgatcagtatatatttcactgcgattcccaatgagatagtgccgccagatttttagagcatgaaccaccgcggctaactccaaatcatgggtagggtagttgccttcatgaggccgtagctggcgtgaggcataggccaccacatgaccatcctgcataagcacgcaccccaatccttggcgcgaagcatcacaatacaccatgaaatccttgcgagtatctggcaaggttaacaccggcgaggaaaccagcttttctttgagagtttgaaacgccttctcgcattgcgggctccacacaaatttctcttctttcttcaacaactgtgtcatgggtcgagcgattttggagaagttctcgatgaacctccggtagtatcctgcaaaacctaagaaactgcggacttgagtgactgtcttgggttgcttccaatcggtgacggcggtcactgtttcggggtccacagcaactcctttagcagatatcacgtgccctaagaatttgacttcggacaaccagaactcacacttgctaagtttggcatacaattgatgttcccgcaactttcccaacaccagacggagatggtgctgatggtcttcctctgattgtgagtacaccagaatgtcatcaatgaacaccacaacaaacttatccaagtattccatgaacactttgttcattaagttcatgaagaaggcaggtgcattggttaaaccgaacgacatcaccgtgaattcatacagtccgtatcgcgtggtgaatgcggtcttaggaatatcttcttcacgaatacgtaattggtgatatccggaacgaagatcaatcttggagaatacagtggcacctttaagctgatcgaacagatcatcgatccggggaagagggtacttgtttttgatggtgacttcattgagagctctgtagtcaacgcacatcctcttcgtcttgtctttcttctccacaaaaatcacaggagcaccctagggggaagtactcggacgtatataccccttttctttcaactcttccaactgtttcttgacttcggccaattcatttgctgccatacggtagggtcgtttgtacagaggagtggttcctggagcaagatctatccggaactcaatctctcgcttgggcggcataccgggtagttcttccggaaacacatctccgaactccctgacgatggggatttctgacagtcctatctgatgaagttctgaactactgacagaggttgggggtgcaaagaaaacaaccgattgttccggccctcggtacagagtgacagtgcgtctcgcgcaatccactactccttggaattgagccatccaattcatcccaaggatcacatccaagttcttggtgtctagcagaatcagatccgagggaaaaggaatcccctgaatttctatagggacggcaggactataatactttgctgtcataacccctccaggggtggtgatgagcagagggttcctaagcctttctacccccaactgatttctccccacgaatggcacagatataaacgagtgggaagctccagagtcgaacaaaatggtagcagggatggaatgaatgaggaacgtaccaacgatgacgtctggagttgtcagcacgtcctcggccgtcacgtggttcacacgaccccgaatgacatccttaccaccgttgttggagcggggaggcgcttggccttgctggcgcctcggcttcgggcatttatccgcaaagtgcccgggctcgaagcagttgaagcacagacgctgcggacctgaagcgtccctgcggccttgaccagactgcgcagctggcgtaggaggacggggcacacgggtcccttgctggctctgctgttgctgcggctgtgggacgcgcaccacgaattgaggtcggggcgcggagcgaggttgttgctgctgttgctgctgcgaggacgatccccctggatagggattggtgtagcggaccctttggttagcaccctgttgattgcggacattcgccaagcggcgcttgtgcgactccagttccttgtgcttggcttccaagcggatgctcttgtccaccagacgttggaaatccggatagtcaccggagactagacggacggacagctcagggtccattcctgccaagaacttctcctgcttttcctcatcttcccgcacatcctccagggcgtaacgggccaggttgttgaactcatgcaaatactccatcacggagcggttgccttgcttcaactctcggaattcccttttcttaagggccacgactccggcgggcacatgggttctccggaaagcggcggtgaagcgagcccaagtaataggctgcccctctggctgcgtagcctggaaatggtcccaccatagagatgcgggcccctgcagctggtgggcggcgaagatgactttctcctcatcgctgcactgcacagtgtctagctttttccccacggcatgcaaccaatccaacgcatccacggggttattggagctagagaaggttggtggacggatgcggaggaactcggcgagtttacagtgttgtgggggtggtggaggagcattctgttgtggcggattttggaggtggtggaggaaagcagtcatcatgttggcctgctgggcgaggatttgggtgagaatagcgttggtgtctggtggtggtggtggaggcggaggaggaggtggaggtggactgccatggttgttgtggttgctgccttcgggttggttgccatcaccggtattagcacttctcctggtcgtcaccatctgaaaaccccacacaggaccagcaaacagagagagctgacaattaaagctaaccacccacgactaccataattcttgaatttattactgctattaaattagttcattaaagttcaagttgcttaagcaaataaaataaagacaggctccgacacagttataccacacaccggcataaccatgccccacacgactccaacaagaagacaaacgagaaagaatacacgcgcaagcctactaactgctcgtctaccgctgcgacgggccaggacggaaggtgagcaacagcgcatcctccgtgctaccaacgccggaggcttccccctcctgaggaaccacgggcgcgggctcggcacgaggggtctcgacgaagcaagtccacgccagggactgacgaacaagctcgggcctggaggtgctcttgcgggcggtgatcttctggctgcggcagacgcggcgacgcttggggcgacagacctctccctgggcgatcttgagctgatgcagctgcgcctccactgcgtctagttccttcttcagctgcagattctcttgacgcagctccaggatcttcatgttgttctcgaccatcccacggcgcaccatctgatggaagtcgatacgagccgcgtcgtacgcctccaccatgcgcgccaggtgcatgatggtagcgtcatcctccgagctagcatcccggaaggtggcgaagtcgcgggctcctccgcggcgagggtggtagcggtagggcgagtgctgcaactcgtccgggtagcgctggtgaagagtgccgatggcgaggagagcggcgttctggcaagcggcggggaaagaatctccacccgcggtgactgccaacgaagtccgctcgggagagccagtgaggatcactgcagtaacctcccaagcagcgtggggctctgcatcgtcaccctcctgctccggaagcggcctgccctggtagtccactccatgtggataccccaggacaacgcacatgccccgcagctccaagacgaaaccagtcaggtccagaccacgacggctgatgctgccggccatctacaaacaaaaacaaaaagaaaaacaacattttaaaggtcagattttggcgataaatgaagcaacaggacagagagagactagaggattttcacaaataagacaggatttttttttatttttgaaaatattgctaaggcttgggatctacggctcgtcctagggtcaaaggtggctctgataccaacttgtcacgaccggaaataacccaacgggcgttccttacgtgcgtgtattattccttgtcccaggaggcaaggtacaccaaaagttgatacaattcagagtttaacaagcggaagcgtaaatagttaatttattacatgggcagcgaaggcccagcacacacaaagacaaacgagaaacagtggaagactagggcgacgaccacaggcgcttgacggcagacacgagctagacaccaaagccttcatcctccaggaactcctcttctgggtttgggaaaaaattgagcaagactgagtacaaccaccgtactcaacaagacacacccacaagtgcagaataaatgcaagggagtacaaaggagttatactataaagggttagggttgcagtaaacagcatttaaagacacttggttgcgcaaagctattttgtaaacacgattctagaactatacaatattatttatcaaggccgtgaacccacatgaacctgccttaacccaaggcctacgatgattcagaccgaactggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagtttccaacccatcctagccatagacaagagtaccgacccaatcccacctacggccggaacctccgggacaggcaggcaggactgagcccctagcagcaggacaccggccctgtgccatgacatctcgactaccgggccgtagctcgtgtagccttcatttgtcctagagatgtccatcgacccccgacttcttccatctccatccgtgtacttttgtttataaccagactgagccacaaactaagccttacccactagacatgtggaagtacggtagtgctttgcaacagaggcccgaagaccggtccttatatggccaaggtgctactatcaaaaccatgcaccccgagcccagcctaaaaccattttggggattttgaatagaaggagcggtgtgaagccaattccacaataaccaaaccattccatagtgtccaggtgatatgaatattcccaaagtctagagttgaaaaaccacctaatgttacctaattaaatagcgaagcatctacctaaaatcatactagtggtaccatgagaagagtgtccactagttggggttttgtttaatctagggtgaacaaggtaataataacaataacaataataaggtcataacaaaggtaagtaggcatggctagataaaactgtgataacgcgggaatttaaataaagcgataatgcaataatttaaagcaacataattttataaactgggattcaatatgctcaaagatgatgtgacttgccttgctcgctttcccaaacgtcgacttcaacttccacgaagagcggatcttccgaagctgcagcgtctacacgaccaacggaaaagaaaaggcttttactctaataaactccatataacaagcaggaacaaagcacaaaaatgggttcttgactttttaaggaaaaattagagacttgaacggtccaattccgagttcaaatggccaagttatggccatttgaaggttatatgctctttaaatgaatatttgcgaatttcttcatttaaattttaatttaaaaatggatttattgcgtcagccgaggggaggggcgcgcggaccgggtccacgggggtggggcccacgcggcagcctcacggtccacggtggaccgggtgcacccgggctcgcaccgaccggcgccgtgggtcccacgcgtcagccgcacccgagggcgcgggcggctgacggccgggccccacgcggcagccgcggggcgcgcccgaaggcggccacgccggcacagccgacgggaggcggcgcactcgtgccccgatggtcgccgccggcgaccaccggcgcggcggagcggtgcccgagagaggggagggaagggggaaacgaatcggcgatccacggctcaccccgggtcgacggcgacgacgggaacggcgaccggagcggatagaggcggcggcgcggctcgggtcgacggggacggcggcgttccggcggtcggcgaccgaaacggagaggtggacgaggtcggcgaggttgcggcgaacccgaagaaggtgacgccgaagcgggagaaggtccggggcgacgacggcggcggaccggagctcggcggcgacggcggagagagagagcgatggcgcgagctcgattccggcggggagagagagcggcgagtggcggaaacggtggagggaggcacggggaaggtttatatagggttgggagtgggagagggcggccggacgagggggaaacgggcgcggaagatccggccgccattgatgcgccggcgaggttagggggaaagtttccgaacgaatccgagggagagagggaggaaaaaatgggggggaaagagggagggaatcacggggaatatttcccccctcttgattgcacgcgggacggacgggagcggcgggattcgcggcggcggcggcgctagggcacgggcgaggcggcgggagcggcgggaggaaggggatgacgggtgggccccacccgtcagcgagggtggcgggcgggcccgcccgtcagcggcgcgcgcgcggggaggaggccgaatgggccgcggggaagaggggagagagggaaagggatgggccgagccggcccaagagggagagggggagggaaagggaactttttagggtttttctttttataaaaccattttaactttgtttatttcttcttaaatattatttgtgctctgaaaattccactaaaatttatttacgcattttaggcttttaggaaatatacaaaaatcctccaagccttatttgacttttaactttgcacattttaattgttggaggctttcacatggattttaattattctaggcataatttcaaggatgtattttagagtcgttttgggacgcgacattcgagcatatcggctttgcatcttctcggaggttgttgatgtggtctaacccctcgtttgataggtagctgatgttcaacaatcgatcggctgagtcctggcatctcataatactcccaagcaaagcaatatctgaattcctttaacagctctatcaacttggttctaaattctgaagataagttcttactgataaatctcggccttggtcgatcacctggaccaatgtcaatctcttccaaatcatcggccgacatgaaaccctgtccttgcttgtcatcgagatcatctactatgtccttggtgtagacgtttgaaccctccacgacgccctcaaaataatagcttgggctctccatcttcaattggctgtttatcacaatcggacacttttagaaaatctccatcccaaacttttctagataagcaatcgagaccatccatctcccaaagagctaaattggcactggcaacgttgactgacctgtcggctggcacgatttcaatcttgtcgccttgccactgaatcaagcattgatgcatggttgaaggaatacaacaattggcatgaatccaatccctaccaagcaacaagctgtaagaacccttcccaccgatgacaaagaatgttgtagggacagttttgctaccgactgtcagttccacattcaaaactcctttggtttctgatgtattgccaccaaaatctttgagcgctgttgtcgaaacaacaactgcatacgttgaaagacgtggttactcaacggtggttggaaagaaagtaaagtgtattgaattgagaatttttcttaggatccccctgttacatgaccctaggagactatttatagccttattacaggttcttgctactagggtttaggttatacaggggaatttacttggctgcccttatgaaagggacatttatgtgggtatacagtgtaattgaggtacatgggctcctaatgggccgtcaggcgattgttggctcaaaggccactgggccttcgtgaggccgaacttgctatggcgaagtcgtctcccttcgacatacactcttcgccttacatccttcgcccaagaggtctttggctctgcgaggcacccgcgctattctccgcccttcgcggtctttgctccatagtcttcaccatgggggcttcgccccaaccgatcttgacgtcttaggcttgaatccttactggtcgcatggtttcggcaggtttggtcgaagggcctcatgccataccgccaacaagcccctcacgggcaagggtgagataggagcttcggccgagaccgtgcagaccatgtggtatggtatgtggctccccctttcgaccgatgctcctgccgaaacctatcttattcgtgcaaagaaagtgtgttgtgttttttcggttggtattgttttgtagctttcgcctcttgcggatggtggagttattttttttatttttcccgggccgaaaggaacagtaatgggctttcccttcatgggcttattactgtgcggctcggtcgatggaaatttaccgtttcgcctaccctcgcgacacgtgacgctttattactggtgggtaggcgaaccattgcctgggtgggctatatattctctccctcttttcccttttcactgccacacttgtcattttcactgcgcgcgctctcttccaccgttctatcctttcacggcgccccttgacccctcatatctttcgcccgttctctttgttcgccactgcacacacccttcgccatggctcctcgcaagccaaaccacgggccggattgacgacgacaccacagcctttttggggatttctctcatagatgacggcgagctggcgaagttggtcagctctggggtgttggttgaggggcaggctttcgcccctgggaaggccgtggtaccgaagcccgtcgacaaccagacggtggtgttcgccggcttttttgaggcggggcttcggtttccgtgcaacatgttgttgccggagatccttcaccttttccaggtagagttcccacagttgagaccgtcggcgctagtccggattgccatcttcgactaggcgtgccggacctccgggtttgaacccagcgccgaactcttcggcgccatattttttgccaccatgaattcgaagatggtggtgaccccggccggaacgaagaagacggtgttcgggagcgtgaacttcaacgttcgccccaagcgctccgatctctggcctgtgaatgccgccatgtcgaagtgcgatcgccactagatggcgaggtggttctatcacaccatccccttcgaggctgggtccgagtcggcgaaggccctccgatgtcggcgcatggtgattgcgccgaaccggaaacccaagatcgccgtggacggcgcaatggaggcacggttcgccttgctacgcaaggtctgctcccgcctcagctgccgcgacttggtggaggagttctgtatgcttcacatttttcccctctccctgtcgtggcaagtcacggttgaccaagacgaagaggtcgacggtttgccgaagctggttcttcctgaggggacgaatggtgagaccacgctttcgctatgcacttctgtgttttgctattttcccggttcaacgcttaatatggctacaccttttattttcatagtgttgactctcgatcaggccgacgctgaagcctggaagatgatcggcgatgtgtcggtcatcgagtacagccagctgctcacacgacaggctgccggtcgggcgaaccttgtttatgacggcgaactgcctccccgggcgaacccccacaaggccgacgacgatgcagggccttcgcgaaagggacgcgtggacaagtgaaactggcccctagaaagcgatgggtccctgcttgctccgattctgacgccgacgacgaggatgacgtcgaagagcgtgacgacgaggaggaaggggaggaagaagagggggcggaggctgcggccggaaaggctgcgaacgaggcggttgaaaaccgcgccgagacccctggctacactcctactccaagtccagggcataacgagaccggggtggagtcgaatagctcccaccttgatcgaaaggatttggagggagcgaaggtgctggttgcgttttcggcgggcaaggtggcgaagggggtagtccggttaagaaggccgccaagaagaaaggactcgtcgatgttgctcgtgtttttagcgacgacgagtcttttgacgaaaccccgacttcgcccgccagtcgcagcttagatctttcgaccgcccccgttgtttcgatcgacgctggcggcgcaggtggcagtgccgccgctggggcctcagcctccgctgatcgtgtcgtgaaggctgcagctagggttttcggaagccctttgcgtctgccagttgtttcgccgctagagaagccgaaggggaaggggggggcccatcgaaacatctgcctcggagtattctctcgcggcgccccacttcgcccccggcgattttgagacccgggcggaacttattccctttgttgagggggtaagcaaccttgtctctcctgccggcaccccgagcctattcaccgagctgaatgagttcgacgaagggtgttctgctattaaaagcttggcagttcgggtatgctattcgctctctcttcttgtttgtctttattttcatattacagatcccacaactaacatttgctctcttcatccgttttaccttacatccaaattcttgcggctcattgttcgacagagcgaaccgtgcgggcccatcttgacggatttaggaaccatcttcgggccaaggatgatgagattggccgcaagaatttggagatggaggccctcgccaacaccctcaaggaggcaaaggtggaaaacaagcgactccaagccgaactggagaagggaagagaggctagagctgaggtcgatcgcctcaaggccgagcttaaaaaggaaaaagcccattccgccgcgctaaccgactattacaatcttactgagccgaagatagaggctcttcgcctggaggttagcaaggctgaggcaagcgctgcagaggagtcgcaacggttttcgtgggagatggcgaaagccaccgagtccgcaaaaaggcatgccaaactctccgccttgccctttccgacatgggtgcgagggtgcgaggagtccctgccaaagatgcctctatctttgacttttcggagtggacgcaataggccggtggtgcggtttcggactacgccactgcgtacggtgattcctgtgcacatgtatcggcggcgttcactatgggccttctacagtagtttggctgtgagcatgtcgccgagttccctaactatgcgaagggggactgggaggttagtgcacaggacgtttcgcctacgctccatgcgtggcagaagcagttctggcagaaggatggccgatccactgctaaggcgcgccttttggagcaactggcgaaggccgaggcggcagaccaaggcgaaggcaaggatgcggcagaaggagggggtggaggcgatgcccaggatcacccagagttgtgaggccctccgccctttccttagatttttgtagtttttcttcttgcgtttgccgtgaaaggcgaacaatgtatatttggctgatggccccttacccttcttattgtagccgaaaatgaccttttggatatttggaatgtatgacttagtcttagtcactttttatggtcgatgcctttggtgcatgtgcttgcgccattttcgcattacgtaatatttgctctttttcgcccattcttactatgcaattcaccttttgccctatctgcactgtttagcagggtgttcgccgaaaattgtgcattcggcccctctctgggaattggcaaagcaaaaacgagaaattcgtggtgttgaagggtctgccaaaagtgcgatgctcgtttcggcctgtttatcgcgagatggtaataaatggccacagctataaggtttttaaggttgctggctggctgcgggtgcaccccgggcgaaccttagaagattacgatcgtgttcatacaaaatgtttggaggatatggttcgcttttggcgaagtcatcagaagaccgatcgacaggaggcgatctcccagcgtcgttacagtctagtctgtgtttcgcccccttctccacttagggtcgtgtatgatattagtagcgatgatgatcctagttcgcccaaccattccttagagagtgaggacggttgtgggggcgaagatataatttatctgtaggctgggctgcagagccatcgcttttctttacttgtaccatgttgtatggtttgtattcttggatgtgtattttcctcgaagtcaataaagatgtgctttatttccttttcactattttttgcattgtcacttctcgtgctttcgttaggtcggaacatgtcggcccctttgcgtgtattagcgaaataggtctatgacttttcagctttcggcttccgttttcgatctgttttattctacattgaaggaagcacttgtgctttcgttttgatcgaatgtaacggtgttcagttagttgtttctcgaaacaagatgttgcggtttcaacgttcggcgagcggtgcttcggccgattcgtttcgccccctggcattttcgctgatcaggcgtttgccttagggtttttccacagattatcaatcacacaaataagaaggcgagagacacaaagattttatactggttcgggcctccagggtggataatagccctacatccattttttttgtcttttttttcattttcctcttttttttgcatttttgtgtcgaagggcttacatagtgccgaaaggcttacataacaatatgtacatttttacatgttggcgatctgggtgccacccgttctacacatagaaacgctggagagaggcagcgttccaggaatggtcgaactcttcgccttccagtgtcgccaggcgaaaggagcccgtcctggacttgtgcttgatgaggtacggtccttcccacttcgattcaagcttgccaaccgccactgggttcgctttcttccttaggacaagatggccaggcaacagctccgtcggtcgaacttttttgttgtaagttgccgatgtgcctgtggcgtatttgcgcatgtgttcaagtgcttcgactctcaccccctccaagagttcgagcgacacttcgcgcccctcttcgcccccagagaacatcacccttggtgatgaaagatctatgtactagaattgccttgtaaggggagattggaatatctatgatcctaagagtgtggtgattgttttggtgattaatgacaacccattgttggaactaactatttccatgagttggtgagattaggttattccggcatcaagttaaaagattgaagctagaagatggacattataccttgatgaggagtaagtgaagacattgatgatgcgggggtatgaaatggctatctatggcaaaccggtgaagagaaagaaaggctcagctagaagatggacattataccttaatgaggagtaagtgaaggcattgatgatgcggagtatgaagtggctatttgtcacgtcctgataaattcatcccgaaataaaaatcatcttctaaaaggaataatagaattaattaaaattcgaaaagaaattggcaaaccctaaaatacgtacaagaaaaattcaaatgtggcccggagaatttttgttaaattctccttggtctaaaaggagccctcaaattttagtggaattttcagagcacaaataataattattaagaaataaacaaagttgaaaaggttttataaaaagaaaaatccctaaaagtcttcttttcccccttcctctcttgggccggctcggcccaactctccctccctctctctcctctccccgcggcccatcggcctcctccccgcgcgcgcgccgctgacaggcgggcccgcccgccaccctcgctgacgggtggggcccacctgtcatccccgacctcgcgccgcgtccgccgcccgcccgtgccctagcgccgccgccgccgcctattccgccgcctcccgccgtccccgcgcgcattaaagtggggggaatcactccccgtgattccctctctcttttccccctcttttctctctctctctccctcggatccgtttggaatcgctcccgcaatcttcgccggcgtcttcaatggcggccgagatctccgcgcccgtttcctccctctccggccgcgctctccccctcccgacgctatataagcgttccccgtgctctcctcctccgtttccgccactcgccgcctctcctccccgtcggaatcgagcccgcaccgtcgcaccttctctccgccgtcgccaccgagctccggttcgccgccgtcgtcgctccggacctcctccccactcggcgtcacctccttcggcttcgccgcgtccccgtcgacctcggccacccctccgcttcgctcgccgaccgccggagcaccgtcgtcctcgccgtcccgaaccgcgccgccgccttcctccgcttcggccgccgttcccgtcgtcgccgtcgacccggggtgagccgaagaccgccctttcgcttccctctcctctccgctctctcgggcgccgctccgccgcgccggtggtcgccggcggtgaccatcggggcgcggtcgtgccgcctcccgtcggccgtgccggcgaggccgccttcgggcgcgccctcgcggctgccaagtgggcccggccgtcagccgcccgcgcccgcgggtgcggctgacgcgtgggacccacggcgccgaccgccgccagccgcgtgctcccggtccaccgtggaccgagaggctgacgcgtgggccccactcccgtggacccggtccgcgcgccctctctctcggctgacgcaataaatgagtttttaattaaaatttaaatgaagaaattcgcaaatatccatttaaagagcatataaacttcaaatggccataacttggccatttgaactcggaattggaccgttcaagtctctaatttttccttaagaagtcaagaacccatttttgtgctttgtttctgctgttatgtggggtttagtagagtaaaagccttttcttttccgtcggtcgtgtagatgctgcagcttcggaagatccgctcttcgtggaagttgaagccggcgtttgggaaagcgagcaaggcaagtcacatcatccttgagcatattgaatcccagtttacaaaattatttttaatttaaattaatgcattatcgctttgtttaaattcccgcgttatcactgttttatttagccatgcctatttacctttgttatgaccatactattattgttattgatattattaccttgttcaccctagaataaacaaaaccccaactagtggaccctctatttatggttccactagtatgaatttaggtagatgcttcgctgattaataggacaacattaggtggttttataattttagactttgggtgtattcatatcatttggtcactatggaattgttggtttatggtggaattggacatacacctctcttcctctttcaaaacccctaaaacctgttttcggtggggtttgggtgcatgccagttgtgggaagtagcaccccggccactataaggattaagctcgggcctctgttgcaaagcactaccgtacttccacatgtctagtgggtaaggcttagttggtggctcagtctggtcataaacaaaagtacacggattggagatggatgaagtcgggggtcgatggacattctccagggcaaatgaaggctacacgagctgcggcccggtagtcgagatgtcatggcagagggttggtgccctgctgctagggggctcagtcctgcctgcctgtcccgggtgtcccggccgtagggggattgggtcggtactcttgtttatggctaggatgggttgggaactatgtcacgtcttccgtccgtataccgtggtggtatgtggcacgtggtaacacgtgaggaagatgtgtcttgtgggtaaagatgtacacctctgatcagagtataatctattcgaatagccgcgccctcggttatgggcaagccgagcaatgtacccaagtcagtgttataattcttaaaatttgctcaacaactaaaatgtggaatggttggcctgggttggcttgggacgagctgggacccagggtcgggttgccagttcggtctgaatcatcgtaggccttgggttaaggcaggttcgtgagggttcacggccttgtttaataatactgtgtagctctaggatcgtctttataaatggctttgggcaactaagtgacttttaaatgctgtttactgcaaaacttaacccctttattattatccccttgtactcccttgcattaattatgcatctccggcgtggcttgctgagtactgtggttgtactcattcttgctctatctttctcccccccccttcagtaagagaagctttggagaagaagtcttaggtggagtcttggcatataccccagttgagcgcctgtgaagatggagccgtaggctgctagtccgctgctgtttatttttgattgtcaggcctgaagcgcctttgtaataatgtaaatattatcgatgtaataaagatgtgtcttttatatcatgtttgtatggtgtaccccggcttttcctgggacggggattaatacactagcgttcgggaaaaggcaattttcccggtcgcgacaagatggtatcagagccatctcgactgtaggataagccaagtggataaaacctaaggacatattttataaatgaaactatttgcgaaagctcctctttttctccttcccctaatgctatttgcaaaaggtttactcttttcttccttcaaatttcaactagtactagatggtcagctttgctaagaagaagatatcgccaattgtttgccgaagctccggaagactgcaggatccgctagcgaagcaaaggaagcagtgaagccagatgtgaagcaggagtgaagatcttggaaaacccatcgcagaacctaagccgtcctctagggtagagtcgtttgtcgtgtgtttccttgcttgtgtgtgtagcgcgtggtttgcatcagtggggtgtgatgtaaccatgctaggttgtttgcttaatcaacttgcagaataagcctaacatacatcataacagcaaaagacttagatctgttaaggtcctatccttagtttctaatctttctctcccctttgttttccctctctccctctccaaatctttgcaacagatggctgacaatgagaaaggcaataaggtcagaagtcaggacattggtacctcaagctcccgagtgaatgaagcaccagacaccagttgtgtgacactggtccaacacctgattaaccagaaccgattgcttatagagatactacagcagcatcagacgccaattctgaacctgagtcaaatacaacctcaagtgcagttggaggcagtccaagcactcacaccacaagtcagcatgccgccagcatcccgaaggactcatggtgacgtgccacatgttgacccaaaagaagcaagtaacatttgctttatgtgtgatgagcaagggcactatgcaagggagcgtcctcagcagaaaagaaaaacaccaatgcgaaccgaagatgaagtccgtaagatgatcattaccagcacagaatggcctccaccaggaatgacaagacgtcagagaagaaataccttccgaggtgcaccacagttgacagagcatcttttagctagtggaggtagagtgtctgatagtgaagattcagatcaagtctcctcagatgatgaagatgaaatggaacgtaaggcatgctctcgttgtggagaagtcggtcatgttgccagctcgtgtgccactacatgcgttcattgtgaggaagaccatccacccgacaggtgtccaacgagcaggatcacttgtttcttttgtgaaggaactgatcatgtaccaaaagattgtcaattcagttttctgctgacgaagaagatggccaaccaacccgccagttccaacggagagaagcatcaaggcaacacaaatccccgccaagattaccgtttcagcctaactccagtgccaggacagaggaatcgaaatgagaaaagaaaatgccgagtccgggaagacatctgttgcttcaattgtcaaggaatgggtcatttcgccgacaagtgcccaaaaccgagaaacatagctgccggcacgtcagtccacgcaactccctgcaatcagaagcttgctcctcagcaaattgtcatccatgcatcccgaagcagtcctatagcccgcgttgca

SEQ ID NO: 65295 - DNA, 1492 bp, Oryza sativa
  unsure (1)..(1492): unsure at all n locations
aaaatctacatttggaagttccatataatttgagctaaaagtcgtatgattttgagttgaagttgaaagttttatatgagaatgctactaagaaggagaaaaatatgtacactgaaaatgtacgtgcgctaattagcgatcccctttggtccttttctgagagcggcgcctatgttgttactgctgatacattagtggtacacggaagatgatctttggcttactttcctttgtttttgagacactgacatatagacccgctggatagagggttcacatgtcaaagaaaagtaagttacagagtctcaatccggtggtacactggtacgcgcttggagattgtccaacgagacaaacggaccgtccgatcaagcgagcagctgtgatcgaagccgtctgctcaccttgccagcggccaaacgggcatattgaaggagcagagatatcgaacacgtttaagaaaagggaaaaaaagtaggactattgagttcgtgaaacaccaacgagtaggaagaacctggaccaggaagtgtcatgtgctcatgctaggtcgccggtgccatcacacaaagcagctgtgcaagaatctgctccttttcaagagtgtttggcaacttgctaacattccttcatcagtcaagtggtaaaccccgcatcgaagttaggtgaaaaaacaggtgtgagctttcgaagccaatcaggcgctcacatggtggtgcccagctttatcaacacaagaacagaatcaggcttacattatcttacatataatagtaatattcacataaagtaaatttagacctaattaaggaacgtaaaatgcatcacccaattcaaaaggaccaacacagcaacagttcgctcatgaagggaaaacttgtttaggtttatctgtttggagatacagcactgcaggaataaagtagtgcatgcaaggcattaatatgtttggacccacaaagtanagaaaatattcatcagtgtcactgagatgcaatgatgtgttgaatacaactctgatgttagttagatgtcaaaagaattgcacattnttttagacctcaagcaaatgcacatttgcacgatggaaatcccctccagttatataatgaggctgtagcagtgtatttacctttacacatcattcagggctaaatttactggacaagaaggtatgttattatacatcatgaaataactatgatttcaaattgtgtctaagcatgccattgcaagcaattttccaattaatgtaaaagcttaaaggcaaccaagatcatgttgttgagttccattgaagaattcagagattgaggaaagcacttatccagatgatcttttatttcacaaccgtttggtggcagtgcacgtattccactttagcttgcaatagatcctaagcagccaaatcacaatatgttgctagagacatatgtatcttttatgtatcttttataaccaaccaacacgatcttcaggaatggaccaaaga

SEQ ID NO: 65296 - DNA, 1062 bp, Oryza sativa
ttcttgcggcggcttaaggtggagctgaagctgccggtgctggcattggtggactccaacccatatgggctggagatcttgtcagtgtacatgtgtggtccaagaacatgtcatatgacagggccaacctgacaacaccggatattaagtggctcggagtgcggccaagcgatctggacaagtatcgggtgccggaacagtgccggcttccgatgactgatcacgatatcaaggtggggaaagagctgcttgaggaggactttgtcaaacagaatgaaggatgggtgaaggagctggagacgatgttgcggacgaggcagaaggctgagatacaggctctcagttcatttggtttccagtatctcactgaggtctatctacctctcaagctgcagcaacaggactggatttgaggaccctttctatgctagatgaataggtgaattttcatgcatttatttgactactgcgctgtgcactagatttatttatttaaaataaggtatttttgagaatcagtattcccatgggccatggctagtcgaagtcaaaaggtagctccaaaatgttcagtcaaaatgcatggttaactaatttctatgttagattaggttctttatgttaggttctttaggaagtattgcacacccctgactgagagtttgtaggatcaaattgataagggtgaccaagattgcctcgtagtaccgtcagatgtggaaatcttcttctagcattatgtatttgaacagcagctgctgtgtgtattcactaatttttaagaacatggaaatgcttacttcagcatgtattcagagcaggtatagtgacaggaaattcaaatgttactgtgatattactcatgtatcctgagcatgtattcaaaacaatgtattccagcatttatgtgccaactccatgtttggatcaatgtagaattggagctgttcacatgtgtaactgagcacatcatggcatgtttttaagaggcacaacaatacagccatgggcatcttggacatttgttttgcaatcaggtttcaaatcttgagcgaacaaact

SEQ ID NO: 65297 - DNA, 971 bp, Oryza sativa
caatgatcaaactttattcttcaaccaatgaaccaaagcaacctagcatcttaattaccaactgaactataggtagttgcattacatcacatctaggctgaaactaatacgatgcttgcttcaaaacagaatatacagattatttctgaaatgctgacatgctagtgacaagcatggtatggtaacatgggagagctaatgctagtgagatatacataagatgcttgagctttctggccaaccatgcatgctaccattttgtctggttttccttcctatttttatgagctgaaagcaacagcgaagagggaggagtccgtggtaggtatgaggcatcttcagggtgagctagcagctggtttgcatggcaccaattttctcacaacaaatccccaaccaaaatgcatccaaggaagaaaagggaaaggaaataaaagtaaggaggacatgaaaattgtaccaatggttgttgattatctgatcagcctgctaacctcttctagaaatgggttcagaacctgtacttctgagagggaaaatgacaacaaattccaataattgaattggattgggttatttgttaggacaaatgcatggtgatgtttgcatctgatcagcatctgacatgcttgcactgcacgcactgacttgctctgcaaatgttggcgcagagcagcagcagatctgtgcattaacttgtggagatgtgaggagtaaaggtagtacaggcaggtgatccacatgtatgtgagtaactctgatgatctgatctctgaagcccattgcagtaatatgcagctgttctatggatcacagatccatggatccagccaactgctccatcgtgggctccattaacaagctgtttgcactttgattaccctgaactttattctatccataaaactgagattgtcttcaggaaaaaaaaaggaactaatctaattccagatactacaagacaatgaaaa

SEQ ID NO: 65298 - DNA, 1458 bp, Oryza sativa
gaacccaaccttcttatggttatggggcaacgcgatgaagcgtgcggccttgcacaagcgcttcaatgagtacccaatgtggcttacttttccattcagaaaaacatcgaatatcctgtttcagatattttttgtttggatggatgaattttccggttaaaaggacagataccgacagtggaaagagtaagtacggtttttttgttagggatgaacacaataataaaataagattcagtacatgccatcctgtcaaactaatttcacattaattaatgatcaaatttacttttggcgatcgtgtaaaattaattttgccatgaaagaatgaatgcagagagtagctctttctttttcttttttattaactatttttttttctcttccaaaatttgacatttcaattctagtatggcatctctctgaacatgcctatgtgtctgtctgttgtagaatcatatgatgattaatcttggtgatgaacaattgtcaacggtaagtgttgttgaaaatacggtggatagtattttcgaatggtgaacactgcggtcggcaccgggtgcttgtcagaccgggcaggaggcaccggtcagaccgggcggcccgatggtctgactgagtgattccaagagggagtcggtttcgggttgtttttatggaatttctagattgattcatgtttattatttctagatggtttctattcgtatgtgatactattgtatgctgatgtgagtcaagttagcgtgaacttgtactcagatatggagtttcattgttattcatgtgcaggtgttgcttgaggctatgggagtatagtcggtgatggatcaggactaggctcggaagaagttgaggtccagacggtcaaggatgtcatgcgggatgctcaagctagagaacaatgtacatggaggtgaaggtttccatatggcatacacatcgtgttgtgtgcatatggaaagaggagtcaaatttcgatcggagtccaagtttggaaagactagagtttgtaaagtttgtttcttatacgggaaggactttttgtatgagttggattcgtggctagggacagccatgttatcggtataaatagagagggaggatgttgtctgccggtatcaatggatagagagttgagttgagagataagtttgggtatcaagtctagttcgagattttggtgaggagtgatgttggtgcactttgtaaacactagttgatgcaataaagtcgagatagattaatctacatcttagagttttcatctatcggtgttttctggatctcgacggtcgatggtttgaccgaagtattacgagcggtcaccagcggcaatcaagcagtcagactggcggcggcgagcagtgacaagtagagaggcggtggtcttatcggccagacaacacctgtcagaccagcggcataggagcggtcagatcggtgcgcacatggtgg

SEQ ID NO: 65299 - DNA, 8577 bp, Oryza sativa
ttgaaaaaactaacaagctttatttgtctttttctcttggatttgctttgcatgctctcatgttgttaatgagttgactttgacaaaagaacgttttgaaaaaaaatataaagttgctttttgtgcgtgttctttgttcaatgttttgagtgcataaaggattaaacaacacaaatatgttttggtttctccaaattgctcaaagtgttttttgaatgaaatgagattgaaagatgctttagggcgtgttgagtatatggaggatcttgtaaaagctgatgaggtgctttcttgttctaattgtcacaaagaacaatggtgttttggttgatgatgaaaattgtgaaaatttgacaaaagaagtttcttatttggaaaggttttctgatggtaagaagaaacttaacatgatttggataagtcaaaagtgagtgcttataattgtggtgtaggttttgataccaatgcccattttacaaatcaccgatatgttgtcttgagcataactgaaaaaggtgaagtacaaaacccaaacctaaggagttttgccgtctctttcttcgacgactcaagagaaaaagactttcattgcaaaaccatctacttcaaaaatttcttgtcgtgagagatacacttgttctttttttggaaaagatgaatatttggttggtttttgttttagacttgtccgcaaacagaaaaaggaaagagaaattgcttttgcgaaacgacagtggcaaaaacaaggttgtggattaaggagcttggttagaccgacactaaccaatcggtcatactagttgccaatggcggtcagactgcaggtatatcaatggtcagaccggcgactaggcccgggcagactgcaggtacaactgcgatcagaccgacctcggggcgattttgcgcgtaattcaaatcggatttttgtgaagcgtcaaggtaagttttcaggtatgtttggttccgattttgttcgtgcatatgtacctactggttcagtgttggattccaaatttttttatgactaatgccaacacggaggcctcaacatcttcatgttcataggtattttggcggcatactccccatgattgtttagtgcggagacggtgatttcttttcaaggtaacatcaatgtacttttgagttgacataactttgttctacttcttcgtttataagcttttcatgctagtgtttgaagaggtagttttggtaattcaaatggatatatgttaattcataagaaccttggtgatatcattggcaattagatgtctttttcaaaatctttgatttcttcttgatttttcttcagggagaattggaggtttatttgaggggaagtttgtgctttttcggtgcattcatgtctatatccatgcattgctctaaatctgaaaataaagaaaaaaaatgagaaaaagaagagctttggtatatacctctagtatattcttgtgcatgctagtaaaataattgatgtatatttgttgatatgttagcttgtatgcattttagtcttttcatgtggcttggatattacttttaagtgagatgatgcatgacactaattcttttacttgattaagtaaatatgcaatgttaaagcaagtgctgagtttggatgattaatgcttatatttatacttattggattgttattcctcaaattgcttattgtttattccaaatgtcacaggagaataaaaagttgcttatgatgagagaaaaaaaatgaatacagaatccttggaaacagtattgacgataaagccgtatttacagtaaggaaaataatgggtaccaaatccttagaacattcttaacgacacggacgtactcgaaataaattgagatattttattatcaatgtcaaaatgagcacaaaaagctctaatacttgtggaaaattctcttggttatttttgtgaagaagttattttgagaaagagtgatgatgcaataggtatatatatatatatagggattttttttcaacctatgtacttgtgaatatgttgcattataaatcgtttgaaatcattatctttattattgactagaaaaaatgcccgtgtgttgcaacgggtgaagattattttaatcttattatattatatcgagttaagatgaaattcactgtgtcaaattcgcttggatatatattgtgttagaaaatcatgagctgtaattaggtgtccgaacgtctcaagttagtagtatgtgagtttttaaagagatttcttatacgatttcttctgtatttccaaaagcgaacgaacttaaaaactgactcaaatacggatttgtatttccaaaatcaaacggacttaaaaaccgactcatacgcggatgacgtactaaaatactgacgaaaacatctacaatttttataatagtagagatagaaatataatttaagaggtaaagatatatgtgcgcagtagcttgattgaatatttctctgattaggttttcgtatttctcttggcaaccgtcatcgatcggctgctgttgctgatcgtcttgctgcacgcgtggattttcgatatgtgggtagtaatagatctcggctttgatatcgatcctgatcttttctttaatctttttggaacacgtatacacagtagacaatattggattgagtttctgatgaacacagtaggaattcttctcgatacggtgtgtgcgtgtagagaataatcaacaatggtacgtcgtgctgcttgcctcggcgcacggcaacacacctgactgctgctggttggtgttgatataggtgcacgacagcaggtcccaaaccgtgttgccgaacagaccgtatcagcaagatgacaacctcgcggtggtggttggttcgtgacaatgcacaggatgaaacgcaatcggccaaaggcactgatccgaacaagcaaattttcttatggaaaatctaatgtttaaagctcatacatgtggggcacataaataattaaattggcagtaattatgtgcgaggctaattcggacatgacgacttaccaagccaccggcaaaaacatcttcaatttttataatagtagagatttgagcttaattgtaatacctttgattcatgtttatactctaatgcatgcttgttaactagttgatgaatttatctcatttgtcttgcaacatatgaccatgaattgcattgctttaggtacacttcaaagctctcaaaaaaatttcagaaaattaaaataaaaattaaaaaagaagtgattattacatgtcacaatcatgaaatcatgacatttgtgctttattggttatattctcttttaaaattcttgatgaaattattatcaaatggggagagaaatatacaaaatacatgcttcttgaaaaggggagaaaataattcgattttaaaaatagttgattttgcaaatatgggacttgaatattttcatatcaatgtagtatataaagccactctggaattgcaacgttttgcagcatattcggttcgcaacactagatctgacagtaaactagtagctagctagcaatgcgaaactccaaatgcttggctgaactggttaatgttgggaacgcgaaataaatataagtctggtggagatggctatagatagctcaccttgtttgaacgagcgtgatcaccgtgagactccagaagtccttgttggatagcatggagacgaatccaccgaggaggatgacggtggaccacgtgagcaccaggaaccccgtcccggtgacaaccatcgacaggtaccccatgaacaccgcatagtcattgatcaacaagacctctggccaatccgaatcaatgtgtaatccaaggcgatgaccacggctctgtccggcgccggacatcgatccttcctccgctaaacacctgatcaagtcgagtttgatatatacatggtaaaatatttcaggtccagccgtcttagatgatactggctctcactgcatttgcatgctcagtgtgcgccaggcaccaagaaaccggtaggtaataaactctaaactgtactaaacactaaaatcacatcaactcccaggtggtatccaagtaaagttccacgccagtttaaccccaaaatccacaaactacgagcattaaggcctatgtatcgactcccagagtcacaaccaagggtgtgtttagttcacgctaaaattagaagtttgattgaaattggaacgatgtgacggaaaattaagttgaaagtttgtgtgtgtagaaaagttttgatgtgatggaaaagttgaaagtttgaagaaaaaattaggaattaaacctggcccaagacaagaaagacgaaattttaagggatgatcacaagcagtatctgcagtcccttaattacctgcttagccgcttgccgaacccggccggccagccagccgccgcctggccatgctgatacctcgctgcggcgcacgtgcgccctccggactccgctgacccgctgcttgctggagtgctactagttggcagctcgtctactgaggcaagcaagggagcgcttagctggggacgactggggtggtggtgggtgggctgtacgtttcaatattaaaccatcggagagctagaaccatcctctttctgctgaagtgtactgttagttgatagtcatatgctccacaagttctctgctgaccatctagcaatcactactagcaaaagagtttttcgctggtggcactgtcagccgcccgcaaacaaatggcaagtgaaaataacaatcttcactagcgaaactttaaagcttgttttcacaagcggttaagttacgttgaccgccagcgaaaaagatattcgagcgaaaaaaagaaaattgaaaatccgtttcccgaccaccaagaaaaattgattttggagaaaaaaaaacatgccggatcgatacccgagctccgccgccggatgcgtcggccacgccccaccaccccgagccactggatatgagagaggggaggagagtggaggagccgcccagagcctatccatcgttgcagcagccgctgctgtcgtcgtccttgaactggttgacgagaaccaccgccatcggatccgtcctctccaccatcactgctaccgatctcgccgccgccgccgccgtagcctccaccgctccccgcgcaccagatctgagagagggagaggggtgggtggtggcggtggaggaaggggaggaggaggatcgggggagagagagctgggactaggaggcggcggatccaccgccggatggagtcgccgctgctcctcccataccaaatcgtgccctccccgccgggctcaaccgagccgctgtcttcccgctgccaccaccggtgggaagggaggcggtggtggctggagaagatgaggtctagagatgaagatgaggatgaggaggagggaaagcagtggtggcaaggtggcacggtaggtggtggtttttattgtgttcaattattttttagtgcgatgatgatttttttttcttttttttttctggtggacctcttagcagccgacatcgaaaattggtttttgctcacggcctcttaagaagtccgcttgtaaacaatggattttcgctggtagcttcttaagaggttcgcttataaaaatattactatttgctggcttattaagaggccgttcgctggaggttcgtgactttgaatctttccattcaattttacaagcggtgttttgtcatggccgccggtaaaaataaaagggtgatgtcataaaaaatcattttttacagtgaattaaccattctatggagaggccacaaaagcgatgcaggcaagtggggatgtgatcatcaggaaaaaacatctggtgtatacggaactggtgtatacggaacaggatgcaaaccccagtccacacggttcacgaatcacgatcccgacaccattgctctagagtggtatctacggataaatcttgtctaactttttttacaaaactagaaaggtggtagcccgcgcatatgcgcaggcatctttttatttgatgttgcttgaaattttattttggatgttttatatgtgggttactttttcttgaaattctttgactctcttctaaatttgtttttgtcaataattagtttggggttgctttgaacattgtaagtatattggttatgatactctttgatctacccttgcaacatatgaattctaaactaatattacttggaaccatgcaatcttaaatttatgagaaaatattgtgtcgcaataatagagttgattactattagactatcattttgtactatgtgtatatcttttttgaatattagcatatcttattttttaaaaactttcggtcacaaaatttcttttatactatagatgtatttatagattttaggatatatttaaatatatattctacttacatttacttctgcgcctttctttttttcacatcacatctcttttttgaaaaaaaaaagagatctgaaataagtaggtgtggatcatttgtaaatggtccgtcaccacggactaattaaagtataattttgtttggttaattcttatttttatatcgtatattttcattgcatgaattctgatatataagcttagtatgatttgtattccctaattaaccaaacttagtatgaaacacccatatcacaaattttacaaaatttgtgtggcatggttcaaattgtccctttttaataggaattaaagagaaaaaaatcgcatgccctatactccgaatacttttggttattcccatactatcctaaccgctgaataaaatggaccccaaattttatgcatcttcaaatgatgatataatccatatcactaatttttcatgatttttaataattctcgatttccatgcaaagcgccaatatgacttgttatttttgggcattgtagatttaatttaatggtgcatacctatgaaccaataatggatatatagtgatatactatattactgttatcttattcaaaattctcaataacgtttgtaacatacctgcatacatttacgtatagatcccgggtggagatgggtttgcgaggtaatggttgtaaataatagatccattttacttttatcattgtagagttaatttaattattgtgaagttatatgtaagatgataaaatctatatcattatttgtttataatctttataacagtttaaatactatgcaaaagtcagaaaatataataaaaaatggcatatttcttttccaagtgaatatggatatttaacactaaatttaaaaagttacatgtatgatttagatgttatagttgtttaattttgtaacacaaattttctaacttaatatagcttgaaaatagaagaaaaagatgatgaagggattgagggagaggggagtacgcacattacgtatgtacatccatccacgtacaaggactcgaatttgctatatatttgtcgacaaattttcctccaaaaatttatcagatgtaattacagtataatcatagtgtaattacactgtaacttgcatgtaattacactgtaactataatgtaacttgtacgtaactttcaagaatctctcggtaacatgttatttcagtaaaatagaggtcgtgggaacaaatccttttacatatgtgtgtgctgtgatttttttcttcttcaccagaacaaattttgtaatagatctaacgattcaaaattacgtgaaacttaaatacaagttacaccgtagttacatgcaagttacagtgtaattacatacaagttacagtgtaattacactatgattgtattataattatatatgtcaaatttttagtagaaaatttgtcgacaaatgtataggtagtcccacaaggacttagtggagcctggttttagcggtggatttttctcgaagatagatataatagttttaaataatgagtccaccggatttgatgaattttgtattaactagaatgctatgtggcggcttagaagcgtccgtagaaggacacatgccggcttaagagcgtttttaggaagtttaatggacttttagtatgtaatagattagggtttttttttcacttgaaaaaagtgccatttgtgttttcaaccaggtacagtttccaccgggataataaaccttgcagtccttgcagcccgaaaaggttagggttaagtctattttgcttccctcaattcatgctatgtgatgttgatgtgtcattaaataaaaataaaaaactaaataggacccacatgtaagtgagaaaataataaaaataaataacgggtccacatgtcaggcacccctttctcccctttacccattctctatctttacccttttctctctccctggtctccgtttcttctccacatgtgacaggttgacagaggctcgcgagggagcgccggtgcagcgactggtagtggacggtagcagcggcaggacggagctcggatgagcagtcccaaaaccggaatcaatcagagaccgtggagatgacgcatgagcaggagcctatttttccatatgaagagtcaacagagatgatggggtgatggaatgcgtcggtccatggtt

SEQ ID NO: 65300 - DNA, 1998 bp, Oryza sativa
taatgtcggttcacctgctccttgtccaactcatgatcctgcatgcttttgtcttgccgtacatatatactagtaggacacatgcatcgatcagtatttttaaatacgttctgtaacacaattaatcgtaatgcgtatatggatcagatggatctctaactaatgcaacaaatggctggcaaaactgtgcgaatttgctcaaatcagatcacctagctttcctgtaatctcctagcaagactaggatttgcattgcatcaaccatcacttatgaaagaaaatgcagggtgcagcctacatgttgccaagcttctcgacctgctgcttctactcgtataactaatggcttctctagcaagatccaatgtttcctgcaaagcaaggatgtagaactggatgtaatttgaagcctgttttggatatagttgaatcaaaggaaattgtcccttctgaaactagaaggaaattaaggtgctactgtgtcaccattattttttaagtccaagttctttaatctcctgtatcttgaattaattgtagctacaaaattaggataaacagggaaaaatgaagactggaaatctagtttgaggttttcttgagtaagcactgaattggaaaaaggactgtatttttgctcttgtatttcgctagttatggattgtatttttaataggtgcagctgtctgccaaaatgggcctaatgtgtgtattcatacaggcccagcaaacactaacacctgggatacaccccaaatcttactgcatgccactctccactgcaatattgcagaaggtttcacttcaaaacagagtatcatatcactgcacaagtacaaaacacaattactaatggtgactgctaatttggttgaaatgcatcttaattcattgatcaaatcagtcagacctgaggcttaaaaaaaatcttgtgcttctccctttgcacattttgaagcagagaataaactaacaaaagaaatgcggatttgataaggagtgtttgttaaagaaaatttacacaggcatatcatgtgttgactgtggagtgcagagcaaaatatacaataccttcaaaatgacagagcaactaatacatacatttgcagcatagaaaatatatgtcacactcacaatcatcatcattgtttctgttcatacaagtgaagtaattaggagtacaaactcggtcagtccacatatgctgacaaatcacacgaacacacacacacccacaaacaagtgcacaacagcaactcggctgcacgaggatcacccaatggatcttctcatgccgctgaagctgatgatttattcgtcgacctctaggaagcacaccacaccagaacggtgctagagatcaaagttttcacatatacatgtatgatcatctatccagaaagatgaagcatacgtagtaatccgatggatggatcggtcgaacaagcagatcgactaaccggccaaacggaaagcaagcatgtatggagaaaataacttagcagatagatgcagagctcacacaccagctggcagctgagcatccatttattaattttcacacagaacaaaagaagcagaaatgaacagaatccaagctagtaacaagcagatgacgagcgtctggatgccggccggagatgtacttactcatcatgcattagatattgttgccgttgcaaatgatatgatgaaatgagcgagcactttgaacaccagccccaaataaggacatatataatagagatagagctgaagaacttgatgagccactggatgagggaaagggaatgatacgtagatgattacagtatcaaatatgtagtgtatggacgtatatatcgatcacctgaatttaagaagaaaagaaagcacgccaagtcagacaaaattaaaaaaaaaagggaaaagctcgatcatatatatatatatatatatatgatggagtaactaaagtactgagctatataagtttctacgtatgtatgtatgtgcgcg

SEQ ID NO: 65301 - DNA, 10775 bp, Oryza sativa
cgaggaggctagcaagaagataggttgggcggtcttctcttcttgtccgacttcttccgtcgcatcttttataacaaacttgcctagcaaaacttctccactctggactgcttggctcaatctcctgttgcagatggaatcttctcttcacctgacttttccctggttgcacctctagctgacttcgactggattatggcacttgaagatgggacttccgttctagaacttctcataattcatatctttggcgtcaacctcatacaagttacccacttcatgtcatgcgtcgagatcagctcgtcattactaagataccatgcttgtcatcatttagcattcaaagtattcctttacacattcagccctgacgtattctttttagatttctcttatcaatcacctttcgacctacttcttggttcgataataaacacctttgctggtatcttctatcaatcacctcttaaactttgtcaaccaagtactcttcactccgagagttgtggatgcttctggtgacgatggggtcctttggcttgctgcctttcagtgaaaccttgaagtgtttcgccaaaagctatactaactgtcgttgcctttgatccgaaaaggactcatctgtaactcttagtccaaacaaatgtctctttggttaatcacttgatttttcttttccatcctcaggttggttattagctcgaggttagaatatagttcctctgacacgagaccctaggtctcctttgtcagtaaacaattatacacatgatcacatatccgcatcttccaaaagaatcctcttagaacttgtttttattaccaatttctcccatattacatgaatacaaggcactgtcttaaacaaaaagggaaggtgcttaacatcggtacattgtttctactatgggttatgattaacacgaggcctcacaggtatgacgtttgctccagtgaccacaaggcgagtgacttgtcttcttcttgcataatggccggagtgatgacgcaggttacgcttcggctgtggacaatctctcgagaaatgacctggttctttgcagttgtaacaaatcaacgtcttctttgctgagttgtccgcctgggaacgatcgtcctgactaggagttggaattggtggttggaaatccttgctaacattggcatcagtggtaccattattgctatcacccttggagtctttctcagagtcaaaattgctagggttgccattctgggtgccttcattgatactatcgtcgatatcttggtgaatgatgttgttgttgtctacattgcgttcatcttcttggggcaggaactcgtgatacccaacagaagatccgatgatctgaagtggctcagtgcgctgtctttggttaccacctgaaaatactgggatgttgacaatccttctcttgcagttcgtcatccgattatgctcactttcaagttgcatggctttgtccacaagtttctcaaaattttcataatcctctaggagtagttgcactgcaagctcatcttttaacccctggagaaacttctcttgtttttcttcatccgtttccacatcttctggtgcatggcgagccaaacgatagaactcgtgcaggtactctgtgacggtcaaatccccttgcttcaggtagcgaaactctcgttttcttagtgtgatcattcctgcgggaacatgtgatctcctgaatacagatgaaaactcgttccaggtgatggtatgtccttctggccgtgatgcttcgtagctatcccaccactctgaagccggtccaaccagctgatgagttgcgaagccaacccgctcctggtcggtgcactgaatcaaccctagcttcttctcgatggtgcgcaaccactcactggcttccataggatcgacggcaatggcaaaggttggaggctcagttttgagaaattctgataacttgcactgttgctggactgtaggcacttgaacgttggttgcccctgctgggttgttccaattctgtaatagttgaaaggctgttgccaacatgttggtttggttaaccacaacttggattagctctggtgaggttgcgttgatgcttctctcattcccattggcttgggttcttgagtcatcggatccatcattcccatagccttggttaccaggattatccatctgtcacaaggtagaggttgagaggggaagcatacaaggagagaatagaccagaactagagacaagaccttaaaggaactaactcttttttttgttgatgtgttgtttgttttgcttattctgcaggttgattaagcaaacaacctagcatggttacatcaccacccaccgatgcaaaccacgcgctacacacacaagcaaggaaacacacgacaaacgaaacactagagggtggcttaggttctgcgacgggttctccaagattttcactcctgcttcacagctggcttcactgcttccttcgcttcgctagcggatcctgcagtcttccggagcttcggcaaacaactgacgacatcttcttctttgcaaagctgaccatctagtacttagttgaaatccgaagaaagaaaagagtaaaccttttgcaaatagcattaggggaaggagaaaaagaggaactttcgcaaataattttatttataaaatatgtccttaggttttatccatttggcttatcctacagtcgagatggctctgataccagcttgtcgcgaccgggaaaattgccttttcccgaacgctagtgtattaatccccgtcccaggaaaagccggggtacaccatacaaacatgatatgaaaggcacatctttattacatcgataatatttacattattacaagggcacttcaggcctgacaaacaaaaataaacagcagcggactagcgggcctacggctccatcttcacaggcgctcaactggggtataagccaggactccacctaagacatcttctccaaagcttctcttactgaagaggggaaggattgagcaagaatgagtacaaccacagtactcagcaagccacaccggcagatgcatgattaatgcaagggggggtacaaggggataataataggggttaggttttgcagtaaacagcatttaaaagtcacttagttgcccaaagccattttgtaaagacgatcctagagctacacagtattattaaacaaggccgtgaaccctcacgaacctgccttaacccaaggcctacgatgatttggaccgaactggcaacccgacctgggttccagctcgtcccaagccaacccaggccaaccattccatattttagttgttgagcaaaattttaagaattaaaacactgacttgggtacattgctaggcttgcccatatccgagggctcggctattcgaatagatttactctgatcagaggtgtacatctttacccacaagacacatctttactccgcattccatggccttggaacccgtcgtaaagatgtgacataacccttcacccatcctagccgtgaacaaaagtaccgacccaatcccacctacggccgggatacccgggacaggcaggcagaactgagcccctagcagcagggcaccaaccctctgccatacgacatctcgactaccgggccgcagctcgtgtagccttcatttgccctggagaatgtccatcgacacccgacttcatccatctccaatccgtgtccttttgttcaggactagactgagcaccgagttaagccttacccattagacatgtggttagtacggtagtgctttgcaacagaggcccgagcttaatccttatagtggccggggtgctacttcccataactggcatgcacccaaaccccaccgaaaacaggttttaggggttttgaaagagaaagagaggtgtatgtccaattccaccataatccaacaattccatagtgtccaaatgatatgagaattcccaaagtctaaagttagaaaaccacctaatgttgcctaattattcagcgaagcatctacctaaatttatactagtggaaccatgaatagagtacccactagttggggtttttattttcctagggtgaacaaggtaataataataacaataacaataataaggtcataacaaaggtaattaggcatggctagataaaacagtgataacgcgggaatttaaataaagcggtaatgcaataatttaaatcaacataagtttacaaactgggtttcaatatgttcaaggatgatgtgacttgccttgctcagagagaacggccttccgaaccttcggcgacgaccacgaaccacgctttggaaacctccggaacgacgaaagctacgcgaagcacacaagcaaagctacaagcctataaagaagcaataacaatacataaaaacaaagcacagggttctttaggttataacaagcattaggagacttgaacgggtcgattcggagctcgtatgaccaggatatgatcatccgaagtttaatgctgttatatggagatttgcgaattattataattaagctttgcaattataaaacatgtgtaagcgctagcccggaaaggacaggaaggctgcgccgttgacatgcggaccccacatgtcaacctaaaggaccgcggtagaccgagtacacagaggcggtccacgggtcgacggaagcggatcccgtgtgtcaaccgaggcgagtggccgacaaacggactccactagacaccacacggactgcacatgtggaaaccacgcggctaccgagcggacacactaacacggtcaccacgcgcacaagctaacgactgccgacgccgatacacgggtaccggggccgacaaccgcacaacgggcacgggggacaccgaaaggacgaggacagggcagcgagggagagggaaccttaccaccacgcgacgaggcgtgggaacgacaacgacgaacgggcgcggcggaggcagacgggcgcaacggagacgaacggcgaggggacggcttcggcggcgatccttgggcgaaggcgagacgcggccggcacgaggcttgacgacgcggagccgaggacgaacacgaggacggggctgcagcgatcttgacgaagcgaggacgacgaacgagaacggcttgacggagggacgaacgccacgacgatcgggaacgacgagaggacgaggacgacgacgaccggggccggcgaggaggctacgagggcagccggcgaggagacgacgagggcagccggcaacggctgcacggaggcgaggacggcgtggaacacgccgcagcgatgacgatgacggaggcggcgccgcaagacgacgagccgggcgaccgatgggacgtcgacgacgagaacgatcggagacgacgatgaaacgatgatggcaggcagcagcggctgagcggaggaggggacggcgtggaacacgccgctgcgatgttggtgaaggtggtggtgcagcggggcgacgagccgacgaggaggaaggagaggccggcgcggagacgacggcgttccggcgaaattcgggcgaggaggaggtgatgccggggaagaaggcgatgccgcggtgtcgaaggaggagacggcggcgtcgatcggcgcaccggcgatgaacagcagccggctggagggagtacagtggcaccaatgccactggttgccggcgggggcaccgttccggcgagtttccggcgaggagacggtgaggccggtgaaggggacggtgttgcagagccgagggaggcgacgacacggccggacgatgctccggtgaggagggagaggcggctggaggccggccggcgtcggagagggagaaggagaaggcggggagaggtgatacgaccacggggaggctcgggaaggggctaaaacgatagaacgaaggatgaggatcccattttataggatgggggagagagccggccacgggaggagcgggaacggcgacgggaatggcggccggcggcaaaggaaggcggccggacttggcgcggccgttcccggcgattgggggcaccattcaaggggaaattaagggggaattgaagaggagggaaaggggattaattccccctaattaatttggaaggaacggttggatccggggcggatttggaggaggaaacgagctagggttccacgggagtgagaggagccgggcgggaggaggaagacgacgcccgcctgacgcgcgggccccacgcggtcgggcggcggcgtcagcgcgcgcacgcgcgcggcacgtgcgggaggggagcggctcgggggctggggcggcttgggccggcggccggcccaggaagagaggagggagaggcggcctgggccgggcaggccgggaggggaggggaagagagaggcagcccgggagggagagggaagagggaggtgggccgaggggaagggggcccaagaggaggagggagagaaaaaagggaggagaggaggacttcggactgggcttggcccaaaggaggaagaggagggatttttaggttttctttttattgaactttgataattgtttttgttgtttaataattatttccggtgctctgaaaattcaagtaaaatttgagggctcctttttagaccaaggagaatttaacaaaaattctccgggccacatttgaatttttcttgcacgtattttagtgtttgccaatttctttccgaattttaattaattctattattccttttagaaaatggattttaatttggaatggatttatcaggacgtgacaaatccacccccctttcaggaatctcgtccccgagattcgaggaggctagcaagaagataggttgggcggtcttctcttcttgtctgacttcttccgtcgcgtcttttataacaaacttgcctagcaaaacttctccactctggactgcttggctcgatctcctgttgcagatggaatcttctcttcacctgacttgtccctggttgaacctttagctgacttcgactgggttgcggcacttgaagatggggcttcggttccagaactttgcatagttcatatctttggagtcaacctcatacaagttacccacttcacgttatgcgtcgatatcagcttgtcattactaggataccatgctcgttatcatgagaatatcatgcttgtcatttacttctaacttaccactattcacttcatgttgtcctcagttagcattcaacgtattcctttacacctttgaccttgatgtgttctttcccgatttctcttatcaatcacctttcgacctacttctttgcctggtaataaacatctttttcgatacctcctatcagtcatcttttgacctttgtcactaagtactcttcactccgagagttgtggatgcttctggtgacgatgtggtactttggtctgctacctttcagtgaaaccttgaagtgtttcgccaaaagctatactgactgtcattgcctttgatccgaaaaagacacgtctgaaactcttagtccaaacaaatgtctctttggttaatcacttgattttcttttccatcctcaggttggttattagctcgaggttagaacatggttcctctgaaatgagaccctaggtctcctttgacagtaaacaattatacacataatctcatatcgacatcttctgaaagagtcctcatagaacttgtttttattacacctttctcccatattacatgaatacgaggcactgccttaaacaaaaagggaaggtgcttaacatcggtacattgcatcctcaacatgaatcatccataaacatagcaagctcactgtttctagacatgaatatatttatttattacatgattgctgcaaactttcgattacagtgataagtagcgaactgaaaatcacaaacatggttactcattctgattctggagagatatagatggcattgtcctagttactgcatcatccttgattggttctgtgatgatgtgataggactgcatattgctatcattcacaggagaaaaattccttctgattgctggttgaagtggataatggtcttctgcttggtatcaccctcctgaggttgatttcccttcgctcggcctggagtaggtcggggagagaaacaacttcttccatcgacgacaattcattgctgaggctgtcagtgcagagaatggttggtgctgaaggtattattgctatgatttattgcagagtcaggtgcagcaggaggagcattggtgctgtggatgatatcgtcgaggttgctgttggagctgactagctgatgagacaatcgtagggttgttcgttggatttctgcggtcttggtcaacaacacactgagttggcaatccttgggcacatggtttgtaccttcgcatagaaaacatgtgaccttgcgggtgggacactcccctggtggatggtcttcttcacaatgagggcagagtgtgagacacatgctagcaatgtgtccaatttctccgcaacgggtgcatgcttttaattccatctcttcctcgccgagacgtcggggggactcatattcataatccgaggagacttgatctgacccttcactatcagatactctgccaccatggcttaggaggtgctgggtcaactgccgtgcacctcggaaggtatttcctctttgacgtctaggaatagttatccctgctggaggccattcggtgctggtaatagtcatcttacgtacttcttcttcagttcgcatcggcgcttttctcttctgattcttactcttcttgcctttggcgtgcttagtacgtgaccccacgtggtacgaaaggctaggaggaaagcaattcccgggattcaatggattctcttcattgggctctctgctttgcacactaggctgcaagcttgacttggtgcaaggaggctggtttagcgatgcctgccctgctaaaccaaaggaaggagcttctttggtatatacccatggacaattcagggcatagtgtccttgctctctacaatcctgacaaaaggggacatcctcttctggcattggaaagctcattgacctgggtggcaaatgctcgatcaaacacatactgattttggtcttgacttccaaccaatggtagctgtgaaccaagcagcatgcttggaatggaccaagggtgtacccttgttaactctcttgaggctagtggtggatggagttgaaaacttgagttactggaggcatgcctgctgacattctttcctttttctctgttaaacatctgttacaaggattgaggtgagagaggaaacaagccaggaaagaatagaccagaactagagacaggaccttaaaggaactaactcttcttattgatgtgttgtttgtttcacttattctgcaggttgattaagcaaacaacctagcatggttacatcacaacccaccgatgcaaaccacgcgctacacacacaagcaaggaaacacacgacaaacgaaacactagagggtggcttaggttctgcgacgggttctccaagatcttcactccttcacagctggcttcactgcttccttcgcttcactagcggatcctgcagccttctggagcttcggcagacaattgacgacatcttcttctttgcaaaactaaccatctagtactagtggaaaatccgaaggaggaagaaaagagaataaacattttgcaaacagcacagggaaaaggaggaaaaagggactttcggaaatagtttcatttataaaatatgtccttaggttttatccacttggcttatcctacagtcgagatggctctgataccagcttgtcgcgaccgggaaaattgccttttcccgaacgccagtgtattaatccccgtcccaagaaaagccggggtacaccacacaaacatgatataaaagacacatctttattatatcgataatatttacattattacaaaggcacttcaggcctgacaaacaaaaataaacagcagcggacttgcgggcctacggctccatcttcacaggcgctcaactggggtataagccaggactcctcctaagacatcttctccgaagctgctcttactgaaggggggaaagattgagcaagaatgagtcacccacagtactcagcaagccacaccggagatgcccaattaatgcaagggagtacaaggggataataacatagaggttaagttttgcagtaaccagcatttaaaagtcacttagttgcccaaagccattttataaagacgatcctagagctacacagtgttattaatcaaggccgtgaaccctcacgaacctgccttaacccaaggcctacgatgattcagaccgaactggcaacccgaccctgggtcccagctcgtcccaagccaacccaggccaaccattccacattttagttgttgagcaaattttaagaattataacactgacttgggtacattgctcggcttgcccataaccgagggcgcggctattcgaatagattatactctgatcagaggtgtacatctttacccacaagacacatcttcctcacgtgttaccacgtgccacataccaccacggtatacagacggaagacgtgacatagtttccaacccatcctagccatagacaagagtaccgacccaatcccgcctacggccggaacccccgggacaggcaggcgagactgagcccctagcagcagggcaccaaccctctgccatgacatctcgactaccgggccgcagctcgtgtagccttcatttgccctggagaatgtccatcgacccccgacttcatccatctcca

SEQ ID NO: 65302 - DNA, 4663 bp, Oryza sativa
aaatttagcccaaatttccagactattttgtgtattaaatccctgtccaggaccagccagggtacacaaaacgacaagtaataaacagatccaaatgtaaataaagcgtaaaatacttacagaagaggcacttaggcctcacaccaaaagagaacgacagtagcggaaaaaggcgatcctagcggggcttcagctccactccacaggcaaaactcaactggggtctgagccttggtcttctaacttcgtcttcagctcagaagcactacacttctgaaaatggggaataatagcaaggctgagtacaaccaccgtactcagcaagccacaccaacgatgcagacgtgcaaggtgacacaaggaaggcttgtggctatttgcataaaggcgattgtaaaatatttcattgagcaaaacagtaaaactgatgagtaattaaagtaacattaaatctccacttatcaacgctacaccacgttgaacaggcccaaccaacccacctgaactacagtgcattgagtcgatttattaaggtgggactaatcacggtgaatctggtcgaccgcccataaccgcgggcacggctattcgaatagttttactctgatcagaggtgtacaactgtacccacaagacacagccccacgacacgtttccgtgcgctgacatgccaccacgacatactggaaagaggccgtgacaggacccttcgcataaccccctctaaccaagcacaccacacctcaggtttcacccccactcctcgcaaggcagcgggcagtcccctctcgtgcctaggtgaatccagaagtcgcataggccgtcgcagggcccatccaaactccatcacgcccacccttgcctggatgcgtcggctagaggaaagctacactacaagcccagccgttgcccacgctggcttgtggtaagcacgataaattcttccagggtttcccgcgaaccggtccttaattgccatgggtgcgactagcaaaaccatgcacccacagcccaccatgtaatcgcattttagttggataattacgaccatgaagcatggccagatgtctcgagcacgcagctcattctgatactaaaaaaggtctaatactgtaattatcccatcaactgagctagtggtaattaagcatggctaagcatatagttctagctaggtcacataagtaacatgagctagtcgatttattacccaatgttgacgaaggacagatatcaagtaaacatggcacaagcgagcagataggtaaaccctaatcccatgtaattagcaagacatgcaattttatttgcaaacggtaaaacatttgtaaattaggatcaaaatgctcaaggggaatgtgtgacttgccttgcttcttcaaacaatcttccgaacacttttcctcgcgaccgcggacttccgaaacgacggattctacacgcaggcacgcaaaatgaggaaaaactctaataaaaaccaaggaaatagtacataaaaactaaacaaacatgtagagctcaattttatatgaattttgcaagttgaatggctcaattcggagttcgaatcaattagatatgaattttagaagttttgagccatttaaatgaatttctagaatttttaacgatttattgcgcaattaataattaatttcttaaaggaaaaggactgtcgctgacgtcagcaagagaggggccgacgccgataggcgggtcccacacgtcaacggcacaaggggagggcgcacggtggactcagtccatcgcggcacgtgcgcgggcgcaccacgtggacggccacggcggacgagcggcagcggtggcgccggcgtggcgacacgagggcaccgacgcggggcggcgccgagcggccacgtggacggcccagattcacccggggtgaatcgggcggccacgggcgggcaggagccagctcgccgaccgaccggccaggagcggtgacgcgcggcccgatggtcactggcgacgaccaccggcgcggcagcacgcgcgggtgagcggcggagggtagcgggaaaggggaggggagctcaccgagcggcacacggccgaaggatgcggccggcggcgagatggcaacgggaggcggcgacggcggagctcggggcggacggagacgacgacgctccggtgacgagctgagctcgggaacaggcggacgagcggcagctgcgccacaggatggaaggggaactgttagggaggacggggcaacgacatggccggccggagaggaaaagaagggaggaagggctcaccggcgcacggaatagcggacgtcccgtgagtctccggcgatgggaagaggtggccgaggttcccctcgtccctgcggagccgaaggagagcgacggcgcgggttggcaacgaccggagcagcgggacgggacggctggaggcagtgaacggcggtggtagagctcgggtcgacggtggaaaggtggttgcggcgatgaaatggggaaacggagcagaggccggggtagagcttggcacggcgttgccgacgacgcaaacggcgaggtgcggcgacgactaacgcggcagcagcggccggctgaaggcggcggcggcgggggagagaggtggtgcacgaggcggcggtgttccagaggcggagaggggaaatggagtagaggccgggctgcggcacggcgccgcgaagccgacagtggtggcggattggcgcggcggtgggtggagcggcggaatcggccggacggagctcgccggaaagcggtggtgcacgggagcggcgtggggagggcgttagggaggcgcggggagctcgggaaaaatggggaaatggaagaggggaggccgaggatgcttttatagcctcaagagtcgacggggaggccggttggcggcggatttgaagggagaaaggggcgccggcgacgtggttgagtgggctcggggtggcggcggttttcgcggggagaggtgggggaacgaggaggacgtgggcggcgaggtcccacggacgagcgcgcgcgcgcggggtggaggaggtgggtggaaacggcggcgtcgtggggcggctcgggcggccatggcagcagttggagctggaggaaggggatgacaggtggggtccacgggtcccacctgtcggagagagagggagggagaggccggctggggaggcggaacggacttgagtgagagagagagccgagcgggccgagggaggacgccggcccgagagggagagaaagggggcgcgcgggccgcgggagagaatgaagacttgggccgaaaatggcccaaagaaaggaaggggggttttatttgttttctttttattttaattgattcaatgatctttgtgctattaaaactatttctcgagcttcgaaaattcgcgggaaatttcagagattattttagggcacaaagaatattacaaaatattctcggccagtgatttttaaaggaaatttttaattccctcaataattcacttgattaatttgctttaacttttatttaatttctagaaaatacattattaaatgatttttaatcccgaacgaaaatcggggcgttacagtaggttgtgctttgtctcaaaaccttcaatatatcttagaacaaaatgtcatacactcatctgccaaatatgcttcagctatacatccctcaggatgcgctttattacgcacatatgacttcaacacactcaaatatctacataaacatggaaatgagaaaaaaaagttaagaaatatatattggataacaaattcaattgtatttgtaatataaacatacctttccacaaagtacatcgatcggtaacacacaggacctcctatttcagcctctgttgctaaatgagcaactaaatgcaccataacagtaaaaaatctaggaggaaatatcatctccatacggcataatgtcattttaatttgttcatccaacttccgaagcacatctatgtataggacttttgcacttaattctctaaaataaccacatagttcaaataatacggatgtaacattgtctggaagcacacctcgcaaagcaacaggaagaagttgttggattagaatatggtagtcatgacttttaagtcctgaaatttttgcctgaccaacatttacacatcttgatatgtttcctgagtagccatccggaactttaatatcatggagaactttgcaaaattgttgcttctcatttttagacattgtataggtagcaggaggcaagtaatacttattgttagctttttttttaggatgcaatcctagccttatattcatttcttgcaggtctagtcgtgcctgtaaattatcctttgatttgccttccagtcttagaagtgtcccatatatattatcacaaacattcttctctatatgcattacatcaagattgtggcgtagtaaattggactcccaataaggcaaagaaaatagcccactaacacagttccatgtttttgacttctcaaaatcattaattgcctttattttactaagaattgcagtttcagaaaatgcaataggctctggtctatgttcttcaattccatcaaaagaaattcgattgtaacggaactcatggtctaggggtagaaaacgacgatgtcccatgaaagaatacttgcgacaagagggatcca

SEQ ID NO: 65303 - DNA, 5560 bp, Oryza sativa
tgtcacactccgattttctttcatggattaaaatcaattaataattcatttctagaatatgtactattatattataaaatttgaacatgttttaatggtacgtcattcgtatttaagatggtttttatgttcgttctcttttggaaatacagatccatgtttgagtcggtttttaagttctttcgcttttaaaaatacagcaagatttgtataagaaatctctttaaaaaaactcgcatgctaacttaagacgataggacttctaattgcagctcctgattttgtaaaaaaaatatccaagcgaattctgacagtgaattttatcatagctaaaccgtataacaataataatattaaaatagccttcacccgctgtatcacacgagcgttttttcttatatattaaaatataaggatttatgaagtgaattaatgtgggaaataaagtttcctttaaaaaatcatggctaaggaatatttttataatattctccataccctaaaatactatctggaatgttcttgaatttctagagctcaatatctgattttaataatagaaagttcatttcatcaacaacttacatacaaaaaccaattcaaagtctactctttgtccttggaccgtttccaaaccaactgtggtttccctccccctcctttccacgtgcggtctcggcccgcttctccatttttctctctgtctagcccagccttctccgcaagtccgttttacctccccatccaccggcccacctcgccccactctcccctctctccactggtggagaaaccatctttgctcggtcggccaaaatccataatagtcccggttgcaataaaaaccgggactaaagatagtttagagctgctttttaatctttagtcccggtagtcccggttggtgtatttctagtcccggttggtaacaccaaccggaaaaaaagatgcctactatctttagtcccggttcgtgttaccaatcaagactaaagatctatttttagttccggttggtaataccaaccggaacaaaagatcgtggcggagagtacgaggcatatgccatctgcgagattgagaaggaggaggagatgggcagccttatctcttcacctcttcctccactgaccttatctcttcatcccatctcttcctcttcctcctcctctcctctaactcctctccttccctcccccttcatcccttcctcttcctcctctctaacttctctcctctaactcctctccttccctccccatcatccccactgatagatcgggcggctggctgcctcgcggcggcgcgccggcgggcggaggccagggcggcctcgcggcgggacggaggcctgggcggaggcctcgcggcctcgcggcggcaaggcggcagaccacgggacctcgtggcagacggcgcggcgagcggcgcgccggtgggcggcgcggcagcggctgcggcagcctgtgtttttatttcttttttctttaagaatttgtgattcggatctgtgtatttgatttgtgtgtgatgtccgtgaatatgtgatgtatttgtgatgaatttgtagaagttgtgatgtaattttgttttaagattttgtgatctatttgactatggccgatttggggatttgaggatttggggataatttatttgggattttgggatggggatggagtgaaatcaatatattaaaaacacaatgaagaaaagaaaaaaataatagagcaaccggatctagctaggctagctgtatctttagtcccggttggtgacatcaaccaggactaaaaatggatttttactcccggttatttcacccgggacaaaagatagtgatctttagtcccggattcatagtcccggttggatagccgggactaagggggactacgaaccgggatgaaagatgctttctccaccagtggccctctcctctctcccctacaactgggaccaagaggccgacatctcataatcatctcctttcctctgaccaaatgagttagcaaccgttccccccatgacgacatcgttcccgtgcctctcctttcccgctcttacattcaaactcaagagggcgttgtcgccacctgcgtcctccacctctttcccaactctcccctgcaaatcgcacggcgtaaagccgcatctcgctccacgatgccccctcctcctccaccggctaccgcctttccccagccttgaatctgcctcccgagcctgtaaatggcacccccgtgccttttcctctccttttcccctcctgtagagctcaattggaccccaaactgttagaatttgttattgtttccttcttgtatttactttggtgtcctcctattctcccaactttggttctataagtcggttcgagacatagaaggcctagcaacctatatatgtactcgtgctatctggcaactgattattgcattgagtttattcatgcttacatagtatcagattaatctcgctttcgcgaaattctctaaaccggtgtgatggtcgctatagaccaatttcgaccatcaatataactaaaataaaggagaactagatatgcttgcaatgcatatttgttttagaataatataattccacttgtacttggagtattatttgtttgctgatattagcacataaatagaaaataaatgaggaaaactcactcctaagcaagcttaagcataagaaaggcccacatgtcaggtttaacctccgatcttggaaaccgccataactgtcacaactgtcataaggaccaacctgtcagtgaccctgccaaatctggaggcctgctaagccggctaggttcagcctggtggcgtcggattaggctagccttacacgtggatgctccagatcgcttgctgatggcggttacagagcattttggacaattcgcatcagttacaaccatcataccggcctatttaaggaggagctcatttcactcaacttaagcaagacttgatatctctctctcaactttagtttagtgctctaatgctatgtgcagtagaatagaatagttttcgcagtcctcaagtcttcagaggagtttgggtatggctctagtagttttcctttcctctttagtaagacgttcggaattaacagaatattcttctttatatactttcgatacttaactttgtttgagtatcagttttactttatatctatgtcgttataattgtgtggctagcttaccagagaagtgtagtgttggtatttcttaacgacattactagaaatagtcattccagcaatggcgccagaaatggtcctggtatatttatggttacagaattaatccgcaagcgcatagatataccattgtagtatttcacccgaaagtattccaaggtatcacatttttaatcccaagggaagagaataagagtgaactttactaatgcactttatacatatattacttataattgtcagagcctaagcaggggttaaatataatgtaatggtagagtgacacgaagcaaagctatccaatcctcgtaacaaaataattctaactaagtggaagaagaaatagaaagcactcaattcctatacttctagtatacactcaaattctaatttacatctgctaatgtacaatcgtgtggccaataccccctaacagtgtcctcctagtacttcgagagatcaccttgggttgccgagtttcttacgacaacttgtcatggccgtccaaccggggctaaatacggaggagtaccctccccaagaatttgtcttaggaatatatactaacgtggaggaatacccgtactgagctgtcaccatcagcggcccacctctattatcccgcagcatatatgcccaattaatgatacttaataatctaagcaccacgcttacattactaaatactactctatacccgcatgcttgacatagagtaacggataaatcagaccttaaacccgcaccattacacctctctgttaggctacccacacaattaacacaatgcagatataaagtaagaccaatactcaaactaagtaaagtaccaaagatatataaagaagagtaattcattaattaggaaagtattacaaaagagattacaagagctgctagagccataccgaaaactcttccgaagactccgaggacttccaaacactattctattctactccacttagcactatactactaatactaaagtatgaagaggaatttagcttgcttgagtgtgttgagagagtgaatgagctcctccttttatagggctggtatgacggttgtagctatgcgtaatgtccattttaccctcacaaccgtcattgagagtgcatcctggacgtccacgtggagggccagccggagctgaagccaccagggttcggccgaacccctggttaggccgaacctgggctggcccagcaggcctccagccacggcaggtcctgacaagtggggtcccttaggcggttgtggcagttaaaagtcagtttctgatggttgcttctgacatgtgggcccatcttatccatttgcttgcttaggagtgagttttctccactttctctttattttatttgataaattcctgcaacatgttattctccaagtacaagtggaaatatattatttgaaaataaacatgcattgtaagcatagctagttctccattattttagttatattaacggtcgaaatttgtcggtaacgaccgtcaacatgcagtagtgtgggtttaatgtccgagtattcggttactctatgtcatccatggggatatagagtagtatttaataatgtcggtgtggtacttagattattaaatatcattatctgggcatatatgttgcgggacagtagaggtggactgctgatggtgatagctcagtacgggtattcctctacgttagtatatattcctaagataatttcctaggaagggtactccttcgtttttagcgctagttggatggcaatgacaggttgtcataagaaactcggtaacccggggtggtctctcaaaacacgaggagggcatagggggtattggccgcacagttgtatattagcagatgtaaattaactagaattgagtgtatattagtagtataggaattgattgcttttctacttcttccacatagctctaggattaattaatgagagaatcaaagttcttctgctttgtatcactctacccatacacttgaattaacccctgcttagactttgattatacaagtgatgtatataaattgttagcatggttctctcttataaatcttcccttgggattaaataaatacgataccttagaatacttccgggtgaaatgctacaatggtatatccatgcacttgcggattacttctataaccataaatatacaaggattatttctgtgtcattattgggaatttatatttccagtaatgtcgttaagaaataccaacaaccagcgcctctcacatgcgcccctcggcgcttctctcgtgccaccatcaccatgacagtgccctcactctcgttgacctcggccgacgctctcgacgctacg

SEQ ID NO: 65304 - DNA, 16061 bp, Oryza sativa
gtcagactgcaagccatggatgactctagtcgacacttctaccaagttgtcctctaccaatggtgtcgtgattgctgatcctattgactttcgcagtctagcgggtgctctacaatctcttacattaactcggccagatatcgcatacgatgtctagcaggtctgtctccacatgcatgaccctcgcgaaccacacctttctgctcataagaggattctccgtcatgttcgaggcacactagactatgggcattgcatccaacattattctttcgctgaccagattgcctactctgatgcagactgggccggctgtccaaacaccataagtcaacctctagctatgctgtctttcttggcaacaaccttatctcttggtcctctaagcatcagaacaccgtgttccgttccagtgctgaggtagaatataggatggttgttggtatttattaacgccatagatagaatccacaagcgcacgaatataccgatgtagcacttcacctgggagtattccaaggtatcgattccacgaggaatgtgtgtgctaagctcttctccaggttcatccaagaacataaagcaatgataggcaaaagggtagagaggatttcctagtgagaaacagtgtctacagaaagcttaatttaatcctatagcaatacttcaggcattggcttgctcacttctaacagaacgcgctctactccgtacccagacagagaggactgcagtgctcttgagtgttgtcactacctctacaccaacctttaacgaattgtgggatacacaacaatcactggaaattaactacctagacactaaagtaattaattactactttagcgttagataaacattaaagtaatcattatctattaatgaacaatagtgaacaatgatccagtatgctaataggaactaactaagatataattctcacaaagtaaatcttaattactcggaaagatatttctattaaattagagtaattaacaaggtacaaaaagtaagaggagattaccgacaactccgaaattcctccgatttcttctaccttacaataaagtagaatagagcctcatgtaattcagctcatgcttcgtgtgttatgaatgagggaggagagggatatttataggccaagtgccttgggagtgtggagatgctcaaggcatccaatgagcatattcccccttgcttcacttccttgtgccaagtgtcctatgacggtttcttcaggttgaaattgtcacaactgccttgggatgtcgataactaccggcgtgtgaagtttctaggccagatgggctagccctggtttggccgaaccctggttagcctccctggcctaggcctttctcctggtcactgacacatgggtcccctttagtatttctctggagttacccatttaattatgatcttattgggtttgtaggctaagactccattgacttggatatggaagtattatttccctccttcatgtatatttcctctcaactttagtagtttgtcatctgcatccaaatacacatcaacacttgtggaaagtgttagaaataaaccctatcactatgttggatattttatactctcagttttatgcagatattgacggcgtaaatttggtatttagcagtcgtcaacagcggtcgcaaatgctgttgctgaaaccagtcggcttcgtcaactaagtcaactctgttctccccctactaaggctactctggtttactatgataatgtcaacgcgatctatctctcaattaatctggttcggcatcaacaaactaagcatgtcaagactaatctccacttcgttcgtgagcgggtggcagttggtgcagactgtgttctgcatgtccccacatcgtcacatatgccgatatcttcaccaaggcctaccttcgtccgtctttacaaagtttttaatgcttcaatccacaatttaattgacagagtagaatgacctagcatactgagaacaatgtgaggtgcaggtgtgccctgtgtgcacacctgcacagagcggcggacggagactcgatctggattagagtttggagatggaataatggatgggaggaaggggaagcgatacttttctgtttgactagtaatcgtgcacgtgcaatgcacgttctttccatcataacttgctttcatgcaactttacaattatatcatcatgatcccttaaaaatattggtggtctatcttgagaagataaagtagcacttcaatgtgtaaataaaccgaccgtaatacattgaaatccatgtagctaagaaataaatctataaagaggaatgatacaagcttcgtttccatttccatacaaacagaaagaacaaacaaccagtacgtgcacaaagtaatccacgtagaaatacacacacttacaatggagtctaatttgaagatggtgtatattataaatccgtacacatttcttatatctccaaactgaagttgaatcatccaccatgaacacctagaatcgataaataagttcacacccttcaattagcaaaatctatgctctggtgggcaacaattgttaacattcattctacaaagcttgataattgaatcaaaatccaatccaagagaacgcaaccatttcgtgatatgtcttatagatttaacagataacagataaatggaatgattatatgttcagttaatacaataacaagaagcacccatgatggtgaacactgcagagaacggcaccattttatcatagtactgaattacagtatagacaaatgtgtagcatttggcagcagcagggtccttgtgtagccatgatctttgacaaccaaattgacttccatacaattagtgcagacaactaaggcactgccatgttattgaactgcttgcgaagcattgcttaaaatattattgtggccccaattttccatactaaataaaaattagtgcatatgaggaacaaaacagaaaaagatgaaggtacaaagtggctgttagtaataatgtgagaatacacataagaaaagatatatgatgcccaagtgtggtgcttaattatgtaagaacttgatagccccaggaaataacaataattggaccacatcggaagcacctcagcaaatccacaatggaatcagtcctgccgaatcagtcatccaaaacaaattcctaatacatgaataaaggaaaggtcacaagattcagccgagaaaaatagtacatattcgataatacaaataacaagtcatatcatctacaatcagaccagcaaacctgtaaaggcacattaactctcatgctcacatatttgcttcccatttggcaatgaaactgatcatctgcatagtcaagagaaagagaacatatcaatagttagtgtgcgcatgcaaggcacatgtcatgtatatcgatgggagaaaatactcttattttcataaatactaaaatctgtttcacatgccaattgatattgaaatctgtttcttttttctctgcagtgtgccccttgtgccagtatgaagtatgagcacctgcacctatacagctccagcaaacatgtggcctcgtttttattgacggaagagtagaaaagaaatataataccattgaagattgatttatcgcaaggagcaaggtaatctggagatggcagatcacaacaaaaaataattaatcttaccagctgtgaccaaagtacagttctagactacctttacttagtagtagcaatcatagagatcgagattagagagagatagagagagatgcggccctacctttaccaggagcgtgatgccctccacgcccacatccgcggcacagatcgtcccctcctgctccacggtcactggcatgcgcctcaggttcgtgatgccgcacatcatcatcatcagtaagaacgctgaaaagttttttccagattagactacactatctgaaataaagaggagactttttttaaggtcaagaggagatggtttgaaagcaaaaaaaaaaaattcccatattttttttccaaaatctcggtgcccttaccttagtcaaatccttttaaaatgaaaaaagattggagcagtgataaaaacaactggagcctggttgatatcttgacaattggataaatgaatgctcacaagaagaatataattctgcaatataatcataaagaaaacaatatgctgaaagtacatgtggcgaaccgtcaagataaattaatgactgaacacgtaccgatcggtgaaaaaggactgaaaacacttaataacagtaccaatagcaccttttcgcccacaaattcttcttcagttcaatttgtcatcaactcagtcctaacaagcaaacaacaaaccaataagataaccggggagcctagggaagaaaacaagattagatatattcaaaatctgaggcaattgcaagattacatagaaagcatatcaattaggtacgggaagggaaaagaaccgcatctgcctccattaccgagtcaaatcttcattgtcatctgacattactgcacctgtgctagcattgcgaacagttgagagttcaactcatgattaattcttgaaagctttgttaattaaactgaattgggtaaaatggctagagttttatagggtaattaaacataccacaaaagcaaaaaagagatatggaatcaagatatagttctgtctcatggtaagttttataggggagtttatagcgctgaacagatgacaatgaaggattctcaattcacacacaatcatctcctagtagttgtaaacaaaatcacaattgttaggcaatcatccaggtcttgaagagcctcatcaatagtctttgttcaaccaaaagatagtttgctgaataatgctagagagtatgtacccatataaaataagctttgtgaatatgtgaattggtgactgatttaatagcgtctggaacaacctccttgatcttctctgtatgaaaaccaaccaacatgtatcaacaccaactggataaactatgtacaatattttcttaagtcctccactgtaaggagattaaatgaacaaagcctaaggagatagataaacccatgaacaatcaaatatgaggcaacggttaggaataaatagaaacagtattggttgagtggtattcagtcgaacacttctggggcaaaacggttatttatgcaaccaaaaaagaactccacgataatctgaaacaaatagactgcagtgattcataaagaggatcgaatgcaattggttggtacttggtacctgcatgagattgcagaatccgtctgatgaacagagcatcaagggtcgttgtggtcgtggcgggtaaagttggaggtgctgtactgggagaagccgcggtggaggacaacgtcggagctggtggcgacggaaagtccgctccggccgcggcggcggacctcggcagcggcggcggcggatggggccgaggtcggaaccggacacggcggctctggcggcggggaagaagcagcggctccggcggcggggatgcagcggcagtccacgcggggaagaagcaccggctccggcggcggcgaagaatcagaggctccggcggcggcagtccacgcggggaggatgaagtcttcacccgtggagcgatgtcttcgcgggtagaggaagaggagtgaagtattcggcgtggatggatggatcaaacgagcgaggagcaacgaagtctgcgcgaggaggaggagcgaagtctacgcggggatggagagtagtattcgcggcagtactcaatcgtgtggtggtgagatcgtgcgcgcggatggacggcaaagattactccgaatgatttcaccagtacgattggaggggggcaacttctcctttttatattagtatagatttctctcgattgatttttctattgacgatgcatggtgactaatgtacttgggccatcatgggactttctctatcggccatggttgtcctacgaatttatctctgtgtaagctcgttaagacttgcaagcagctcgtaaacccgcttgaactggctcgttatgcctaacgagctgaaacgacgtctcggctcgtttcaaaacataatgagccgagctggtcacaagcctcgagcttttcgtccagccctagttgcgtcgttctgctactccgttctactgaggttcattaggcatgggtaacaatcccatattgctggagatataaggcaaatggactagaaatttgcccaagtggagcaagcttccctagtattcatcaccacgatttgatctcacgagtttaagtttagcattatgctgattttccactttggccttaaatttctcaagagatttagaacaaccattaatgggataaatatagccaaaacgggaataatcatttgtgaatgtaatgaatgagtcaaagccatccagaaatgtcattgggaacagtccacaaatattgatctgaattatttctagtggcccctttcttaattgtcttagtgaaatttcccttaatgcaatctacgtaatgatctacttcagaaaaatctgaaggaaggagtatttattctttaatgagacattcaattctttctctagaaatgtggcccaaacgatagtgccataattttgatgacatctcagctttatcattatatgcatttataacattcatcacaaaatcatccaaagagagcaaatagagtttgtctcgcacgaaggcaagacccacaactttattattaaacttaaacatgttccttttgtaaaatgacagtcataacctgtctctactaagactcttaaccgaaataagatttctcttaatagatggagcaaataagacattatttaaaattaaattacagccgctagggagtctatgtgtgaggtctccaacagccctcacttcaatctcggctctatcaactactctaggctatgaacttttcacctatttcacaaagttttgatgtgttttatgttgactatttgttacaccaaattgagaggcgttatataaacaaaagtgttttagattcttgataactggagtaatttaattttaaattatttggagctagaatatattatatgaaatttatgacttatagtttgtaatttagtagtacttactctacaatgttaaagtttagagatgatctttatattaaaggttccatattttattttaaaacgtgaaacaatacgcttctgtgaatctagcaggacttggttcactctattttgagctaagatgagtttcctatgaattttagaagttggattatgtgtgtgttgattattttgctattcatatttttagtgatgtttcaggtacagccgtacaggaggtgcaaaattttatcttactaaattaaagtccacatcttgctgaacctacagaaatttggttcatctcaaaacaatttatatttgattttatacggattttacaatttaacatattttctaattcaataggaaaacttgttaatatttccattttatttaaaagatttcaaactggcgactttgcatgaagaaccctagtttttatggaaaccaacacgcagtcctgtgactgttcaatggtgtgggatatttacagataggatcctagattttatctaatttccagagaaagtccctgtgttcctcccagagcagggcagcatggccgacggccatgcctggtctcggcggcggcgaacggtggggattcgagctacgcgaccaaaagaagaaatgtataggggtcctctgcgaactcgaagatgatccaatcacgggctatggtgaccggatttgatagcagtggcggcgcgagcggcggcaacactcgggtgatggtgcatgtggagctagagctcgtttatggctaaaagggcacatgaatgtgtgtttacaggggtcttggagactcattcgatgtcccgcgtggcccagcgaagcttggatgacggcggcagcggcttcggactccggaaaatgctcgatccagccatcaatctgccatgcgtgcatgcgcagggtgttagataggtgctagggatgctccatgcgcgaggaatcggactgggactgaccagagtggacgaatttggagacggtggtcataggccggagttggagaagaaaagctcgatccctctactcggtgcacgaatcttcaggaatatggagggtttttggagaggacctctaggggaagcctatggcgcggtggctcgccccggcttgctccagatcgacggcgacggacatgatgtcttggcggcggctctcagagcgtgctccaggacgaccgagagcgcggcggtgttcccagcgattggctgcacaaattggaccgcggttaaaaggaatggaatcggcatggaagtgggatgacggaacgcataagacatggagaccgccgtcatctttgcggccgacggcgggaagggtgtggtcgacggcgatctggggctgctctctcggtttcttctactccatgggatgggagggaagaggacggagagtacatgcaaaaaggcgaggtttttgctcggtggaggagacctggggctcggccggccgtcgcccgtcgacgcgtggggacgcgcgtgtcgcgcgttcctgaatgtggggtgacctggcacattctgtgacacttacaggtgggtcccacatagacctggggcccactggcagcgagagaggaggacatctcttggaaaaacttcaactctattagctgcagtactgttccaactttgactcgaacttttcttgtattggtgtggtttaaatggtggtggcctactgggaagtggtacagggatgtttgttgcagaggttggacaaggtttcaggccaaattgaattatggttaaattttaagagagttgcaaagtaggttaactgaaatctgtaatttccagattttgctgctttagatgatttattatttgaggtatcaaagtgagtgataaaaaataagtaaaaattacatttgtcgatgtttgaggtcgcgattccggtatttgcatagtatgaggatcgttggtactaggatatatgcgagattgtagtaaaaaagatggggacgaagatttttatacaggttcgggcccctgaattgtcaggtaataaccctactcctgttggccaaagccggtagttgctcttattcaccataaccacaccagtacaatatttggggtagcctatctatctgttgtcgacatggcgatttgaagtgctgacacgtagttgacaacagagtagtcttcctcctcaaatccgcatccggcgagatcaaagacagcgctatgtctctcctgacagtatccgtagacaccgtagggactagccatgcttatctctgaagtcgatatccggcgtcttgtcttggcgcatgttggcttgtatgttgatcttgtatcttgatctattgttccgtgtcccctcttctcctaggggccttgtatttatacccataggtgttctcttgtccaagtagaactaggaaaaccaatatggatataatccgagtagtccttatcgtatccatatagaactctatttatctttccttatccagaactcttatccggaactccttctatatacccgaaggttgtttccgtataaaacatggtatgtggtgggtcctgctaagatttagtcaactactgttaggtatgtagtatccataaccttgacaacattgggttttacttattggatagtacttttggtgaaatttttcatgattttatattgctccgattagatttagaaatgcaccaaggctatcttgtttatgtgttactattatagaaatgcagctaagtgtttataaaaattgtatttggattattctctaactgatgtgatattgttaggcttgattttcattccaccgtccacaatctcatgtgatatttgtaaatttatttatttatatatttggaattaagttaagtgaagactatggtgagagtttaatataagggtgctaatatatacttattaacttttgtgaccatgacctatgttcagatgagagacaaaactaacttaatgaagtttgtcattggtaatgttgtaatattttggttgtaggaattttagggaatgcttcccattcttgacattaggtgttccttaacttagttattgctcctagatttgagtgatgcacatcagacctattatgaagtgcatttaaaattcaaaaacacaaaaaagactcaagtcacactaaaacattatgcacatgcaattatacactatgtttcatttttatttccggttagtaagggaaaagttttaaattgttacaaaattctcatatgtgcactagttaaattagccttgtctaggtgagtcaaaattttaagatttttatttatgaaaagaattttcaccaattttagatgcataatttggaattcaaatattttgggtatattacatatataaatgcatcattaggaaaatttgtatcattcacaagtagtccaaaacttatttggagatggacagaaagaatgtggacccaatttacttggagatgaagcattgccacattctatgtacgtatatatttttgttcttagggggacccttcccacgcagagtagtcaagagatacaacactcgttgggattttcatcgttagaacgcatagcgttctccggcggatagtacggcggctgcctctgcattgcttcttggatgaggtcactgaaggtcttgagaggctccgctgccaggtcgcacatacgggccgtaatgtcttcaaaccgatcggccaaatctgcatctgtgttgaccattctattatacacggtcgcacaaagggatgccaatgcttcctgcaatctcccgtcattgtcttgggtagctgcaaggcctgaacctgccggtgcagtataacttggcactctttgtatatgtgtttctgtcaatccccaaccaagtacttctcttagtacctgcgacattaactaagaagttagcaatacttttagacactctgtttggcataaaaaagatcagaagttgtatggtgtttgcattctaaaaatagtaaaaatccaactatatatccacaatgaaaggtacaatgtaaaatcaatagttatagtatatttcattatcataaaaaagatgtttattgatataggtagtaaatgtcagagattgcataccttgggcaacaaatcaatcatggcctccttcagattctgaaaatgttcatcatcgatggaatagttaccatataggtgtttcaggacatctgctgcaattttcctgtggatgctgttgtacaagcctgaatcagttttaccgatacaatcaatcatattaggaccatatttctccaatatgatggtggcacagcttccaaatccgaaagatagctgcgccagctcttcacctgccagattttcaaactgggagcccttactcttgtgaagaaacatgtcgatcagggagccaatgaatctttctttgttctggtcacccataaccgaagatgtatcccagcatatttgtgcgagaacccttatagcttgtttcttgacctcttcgtcacatttgtcacagtcgataatactctccaaggagctgattgcttccaagcttgtcgatatttcgcgccatagaatgttgtttgatcttgtagtcgcagacatgaaccgttttataagtttcaccccagggtctactatatcgcgggaccatttgtcatgtttccggaggtgtagttctttgtcgtttataagtgctactatcttccagaccagatcatccgtgttgctcatgatcctcaggttgttctcgtcgtcggagagctttagaaggatttgaatgcctctaacctgcatctgtccctcttcaccgacagaaatacggtggccatactcctcaagtggctcatctggctgatgaaatggcttgagatcaagcaacgaagatatgcactggatcccttgcaggatcttgtccaagcggatgtcgattacaaagtgttccacaatcctcgcggcgcgcaacctgatctcttcgtcatatgggcttttggaatccagcatctgtaccaagttgtggagtatggagccggaggacgctgatccaattgtattggatatcagcatactttgtcctggaaatccgctcccaattgcacccgagttaaatcggatgagtgtatcaagaatccttactccagataggtacctataagataatagggagattttataaagagtaattttacgatccctgaaaggtaaaaaaagaaatgcaaattttgatatcaccttgtaaaagaggtactaaattttacattaaaaatttgatatctctcggaaactcctaaaggaccgtaaaattacttttttataaagagtattgctatgcacataaagtttcagtcatctaaaattatacattcctaagcctaaaattgtagagatatagaatgcgcaatttcacttctttttaacttgttatatattgtttttaccctgtttttatcttagtttggataattttgcatggaattttataaacagtcaatttatttaattcctttcatataaggaacaaagggagaggtacgagaaccactggatcagcatctaagggatgaaaaaaaagtgactgaaatttatggaaaggtacctgttaggtgatgtggactccatcagctgtgcggcgtacgtgatcatgttccgaccaccggcaaaggacgggtccttctcgcatcccaccttgatctcgtgcaagtaatccaagaccgatccacgtgacgcctcgtcgaacccgtatgcatcggccacatttcttaccagcttgttttcctcgtaagcagagatggtcctgtaatagaagagcacaccctgaaacaaagccagggaatagagaaccaccagcgccggccgcaggttcgccttgctactatctccggagtccggccgtctcaccgtaatcctgaaagattagacgccacagcgaaatccagggagaaacgaacagcccaaacatgtatagcaggaacagtgggcatagcacgatggtgaacaccagcacccgaacggcacccctgaacccgagctctgtgcgggtatggggcaacgcgatgaagactgaagcctcccatagccgcttgaatgaatacccaataaggcgtatatttccattcagaaaaacatcgaatatcctgtggtatacactataagtttcagttttttttatttgaaaggataaatgttgcatttaaaaagattgagagaggagatagtggaaatagtattgtttgttgtcaacaattcgtaaaccaacaatgcttttagtataaatggagcctaacattctgacgtgttagccctagataagtcactaccacaagatttttggagagactagccaacggatcctgtcgaaggatgggatcaccatccattcttaccagttttctcttctttcgtatctcgcgctccatcctcctcccatctatcgacctccacctccacctcccactctatctctctctctgtgtgtgactgctcccttcattcctaccggaacaggggtgggcactgggcacacgccccttggtgagcaccagcacctgtgccgctgtgcgtggtacgccttggctttgaaggctcaaggcatttcttctggcggttgagttgtctgcgacaagccacttcgagaaggatgaggtggtatccgtgatctctatgttgcgtgttgcgctaccggtggtggctattgggctctcacacgcaggggcgggcctaccataattcataggtattcagtggaatacccaagattttggacaaaaaaattcatatatgtaatatatatttcatatgtatgtggaaaagtatgcaaaatagacttgttccttaaaagaaagcccgacttagcaccatcccacctccctcctctactcggcccattggcacaataacccaaatcagcccaaaatggatgtaaccctaacctctccagctctccttcccgatctcctccatggcatggctacctagccccctccccaaccccgacgcgacggcgcatcgcctcctacccacccccgagtcctcaacggcggcagcgcccagctagctgcggcgcagcagcggctgccaatctcacgccgcgcgtccgtgcccccaggccggccgccgcgaaggccgccattgcccacgcgccgccgcccctgccctgtggcgcccgggcggcgagccaggcagtgcccgcactccgccgcccgcacctctaccctccaccagtccacctccagtccctggagctgcctcagacttagacggctagacgcccagacccaaacaaaggtggaaggttagaaacattttggtaatttggttggattaggattttagtatttaggtcatagttgaatccaggatggttcatttgatttaggatttaggatttagtttatttgaattgttgaatctaggaattgttcatggttgaacattttttatttaggatttgaatccagtcattcaggaatggttcatgatcgaacaatcgaactttgaaacttgtgattcacttatttgtgaagctctgtagcagagttagtacttataaattgcataagtgcacatattcagcagacttagtatggttagtacttaaattggaagaccatattgttgttctataggtttgaaacatgaagaggaaaaatgctcccacggttaatttaaaggcttttttagaagcagctgttgcaaagaagagaactcaaaaacaagttaagaagcaagatggaataagaatatttgaatgattgtttggttacattcattgaaagggatctattctttcaagttaaggataaagacatcattactcattttcatcaaaatatcaagaaacggaaagttcttctctaaattataagatttcttattattttttcattttctatgctctataaatttaatatgttttgtcaattaatactttagtatgcttaacacattcaatttataatcaattctataaatctacggctttttaaaatcatgtttataccgttatatattatacaaatattagactttaggttgaaaaaaaaattctcttccagtttcaaatacccaagttgaaaatcctgggcatgcccctgctcacatgccaggggaacgggaagacttgcaatgagtgaagtgagctgaggtgtgtgtcatgttgccacaggtggtacctgtactcgctgttgcacttgcacacatgttgaggatctaacggtggtgctccagatcgaggatggcagcaagaaggaatggtctccctcaacctcccagaaaggtacctatctcatctccgtgcttgccctgcctcctttcccttatcctctttggctctcgttagcatgaagggttggtctgagtagctgatagtattactcccttcgtccctaaataaaagggattttggttggatataacatatcctagtacaacgttgttaaactaggatacgttacatccaatcaaaatcccttatatttagggacggaggaagtacgtacttaggccctgtttagttccaaagtttttttccaaacttccaacttttcatcacatcaaacattttatacacatataatttttctatcacattgtaccaatttcaaccaaacttctaaacttcagtgtgaactaaacacagctttagtatctagattgatggacctggtacatgtaggtatcagactgcagcatctaaacagttgaagtggggcgtttctagtggggagatcaatgtggactgacgagtggttagatggtctgacaattaatcatgctcattaactatcccgtccttggaacgggcccatagcatagccgtagtcaaagcttttatacaggttcgagacgtcattagggtaataaccatatgccatgttggttgtaggcaacatatcctatgcacacaggccctcacgtgtatacacgtgcacaccaactaaaaaatgtcaccaaaaaatctagaaaaaatcatacacatactttcaa

SEQ ID NO: 65305 - DNA, 3474 bp, Oryza sativa
aaatttgagggctcctttttagaccaaggagaatttaacaaaaattctccgggccacatttgaatttttcttgcacgtattttagtgtttgccaatttctttccgaattttaattaattctattattccttttagaaaatggattttaatttggaatggatttatcaggacgtgacaattaccacaaggtgtcaatgctcactttcagccccagccatcagttgacaagacagaggccagtatcggcattgtacctttggatgttccagcacagcagccaagaaatcaagtaccagatggagaacccgagcataagaaagttattgtctgttacaactgtggtacctgttaaggaagcggacatgcccatcgccaagtggtcactggagcaaatgcagtacctgttaagcctggcgctaatcagaagcaaccataatactcttatatcagtgttcaaatacttttgttttatagttgttccccgtcaatcatgtaataacagagaaacatgagataatgaatgagcttgataagtttattgagggatccgtgttaggattgcaagtgctgtgagttgtgtacattttgttgctgattagggagacctagggtctcatttccgtaagctcataatctattatgaatcaaataacctagcgattgatggcgaagcaaatcaagtgattaacccaagagacatttgtttggactaagagtttcagatgtgtcttcttcggatcaaaggcctacacccgttgtggagaaattggacacgttgctagcatgtgtctcacactctgcactcactatgaagaagaccatccaccaggggagtgtcccactcgcaaggtgacatgttttctgtgcgaaggaacaaaccatgtgcccaaggattgccaactcagtgtgttgttgaccaagaccgcagaaatccaacgaacaatcctacgattgtctcgtcagctagtcagctccaacaacaacatcgatgatatcatccacagcaccaatgctcctcttgctccacctaactctgcaataaatcatggcaataatacctacagcactaaccattctctgcaccgacagccccagcaaagaattgtcgtcgatggaagaagttgtgtctctccccgacctactccaggccaagcaaagggcaatcgacctccggagggcgataccaagcagaagaccgtcatccgcttcaaccagcaatcagaaggaagcttctcctgtgaatgatagcattatgcagtcctatcacatcatcacagaaccaatcaaggatgcagtcactagaacaataccagctatatctctccagaatcaaaatgagcagccatgtttgtggtttccagttcgctacttatcatggtgtaatcgaaagtttgcagcaatcatgtaatacagaaatatattcatgtctataaacagtgagcttgctatgcttatggatgattcatgttgaggatacaatgtaccgatgttaagcaccgtccctttttgtttaaggcagtgccttgtattcatgtaatatgggagaaatttgtaataaaaacaagtcctaagaggattcttttggaagatgcggatatgtgatcatgtgtataattgtttactgacaaaggagacatagggtctcatttcagaggaactatgttccaacctcgagttaataaccaacctgttgatagaaaagaaaaccaattaaactgtgttgggttaaaaagccaatgagacagtagttgggggtaggagtttggatacgccttttacagatcaagataaggattgttggatgaaacccataagggtacctgccatgcctctacattgataagttcggatatacctgcaaacagttaagaagatccaggagacatcaatgtttgagaacatagtagtcgatggttggtaattagtctatcaggtatcagaagagggtcaaaggtgatatggcagaagaacaatttggatgctccccatctcgaggaagcactaaggatgatcatcggcaattaaaccctagtggcatagatacagatagcaagcaatgtatttccctgaaggtagtcagtacagctttctgacaaaccacatcaaggtgtcactgaaaggcagcaagccaaaggacctcatcatccccagaagcgtccgcaatccacattaaagaataccacctgttagagataagccgaaagaagattgataaaagagattggcaaagatgttctctagcatgaaagaagtaggccgaaaggtgattgataaacagaaacatgctctgcatcgctcaaggaagacccctaattgtaattgccccgcaacagtcaccttgtcattaagtaagcaagatgacctaggtaaaagtgtttttatgaaggcaaagagtgaaatcttcaactcggtatcagatgctacacggagtgaaaagtacaagcaccggttaccaggcaatgccatgacttgggagatgatccaatgggaaagaacacatcaaggttaaaggtgtaaaggaatacgttgaatgctaactgaggacaacctgaagataataaggggaagtaaactgaatgtaaagaaagtgaatccgagttgattgttcgtgagggctattcccagttatgaatcaagtgatatgttcgaagataatctacaggggtcagattaaaagcacatctaacaacgaagcctcagatttgacagggtaatgattagacaataacaaatccagcaataaagccattggagaagacgtcaaagtatgtcaagtgggataaactggttctcttgggaagcataacttatagttagagtggttgacccttgcatcgaatagcagaagtacctagcaccggagaccaggaaagctaatatgagacagttggtggcaagttagaagtgaatgacaggcatgatatccttatgatgacaaacctggtaccctagtaatgacaagctagtgttgacgcatgacataaagtggtgacttgtatgaggttgactccgaagatatgaatcatgagaagttcgggaacggaagcatcattgaactaccgcaacctagtctgagtcagccaaaaggtgcaccctggtccaagtcaggtgaagagaagattccatccgcaacaggaggtcaagccaagcagttccgagtggtgaagttttgctggaagtttgtcaagacgcaacggaagaagtcagacaagaagagaagaccgcccaacctatcttcttgctagcctcctcgaatctcggggacgagattcttgtaaggggggtggatttgtcacgtcctgataaattcatcccgaaataaaaatcatcttctaaaaggaataatagaattaattaaaattcgaaaagaaattggcaaaccctaaaatacgtacaagaaaaattcaaatgtggcccggagaatttttgttaaattctccttggtctaaaaggagccctcaaattttagtggaa

SEQ ID NO: 65306 - DNA, 1953 bp, Oryza sativa
ataaatgtttttttaagccttggcttaattgggaagtatcgtaaaacttttcttggggttgcccttcttctttccttctttgttaaagtagttttatcttctttgtttttccaccttgaagttccacattttgaacaaaagtcatcatttgccttgtctttcctgtaaagttgacagtttttttggacaaacatgaatcttgacataattaagtccaagctttcccattatcttcctggcctcaacaaatgttctaggtaaactcttaccatttggaattgcttgttgcaggatcgctagcaaatcatttaaagatttattactccacttgttaatggattttatgtaaaacaagactacaagaaacgaaagccttgtaagttcacacccttcccataaaggttcatgagcatctcggagtaaatcatagaacgcttttgtttcagagtctggcccactgttagaagaagttggtgcatcataatcattcactggagggctgctgcctgtgtttccaaaagcatcttgaactagctgttgcatattattatcaattctattttgtgattttatttcactgttagcagagatgaatgatgcagtttcaccatgacaaccccaaggattataaccaagtaacattccattgtacactaagggagtgtttgaagagaaggggattgaggagattgggaagatacgcaaaacgaggtgagccattagctcatgattaattgagtattaactattttaaatttcaaaaatggattaatatgattttttaaagcaactttcctattgaaattttttgcaaaaaacgcaccgtttagtagtttgaaaagcgtgcgcgcggaaaacgagacacaatctctcctatctccacctaacgaacactccctaaatgatcatacacttcatcacgccttagtaaccacttattaacacatttcttgcacggacaccggatcttatcattaggattcttttccctatatgcaaactcaagaaaaccctctattccagcaaggtactcatcacttggtctaggggaaagcagtaacttcttaatagcatttaaatccatcggttttctgtgatgggataagaaatatggttagtacatcagtgttcctaatttgacaaccacccactaaatttttttgatataattttaagttcaactcaaaattagtctgtctacagaatatatatatgatgtgaggttaaccgcacctggactcctgacgttgtgatccagtacatacggcggctatattggacatattgcggagcagcagatgggtagatcaggcatcggtgaagaggttgggcctgaaaaaagcactctggataaatgaaagtaatctgaggcaacatgaacagccacatgataaggacattacatgacaattgaaaactgaaaatacagttccacaagaacagtttgcatgtcaatcttgattaggagcagaggagataacaggacctacaaatataaattttagaacatttgtgcactacaaatatgtccctgtgattagctaactggagctctgatactctagatatacagcctttacctacgatctgaacaaataaatgccagatataataggatggaagataaaacaaaaacgatgaaatatttcgtttgcactgaaacaaacaagtaatagatagaggtgtgtctatacaggtcaaggatcgaacacctggtgtgcataaaaaacagagtgctcctaacctggcgtagtttgcacttgcagatgagaggtctttgggcacaaccaaaatagctgatgaagatgcagtagagagaacagggaagatgccagccgcccttgggcagagcatcagcaggatatggggaacgccgttcttgggagcggctcgatggagcagctctgcacggtgcggcctcggaaccggtgcagcggtgctggcggacagcgc

SEQ ID NO: 65307 - DNA, 12337 bp, Oryza sativa
cattcaacaatttagccaaccccacagcatttcaggtatagccccttcggcccagccggaggggagtacaggtcatggtgcgcctagttggttgtcgtcgaatcagccgggtctgggggctttgccttggagtcaaggaccgtagttcgacttcaacaatattgctcaggcaccaaccgttccgccgcaagcaccaacactaggcttcgtggcaaaccaagcaccaaaccagtccgccatggcatggccccagccaacattcgacccatccatggcagctcaccaagcatcaccaatcggagctgggcagccgaacaccgtggcccaacctcacgcgcaggccgtgacttcgcctttcgccacaccgtatccgtagcaaggtgccgtgaacagggcagggggcgaaaaggggctactgctgagtgggggaatcaagacccgtccaatcccaccccagttcaagttcccacccgtcccacgctattcaggcgaaattgacccaaaggaattcctctctatctatgagtctgcgatcgaagcggctcatggcgacgaaaataccaaggcaaaggtaatacatcttgctctaaacagcatcgcccgttcttggtacctcaatttagcagctaatagcatctactcatgggagcaattgcgcgatgtctttgtccttaactttcgagtcacctacgaggagccgaagacgcagcaacatctactcggcattcgccagaggtcgggagaatcgataagggagtacatgcgtcgcttcttgcaagcccggtgtcaagtacaagacataaccgaggcgtctgtcatcaatgccgcttcggccgggatactcgagggcgaactcacaaaaaaaatcgccaacaaagagccgcagacgcttgaacacctgcttcgcatcattgacgtgtacgcatggggcgaagaggattccaagcgatggcaagcaattcaagctgagtatgataaagcctccatcgccgctgccaaagcccaagtacaagctcaggtcgccgaaccacctcctctcgctgttcgccagcctcagccggcgaaccaaggataaccgccaaggcaaggccaagctcccataacttggaggaagttcagaaccgaccgtgcgggcaaggctgtgatggctgtcgaagaagttcaagccctccgcaaggagttcgattcccagcaagcaagcaaccatcagcagcccgttcgcaagaaggtccaaaaagacctttactacgccttccacggacgctctttgcacaccacggagcaatgctgaaacattcggcagcgtggcaacgtgcaagatccaaggccgcagcagggagcagctgtcgaagcacctcgcgaagacgttcaagaacaagcacccccggccgaacagcgccaagatgtgcagcgtcgagtaatccaagtgattacaagggccgacccgccgaatcagctgtcgaaatgacaaaagaagatgcagcatcaaatggtccacaacatcacttcggcgggcgaaggggccccacaatatctgaaccagcaaatctctttcgggccggaagatgccgaaggagtaatgttcccgcatcaagaccctctggtgatctcggccgagatagctggcttcgaggtccaacgaatcttagtcgacggagggagttcggccgatgtcatcttcgctggagcatatgccaagatgggattaccgaccctagcccttacccaagcatcggcatcgctccgtggtttcggcggtgagtcagtccaagttctaggccaagcgcaattgctggtagctttcggcacaggcaaaaacagacgcgaagagaaaataatgtttgacgttgtcgacatcccgtacaactacaatgccatcttcggctgtgcgaccttcaataagttcgaagccatttcccaccacaattatctcaagctcaagatgcctggcccggtaggagtgatcgtggtcaaggggctccagccttcggccgcttcaaagggcgatttggccataatcaacagagctgtgcataatgttgaggccgaaccacatgatccggcgaagcacgcgccaaagcccgcccctcacggcaaggtaatcaagatacagattgatgataccgatcccacaaagcttgtatcgctggggggcgacatgggcgaagaagaggttgagaacatcctagaggtgctcaagaaaaacattgataacttcgcctggggccctgatgaggtgggaagtgtttcgacagatctcatcatgcatcacctggcagtcatgccggatgccaagccaaggaaacagaagctacgcaagatgtccgttgatctccaagaagcagcaaaagccgaagtccaaaaattgctcaaggctagggtcattcaagagatcgaccaccccgagtggctggcgaatccggtgctggtgcggaaatcaaacgacaaatatcgcatgtgcgtcgatttcacaaacctaaacaaggcatggccgaaggatgatttccccttgccacggatcgaccaactcgtggattcgacagctggctacgaactcatgagcttcttggatgcgtactccggttaccaccagatccacatgaacccggccgacatccccaagacatccttcatcacaccattcggcaccttttgccacctcaggatgcctttcggcctgaggaatgccggggcaaccttcgccaggcaggtgtacaaggtcctttacaagcagttggggtgaaatgtagagggttatgtcgacgatatcgttgtaaaaagccgcaaggctttcgaccatgtgtccgacctgtaggagaccttcgacaacttacgcgcggcgggtatgacactaaatcctgataagtgtgtttttggtgttcgcgcggcaagttgttgggtttccttgtttctgaaaggggcattgaggcgaaccccgagaaaatcgatgccattcagcaaatgaatcccccgtcgagcgtacgtgtcacaccctaaaaatcctaaatatataaattgttgtttaattggaattatttttaaaaggctagaagagaagatttaattttaattaataaattccaatataaaatggggccagataaaatttcattaaatactttgtttaattctataattcctagatttttctgggatttatttgagctaaggaagtatttttaataaatggaattgcatttcatgaataatttaaattgaaaaaggtttttaaaagtctcttttggctttgggccgaaagtcggcccaaaacctcctctctctttcccccggcccaagtcggcccagtccgcagccgtccgcgcgcgcgcgctcgctgtcgctgacaggtgggtcccacctgtcaatcttcgtcttcctcgcgccgccaccaccgcccgaaccctagcgccgcgccgccgccgtctccttccaagttcggccgcgccttttccttctccggtgaaatcaatagaggggaaatgatctctgggatctcctccaccttttctcttttggaatcatcggctaatttcgtttggaaatccgtggattcgaggtcgattcggatcggtctctctcctccgaaccctaacctttccttctcgtcgccggtcgccatgggccttcgccaccgccttcttgcccctataaaaggatccccaagtccgccgctacccgtggccacccttgccttcgtctctcgccgtcggaagcgccctagcgccgtgagaccttgtgccgttgtcgtcgccgtcgctccagccgtgcttcgccgtcgttccactcgtcgccgtcgctcggggagaccgccatcatggtcgtcgtcgcatcgccgtcctcgtccgccccttcgccgtcgctgtagaccgccggagcatcgccgtcgtcgtcaagccgaaggactccgccgccttttcctcgacaccgccgccgtctgttcatcttccgccgtcgttttggtcatcggtgagttcgccgcgtcgcgctctacgtcctggtgccctccgtttgtgccgtagcgccgtcgttcgccggcgagcttgcgctcccgagccgccgccggaggtgacgtcgccgctgacgtcatcgggaccgtccgccgtggcccggtcgtggaccgttcgatctcagccgtccgttttggataggatcgatcccgaccgttcgttcccgcgaaccgctgccgtgcacccggtccaccgcaaaccctagccgctgacgcaataaaccctttttccttttcaaaaataattcattattgcgtcataattcaattaaaacccatataagtgttttaatccgatttaatctttaaaaattcataactaattcatcttagctcggatttagttggttcaagtctctaaatttttctaaaattgagatctacatgttaaaaatatccacatgtactgttcatgcttgtttatgtgctgtttggtgattttgctcttttttgcttagattccgacgtttccggagagtccgttttcgcaggagaagaatttgaagagttccaaggccagcaaggcaagtcacacagattccaaacaaccctttgagcatgttgatcccgtttaaagctactgtttctattcaactattgcatttattttcgaatgtcattgggtggaattaacctattgtttgttatagcccctttgttcttgcttactttattccttgataccttgggtgtttataactcgactagttgggctatatatattggttcagctagatattagatgtgattgcttagccatgcttagaaacattagcacactattgggataacttatgattcactattaattaatgatggcttaatgatagttcacgatggtcaatcgtgattggttaattaattatttgccaattaaaacttgataatggtgggttgtgagcacatggttttgagagatcgtgctcatgacaattaaggaccggttcacgagtttcggttgtgaaacattaaccgtgccaaccacaagccagcgtgggcaacggctttacctttggtatagcatggttcattgcggagcaccagactgagaagtggcggagataagcccacgggggtcgctggggagtccatgccttgtttataagggggtgattatgatccaggaaaggtgcgctgcggtggattgtgttgtgcgaggggtattgtcacagctcctttccgaggtaccgtggtggtattgaggcacatggagacatgatgtggggctgtgtcttgtgggtacagtggtacacctctggccagagtaaaactattcgaatagccgtgcccgcggttatgggcgggtctaacaatgtctttcatgattagtctcacacttctcaccttaataaaagatgctataactggtaataatttgattagctcctggtttggaatggtatattcctggtttggagatagaactgtacagccgggatggttgttcagaatggttgggcctatacaacagggtatgttgtatagcgttggattaatattgtttaattattacttaactgttttattaaattctgaaatgtttatcaaatgctgtttatgcaaatgaaaccctactatgccatcctttgttatcctgtgcacttgcatatttgctgcgtggcttgctgagtatatcatatactcaccttgcaatcactcatcagaggaagggttctacagtgatgctgatggtgtggaggattaggtgtagccctggtcaagctgcctgtggagtggagtcgtctgcgccgtttatcttatctttccgctgcttagatttttattgattgagcggaactatctacctctgtaatgacattttgttcgcttattaattagagtaataattgtactcaattatcaatttgttattgtgtgcctcggctgattcttggacgagggttcacacacatgtaagcgtttggaattttggatagaaattctgggcgtgacaagttggtatcagagcccccttgaccctaggttatgccaaacggttacccatagaagccctctaaaaatattggaaaagtagaactgttctcctccccttctcttttaattaaaccaaactaatagcacatgcaattcataatctcttttagtggttctcgttcaaaatttattccagcgttattagtactgtacatctattactgtactaatggctcatttaccagcaaaagttttacaatatggttttatttaatcttgctgcaataaaataaatttagcatgttgattttataactttcttttatttctttggaacctgttgttcaaaagtacaaaatttgtgaccttatttccaactgtttcaacttatcttgcaagcttggtttactttatttacttacctttttctttgattttctaactttattcaaattaatccaaaaacttgtgctattaattggataaatgtcttaactccctcctttcacttgtctttagatgccgtgctacaagcctgagtacttgtttggtgttgagggatttgtccaggagttgcgtacgatgtcctttgccataggatttgggactacccctttttatgcccagattcctcatgatcgtcacgaagagaagtgccgagtcaaagtcaccttgaacagtaatagtgaagatatcccctcagtgatgttcgaagctggaggaagaaactacatccatgcatgtcaggaggtggcaaggatcgccataggagagctccgcgatcgctacagtgatcagttggccgacactgagtatctctaccatcctcgcaaccacagggaagtgaccgtggcagctaccttgagactgaaggaattgagaatgatgctaccacaaagcatttggttgagatgctgtgggctatggatgaaacccgtgcagagactgtgttagcagctcaagatcgtgaagaccggaatcatggtaagatttgcaagctataggacaaagtggatcgtttagagaaggaactagccgcattgaagggagaagcaccaccgcagaaggccaggattcgtcttaccgcaaggaagagagctctatttgtccctcgctaccaattggcgccaaaggtccgtgtggtggagaaagaagttaccccagccctagcgaatcctccggtcgtcaacgtaagtgatgatgaaggagaagaatccaagcgcacccattccaagatcgagtggggagcaactcaagatgatgaagacgagccgaacgagccttcaatcaactccgatgcccggaagaactagaatgccttgtcaaacagttgtcttagatcgttgtgttagtttgcttgttttaagtttggttgtgtgtgtctcgcatgtgatttacatcagtggtgggatgtaagtccatgcgtttgtttgctttcgagtgttaggtagttggtgagtttagtggtgtgagagtctttagttttgtaataatgaaactcacttaagatcaataaaagttaaattaattctctgtcctaagtagtttttcccggtttctcttcttgtgatcctgcccatgccagatggtgctcactcgcagcaacgggaatggccccaacaacaacaataacaacaacaatggagagaatcccacacttgcccaagtcctggctcaacaggtacagcttatgaacataatgatgcagcaacttcagaaccagcagaaccagggaaataatcatgcacctcctcagaacaagttagcagaatttcttcatgtgaggccgcctactttctctagtaccactaatcctgttgaagctggcgattggctgcatgccatagaaaagaagttggatttgcttcagtgcaccgatcaggagaaggtctcatttgcatcacatcagttgcatggccttgcctctgaatggtgggatcacttccgcctgaacaggactactactgaacctatcacttggcttgaattcaccgctgctttccggaagacgcatataccatcgggagtggtgtctctcaagaagaaggaattcaggtcgctcactcaggggtctcgctctgttactgagtatctgcacgaattcaatcgtctggctcgttatgctccggaagatgtgcgcactgatgaagagcgacatgagaggttcttggaaggacttaatgatgagctttcttacccactcatgactggggattatcatgatttccagaagttagtggataaggctattcgccaggagggcaagtacaaccgcatggagcagaagaaacgccggattgctcaattcaaggcacaacaagggaatagtcagaggccgcgtcttactttaggaccccagtccatgcgacagggaggttcttcgtctgttgttcgtccgcagcgtcagttcttcaacaacaatgcgggcaacaacatccgcaatcaagctccacgccctgttgcagcttcgacacagcaacagcctgccaagaaggagcaaggcagcaagcccgtggtgtgcttcaactgtggagacccaggacattacgctgacaagtgtccgaagccccgacgcgtgaaggttgtccctgcccagagcaactctactgtaccagcatcaaaggcccgtgtcaatcatgttgctgctgcagaagcccaaggtgctccggatgtgattttgggtacgttccttgttaacttagttcctgcaacagtgcttttcgattctggtgctacacattcattcttatctatgagttttgcgggaaatcatgggatggaagtagaagatcttagacgtcctttgatggttagtaccccaagtaatcaagcactctctttgcaacgtagcccctctgtcagaatagaaattcaaggagtaccatttctggccaatcttatcctgttagaatccaaagaccttgatgtcatcttagggatggactggttagccagatataaaggtgtgatagactgtgccaacagaaaagtaactatcaccagtaatgatggtcgagttgtaactgttcatgcattgtcttctgagcctttaaggtcaagactgaaccaaataactttggaagagattcctatagtccgggagtatcccgatgtgttcccagacgatttacctggtatgccgcctaaaagggatatagagttcagaatagatttggtaccaggaacgactccgatccataagagaccttatagaatggcagccaatgagttggcagaagtcaagaggcaagtagacgatttgcttcagaaaggatacatcagaccgagttcatctccatggggagctccggttatttttgtggaaaagaaagatcatacccagaggatgtgtgtagactatcgtgcactaaatgatgtgactatcaagaataagtatccgctgcccagaattgatgatttgtttgatcagcttaaaggtgccatcgttttctccaagatagatcttcgatcagggtatcaccagttgaggatcaaagaggaagatatacctaagacagcttttaccactaggtatggattgttcgaatgtactgttatgtcttttggacttaccaatgcccccgctttcttcataaacttgatgaataaggtgtttatggaatacctagacaagttcgtggtggtctttattgatgacattcttatctactcccgaaccaaagaagagcatgaagaacatcttcgccttgcactagagaagctacgagaacatcaactgtatgctaagtttagcaagtgtgaattttggttgtctgaagtgaagttccttggtcacgtcatctcagcaggaggagttgccgtcgatcctagtaatgtggaatccataaccaattggaaccaaccaaagacagtttcaaagattcgcagtttcttaggcctgcaggaatataatggaggtttatagagaatttttccaagattgctaagcccatgacacgattgcttcaaaaggatgtgaagtacaagtggtcagaaaatgtaagcagagttttcaagagttgaagaatcgcttaatatcagctcctattttgattttacctgatccaaagaagggtttccaagtgtattgtgatgcatcccaacttgggttaggttgtgttctgatgcaagatgggaaggtggttgcatatgcatctcgtcagttacgtccgcatgagaagaactaccctactcatgatcttgagttagctgcagtaattcatgcgttgaagatttggcgccattatcttttcggtacttgtatagaggtgtataccgatcacaagagtttaaagtatatttttactcagccggatctgaacatgagacaacggagatggttggaattaattaaggattatgacatgggaattcagtatcacccgggaaaggctaatgttgtagcagatgctcttagcaggaaaggctattgcaatgctacggaaggacgacagttgccattggaattatgcaaggaatttgaaagattaaatttgggaattgtcagaagaggtttcgttgcagccttagaagcaaagcccactctaattgatcaagttagagaagcccaaattaatgatcctgatattcaagaaatcaagaagaatatgagaagagggaaagctatcggtttcttggaggatgagcaaggaactgtatggttgggtgagagaatctgcgtccccgacaacaaagatttaaaagatgcaattctgaaagaagctcatgatactttatactccattcaccctggtagtaccaaaatgtaccaggatctcgaggaaagattttggtgggcaagtatgaagcgtgaaatcgcagaatacgtagcagtatgtgatgtttgtcagcgagtcaaggcagaacatcagaaacccgccggtttgctgcagcctttgaagattcctgaatggaaatgggaggaaatcggtatggatttcatcactggtctacccagaacgtcatcaggccatgactctatttgggtggtagtcgacagacttaccaaagtggctcatttcatcccagtaaagacaacctattccggaagttggttggcggaattgtatatggcaaggattgtgtgtttgcatggcgtccctaagaaaatagtgtctgatcgaggcagtcagtttacttcaaatttttggaagaagcttcaggaagagatgggttctaagctgaactttagtactgcttatcatccgtagacagacggacaaaccgaaagggtgaatcagattttggaagatatgttgagagcttgtgctttagacttcggtggaagttgggataggaatctaccttatgcagaattttcgtacaacaacagttatcaagctagtcttcagatggctccttacgaagcactgtatggtcggaagtgccgcactccgcttttgtgggatcaaacaggagaacgtcaggttttcgggacggacatcctaagggaagcagaagagaaggtgaaaatcattcaagaaaggttgcgtgtggcccagtctcgtcataagagttatgccgacaatcgtcgtagagatctaagttttgacgaaggagattatgtgtatcttcgtgtcacgcctcttcgaggagttcatcgttttcacaccaaaggaaaattggtaccgcattttgtgggaccttataagattgtcaatagaagaggagaggttgcttatcagttggagttacctcaatctttggcaggagttcataatgtgttccatgtgtcgcaattgaaaaagtgtttaagggtacctaccgaagaagctaatcttgaacagatagaagtccaagaggatctgacctatgttcagaaaccaatccgtatcttggaaatagaagagagaagaaccagaaatcgagttatccgtttttacaaagtccaatggagtaatcactcggaagaagaatcaacttgggaacgagaagatgaattgaagtcagctcatccgcatctgttcgccagttcttccgaatctcgaggacgagattctgtttaaggggggtaggtttgtcacaccctacaaatcctaaatatataaattgttgtttaattggaattatttttaaaaggctagaagagaaaatttaattttaattaacaaattccaatataaaatggggccagataaaatttcattaaatactttgtttaattctataattcctagatttttctgcgatttatttgagctaaggaagtatttttaataaatggaattgcatttcatgaataatttaaattgaaaaaggtttttaaaagtctcttttagctttgagccgaaagtcggcccaaaacctcctctctctttcccccgcccaagtcggcccagtccgcagccgtccgcgcgcgcgcgctcgctgtcgctgacaggtgggtcccacctgtca

SEQ ID NO: 65308 - DNA, 1580 bp, Oryza sativa
acacactatttgacaacttctagcttcgaggctaaaacaccattgggtttgttcggcacgtggtaagcattttccctgggagaaacgccaccaggggggtattggatgaatcccctcccatcacccaatcccctccaccccagggatctggttcccttggtcattcggaatgcaaatggtggggaaggttaacgttcacttcagacattaactcatgccaaacaacattcaacactgatatttaaatttcatatcactgaaaataccaagaaaactaaacagatagtcttgaaatttaaaaatagcattaccgaaaatttgaaatattgtaaataaaaaactaaaatttctggagaaaataagaaattctgaagattgcctaaaaagattatgaaaattctgaataccgcatagaatgttctaaaaattgcttgcatcatatccattcagtcaccacaatcagtcacccattcacaatacatgatttactcatttaaacatcatattcatcaccacaatcagctaggataagccactgaaaactaattacattcatttcatacaaacagaaagtaagagtcccaaaaatccaaattctccgtaagtgcaagagcagaaggcattactgcaaggctatcagtagctccattacctgctgcgagtgaaaaatgagttatcgtcagtgctctgcattaggcattaatccatgctatgaatagaactatagtataaaaagtagcagaattacagggaggaaatatacatcagtagaagagcatttccttgaacaatcgacgtcagaagggaactatttgtatagaaatatatataaatataagtagatcacattagcagtatagcatcattagcaaaataggatcagtgctcaagcttatactgagttcatggcaaagcacaaagaggctgaggggggctcctgagtatttactccgtacaggaaatgacatcgatctatctatgactagacctacagagattgatcgaaatttttacacattccaagtagtagtgcatccaattcatcccaatcccatgaattagcacatagtaaaagatgcagagcagggaaaaggaaaagaatcatatcgtcatcctcttcctcccgcttccgacgattagctcttgaacacatttttgtactacacacaagaggaaataggagtattgttcatgcatacagcactcatcatgacagataatgtttctttattaaaaacaaggacttgacagctttgcataaaaaccatcaacaaatacaaacactccatgctacacccagatatagtctactgtcatagaactgaatgaagaaatgcaacccggtgactgatcaaagataacacactgcttccaaaagtacacattggacaatgtataaagctgttccctcctttgtagcaaacattattacaattatattgcaacagtgaattaggaaattttcataaaatcgagatatccaatatatttgatcataagtcaattgttaatctaataaataagagggcaatgaaattctgtaacaaggaaatttagtactaaataatactactagtctg

SEQ ID NO: 65309 - DNA, 1168 bp, Oryza sativa
gctcacctcatcacaggtatgctcccatacatcttttgcatttgtactaatatgttatgtttgagtatatatgttgcgttttagttttagttccatatattttagcacatctgtagcacacagcacatatgtgtagatccagagcatagaatataaagtatgaattgagacatagacagtagtgttaattgtaagatgtagtttagtttgatctggagaatgtaacgtacttttagaaatttagagaacaatattgtagagaatgtaacttagggcgtagtacagaaatgcgaggttaacgcagttattgttttcatcaggtacaatgtcaagtaaggtcacatttcagatagttcacggtgaaggaaatattagatttggtccagatggtgttgatctgtcagattttgtaatgacatctaagggcatcgataggcctgcggagagaacatttcagtcaatttatagttggttgttgagaggatttagaatagaccaagaagtctacacaatgtcagtatcagttgtagtgagtcgtgcaacagaaggttatttttgggaactaatgccgatggacagcactgctgcttggagatatttgtgtggaaatggcttttgaacggtcatggcccctcgttatatttgtgtcggtacaagagaaagatataaatgtttcaatgcaaaccgaagatgtagagggtcctatcaatgcaggggatgttgttggaccatcgatgcaaaatgaggaaaatcaaccaagggaggagcaggccatgggcatggcggatgagggggagagagtcggtataattgttgatgaaatggagaggaaagattcggataatgaggaagcggacgacgacgcatcatccgatgaggaaggtgatgtaatggccactgattgggcaaatgaggacttctctggacttgttatatcagagggtgatcatgtaccctgggagtataaggagaacgaggtaattgagggtgcaaggtatgctcataaggatgagatgaaggaggcggtgaagcattgggcagtttccttgtagagagagtttagggtggtcaagtcaacaaattatgtgtatgaagtgaggtgcatgaagaaagattgtccgtggcgtgtctatgcatataagggtaaatggaatgattattggaaagt

SEQ ID NO: 65310 - DNA, 24414 bp, Oryza sativa
ttttcagctattagattagatcatattaaagtaattaatccttctttcctaatctcatgtgtacttgcaagagagaaaaataaatatatactatttgcccagaaaaaaatatacgtacatatatattcatgtacaagagactattatttgaaaaaaaaacatacatatgtacgtacatcagaaaagaactattaaccatgtcctcctaacccttaagtagaaagtttttacttgatcagtctacccctatgctgtactcctttctctccagtttatttcctagcgttgttgttgactaagctatatcgtatatctataatactcttatatataatacaataaaaaactattacattctatcatatgttatctatttttttaataaaaaagactgtatatttcttctgacataaaactaacgctataacaatcagatttcacaatacaattaaaaggagatcactaaggttccgaccaaatagaatgcagcacaatttattaatattgttgtcgaaatgacaaccgcatacgtcgaaagacgtggttactcaacagtggtaggaagaaaacgaagtgtattaaattttaagtttcccttcttttctctccccccattacatggccctaggggactattttatagccccattacaggttcttactactagggtttaggttatacaggagaatttacatgattaccctgatgaaaggacatttacaggggtacatgatgatataggggctcatgggcccctgatgggccgtctggcgatcgccggccctattgcccctaggcttgatgggccggaaaggcttcttcggccctcgcgggggtgaacttgccaaggcgaagtcgtcttccttcggcagatagtcttcgccttgcacccttcgcctgagatgcctctggcctggcaaggcactcgcacgactcttcgcctcatgccgttcttgctccatagtcttcgccatgggtttcggcagatttggtcgaagggcctcatgccatccgccaacaaatatgatgatgcaaaattaaagaaaattaacttggtgaaaaatacaaaatagtaattaaattttgaaaaagaactaatgattaaaaattacactccagtataaaatacaccttaatcatatcctatcttactataaagttataacccattaattctaaagctcaacatgcaaacatgtcacaagaatatatccatcatttttataatccttaacatatattcaccatataatcaaagtatgggatatcatatttcatctactaaatgtatttctctctaaacatagtttgacaaccaattttatttttttaataactaatataaattttacttttacctcgattaattaaaaaaattaaaagttatttaggaatttccgcagcaaagcgcggggaatcacctagtatatctataaagttcatccttactaagtgtagttaatactaattctctctctcataaagccacatcatcttaattgtttttagccttaggatgatacataaagggtgtaaattgcatctctttacatcacctcaattgtttttagtctttagaagatttatcaaaggtgtaaattgtatctctaccccaaaaggcacaccatataacccaatcatttataacctatggataattgataaaggcacagacatatataaacacatgaaaaaaaattgtataataggtaagaaagaaaattttataactcatatctactatataatcacacaattctcccacaacaacgcgcggggtacccatctagttataatgtagttacactataattataaatataaatgcaagtgaagtgtaattacgcagtaaaaacattcagattatgctaattgtgacttctctctctttctgccatttgccagtcgcgtggatggcatctgacctttctactggtcgtgtactggtagtagtagaggtttagagtagtagcaatggctcagctaagaagccagttagtgtcagcttagtaaatgctatagcacagatctcaacattagaagtaaatttcactttaaggcactatattattatggatattttgctttttacaatgtttttactttgcaccgggtatttttacctttgtgacttttttgaccaccctcaacttttttatccatctatatcatatataaaaaaatatggtcttacatataactgtgacacttaattcattattatgagccaacctacccaagatcgttgacatgcttacctagtccaaaataaaaatattgaaaatactggtgaaagggtagtataaaataaaacattcgaaaaaaaatatagcccaaagtgaaatttatgacctatatatagcatttcggattaaaaagttatcacatggaaaaatattctagcccctttttatgactttccgatgcaaataatcttgacaattacttcatgctttttaataactggtagtggatattttattcatttgcaacccacttttttctgtagaaaatttataaatatgttaactatcttttgaattaaaaaatattacatgaaccacattctatcacttttcatgatattataaatagtcttaacaattggcacaaataaacttgaaaacatatattattgtatcatatattagcccacggacatgcatagacgaattagatcaataatacaaagaaacaaaaatatcaaaaactcatatcacctcatatattcgtgaacaattactactcaagcaaataattttttcacgtggttctcaccactgaagctattagattatttgaagtaatgttgaatgatcaattctgcttatttttagaagagaaaattacttttgtaccactaaaatttagtagaccaattaacgccataaacaagtgctaactctattttataaatggactcaaaacttttaaaaaaatatttatatcactttcatcttatctatgtgtcattccctaaagggcgccaagcatagataacatagcatgctaagctaacttacgtatagcggggtcatgcatatgactgagttgaggtgaccccagtgacaggtacagtactcacaataaagttcaactggcctacttaaaattgtgctccacactgatcttgaggagcacagctatttataaatagaggcaattgcaaatttaccactactttgaattcttattgcaagactgccactaaaaaattacaaaaatgccactagtactgtcattcgagtggcatccttgcaaaattgaaaaaaaccagtagcaaatttgcaaatgtcctaaggtaagttgctcgtgcatctgtgcgggttttcttcctagttattttaaagagtaaaatgcactagcggtccttaaacttgtcaggagatttcacttaggtccacgaacttgcaaaatacacatcgagttccctaaacttggtttattgtatcatcccagtccaaagtcgtgtttgaccgtggtcttgcttacgtggcacgccacgtggacgatgacatgaaattttttctcttctcccttttttttgacccgctgtggccacaaaacatcatctccttttctctctctctgcctgccgctcgtctcctcctcgccaactcggttgccgcccccgtctctccgcaccacgccgcaccaccgtagctgctaatgacaagctagccatggcggcgacggcagatccgcgaagccgcctgccacgacgtcgacgcaccacctcgagctgtgggagcagctgccgccgccgctgctgccaactcccttaaacggtgggatcgaggagctccgcgtgccccagcctagcccctcacccataccgccgccgccgctgacaacgaagcctgagagcctacctgcggagatggacttcgagcccgagctcaaggcgctgcctccgcctccacttctcgccctgtcacagccgcaagtggatggtgcagtgaggccgtggaacctgcgacagctgacgtggcggcgcccagccatctccttgtcgtgggcggcggcggtgcccatgccgtcctcattccgacgccggaagcatgcgccatttttggtggcactcaccgcggaggagatcgaggaggacatctatgcgccactgcccccctccctcctgtcagcgccgctgtcctccctcccatcgcgcgcttgcctccggcatggcagctcagtggctcggcgagtggaccagaggctgatggagaaggagatggaggcgcggctgtggagctcgcggtgcagcggctgccggagagaaaaaaaaggaagaagggagaaaaaaaaaggagaagaagggagagaaaaagaaggaagaagggagaaaaaataaaaaaatttcatgtcatcgtccacgtggtgtgccacgtaggcaagaccacggttaaatgagactttgtactaggatgatacaataaaccaagtttagagagctcgatgtgcgttttataagttcgtggacctaagtgaaacctcacgacaagtctaaggaccaccggtgtattttactaaattttaaatgagcgatgagactgtcagacgagggagcttggcacaatacgattggcagattggtctttagaaatctcgttggcttgctctgctatgttgatgattcgatcgtgtggacctgtatttttaatggactcatacggatatttttttaggaggtgttttagatcatgggtgtaaagttttggcgtgtcacgtcggatattatatagggtatcgcatgagatgttcgggcactaataaaaaaaactaattacagaacccatcaataaaccatgagacgattttattaagtctaattaattcatcattagcaccacattgttaaatcattgaacaattaaggtgtaaaatttttgtggggatctaaacagggccttaatcgtcctatgcagccatggttggagtctgatatccctggttatagggagttgttatcatgtatggaatgatatattattgctccgttggtgtattcatgcacctgtatggtatcccatatttaggacacactgacaatagcaactagccgttgactacctagcctccatatttaggagtaaactctattcaagaaaggaccatcaatcttacatcatctgagccgatcaagcagtagccattgactacctagcctccaaacattcccaactgccaacggcagctccaaccagccacatctcctcgcggggccaaactccaacctactccctccgctaaaaaaaaatccatttctagcatcctagtatcgaattagtggagagtgaaaaaaatagtaagagtaagggtattgaagaaataaaacttctcgttttacgtgttgagggtagatagaatgatagaagttggttttttttacaaaatttaaactctagagagtacaacacatcccctggccaaacgtgcaccgatgcctatgccagagccacatccatcgtcgggcactccaagtggtcgcctcgtcgcccggcgcgctcctagatcgacatcacctgctggcgcgcgccacacccaccaccaacctctcctggcgctgccgtcctctgctcgagcgccccaccagctgctcctacgcaaactccacacccgagggatggcagtgggccccgttcccggttcctgtagggaattctcccactagggaatggggcatggatacaagtgattctccacggggaatcaaatggaggaaaattgtccccgtcaggtatagcggggcggggatgatcctctatcctctgtccccattccccacggaaacctgattattgtatataggggtctaaatccaatgtgaatgttacatgtctaaaggactaacagccatgataagtggataatcaacaatattttgttcttgtcatgtgactaatagatactccctctgtcctaaaatgtaagcatttttagctataaatctggataactgtgtgtccagattcatagccaaaagttgttacattttaggacggaggtagtatatgctaatatattgctatatgttatggacattatttattaattacatatgtgatttaaggtgtaaaagatttttttaaacgtcaacggaggatccgcggggattaattccccgcgctgaggcagggatgggagaggatgggggcagagaaatttcctactcacaggggcggggatggggacgttgccgtgcctacacccgatgcttgatccggccagagggacgctagatctggcattgaggttgctagacccagtcgtactagccgccacaactgtacacatccgacacagctaactagacagtctgcccaccatgtaggccacaatctcttgctcacaacaccaccatgcccctgaccatcaacttgctcgtgcatgcgcattagatccgctacgcccaccgctcgctagatccagctcaggagggaagagaacggtcctgttgccgccatccttgctgccacacggtctctggcggccggctcctttgacggcgagctcctttaacggcgagtgcgaagggaggaagacggagaggtggcgcagtgagcagactcaccacactatccactctgtggggagtgacacagggaccttctgaatgaagaaaaccctgaaatgctgcagaagtttgagcagcacaaaaaggttgtcttgtgttgttcattcctctagtgtttctaacatttgaattttagtattgcaactcccaaaacacatattgcgcagtctgttcggtgatgtgtctattttgcttgcaacatccccctacgcaaaatgctaaacatacttttgataattggttgagggagtgcctagatccattaaaaaaatgatttcttttttaaactattgccttgttacttggtcaatctgcgttgtcaaaatgatgtaatattatactaccagtagaaatgatctaaaccatttattattaagggtaaatcggtgatttactaatatagtaattaggggtaactttgtcctttatgtttttttcctggctaaatcgatatgtagtcatccattgccctggtatcgctcatattccatccaaaaagccaaaaaaatgaaaaaagaagtttagtcagtactaaatgacgattataccctttaacgcagtttttttaaaataatgccacttcacgtttctactgccgccaactagggtggtggtataagtagatatgaactcttcaattaaatgagttcaatggttcatattgatttctactactagtagagagagtactgtagtggggctctaacccttcatgtcttttagatggctccattattagtccttatgcttttataggagaaggacattataagtaatggagctacactattgatagccaagatcttttattttactttggatggcacaattcctatagaacatcatcatagaacccacgtgttttctattcgagatttcagtcggatatcatcaggaagggatggggatttaaatcccataaccttgagaattttgtttaacttgactcattggccatttggctatgtccgttggcagaggccggagatataagcaattttcattataaaataaaacacatgtgtatgtgtatctgagtgttgtttgagatcgatttgaatattttactgtgtaatatgaaatctcaacgtttcacaattctgaagagaattcaaattaaagctatatctaaccataaactagcaagctgaaactccaaatgctcggcttaagggtcactacaatagaaatgcacaaaggtgtcggcactatagataccggaagtgttaaaacctagaaccggcgccttcgaacaaattatatgtgccgattctaaagaaaaaccgacaccaatattattggtgctgatttttttaaaaaaagaatcggcatctagaatattaataggtactggcacctgtaaaactgacctgagccaaaccggtgggtgttttacctcccgtccttatcctctctctctctctctccgcccaacccacccacccacccaccattatctctctctttctcgcgcgcgccctcccaacccagcggtggcagcggcgatgatgggaggagaggcggtggcaagggtgagattcttgtgttcttgatgttcttgtgttcttggtgttcttgtatgttcttgggttaaatgttcattctatgaattaaatgttctatggaatttggttctagtgaaggtgagctgctcgatgcatcggctcgaacatcaagctggggttcttcgtggaaccttaaaggtgtcgatttctaaaccggcacttatttcccttccacatcaatgccgcctattaggtgtcggttggtaaatccagtacctttgtgaggttctcaaccggcaccgattaaggtttgtgtagtagtgggtgcacttgatcagtaatgacaatcagatctaatttcaggaattgtggagtaattctaattgtttcccttgtttagtaaaaccatatgagatgctagtgatcaggaataaaggattacggtgtaaccaatattccgggaatatgtggcattggagtttcttttaaaaacatgtgtctatcctgggttatccttacccttatgaaaacttatcgaactacagaattccctactatttgatcccgatggataggactatgggggtaatattccacaatttcctatagccaaacgcacgtataattggttaggtctacggaggtaataatattaagataacgattcgctataactaaacgcgaagtcttaattaattaacctggaacaccaaaatttgattgagatgacaagctgacctcgtttgaacgaacctaatgaccgtgagactccagaagtccttcgttgatagcgtggaaacgaatccaccgaggaggacgacggtggaccaagtgagcaccaggaagcccgtcccggtgacagccattgacaggtaccccatgaacatcgcgtagtcgttgatcagcttcacctctggccagttcccatcgatgtgcccaaggcgatgagcacggctctgtccaccggacattctgttcacctgcagagacggtaaatatttacttgtacacaaaactacacaaaatttacttgtacgaacaggctctaccgttctaattccgtttacgaggaaaaaggaaatggtaggaagctatctttgcatttttcccgaccgttttagtccttagccgaagctaccatcggctggaattaaaccaaaccctagaaattacaagcaaggacatctagatcccaagttccagggaacaggcaattaaaaacacaccacaccattatagggaagatgacaaagtaatctctagtcacagaatctaaagatgtcacctgttttgccaaaacctggcctgcgccgcgacacgtttgcctcagccagtcagcctgctcgatcctcctggtagcgaactgacaattgcttggcgtcgccgcaagttaggttcggtttgcgtgggaatgtagaaagcagaacgaaggaatcggggaagaagaacaagaggaagagtgaggctggggaattcgatcaggatttatttactacttcttggatgccttgcccattcagcaagtaggtgatttaggctgtgtttagttccacgtcaaaattgaaagtttaaagagattggaacgatgtgactgaaaagttgaaagtttgatgtgacggaaaagttgaaaatttgaagaaaaacgttggaatctaaaacagagccttacacaattccacgcacggcccacactgccatcataaccgttgcatattttactaatccgcttgttggcctgttctcagagaacttaaagctcccaaacaatttaattttttgtctagattataataaactcgaataaaaaaataggagcaaccggttagggtttgcaagaatctaagaaagctatgtttccgcttctagcttcctagttaattttttaagattctatagctacgatttcttagaaaaaatatatattgtttgagaatgctaaaggttctgagagaagctgcagcttttagactccccgaaacatgaaactatatagatgcaacaaaagcaatgcagcatgtaagtggcacataaccattaccattatatgaaaaaaaaaaaacattccgcctgtcaaactatcttcaaggccgtacctaagaatccttcattatagttttttttttttggcaaattttgctacaggacatcgcaattatgtggttttagctcaggacactgcgaaagtgaagttttgggggaagacatcccacaatcatgaatatttgccgatggataccgcgccgtctaaaggatacttgccgtgctgacgtggcgggcgagaggcccttttttgacacggtatgacgtaaatacccctgctgacgaaggagggagtagtaggtcccacattgaagcggttgtgttggttaagaggaggattaaatagaaatttactccgttggggaccagttgctgttgagacattggaagggacgaggagggaataaatattgcacaagagataataaggttatgtggggcccacttgacagtgtcccactcctcttctttttcttctctctcgatttcttctcctctcgatctctcctcacctctctccatctcgtttccctttctccccacgcgcgcgcgcacccgagcgggatgcggccagccgcgccgtcgcggccggcaaccggccgcgcaactcgggccgaggtgacagcggcggcctgaaggcagcctggcccggtggcgtcgggtggatgggaagatgatggtgacgatggcaggttgttggctcacctgcggcccgtggaggaggcgcggatgagcggccaaggcgagagaaggacttaactggcggcaagcacgagaggggagcaaccgctgcttcgtggcaagttgggggcgcaacgagaaggggaggtaggcagccgctcgcatggggaagacgaggccagacgagaggcagtcaacgaacgaggcctctcacttcgcctcgtctgtctatcacggtgttgcctctcgcgcggccggcgaccggctgcggcggcacgggccgaggcgatggcggcggcctaaaggcggtccggcggcgttgggtggatggggagaaaaggccggcacagcgaggaggtgccggggcagcgccgggcagaggaggcggaggtggaggcgttgggtggtcggcggaggcggcgcccgtgcgggccggcttggccgcgcgcgggggcagcgctcgtagcatggtggtggccccgagcaagacgaagacggcgggtggtggcaaagcggcagtggcgcacgggtggtgctcgtacgggacatgtggccacacgcgcagcagcggccgagcgtggcgatggcttggcgcggcggcggagaggggaaagaagtagctggcgacggtggggagtggcctgacgggaggcccttttttttgctgacgtggggctagggtttttgcgtccgaccgcatcaaaaaagggcctcccatctgccacgtcagcacggcgagtatcctttagacggcatggtgtccatcggcaaatatccacaattatgggatgtcttccccttaaattttactttcgcggtgtccctgagctaaaaccataaaatttcgatgtcctgtaacaaaatttgccttttttctcaaaaaaaaaaggggggatgcagccgtcgatcagtggtcacccagagattcttgggttatagtggttatcaggtacgatacgttggatatcacgatagcacgggctaactaggttagcaatatcacataggagaaaccactgtgtaaactaccggtgaggtgaattgagccagtttttatagttgagggatactctatgtctagttttacagttgagagatgaaagtaaaacgcaggttataattgagagatgtacataggagcaacttgtagcggaaaaggaagtcacacctctccatgtcatccacgtgcaggccacatgaggagaaaccctagctaccgatcgcaccaattcccgtgagagcaggaagctgggccgtcgtcgggaagtcgggcggtggtgtggccaataccaaacgatggtctccttcttcggcaagggggagaaggagcgcaactggcagatccaacgccaacaccaccaaattccccctccccctctcggcgactggatctgatgccccttcaccagatctggcaggggtcgtagtcaatatggcaggggtaaaggtcagcctgtgagagggttgtcatggttggcagcgacagacgaccggaacaggcggagcgaaggtcgtgcatggccgccggcgagaggtcaatgcggcgtggagtggtgtggccggcgatgacgtgaggccgcctggccaggggaaacaggaggcccgcgctgcgtgtcacaccctaaaaatcttaaatatataaattattgtttaattggaatttttagaaattattttaaaagcctacaagctaaaccctaattttctaggaaaattttcaacataaaaataagctagataaaattttattaaatactatgcttgctcctctattttctagatttttctgggaattatttgagcaagggaagtatttttaataattgaaacatcatttcacaaattgttttattcaaaaaagttcaaaaatctttctctttggtcattgggccgaattcggcccaatactctctctttctctctctccccgcgcgcggcccacgccggcccaagccgctgccgcccgcgcccctctccccagccactgacatgtggggcccacatgtcagggccgtcttccacctccggccggccgccgccgagcccgaaccctagcgccgttttgcgccatcgattccgcccaaatccgagcccaattccttcgattgattgaggggttttgttcctctcgttctcctctttcttttccccccagaatcaaaacaaatcgttgcggtttggatccgaatcgaattcgtttgtttttatccctaaaaaccgagtccgagatcttcccgactcgattcctttcgtttgcggcttgatctcttcaatccgagctcatataaaggttcccctcgtcgtcctctctcgtttgccccctctctcgagctctcccgtgccccctagcgccgccgcgacgcgtcgcaagtccgccgccgccgccggccgtcttcggcaacgtcgccgcgccgtctccgccgtcgccaccgctcgccgccaccaccgttaggtgcgccgtcgtgcgaggaagctcggccgcccctccattttcgccgccgaccaccggagcaccctcgtcgccgttgagccgaaccgccgccgccttccttctcgtcgccggccgccgtcgtacatcctttgactacgtggtgagtaccaacgggttcgtctcgttgtcctctacgcgtaggtggtctccgtttccgccgccgatgtccctagcgccggcgagctcgtcgtcccgagccggccgtcgtgctgacgtcagcatgacgtcaaccctagggctgacgtcatcagggccagggctgacgtcatatctctctctttttcctttttctcggttttcaaatagattaaaacttcggaaaatcataactaaataaccgtagatccgttttaggtggttcaagtttctaaatttttctaaaatcaagatctacatgttaaaaatatccacatgtactgtttatgcttgtttttgtactgttttgttgattttgtttatttgctttagtttccgacgttccggaggagagcgtttccgttgaggaaggttctgaagtgtttgtggaagcccaaggcaagtcacacagatcccaaacaaccctttgagcatgttgattccgtttaaagctatcattttatttcaactatgcattgttttcgaatgtcatcgggtggtgaacctttcccagttaattaatggccgaagatgactttattttcctatgggttataacttgattagcatgaaccttatatattggattggttcagctaaatgctttatatataggtttgcttagccatgcttagaaacattagctaattaaaaggggttaaatatgaattatattataattgttattaattatggttttatttattggtagctcacgatgattgatcgtgtgatgttaattaattgataattaaaacctggctaaggtgggttgtgagcatatggttttgatggttgtgctcatgacaattaaggaccggttcgcgagctactgttgtgaaacatttatcgtgccaaccacaagccagcgtgggcaacagctttatcttttgtatagcgtgattcattatagtgcgccagactgagaagtggcgagaagtccatgggggtcgctggggagtccatgccttgtttataagggggtgattatgatccaggtacggtgcactgtggtgaattgtgttatgcgaggggtattgtcacgactcctttccgaggtatcgtggtggtactgaggcacatggtaacatgatgtggggttgtgtcttgtgggtacagtggtacacctctgatcggagtttaaactattcgaatagccgtacccgcggtaatgggtgagttgagcaatgtttttcgtgattagtctcacactactcgttaatggtaataatgtggtaattaatttagttcctggtttggaatggataattcctggtttggaggtttaatttgttcaactggggttggttgttcaaatgtggttgggcctatgcaacatgggtgtgttgtatagtgtttatttaatattgattaattatacaactgtttttactattctcttaaatatttattaaatgctgttttctgcaaatgagctataatatgccatcctttgttatcctgtgcacttgcatatttgctgtgtggcttgttgagtatgttatatgctcattcttgcaatattcattcatcagaagaggagtacttcagtgaaggtgatgatttggaggattaggcttgttcttggttaagttgcctgtggagtggagttgccatcgctgttccgtagtttgttttagttttgttttccgctgcgtagaatgttattgctttgagaggaactatctacctctgtaatattttattatttgcgaatattcgatagttaattatttgtactctattatcgatattgtcattgtgtgcctcggttgattcctagacgagggtttaacacacatgtaagcgtttggaattttggatagaaattccgggcgtgacactgcgcctggggcacaagcaggaaggtcggcgttgtgcaagcagcgatggccagatgccagcgtgatgacggcggacatacaactagagcggggtggcgaggacaacgagaagccacgaccaacgacaagtcgacaagatgagcaaacacggcatgggtaggagactggatggtgctccgagtcgagatccagcggcagcaagggcaacagggctagtgacgcgactcgagacggggatgatgcaggtagtccggccaaggtggcggtgatggtagccccgtgaggtgggcattctagacctatggcgagctttgatgcagatgctagtcctcttgcggcgacggcgcattgccgccacaagatgaccacgttggcgggctaaagtagggaagaagggggccatttttctctctcaccctctccctctctaagccaactgcgtggatgaaattggagcacgccgaatgtcgggatcctacttgatggccaaccgatgacgaggcgttgacgcggtggctgctgttttcggcaagcggtctcgacacgagaggggaaaaagattacgaacataaccccagcctgttcgggccagcaattgcaacacttgcgggtgccacatttcccttgttgcatgatctttcttgccctctcgatggatttcttcggtcgaaaaccatgtcccgatcgactttccaagtgaaaatccttgtagagatgtcgctttcctgctttacttgtagactcgtggtgtgaatatcttttacttctcatccctttcatgtttcctggctaaaatctcccagagctatagacatgtaatctctttagtgctctatcaatgtaaagaggatttttactgtccttgagagtggccagtaccaaatcgtggtcgttcaatgagcaagatcgaacggtcgagcatgagcggtaccgctactttgcgagaaaattgggattatactatcgcaaaagagtagtttcgctgaaatgctatcgctttaaactgattcattaaaatgctattctaaactgaaggtgttcaccaaaatactattttcgctcttttaggtaaatataaatgtttttacctaatttcaacttttttcggaccaaaatacccttgacgcgggccccacctgtcataccctctccactctctctttctcctcttcctctctcgaggatgccgttgggagcgcgaggtggccggcgggtgggcatggcgagggtggagcggggcatggcgacgcggggctagtgagggtggggcaggtgtggcggcgcgggaccaacctcatcaccgacgacgacgaagccactgccgacgctcgccgacgctcgacggccagcttcgtcgaggagcccgtcgaccagtggctcttcatcgtcgcatccggtgcggcttccgcctcctgctcctcggtggcgacgatgcggcggtgatgcggtggaggaggcgcgaagaaggcggcggaggcatgaagaaggcggcggcggcggcgcgaagaaaagcatctagagcgccttggtgcgggggatctccgcggctcccaccaccgcctgaagcgctggcgacacgaccagggctacgtcagccctgtagacgccgtcttcttcggggccacggccgccggggagttggacgccgcggcggccgcgtgcatggctacggtggcggcagcacgcagtagcggagcgaaggaggcggccaggaggggcgggcggagggcggcgagcggggagggggagagggacagcaacgcggcgtcggccactactcgccttccggccaccggtgctctcgcccgtcgccaccctcttcttcggggtcgcggtcgccagggagttggacgcagtggcggccgcgtgcacggctacggtggcggcgacgcaccgcggtgatgcgaaggaggcggccgcggagcgagggaggaaagccactagcggagcgaaggaggcgagccagcggcgctccctcgagagaggaagaaggagaaagagagtgtggagagagtatgacaggtgggcccgcattaggggtattttggtccggaaaaaagttaaaattgaggaaaaacatttctattcacctaaaagagcgaaaatagtattttggtgaacacctctcagtttaggatagcattttagtgaatcaatttgaaaggatagtatttcagcgaaaccactcttttgcgatagtataatcccaattttctcctactttgcatgggggtaccgctcctccttcggtgtgcgggagtagagtgaaagggtaaatatgtactttcgcgtttatcctcttccatgatgctctcgcctctcatttttgcatcgtcaaagccccaggcggcgcggcgccgtcaggagatcggcgatgccccaggcggcggcattaggaggtccagccaggctctcgacagtggtgcttatatcagggtgatgctcttgccagcggcagttaggatcttaatgaaatctcaagaggcaaatatcaggggtccggcgaagctctcggcggtggtggtcacaagctcggtgatgcccccccccccccccccggctacgctcatgggctactgggctagaagatgctgccagttgcatggctgacttcccgtcctttaatttcagcgaagctcagtagctcacccacctatttctttcgtggcacaaatatactggtgttgatttttggtggaaaaaaacttcgttgttactcttgcttactatggttattggatcgattaattactgttatattccattaagcaataagcatctagccaatagccggctcgggacggcggcaggcacagcggcctcgatgagagggcggtgggctggatgcggcggcgcctggagcggcctcgatgcgccggcggccgcggcagcctcgttgtggcggcagccgcgccagggtcgatgcgatggcgccgcggcgagagaacaggcttgatacggaggcgccggggaagcttcaatgcaacagcgaggaacggatcattagcacgggcacctcattttcattagacggtcctacccctattaaaccgatggttagattagattggtacctcatacctcatggtacctctttaaggatgggaaagatgctccaatgtaaatgttgcactatcttgtgcagtttgtttaaaaaataaatgtaatctttttagggatgtgtaatgaatttttagggatgtaaatgtaaatgtaaatgtttagggatgaatttttaggggtgtaatgagtcttttaaaaaataaatgtaaatgttagggatgtgttatgaatttttttgtcctcttttaggatttgggccatggaacatgggccatgggccgtttgagcgagacaggtttcccatatggaaaaagtacaccgaaagcccctcaacttgtcatcgagttacaaaatcatctcccaaccgcaaaaccagatatatgacatccctcaactttaaaaaccgtttactttagatccttcggtggttttgatcccgattttatccgacgtggcggctaagttagcgtgggacccacatatcaggatgccacatcagcacactctctcttccccctcctctcccttctctctgtctctctagtctagtacttcatatgcttagtattgttaaaattgccagttcctgaaactgcacacaaatttattccacctacctattcagctatcccttacattttgagggtttctttggaacgcagggtaggatgtcacgtgtcctacgaagaaaaagttcacctgaaattacagaacatcttgtttgataaccccatatgaaaaacatagacactagcaagatctcatgttatttttcctccataattcctatgaaatggcaccttccatacgaattttaaggaatttcttacatatattcctttgtttcaaaagatcacatagacccccccccccccccccacttcaattcttcaaaattcttccaagtttcatttgttccaaaggagccatgaaaggttatatggtattttaggacatttagcttgcccaccccgcttgcattccttgcattcctactgctagttacagcggctcaaaaaagggcaaaggaatagcgaaagttaaggcggaagtaccaaacatcatgtttatcagaaaaacaccttatcacaaaagcatcgcatatgagcttctagacaatttaacagggcctgaatataaacggcacgctgacagtagcatatttccaaacgtacacaacaatgtcaatcaactagaaataaatatataaatatatattattatatctctctctcacacacacacacacccctgtttagaagaaatataaatggtgcagatgtagagttaaggtaaatttcacaggatgttaaaagccagctactcatgttttaaaggaactggcaatgagacctgactgttatatttacatgataatcatatatacaaagtttctaaaccgaaccaatcatatgaacaacagactgtttaattgatggtaactattttcacaaggattagctgcagagcaggatgaggctgatgaacagccaacaagctaaagggcgcgcaatgcaatcaatttgaaagttaacgttagaagagtgcatctggagagaaaaggagatgaagtggcgttgcaatttggacctaactgaggtcaatttcaacacgctccggtgtccccctctcgctttcctgcgcgacgagttcggtacctagctgccctttgtcccctgcaccaaacgcatagagttttcctgaatctgtcagtgcaaatgtatgtgcattccagtaaatggagttagtgaggctgatctgagcaaccctttcatttgttcttttcaaagaagtcaccaactccgggctaaggacattagtgtgcctattattaccctggaaaaagaaaaaaatatacatcaagttcagaagcagagagtaaagaaaaggtttattatactgattctaattcgcagagagaaatgcaaagttataaaaggtatatgagcaaatgtgtttatcttttcactgaagattatcattgtgagtaaggatgagcagataggtgaagagctaaaagaaaatgaaattcacagtagagggttaatagaccctcaatcttttgacaaaacggaagacagacattactgaccaatactcttagaaaataacaatagtagattgaaatacatactgtgtgatttaattggtaaattgcatttagtgtagcatttaacaaaaattatggaactgtgtagagaatcatagagcattgagctttgacagcctattgtgaatatgcagacagaatgaaaatataactccatgtttttgttaaataacttcaagtattcaaaacatgaaaactagtgcctaacctcagttatagtgttgtggccaagacttgatgattcaccacatccaaacgagtaaacatcacctttatcagatacaacaaatgtggtgtaatctccagttgctacatggacagccctcacattgactaaggactcaacaaccttaggaacagactcacattcctcattaccgtgacccaagcagccataccgcccccatccccaagtgcaaacacgcccatccttgcctacaacagcagcatgccaagcaccagcagcaaccactactggttgtatattcaaagcttggaactgctcgattaacctagggtatttctcatcggttcgagaaccatggccaagtttcccacctaacccacaaccaacagaataaacagacctgcaacaaaaataggacaaaagcattttaatagttttatcatatctataacagctggtgtataggtaaaaatattcaaaacttgcatactggttcacctgtctatcaaagcaaaagacaaattcattgaaaatgttaaaacaatttttcatatgttataacggaataagagacattagttttttttattattttatctgatcatacaaaacattaaaataatacagtagctatactacatgcaaatgtaatacttacttgacattagttcacctattagctaattgttgtcaaattaaccaaggctgaatagtgaagagtgaggctaaatgcaaataacgtgtggtttgtttattaaaaaaaatagtatatcactaagccatacttcacagcattgacaaaaagttgcatgtttgggtgaaaaatcttacatgccacttggttggcatgccagagccaggagatagcagtagcctgcggcaatctgcacaactggaatgttctcaagagggcctgctagaagatgaggctgaacatcatttggctctgtctgatgaccaagtttcatgtcattcccccaagaaaatgtatacacatgaccttcccgagataaaactgcagtaaagaagttcccgattgctgcctggacaatgtatatgtccttcaatgattccaccagctgtggtgtggtgacaaccctagaaccttgggctgcatattccacttctccaaatgaatcctttccaaatgcatagaccctaccagcatcactaacaagcattgtgcgtcctgctcctgctgccgcttgaataattctaataccctgcaatgatctatacgagcaccaacagacatttagcactcttttaatctacatttgtgtcatgactaaagttatgataactgtatattctagaagcacctgataatccgtggcctccactcctcttctaaactaccatggccaagttgaccagagctgttggacccaaaagtatacactgcaccgcttgttgtcacagcgatgctgtgaccaggtccagcgattgcctgagatttttccctccggcaacatgcttcacctgccattataaacctaagaaccagcttccaactcccgccgcaacgttgcttaaacatttctctttcttgttgagtcataggtttaaatatcgcccgtttctggcacatatccaacgctgcgagttctgacattgacaactgaaaatcgggagggaaattggcaggcttccggaaaaacgagcatgttgcctatcgcaagcacaaatttcatcagtggcaatatcaattctacattggagaggaagaacaaaacactacttgcctccaagtgagcgaggtcatcaggttccagattgcatgatgtgaggacatggaggacaattgatgggtttgcagccaaggggaattctccaggagcagagccaccaaagcaatggcgctgtgacctctgaaacgactgctgcaacggagaaacagggcaagagcatcatctatgataaggtggaggggtagagaggaggaagctccactgctcgtcgtggcgtccatctgccacggctgcgacttgcactgccttatgcttttatctcaaacttgtggtgttcctggctctccagaagtccagagtgaattaagtacaggaccattctgtaatgtgcaatgcattaatgtaatcaagacatgtaactacaatcattaattgttaagtaacttctctaacaagctcatcagcacaccttagtttaacacaattaaacaataatatgttatattattcatccgaatcagaaaagtggatgagaaagaatccatccaacacttgtaaacaaacaatcagagcatatcaataattgaaagcattcccaaagtcaatgcaatcaacagagcatatcaccctgaccaaacatatagagatgccatattcttctggatggcaaacagacactaaatcagatgcaaaacaacctccaaaaatcaaggaaacaaaggaagaaaacaactgaaatctcaaaacagtgcccccaaacccagtcaagaacaccattagacggttgtgaggcttgcaccaagaaatgattgatgcagaacaggaacatgtaaaatggtaaaggacaaagagccacttccaccccctcacaaaacaaagcatattcctcccaactccaccccccacaaaagtctacctttcttatcctatccaacaattatcaacaatatccacagttaaccagtacacacacaaacaagcaagattccaactgcatcatcggcggcaaaagatcacacccactaacatcctaccagtaaagaaagaccccaattcgagtaaacaacgaaggatccacgctaatcgccccgattctgatgaaaggatcaccaaaaccgagaacatcatctttaagcagagaacaccaatccgaacagacgatcatcaggaccgcgatcatcgccatgatcggctccaatcatccaacctgacatctaattgatcggcacaccacccacaagaaaccaagaaatcctcacccgctaattccccccttggttcttggaccaagaacacaaaagaatcaaaccccctcctcctcaccagaggcaaaaaaaggatcaacgaacacgcaccaacgggcgggtcggccagtcaatcaatcgatcgggaattcttggggttgggggaggaggttggagaggcgtgaatctaaccgagaaacgggggaggagagagagagggagaggatgagagcaggcgagcgacggacagggacgagcctcccaataatgatgatgtgcgtgcgtggagaagggagagagagagagagagagagagcagaggagagagagaaaagcaaagctgcaaaaatacgcatagaaacagcaacctctctctctctctctctaccgtcgtcggctggttcttggggaggagatgaggtgtcgacgaagagggaggaggcgacgtcgaggaggagcaaatcgcagcggccaccgaggaatcatgcggtcggaattacgggaatgccatcgatgtcgctgacaggtgggttatggagggggtggggcccacgtgtcggtgggctgcggtgggacgggtttggtgagtttatcgtcgtgctgttggggttgggggtcaattacttgcgagccggatttgttcgatggcgtcaagcaaacgtccgctgcaaggagtatttttgtcactgatggtcatactattgtttattttctgtagggtaagtgtgttttactcataaaactatttttttcactactggttataggtcctggttagatttcaacttttttctttaaatttttaacttttccataacatcgaattttactacacacaaacttctaac

SEQ ID NO: 65311 - DNA, 19545 bp, Oryza sativa
  unsure (1)..(19545): unsure at all n locations
gtatataaagacatgcatggtcagtgctaatctcccacctagcttccacgtacaagcaaagaaacacacgtacacatggccaaaaacgtaatgcgcgtgtcgcaatactagccatgccacaacaactaatagtgctgctgctgctgttccatgctacggcggcgccggcgggtgggcagcgggcggggtgcccgagcaagtgcggcgaggtagacatccccttccctttcggcgtcggcgtcgactgcgccttgccgggcttaaacgtctcatgcaaccatagctttgcccctcccagaccctacatcgccgatgacaatgagttcatcgacgtctcgctggagaccggggagacacgcgtgtacactcccgtgctgcaaaactgcttcgacttgtccaacaccagcagcagctccgacgcaatctggcaggggctcgacctcaccgggacgccgttccttgtgtcgccggagaggaacgagttcaccgccaccggctgcgacgcgctggggctgatatacggcagggaggacgtgagcttcttcaccggctgcgtcacgacgtgcacgagcttgggtaccgccgccaacgacggtgacaactgcacgggactcggttgctgccagctgcagtccatccctggaaaccttaccttactagggatgacgttgacggccaacatcaccgacacgaagatttctgcgtggaacccctgccgttacgcctttataaccgagcgagacaggtacgtatagtaccacctctgttttagaacatattttgtttcgtcagtaaaacatagttttttttatgacgaaaaatgaatatattagattatcaaaagtatttacttattgtatatattataccttattagcacataaatgatatcatcgtagagtaattcttgatcaaagttttgatatatctttaaatgtatttcaatacaatcatatatatttgatatttctatatatatttaatagaaaatctcgtgttcttgtccaaaataataattattttttaatatggagctaggagcttatattttctcatttggtttttacgtctggagacgatcatttggttcctaaaatgatatgcggatatgtttagagaaattctggaaacattaatttgatatgacccttgtaaaatactatcccatattattaaattttgagtttaaaaaactcgacctatatatacattgagggaaaaaaaaaagacaaatctatagcacgaacaacatacaagcaatgttcaacactgtattcgtcttttttaatacattattgtaaaccgagttaatttttttatcatttttttcttattaattactccctccggttctataataattgacgttttggacaaggttgacgtcaaacttttataacttgaccattaataattttaaaaatatttagtttaaagaaactagaacaacatatatagatttgtctttaaaagtactataataaaagtaaacatgcatttatttattgtatatattataatagaaaaataaggtcaaagatatattttgtataccatgtcattgtccaaaacgtcaattaaaatgaaactggagggagtaactaattaacaaaaaatggagttaactaaggttggaacaaatcaacaatgcatgttttccttgatgttctagtattaaaccatatgtagtggattcggtcaacggtgaagttgaggcattcctctattaagggacaaatttttacaatatatcctactacatcatcaaaactcaagcacacacaaaacacaatggtttcagcagcagattcttgagtgcttagggccggatacaatcggtatatagcatcaggaagggagctagctaggaattagcaggaaacatggagaagccgaggttggaggaaaggatgaggaatacagggagggtcaaaggttgaagacgagaggagccagggaggaaaaatatagctactctctttccaatattttgttcgattcctcccattgaagcatctggtggttttatacttttttaccttggactcagtggtgggttcagaaaatttcttgagcataggcaagtctaatgatggatgataaaaggatatataaatccatataactccgtataccatttatcattgatgtaggcaaattgacaatacatagttacttcctccgtttcaggttgtaagacgttttcactttggttaaagtcaaactgttttaagtttgaccaaatttgtaagaaaaaaatatttttaacccaagacaaatttattatgaaaatatatttaattattgattcaatgaaactaatttggtattataaatattactttttccattccaaaatataaggcataaccacccttaatcaaaaaccaaaaaccaattattatcatatcctaattgtatcaccctagtaaatacaatgcatgcacctaataaaattagagatcttaagggtggaggattttaaaaaataataatttattggagaagcagtgctaattaattgcatgcatgcatgtacgccttatattatgggacatctgaaaaaagtagttgtaccttatgttatggaatggatggagtactatatttatctataaacttagtcaagcttgacgcattttgactttgaccaaagtcaaaacgtcttataatatgaaacagggggagtattattttagagaggaaaaccaatgcatatgcagaccataaataatgttctgaaccttaattgctttgctaatttgtttggttaatcttccattcattaggactagcaaaaagtatgtatgtactagtacatgagaggagtgatagagagaaggaagggagagaagaggtgaaagagagagatgatgtggatagtctgacatgtggggcccacgtggggctcacgctgactcagctgccacatcggacaaaaccgggtttaaaacctcctatggacctaaagtgaaccggttttgtgagatgagggatgacatatatctagttttgcggtttggggatgattttgtaatctgatgacaagatgagggaccttctatgtacttttcccttgcagttttggctgcatggatggttgaataggcccatatgtgcagttgtctaggcaggcccatgataggtccatggcgaacaccacctagatcccatgtcccatgtcatcaataatccgctgctatctttgggtcacatacaatacccatcatccactagtatttcccgagaacaagcctgaataaattttacatacgatggctgacaggatgataatttctgaagttttttgtgccattgctgatgttaaaaaccgtgaggaaaaaaaaaatctctttctggtggtgattatacccaagcaatgtgcatggcatccggtagcatgatcataaacttacaaatccaccacgcaccatataaaagtgatttcttgcatatgccacttaacttgatacacccgtattagtaccgcaaaaagtgtcttttttttctgcatttatttcttataagaaatatttagttaattaactaattaacaaatggcccaccaagatatttgttacagaaggcaatcaatatcttcaaaccttaaaaaatatatatccgagtagacatactatttcaatattatgaactagcaatttttgatcatacaattcaggtacaattttaaccggaaggatttcggtcgctcaggcaacaagatatttgcaaaccggggatggcgagatggttgtccctacggtgcttgactgggccatcagggaaatgggtcatgctcggggtcggtagctcctgcctgcgtcagcgagcacagctactgcgccaatgccactaacggagatgggtatctctgtaagtgctccacgggatacgccggcaatccctatctcaaaggcaatggtggatgcacaagttagttcttaaatttcctattttctccatcatggattaatagtgcagttaacgttgtattcattgacaatatggggattattttatttaaatttagtgttttattacaagactgatatatatacacatatgttgcatgcatgtagatattgacgaatgcaaggaaccagatcgttgttctactggcagcagatgccatgacacagagggcggttattactgcaaatgccgttttccacgtagaggggatggtaaaattaatggcaagggatgccaccttcccaaagatatagtcgtgacccttggtaagctagctgatcaagcaagcgttagttaattcctcgtacttactgcatgtagtctgatttgaatcaacggctcgttcgttcaattaattatttgttgtttgatttgatttgtctccaaatatacagcgacggtgtgcattgtgatttttcttgtgttctttgtgtgctggtatgagagacggaagagaagaaggcacttcaacaacaatggtggccggctgctcagtggtatggaaatcaagcacttctcgaagaaagacctagacaagatgacaaagaataggacgacgatgctcggagagggttacttcggcaaggtctacatgggaacccacaagaaccagctggttgccgtcaagtactccaagggaaagcgcaagctggcacagatgacgcatggcaaagacatcaagtgcatgaacaagaaaatgttccaaaacgccttttgttggtccaaagttccatcctcgccggaagaagattcgtcgtcacgagtgtccggcccggagttagtggacgagctaagggtccagtcactgatccagcacgaaaacgtggtcaccctccttgggtgctgcatggagacggaggaacccacgttgatccttgagtttatccctaacgggagcctcgagaaaaagctccacaaagataagcaacaccctctctcgctgtcgcaacgccttgacatcgccatcggctccgcggaggctctctcctacatacattcatcgtctgaccaccaaagcattgttcatggagatgtcaagccagccaacatcctccttgatgacaaactgatccctaaggtctctgactttgggtcagctgagctcacattgaaaatcaagctcgtgtgtggtgacctggactatatcgatcccgtgttcctgcagacccgcaatttcacggtgaagagcgatgtctatagctatggggtagttctcctagagctcatcacccggaaaagggccaagtacgacgatgggagaagcctcccagtagaatttgtgaaacactacaaagacaacaacgaaaggaggaagatgtatgatcaggatatgttgtcgtctatggatgcactactgcagccttactgcacggagtgccttgacaggattgctgccattgcggtccgatgtctcaaaaacaaggtggagaagagaccaaccatggcggaggtggtcgaggagcttaagcagctgagagagcaattaagcacacgtatgtcctagctaaactgctgcaactaatgccgggtgcaggaatccatcagctcgagtgtacgaagatgaatgttcttctttgcctcgtgtcttcagtctctcaattagttggtctctcgtcaatggttttcctttgcctcttgttaatttctccccacccctgcaaatagcagatatagcgtatgctcacattatagtttgagtttgagtacgttgacgcgatatgtactattccaccgtttctcttgttatccgtgtagtgttatgtggtactgtgttgtctcagaaagaaatgttgtggtgctattttttctatctttttactataccttttgtagctgcggtatcttatgtaataatgtaattaacgcaatgttaagctggacatgtatggttgcacccatgttgtgaaataataaatgacctcataggccattctccatgctaatcgaaagcaaacaaatgtattttacaattgtatgtggtctagctcacgaggccacgaacccacatgtaggatagggctactcagccagtagctagggtctcgtaccttacggacacacaaggcatatccagatatattgttttagaataggtctcatttattttatattactatattttaacagagagagtaataaaatggactagtccacgaacccatttatagtatttgatagatcaacctgtttaaatgacttaaatgaccactgacccgccgtaaataagatgtgcacttcactagtcagcccattaattgcatgtgtacaagcaaaccacccttaattactcagctttactggcactccttgctctttgactctcaatctcccagattagatcctatatcattcttcgccaattaaacggaaatcttttcttttgagaggcatttcgcattatgtcaatcttaaaattataaaaggttgaaaagattccggtgtgaaaataaattttagaaggatttatttttaaaattaaaaataaaaatgttttaaaaaaatctgcagactagggggcaaatactgctaaagatgctcggtaccaaactcagttgcataaaactaattttccttataaacatagtacaaacaattaagcgtgggatgggcttttattggttagagactacactcttataacacctaaaacaacaaaggttctaaccattaatataaacaatattcctatatttcttcgtcctattatagtaaaatttcattttatcaaagctatgagtagatttgtacgttaattaagccgatatgttacggcgcttctccatgctatggcggcgggtgggcagcgggcggggtgcccgagcaagtgcggcgaggtggacatccccttccccttcggcgtcggcgtcggctgcgcctgaccgggcttcgacgtcgactgcaaccatagtttagccctcccagaccggagtacgggattaataattagtcaccccatcaacatcaacagcatgcagtagtagtatataaagagatgcatggcaaatgtattcttaaggtagcttttacaatgtatatataaccactactacagaaaacgtcatcgatgtcagttgaaaaaccatcacaggtgccggtttttccaactggcaccatgaaaacgatactttgatctcaggtcaaaggtgccagttcaagaaccggcatctttgaggcgcacacgagcaaaaaaaaaatagcttgaaggattgagccgattccaaataatacccaaatcccaaaatgatgcctcaaatctatgaacacatgaactataataaataatctccagaaaaacaacacatctagatcaaatccaaaacgatcaaacatgaataaatatcaagaataaggaatcacaagagggagggggaagacgcggatccgcaaacaaccgacaccgtcgcacctctagccggcagccccaccgtcggatccgcgctgccgaggggcaaacgccaccaaaccgttggatccggtgctaccgatgagtgggctactgctcgccgccagatctagcgctgtcgaggggagccgccacgctgccgggcacgggccgctgagagcgagagcgagaagataaggccggggagagagagagggtgtggctaaaaatatctctccttccccgtccgactcggcttggtttttgtgataacgatttttttaaagaaaaaacagcacccataatatattaaagtaactatgaagtcacagtattctatagcaaaatttatcttataattttgaatgtgaatgtgtttctgagtgtggatgtggataccagctattaaatgtgtgaacgcattttttatcagttggtgcagtgaagcgcattttgatttctttttctattacacattattcggttgccatttaacagaaaaatctttcataacgattttgctatatatttgtcgacaaatttttccccaaaaatttgacagatgtaattacagtacaatcgtagtgtaattacactgtaacttgtatgtaattacactgtaactatagtgtaacttgtatgtaactttcaaaaatctctccgtaacatgttatttcagtaaaatggaggtcatgagaacaaattctttcatatatgtgtgtgctatgatttgttttcttcctcaccaaaacaaatctagtaatagatctaacgattcaaaattatgtgaaacttacatataagttacactgtagttacatgcaagttacagtgtaattacatataagttacagtgtaattacactacgattgtactataattacatctgtcaaatttttggggaaaaatttgtcgacaaatgtataggcagtcctttttataaagctacccatttaaaccgaaccgattaaacagtaaaatccatacgcccacccctacttaatactccatccatcctattttaagtgcaaccatgagtttctgtgttcaactttgatcatccgtcttatttgaattttttaaattaatatgtttattgttattagatgataaaacatgaatagtaccttatgtgtgacatgtttttttaatttttttttaaaaaatcaaataagacgaatgtttaaagttagacacgaaaacttatggctgcacttaaaatgggacagagggagtacctaaattttggtttcgccactgttaggagtgatgtccactcaactactccctccgtccctaaatataagggattttagtttaatgtgatacatcctagtacaacgaattcgggcattaaccaaaatcttttatatttagggacggagggagtacacgtaatcaagtgtgtccttgcccatctgttttgtgtaccctcctagccaaggaaatgtacacgtcaactagtcaagtcttgatagacacaggatggccactgtttgtttcgttgcttgatagcgagtgctttgcttgcttttggaaactacctagcaatcactacagtagatttggtcttttatgatggatttcatgtgacgaacagaaaatccgtcattgatctacaacgagttttcaaaaagttatcctaaagtacgttcactctcagccttgtaataacgagttaaaagtcttggtcataaaaattagtgatggcaacaaacggatcgagtcatcacaaacactgcaaaatccatcattatgaagttcggatgaagtatattctgtcatgaatttggtaggcaggattctcatggacccacacagctacctgcaggtctcattgtaagtatgagattgaatggaaaaattcattatagaataggcctacagttttataaactagttgataggcaacaatagtatttaggagatcccaaatttaagtatgccaaaacttaaaggaggcattttgtctggtgtttagtttgactgtggctgtgtttagttggatccaaagtttggattttggttgaaattggagatgatgtgactgaaaagttgtgtgtgtataacaggttgatgtgatgaaaaaggactgaagtttggatccaaattttggatctaaacacagactgtgtttgtttgttcggttttagttcggttgtgtgtgtttgtccatcatttgtttatccaaatcagtgtgcgtatgtatatcctgatattggataattaaatccaccaatttattatttttattatattattatgtcaaattttaattaattcatattgtgttctatatggactttttaatttgaatttcatatattttgaattgtagcttacttagactcctttctttttctccaactaatgttaaaatttctagtctgtgggagtaaacatatatttttgcttcatttgaaaagtgcttcctgtgtttgtgtagatactgtagatcctcccaacttacgttttgtcgactacagataattctagttctcttctttcgtgtgtatcttttaatccgatcgatttgcactacctacgcatatctacatcaatgtgagcgcttaacttcagtgtgaaaccttgcttcctagctgtgtacatcttcagttcttcttttcccttacgacgcggatatgcctggctttgtacgtcccattatataggatccacaagtccatatctatactgtcagtacatcacaaagtgtgaacatccaggtatagataaacttaattaataattattccttatcatggcaatgctctttctcagctatggccatccgtttcgatcgattgtaccttccaaattaaaaagccaacgtcacaaagagtcaagtcaatatccgtatatatacgtgtcacataagtaagaacggattaatttagtttttactcgttgatgttacagagtctttatattttcagccctttgcaaattcacccagcaatcctcgaccatataatacctcaacaacgttggcttgttttgatcttgcccttccaaacaagccaacgttacaagagtcaagtcaatgtccgtatgtacgtgtccacattagtaaagtggactaatttagcttttactacatctaccgagtctttatattttcagtatatgcaaattcacccaataatactcaactatatatgcatcaacaacattggcttgtttcgatctttcccatagaaacaagccaatgttacaagagtcaaggcaatgtccgtatgcacacgtgacacattagtaagaacggactaatttagcttttacttgttgacgttacaaaatctttatattttcaactatatgtaaattcacccagcaatcctcaaccgtataatacctcaacaatgttggtttgtttcgatcgtgcacttcgaaacaagccaacattacaagagtcaagtcaatgttcgtatgtacatgtatcacattagtaagaacatactaatttggcttttactccttgacgttacaaagtctttatattttcagctatatgtaaattcaaccagcaatcctcaactgtgtaatacctcaagaatgtctagtcaatttacaagttcagttctaaattcttttaatttgtgtacaaaactttcaaattttttaccaattttctattataactaggaaggcaacctgcacaaattcgcagccacgtatattaaggttagtttgggagacttaattatactatcaactggattttttgttttcattctttaaaattaagatttgtgtaaaatactttcttaatcggtacttgtttaagtaactttttccaagctatttgttagatgtatactatgcatataattcattttgtaagcaattatgtatgatccacttcatcatccgaaataaaggtagacttactttgtttcaaaaataggtaaatgtaaattaaaagtaagatgttttcccctttttcatagaatgttttggggatctatctttttttttaaagaaatctcaaaacactatcattgctaatatttatgttttattgcaacatcaagttatttctccctaattctttcatattatcgtaatttgaaatatactcacgtgtaaatcaaaaaagaataagagatatgcatatctagaccctacttcctacgatacgtgagacccatattattttttaagaaaaacataattaacatcaagtttaatatgacttttcaaccaattatatattgttatataagtgacctatatgcaagatgtggagaaactcatatgccgttgtacatatatgatagagggaaaacctttagcatctataagcacttaaaaatgatgcaatggttatagttacgggtgttctaatttttatggaaaggaaaactaaatttttctgagactataagatctttttggaattggttcactttgcttcctattggtattttctattttattttacataagttaacatgttcaaattttgtgctggaagcaaacaaattaagcaacaaatttatgaattcaccacgtattccctccatccaaaaaaattaattatataatatttcctagctagtacaataaatccggagaaatttatccagattcgttatactagctccaatactagaattattttatgttggacagagaaagtatatatcaactatagttagagcccacgtgtctaaaataaaatatgcccattattaatcgtcttaattggacgaatttttgctaaggcaattcccaacccaatgactaggatggtgtccatagtattaaataagctgccacctaggatgaaaaatgatgtggcaagtgaaaccatgtcctgcatgagacatggtttctacacaatatctaagatattatgtgagataagtagcactaaatttaagtatgtaatagtggtgtttgtattggaagagatagtgtctattactagtttcttgatgatgtggagtttataaaaaccatgtctagtgtcttgggttgggaatagcctaataggccgataagtcagactagccggctgaatgcgttcgccggataaaaaactgtccctgaactacatatgcgtgctgttctcgttatgcatgcactactacaaatatcatttttgcatgtggccaaaagtgatcatttgcgcatgcggacgggtgccctgcatgcacctagttgtctgcgaaaatcggattcgaaaccgtagtctcggaaccctaatccagaagccactgccggccatcatcgttgcacctcccgccatcgccatcgtcgcccctcccaccgccgccaccgtcgtccccgcagtcgtcagcaacggatccgcttgctcgagcccggcggtggtgcatccggccttcgtcaatgccgccgacgttgctctcgccgccgccactgtcatcgttgttgtccgtcctgctgtcgtcgccgcggttgtcggcaacggatctgctcgcttgagtctggcggttgcagacccggccctcgtcgatgccatcgatgctcctgccaccgtcgttgccaggaaactgttgctgccctcgctgatgccaccattgtccgagactaccgtcgccctcgtcgacaacgccgatgccgctctggctgtcacctaagattgccgccgccgtcgccaggattgggtaggtgtgggaggtgaggagttgggtagatggggagagggagtttgaggcgatgagagaagtaagtagaggaggagagggagtgggaggattgagtgggtagtggggagaaaaaaatagagtggggagaaaagagggagagatgccagtgtgggagagagaagctcgcatgtggctaatttcacatgttggtcacttaacaggcccatgaaccgatcatagggaagcgatttttgcagagtacagtagttatagcctgtttgcaatctaaagaggtttgatcagaaaaattaattatgtagtagtgatgcataccttttttgttttttatccaaggagtaaaataatagaccatcgatttaaatagagattgttgtttcagaatttataggttttttctctaatttatgttttggacagaatgatttttcatcgattttgattcagactcatctgaaacatcatcatccaacccaagaaatttcaggaattccagatgccgatccaaaaatcgagtacatctgccgccgtttcccaattcacataggtatggtcgaactattctactgtgtgatctccttagtgatctatttaagattttctcgatcttttatatgatttgtctggacttttaagtgatgaattactgggggatcatttctctatttaatgaactgttcggtgtccgttgaacgtacatgtttcaacctagctatttaagaaattaccgattactgattttgactgaaataatgaaatagctgttgatctttaacatgttgatgagccgtgctagtaatccggtaatcaggttcagttgacaaatcatagacccttatctatgacttttctctaaatctaaatataaacaagcaaatataatatttaattttccatatttcctgtttgtatgtccgtatacacatcatatagtctgcagcttaccttttcttttaccaatgacatggttcaagatgttgacaatgcgaaggaagcgtccaaagtcaaggtcaggataatcagactttgggatggcataaatcccaacagacgtgatatttattaataaaaggtcggtataaatattccccttgcaaataatgttggtatttatgggtatccccagagagcgctcacatttactataaacgttaactaaaagatctgtagtttattaggtcaatcgtattaccatgaccattgatcaatcaaagaatttgtgttaaaaccaagattaattgtgcacttctgggatgctcgctcattaggcagagagatcttaccacagttgattaggtggttcgcattcctatgatattcgatctatatatatgaattcgtgtaaattaaaatatgccacaaaaagtaacatgggctctttagttttatttttacaaaattaataattctgaaatcagacatcatagtgatcacagagtttcacctttcttgactcccaatttagaaatttgttaatttaatttcattttttaaattcataattagtaagttgtaacttatgtgaactccaaaccatacatctaaaatgtattatttaaaagtaacttagcacaaaacggaagtaagttattacaacattagaagtaaattcattgtagagagaaaaatatggtttatctaaaaattaaatttaaatttcacaaattatagaattgactaaaaaatataaaaataatcaacttatagcattatgaatgcataagaagtaatttaatcaaatctaaaagtaatttatatatatgtgataaaagtaacttatatatttaataaaagtaatttacaaacataaatatttttctaccataatataatcatgtaagatattgttgtaaagttttaattgcaacaaacacaattatgtaatcggattgtaaatcgaataagtaatttgtaagaaaactttataagaaggttaaaaaaacgtgcatgccaaatagcaaaaaaaagaagacctgcatgtgtattgtacttctctcacatatgagtgccgctagttaagtctaaatcaagaggcttctcaaattagattttgcgtattaataattagtcaccccatgcatcaacatcaacagcagtagtagtatataaagagatgcatggcaaatgcaaatctcgcacattcaagcaacaccatagctagcggccatggcacaaggagtgatgctgtggtatgacctccatgctctggctgcagccgtggcactactagtttcgtctgtgctggtcggtacgtcgacggcggtgaactgcggcaggaagtgcggcgaggtgcgcatcccctacccgttcggcatcggcgtcgactgcgcctggccgggcttcgacctctcatgcaaccatagctttaccccacccaggccgtacacggggaacgtagagatcaaggacatctcgctggaggcaggggagatacgcctgtacacccacgtcgtgtccaactgctatacttcgtacaataccaccgaatacgaaagcacctcctcgcaggacgacctccgcgatacgccgttcctgtttgcgcggagcaggaacgagttcacggccatcggctgtggcgcgattgcgtttctatggggcagggacgatgcgagctactcgaccggctgcatcacaacgtgtgcgagcttggatgaggccgcccacgacggtgacgactgcaccgggctgggttgctgccaggtgccctctatcccgcccaaccttgacatcttaaacatttccttcgaccccggaagcctcatcggcaaccctgcttggagagagagcccatgtagctacgccttcgtggccgaaaaacactggtacgtacccgttaatgcgtacactatacatggtcttaaattatgtccaatttaattcctgattgctacatatatatatatatatatatatatatatatatatatatatatatatatatatatatatatatatatatatatatatatatatatatatatatatattcattcactgagtttactgatgcatatatgtacatgatttaggtacaatttcagccggcatgatttcagtcatgccggcagcaagagcttcgtcaaccgtactggagatagaagtgtccctacagtgcttgactgggccatcaggggaaatggatcgtgctcatcagcaacaggggctcctgcctgtgtcagcgcccacagctactgtgtaaacgctaccaacggcaaggggtacctctgcaactgttccgcagggtactccggcaatccgtatgtcaccggcggatgcataagtcagtccttaattaattatatattctctccgtcccaaattatagagcaccctcaatcaaactcgatagcttttaactaataataatactaccttcatattttaatgtatgacaccattgactttttatccaacgtttaaccattcgtcttattcaaaaaaaaatgcaattatcatttattttactgtgacttgattcatcatcaaatgttctttaagcattatataaatactttcatatttgcacgaaaattttgaataaaatgaatggtcaaacactggtcgaaaagtcaacggcgtcatacattaaaatacggagggagtatatactaaccatatttgctaagtattatgcatattatatcattcatattttaaagtactccatgttatgctaaatttatattcgttgggaacataaaatgaaataaattaatgatcaaagtatgtcattgaaaactgtgtaaaaaatataggtcttgtaatttggagtggagggagtatactactttctttattttatattataaatcgtttttttatagtcaaactttttaggttttacaaagtttatacaaaaattaacatttataacactaaatattaatttcacttaatataacattgaatatattacataatatatttgttttgtgttaaaaatatgtcatatttttctatagaccttattaaatttaaaaaatttgactacgaaaaagttaaaacaacttataatatgaaatgaagagagtagtagttgttaatctacacttcgctcatggtgttgcatatattcgatcgaataactgataatttattatttgaaacaaaaattcatagccttttgcatctaatagtgtcaattcctgaattaataagtataacgcttaactcaccttggaatataatattttcatgatttaatcattctgaaatttggaattaatttatccgttttttatggcatgcatatagctaatatagggtatctagctagtattcttgttattgatttggcatcatcatttacaagctagccagttatttttttaaataatggaatatagtatccaaccattgtgtgcagatattaatgagtgcgagcttaggagagaagggcctgccatgtatccctgttacagtggtagcagatgctatgacacagagggtggttacaagtgcaaatgccgatttctacatagaggagatggcaaaatcgacaagggatgcaaaccgataattccagcgaccgtagtcgcaacaataggtcagcatttttttttctttattcccaccatcttaaaatgctgtggatcgtcgtttcttccgtgctttcaattctatgcattcatgcataacatgccatgcactaattaagtcctaagtcttattcccctgatttatatcctccgacagaaaagaaagatcatgtttgactattttatgataatatttgagatgagattntgaaataacatagttttggctagcatttctttttatataatatatacaacatggacaaatatattgaactaccataaaaagcattctacacatatttttgaagtaggcttgaacttatgcggaggagacggggggaggacagaaaaaaaataaactacagatttgttagctgaagcacgagctttaataaactgtgcaacagttagctgagctctgtgcaacagttagctgagcacgagctttaataaactgtatgtgagagagatgtgctcgatattaatgatgtagtataaatctacagctaactattgcatgaccgagctatttgttcggttgtagatgatatgataattgttgaagctagcagttgattatattattgtacttgctctaacagtaagtccataaatttccatattttttatgccaagaggcaaaacagaccttttttttcttttagaaattgaacatgcattcaactaatggaatattgaggatgcaagggacaaaccaaaatccggggacattttctttagttaattttttggacaatttgcaaatttaccactgctttgaatcgttattgtaagatcgccactagaaaattataaaaataccacttaaactgtcattcgagtggcatccttgtaaaattgaaaaaaccagtggcaaatttgtaaatgaccccttttttcgcggggggcacaggagagattggcttaattaatgtttggagcagcagtggaagtttatcttttaagtatatgttgtacatatgcatataaaaaaattatagtctcttctatcctaatatatagtcatctaggactggatgagacacatcctaatataacgaatctggatgaacccctataaatatttgttgtactaagatgtgtccatccagttatagattgctatatatacggacggaaggagtatatccaatgtcataataaatgctttctcagtatcacaattaattacataaatttttaatccatagaaaagaattaagcattcaaagttagtaccctgttgaccccaaaagttgaaatcaaccaggcccatcgtttggcatatgagagaaaaatgcgaaacaacatatttacaaatgaaaaaataatttatgaatacagctttttatatatgtgttcttaacgacctaaaagcaaactgaaaaaaaaatcccaaaatcaactccacatttaaagttaaaaattaaaattttgactgacaagtataattaagcgaaatgatgaggctgaacatttgaacgggcttaattgactgtcgaggtttcaaaagtttgattggatcttattgaaaacatcatttatgtgtattttactggaagaaataccaaaatggttcatttaattatttaaattgttaattgccagcaactgctgtcgccggaggtattctggcattcgtggtgctgtacattctcaaggagcatcggaggcggcagcaaaatagatcattcgacaaaaatggtggcaacatactgaacaagatgatggacatcaaaatcttcagcgaagaggagctgaagaagatgacaaaaaactactgtgagaaaagaagattgggaaaggctacttcggtgaggtttacaaggggatcacccaggacaaccagcaggttgctgtgaagcgctttgtcagaaacggtgaggagcatgacaaacaggatttcgcggatgagatcacgagccaggctcggatccaacatgagaatttggtccgtcttgtcgggtgctgtctgcatacggatgtgcccatgctggttctggagttcatccccag

SEQ ID NO: 65312 - DNA, 2521 bp, Oryza sativa
gtcacaggtgaggggataccagtgacgggccactgaatagaagcccgtcaaaggtatgaccaatacctttgacgggctttttttatctaacccgtttgaggtgtgttgggtctataaataccccccaaactgccaactgctttccatcccgaccattttactgttcacaaatcggttgggagggcaagggggcgattttttgctaaaattcaaggtaaaaaacacattattctccattcattctcaacatatcgatcatcatttatttttctttgtatgttgttgatttcagatggatcgtagatggatatactatgcgcatcgttcgtctaccgagtatagagagggggtcactgaatttgtcacatttgcggataatgacagaaaaagtaggatgagcatgcacatgttgtgcccatgtagggactgtaagaatgaacagatgatcgaagacaaggatgaagtgcatgctcatttgataatgaatggattcatgaagaaatatacctgttggaccaagcatggagagcaagaggcgcctgatgtcgcagctgaagaagtgttggatcaggatgtagagaacaccgccgcagctcgagaaggcatgttcgtaccttctgctttaggtggagagaccatagatttggacactcaatgtctatctacaatgttgcatgacattgaagacgcagaggacaatgacagagattatgagaagtttagtaagttggtggaagattgccagatgccgttgtatgatggatgcaagtcgaagcacagcaggttgtcatgcgtgttggaactcatgaagcttaaggctagtaatggctggtcggacaagagttttacagaactccttgaactgttaaaggatctgttgccagaggggaacaatttacctcagacgacatatgaagcgaagcaagtattatgtccgttgggcatggaggtcagaagaatttatgcatgtccgagcgactgcattttgtattacaaggaatacgctgacttggatgtctgccctatctgtggggcatcaagatacaaacgagcaaagagtgaaggtgaaggaagtaagtcaaagaggggaggcccagcaaaggtggtgtggtatctcccaattgcggagcgcatgaagagaatgtttgcgaatgacagtgggatgacaactgttgaccttaacaaggttggatactcggacgaaccttttgtccttgccaatgatgtaacgcaagtctttttcgtgaaggacatatctagcaaaggaaagaagggcagagggcctgatgagcctaagcgtcaagtggttctcccaggcaaaagaaaaatcgtcggagttgaggacaagactgacgaggattacgatcagttggatgggcaaccccctttcacggtgacgattgaccctagcatcctcctatcaaatgaagacaccccttactcacgcagcgatcacaaggagggaacaatagtgaggagaaagtacgtgcggtcaaccgtcaccgccgatgtaatgccgtaattattgtgtacacgatgtaaactattttggatgtattgattatccatataaatcaattgatgtatggcatatgttaattacgcacgattattagaggtttcaacaagtttaaatcatgtatatgttagttatatgtgatacttacaatttttaaaagttttaaatcacacaggtggcaatttcatatgtatgttaattagagtttttaacatttaatttactagcattcatatgctaattataattgactagaggatttttaaaagttttaaatcacgcaagtggcaatttcatatgttaattagagtttttaacatttaatttactatcattcatatgctaattataattgactggagaatttttaaaagtattaaatttaatatatttttaaaactatcattcatatattagagtttttcacaatttaatttactatctttcatatgctacttatatatgactattcgaatttttaaaaggtttaaatcatgcatgtggcatttacacatgttaattagagtttttagcatttaatttaatataattcctacgctaagtatatatgatgattacaatttttattaattttaaatcatgcagtatgtacatacatatcttaattagagtttttaccaatataataatatcattcatatatatgctaagtatatatatatattggaatttttattaattataagtcatatatttgcttattacgatttatccacttaatttattacagacaaaaataatttttcgaagtaattgtcattaatctttgtactttaaataatgttaatgcattaacttctattttataaacacatatgtaagcgaaaatcatatgcagtgctataatctttaggcccggttcttaaccctaaccgggtttaaaaagaattttgaaatagcgggaaaagatatttactcccggttgttgagaacaacttctcaacaaccgggagtaaagatcttttctttactcccggttgt

SEQ ID NO: 65313 - DNA, 46038 bp, Oryza sativa
gtcaacggtgccaaatattttaaaacggagggagtattaattaatatagataccaaaataacatataatatgtgcttcagcatgagatatgtacatgttattttactatagggattactcatcttaatttgattttatatctaactatccatttaagtttgattaacttttaatactagaaaatggggtaatttacaaaattattatgggagtaggtatggtgggtagattcacttttaagtgacaaatggcgacgagggagaagatcaacttgcactagtaaaagacgacgaccgggacttactaagctagctgattccttggaggtccttataactaatggtggccggtgcatcgatcgaagaacgtatatatttgatactactgtactatcatatataagaaccaattttataattgtattttgtttttattttgaatatcaaataattatgcatcatcagtgagtgttacataactcttcgctgtattattatttattctattccaaaaaatttagtgatatagcgatttatgtttggaattcatatataaaccagtttctatatttctaaatttaattaatcatgtaatatgaactattgtttttattattagtttgcttcacccgaaataaaagagaggaagagtttggcttgccatgttagtaaattaaaggaatgattttatctcacctcaaaaccggaaatgctaatgcgcgggtgatcgccccgcgctggccccagcgatcacccgcgctggcccttccccctatagtccttcctcttctctcccttcctcctctcccttcttctctccccttcttctcttcctactacaatacaccacaaaaaaattttaaaaaaacaaaagatagaaaaatttatgtatagaaatactatatataaaaagtttgaattcaaattcaaatttgaatcgggtatgtaaacttttgacttataaactttgggtctataaactttaggtgtataaactttaaatgtatagaaatactatatatatagaaaatatttgaattcaaattcaaatttgaattggatataattcaaattcaaatttgaatcgggtatgtaaacttttgacttataaactttaggcctataaacttttaggtgtatagaaatactatatatagaaaatatttgaattcaaattcaaatttgaatcagatataattcaaattcaaatttgaaacgggtatataagctttaggtctataaactttaggtgtataaactttagatgtatagaaatactatatataaaaaatatttgaattcaaattcaaatttgaatcggatatataaacttttggtctctaaactttagatgtgtaaacttgagatgtataaactttaggtgcataaatttactaaaataggaaagtaatgcagcgccaaaaaaggaaatcaggtggagggagggagggggaggaggattgatcattacccccgtccctaggcgatcgatcgcccattcgggtccccccccccctcaaaactgccaacatgtgcagcttctagatcaatctattcatgcacagccaattaaactgagggatcttaaggtagcatgcggaggaacaccgcgctttcgttcctcatttgggccatggccatggcgatgttcatggctaccctccttccacaaagttaaaatgatcactaatctcacatacatgcattcttcttttcatttcattattgaaagtgaaaaggcatgtagcctaatggttgcagtgacctgagtagcatcccaagattctgagtttaaattttcataggagcgaatttgagattgggttatttgagggccagaggctggataaaaaaaacccttctctaaaagaaaattcattattgagaatttaatggatttgaccttattccaactatgagcagcgatcattaattggtatatatgagaagtgggttcacatcctttaccataatgacataccattacagacactacatgtgaggcaatagaaagcacgtgactgtaatgacagtgatattatattatatatggtaaaggatctcacccatgaaaagtactagagtatctgcccatgctgccccatagggagtaacaataatggtcttaccgttttggttttcagctaaagcatactgtgagtgccttcagtgcgcagacgtcgacacacacctgattgctttacctgctgttcaacagaatatccttaaatcccttgtgttaatatataatatgagccatatattggttcctaatattattcgtggaggtctatccaaatagatccatcatttcccatcgtatgttgtaatctcagaatacctatattgtctttctttcttgatggtggaattaatgaactaataaataaagttgtatgtgcattgtccaattaattattatttttagaaacaagtacaaacgcagacgctcacaacacgtgtgtactcatccctataaatacgcgcacacacatcctacccaaggccggtcctaacattttaagagcctagggtgagacaaaaattagggccctaaatagctacattaaattcattttagtagcttgtatgcatgtggtctttatctatgtgcaacgcaacatgcacatctcttctccattcctcttggttatacacatgtaacaatttaatatgctttgcaaaattatttctttgaaattatccatccaatatgtgatctaattatactgttatatttattataattaaatctttacaataagatatcacatgatgtatacatgtttcattcattttgattcgatgtttcaaacgtaaaagtaaaatgtttcaactggtcttctactatgttgcgcatatcttttgtatacatataatggatcatttctaatgttgcatatggtattatttgaatgtttcaataagtgttttacgatgtttcagtagttcatttgcaaatgttgtattgtgttctttcgatgtttcaataaatactttgcgctgtttcaatagttataaattgatgtttcataagctatataaatatgtttcaattaaagttataacaacaaatatatttttttcatctgaaatatggtcatgtgagatcttgttgtgaaaatttaattgtaacaaataaaatggtgcaatcgattcacagattgcataagtagtttacaagaaaacatgttttaaaagtttgataaaaaaactttacatgtactgttaagtgtgtgtgcgaaaggatgagagcatgtgcggtacgtgctctgatcagagagagataggattagagaaaatcatgcatgtgagtagctaatggagagaaaaggaagattgtccgacttttatctaaatgatcggggtcaggagatatatgccaccgggagataaattagtactccactgaaaactggtcaaattaattattacgtggtcagctttatcagtccagtgcatttgatgcttagtacttcctccttcccaaattgatcatcatacaatggaatttaaaatttctcaaattgatcatcgtagtataaccgcatggacatgatttcatcagaatacaattaatgtagcatgggagaatatgtgtatgctaaggtgtaattggtattgtgtttttaatcgatgcatgtattgtgggagaatatgtgcatggtgtcttgattgatattatttaaattatccttggtcttggtgcataaacttatacgatgattaatttgtaaatgagggagtagtataccttttcttttgtggcgagaaagattttgtacaattgatcagattctaataaattgcttgaacgacgagccaacaagactagctagggtcattttctctatccacaattgcttcactataatgctccgattttgttttgaaatccataaatttttttgagatagttttttttaataataatggataggaatatcaaagcaaatccctactttcaatagatgatttttcacaatttgacccatttctgtgcttccatatcatggtaaagctgacgacagactgtaattcttacctcccagattatggttgacctacattaatctgaaaacataatcgagccgcctcaaacccactaggaaagcacaaacattatcacgtggtttgtctgatagaaaatactaaaattgggccattttttgtgggtgtaacaaaaactaaaatatgcatcaccaactaaattattccattaattgattatatatgtacagaccgacacagtttgttccaattggaccgtatatttaacagattaacagtcacatgtacagcccattcacatccaaagctaatggtcaagacactgcagcaactgtgtcgaccaacctctctcccaaattggattaattacagtaattaactaactaattaattaaccatgcatcccgttgcaccctcaaatcaattgtaatctacgtttacattaattactatatcctttgaatcaaagactacccaaatgcacatgcatatatgtacaagagatcgatccaaatcacacaccaactaattaattaatatacttagttaagcccataagatatttcatacactaatagaactacctccaagcttaactagctagctttgctaataatatcaagcaaattggtactatgcatggctttgcacggtcagtacagatatataggttagctatttcttgtgtggcttgcttcgattaatttgatggttaattaatttataagcatcccacatatatattgctctcttcgaggatcacatgtacaaatcagttaattatctattactcctaaatatatttcgaaaatgcttatattttgaaacgaaagaaataccacgaaaaataagatgttgtattgtgcttaactattgatgttcttgactccccttaatatttttaacccctagctacccattagatccttctccacagttaattagtaacaactgcttataattaattaatatatgtatgtgcttcctacttcaattaactatatattgaagtacgtactacttgctgaaaattaattaagtatagcaaatttaactcagcatatggtaatttacaatatgttgtagtaaacgttttccacaagttgaggtgatagatggtcttgagtcttgactatccatctatagacttgtacattgttgatcaaattctaggagatgccaagtacacatttgcgtcgatccaacggtgcagatcgattatgtttgtcagttgacagagatcccagccgtccagaaaagctgtgcgggtgaaaagcttccacgtatgctagtcaacgcccgtgtgggccccacattgtcagggggacaaaatactgtacaattaatactaggtcatcgttgacaagtgcttggcttatgtcagcagctgacgccgtagagcagagaaaacgcaacgcatccgagatccactcgtgtatacatataatccttattgcgtctttgattaattcgacaattaaaccggaggagtagaatcttatttactcgcatactgaaagtattagtatggtatatgaaagcataatgaactttcataccaaaatgctattaattactctctccatcctaaaaaaaagtccaattctagagatgaacatatgtccatattcatctctagaattgaacttttttgggacggagagagtagtagattaatcataccaacgatatctcgaaaaatattatattatattttctccggtttttaatgtttaaagctgttgatttttaggactttggacgcacgtttcaccatgtgtcttattaaaaacttacataattattatttattttttttaatttgttttatcatcatgtgtactttaaatatgacttataattttatattttttttacatatttattgtaaaaacgaatcttgaattaaacaaattgtcaaacatatataaaaaagttaacggcatcaaacattaaaaacctatagagtatctttacgagtaaatagttaaattaagaagtcgaacacctcattttctttttcaaccgaactcatcttcaaattaataaaggttgacatatctcaaattgaaatatttttctttaattttagctagttgtcttttgaacttttgtacattagcaatgcaattaatgctaatattcgtctgctacaatttaaggtgactgtctccactaagcacaccatctagtctactataatgcatatgtttgacctaatgcaaggatcgatgggatgcatgtagagccaaatatgaccaattaattaagaacgttttcgttgagcctatatttgtaccttctattcttaattattagcagatgtagtatagacaacatgcatgcatctatatatgtagctgataataagacaagcatatggttcaaactgttgggttttggtaacatcaactattagttgactaatgttttactacggtaaccgtgacgtacgaacagtacatgcatgcttaatgggtaagcttcaaattaaataaacttaactgtgggtctcgcaaaccagcttagtttgatgtggttgtgaattttctatctatcagggttcaaaccctgcagatatacccaactaatacatatttgatgcactttcactgagaatttaaaggttgacacagattcatcactttagttgtgtggttaattatgccacgaatttaaattaaagtactctatgaaaaaagggattaggattaattgtgcatgcgtggggtgtgtatatgtatttgtctttaatgtaattgcaaaaggaaaaggcttagctaagtactatctctgtttttaaatagatgatatcctaaaatgtgggcagtcaaacttcgaaactttagatgattaattaatataaataatggaggtatatatggtatgctgttgtttttcatccataaattagtttttatcctctcctaacttaattagcttttaaattaataatcgagtgcatgccctccacacaaaatgaaaaaaagaaagaaagaaagaatcaagtgctcaaaatggcatgttcttctctgcaaactaagctaatcattctactactagtactctacatagctatatattcagtatataaataatttgctagtagaatgtaacaaacctgcaacaacttgtgattcgtatactaaatatagtacgcaggatgcagggcgtaatgaacacgtcttgtttttaactgtgtaagtatgcatgcatgtgcttaattaagcagtaaacatgtgcttatcatcaagccaaccaagcagaatctgaccctagttaggggtctataagatgcttaattatagcactagtgtgtggcccaaggtataagtataagtaattaacccccactaacctaagattctgtctgttaattatacatatatccctgtcattacttgtagctagcactactgacagactgacagacattgatcgacattaacacagatcgatcacacactgcaaatttactccattctcactcgcagagagatgatcggatcaccggatcgaggtgtcattttgactatttatatactccctccgtttctaaatatttcacgccattgattttttagcatatatttgaccgtttgtcttattcaaaaacttttgtgaaacatgtaaaactatatgtatacatataagtatatttaacaatgaatcaaatgataagaaaaaaattaataattatttaaattttttaaataagacgaacggtcaaacatattttaaaaagtcaacagcaccaaatatttaaaaacggaggaagtatatatcatatactaattaattacgacgacgaagaacagtagtgctagtacttgtgcgtcatcgattaagggtttagaatttataaattaaccatttggagttgtaaattgaactgaagattaaatgcgtggaggaatgcatggtccagaatttattcaacttggagaacttatttattatacatctggttctgatcttagccgtcactcatacaattggatattcaattcagtgtgcgctaagttgatgcgccttactttgttgtaggatatgtggatgaatacatattatacattatagaaatggtaagtgtatatgtttaaatgatgtggagataatgattttacattgctatgcatattgagttatatatatatatatatatatatatatattattactccctccgtccaaaaaagacgaatgtagaactagtacaacgaatatggataaaggcatgtccagttcattatactaggttggtactttatgggacggaggaagtactcttttacttcaataaaattaaatatgtaattatctatatattataataaaaaattatactggaaaatatatatttgaaaaaccatgttacataatcagtgggagtactacctctagccactaatatattacgctttaatcaagtatttgttgcctaccattttttcccgagcgacgtactcctttgtcaaaaaaaaaaaaaagccaactccatatctagatacatagctagcagttagttagcttttttcaaacggatgaagtatatataacaaaagttttcatgagctgaatttgctagttatgagcataatatcaatattttatctgattgacttggtaggtagatatattcgtctattaacaattgttggtttatttttgttttagtattttgagtgtttctaagcaattggccaattcgaatatagggaatgttttggcaaaaattccgaatgtttgctagaacttgggacgaaatatttctttttcgaatggtaattaaggcaattgccaacgttttatataaacaataaggtatctcatttttaggagaaacgagatcaaaccttataatgcaaggttaattagaaaaaactgaacaaaacccacaattacaataacactccaactacataagctatgatgatggcgaaaacaggacagccaagctcaacactcaacaaacaccatccacatgaacaagcaacaagctagaaaaaaaagactcccatacactagccaagacgtgacgttatcatcatcacactagcgcctacgcggctagacaactccaactttgttaagaaacataagggttacgacaacaagctagcccgcacaaaatgttaacctaattcaacgaggctcatgtcatcattgccacgcatcacgccccgtagacaccgcagctccgacttcatgagcaccggtctccttaatacatggctgagctagactgaccgaccttgcagctcaaaatgcttgctactccacactacgcgactggcgatgtttaactttggtcatcgttccaaaatgaaaagaagtctttcctctttcagttatagcctgactctgaactctctctctcaactacaattttgcaggcatatgcatatatttcaagagtgcacaaaagtacatctccttcataaattaagttacattacgatttaaaaaaaaattgaatattagggaagaacctataatttcaaataattagaaggggtctagcccaccaccttgtgaagctagctggaaatcccctgagcgtttctcagttacgttgtgatttattcatgatataccagaactaaaagatcgttatcgatacttgttacaagaggaaactaaacgacaatagcacaatgctgcagctctacaagcataacaggacaacccggcggaagcaacaaacgtcacatctgcaagatcgacggagaaaacaatagcgagaaggacgaatccatatatcgatggactaccaaccgagtctgaagagaccaggcttggttcatcttctacaccatcagttcgttgcttgctctcaattgcttaagctcctccagcacctctgccatggtgggcctctcatccacgtcatctttgagacaccggactgcgatggccgccatcgtgtcgaggcattcaatgcactgatcaggctgaaggctgtgggcatcagtatgcagcatgtcctggtcatacatctccctccttgcattgttgtccgtgtgacagttgacaaaatctgactgaacgtttctcccgtcatacttggcctttttccgagtaatgagttctatgagtacgatcccaaagctgtaaacatcgcttttctgtgtgacaatgttagttttcatgcacacaggatcgatgtagttcttgtcggcacatacttccttggttgcaaggcctaacttggaggacccaaagtcagagaccttaggcacgagatccttaccaagaaggatgttggctggcttgacatctccatgaataatgctttggagaccaagagaatgcatgtaggcaagagcagccgcggagccgatggcaatgtcgaggcgttctggcagcgagagagcccacaggtcaggtccatgaagcacggtctcgaggctcccattggggatgaactcgaagaccagcatggggacctccgtctccatgcagcacccgatgagacggaccacgttgtcgtgccgcatctgtgactggacaatgatctcattcacggacgctttttggccgagcgtaccatcgccattggaactaatggattttctaaaggccatctctttcacgaactcgtatttgcctcgtctaatactgctcttcgcggtggagtatttgacggcgacctcctggtcatcgtggagtcccttatagacctcaccgaaggtgcccttcccgatcttggttctcttcttgtttgttatcgtgtcaagctgctcctgcgtgaaggtggtaacgcccatatccttcagtagttggccaccgttactttcgaagaaccccctctgctcccatgccttgtgctcacaacgaatgaaccacgcaaggcccaaaagagcaaccatggcgcataccgttgctgcatgatcaatatatgtatataattaattaaggattctgtgggttcatctattggacccataaatagatactgcttgaataatccatatgtaaaattagcaattaatcaaaattcatgtacatatgggcggccacaattaagtatactagctactaggtagtactagtagtaataattaatcaagaatcaacggcgtcgatcggctcacctagtgtggcgactatacgtaagggaattatgggcttgcatcccttgccagtaccgtctcctctatggggaaatcggcatatgcacttgtaaccgccatctgtgttctggcatctgctaccattgtaacatggatagagttggccgtatatagaagactttgtcctgagatggcactcgtcaatatctgcacacatatatatagtggtgataaacaatccaaataattaagctaccaatccggtcgcgcttacgtacgcgagcaacttcaaacattaagctataccatactcgctagctatcgacgacgtaccacaccactactggagaagcggtttttactcccgatttataaccatttttattcgtggttatagcaaccgggacgagcaaatcacgtaccaccgcagctggagaaactgtttttacttccggtttacaaccatttttactccattgcgggagaaacggtttttacttccggtttacaaccatttttactcccggttataacaaccggcgcgagcaaatcggaagatggagaaacggtttttactcccggttataacaacctttacaaccatttttactcccgttataacaaccgagatgagtaaatcaggagatctttagtcccccggttataacaactgagtcgagcaaatcgggagatctttagtcctggtattatctttagtggagatctttagtcccacttgagaaccggtactaaaattgcatagcaaatgagaaatataagtgggatgtgagattcgaacttaagatctctcaccttagcctccatatgcataacctttccacctactacatacatcttacttgaatagatatctttagtcccagatagtaacaccaaccagaactaaagatcctcaatctttagtccaggttggtgttaccaattgggactaaagatcaatgtttagtcacggttggtttataccaacccggactaaaaatgttttgagggacttggagtatctttaataccggttctttaacctaacatggataattgtgattttaggtaccatgaaaaaagatcagttatccacttgtgcacatactagataggatatatcttcatgcatgccaacttagagaagaatacagttagctagtcagtaatctgcagtatataattaattaacaactaacctatgcatccgccattgcctttgagatagggattgccgtcgtatccctcggagcacttgcagatatacccctctccgttattcctattgttgcagtggctgtggtcgctgacgcaggcaggagctaccgaccccgagcatgacccgttttccctgatggcccagtcaagcaccatggggactctcttgtggccatcccggttcacaaatctcttactgccagcatgaccgaaatcttcccgtctaaaattgtacctgaattgcatatatatcaacaacaggtttaaagtttctctatccagtacacggtatatattgtgtggatattaatttgacccagaaggatattcatatatatcttgataggccattctttaattaaattgatcaaattaatgtgccggaatttgatgacatatgctttatatatatatatatatatatacctaattaaaaaatacgtaaggtttccggaggtatttttcgtccgtcattaccatgcgcttcgctaaaatccagatttaatccggttaacagccggattgggcttttcttatctactccaaaaccgcgtctgatacgatatatacacatttcatgtaattgcctcacatgtgtagtagtctgcccacttggttaaaggagaaagttttcacttcggccacctgggttcgagtcccactttcctctcaattttgcacctattattacttgcactgtgtatagggctctcttagaataagtctattttgcctcccccaagtcaaattatatttgccttctatttttttctcttttttcaacagatttttattggttatgaaatcttatcttataatgaatcagtttttaattcgaaaattaaaaataattaaattatattcacaaaaatcaatataatatatgttgacctaggccctagaatatgtctactttccctccctagtccgaaatcatatttgcgcgtaatttttttttctctcaaccattagcacggaccatgcacatccgatggctgaaacatcaaaagttctgcacctctttctttaacagatttttagtgattctgaaatcttatagtacaccggtttttaattcgaaaaataaagattattatattatattaaaaaattagtataaacacgtgaaccaaccggtatttttttaaaacatgaaaattgaatatgtgcatggcgtgaaacttcacaccatggctccgttccttctatctcgatttttgttagcgtgtttttaaaactttctatatacaagttgatataaaatactagataatttttcttaatttttgttataataaaactcaattaatcatgtgctaagaggttttctaaaaagaaaaaggaacggcatggtatggctggcactgttcaggttttgtcggttagaacatagcactgtactgttgcattgtgattataatcaatgcaatgttatagcaatcatcaattatgaaaaaagattataaaagtgtcataaaaaatgtagtttataataattaatgaactcccaaaaaattcattatttacttatacgtaaaggtgcgttgcttggacgtccgtttctccaatgctacaatcattgggaccatgtgttagggacatcattcacattctgtacgtgtagagcggattaattatccaaacacaaatatgcatttgtgataactatgaaggtgcttcgataaatcgttaaggccaaatttcattcacctcaccaagtcaccattacccagtacaatgatatcacagtttatcacataagggttgagagagagagagagcgtgtttttattctgcgtgattatcattaacctaataaataatttatctatcttgaaacattactatatatatgttaactctagactttatagcatttaactgttcctttacccgtaacaaagcatgtgcatttttctagcataacaataatataattaaaatagccttcacccgttacaacatacgggtgtattattaaaaaatcagaccgggccaaaaaaaaactcagcaaaaaccatgtgtattattagaagaaaaaccagattggaccggaaaaaatgagcaacccagatcagaccagaggttgccgttgtcgtttctttctctatctatcagaacaatattgtcagtcgcatttctgctgttctggttttcttcgttgccaatgtccaccatcaatagatgagtccaattatgagatacatcctaccacagtcctcaccaccatttgatcatcggaccatccacgcccatcttgagtattatgagaatatgagtatatcaatatgtaatggtggttttatccattctaattatcattaaaatttctaattaatacttagtctaagaaataatttatccgtagcgaagcacgggcattttgctagtatatatatatgcacgtaagcaacgtaccagcctttctccgccacgaaggcgtagctacagggggcgccttggtcccacgcgacgttgggcaccaagctcgggtcggcccactccaaatttaggacgttaaggttgggcgggatggaaggcacatggcagcaacccagccccgtgcagccgtcaccgtcgttggcggctgtctccaagctcgcgcacgacgtgatgcagccggtcaagtagctcccgtcgtccttgccccatagcaacccaacccaatcgcaccgcagccgatggccgtgaactcgttcctctcctccgccaacaggaacggcgtgccggtggcgttgaaactcgcgtaaataccgctggattccgtggtgttaggcgagttgttgcagtagtcttgcagcacgagactgtagacgcgcatctcccccttctccagcgagatgtccatgatctctacgtcccccgtgtacggcctgggtggggtaaagctatggttgcagtcgacttcgaagcccggccaggcgcagtcgacgccgatgccgaaggggaaggggatgtcgacgtcgccgcacttgctcgagcaccccgcccgctgcccacccgccgccgccgccgtagcagcatggaacagcagcagcagcactattattagttgttgtggcatggctagtattccgacgcgcattacgtttcgtttcttgctgcttgtacgtactacgtggtagctagaggtgctgcgtgggatgcgcacgtcgccgcacttcctgccgcagttcgccgccgtcgacgtacccaccagcacagaggaaactagtagcagtggcgccacggctgcagccagagcatggaggtcataccacacactggtggagaaaccatctttcgtcggtcggccgatttccacagtagtcccggatgcaataaaaaccggggctaaagatgttctttagtcccggttcaaaagggtaacgggcatatttgatctttagtcccggtttgtgttaccaaccgggactaaagatgatctttagtcccggttcgaatgctgtcagggtctgtcaggccctcccggtatctttagtcccggttgataacaccaaccgggactaaagatggtaactttagtcccggttggtaataccaaccgggactaaagatcccggtgatctttagccccggttggtgctaccaaccgggactaaagtcccacccctatatatatgtcttcttcctcctccagctgcccgagcaagcttcaaaatttcttcaaaaaagaggggaggtcatgccaaaatttctattgaatttattttggtgattacatacaaatcggaggtgcctaaaaggtttgcaacttcatcctccaatgtttttttttgtcatactaaatttgcacctatgttttgcacactttttttgtctccaaaatgtagttgtaagttgatgagagaaaatgtgtgtggggaagaaagaatatatagaaatttagttcatttgctaaacaaggttttataaaatagttgagaaggaaaactctagtgaaagttaatcttaaataatagaaaacaaactaaaatgaaaattaaaagaagtaaaacacattaaaattagtttattacttaacaaatagtttttaagaattatttggtgtaatattttatgatttttgtatgaataaagatatcttataattattgtatgactgtcattattgtaagaataattatttgtgtacggtttttttgactcatgtagatggatcggcaatggatgtacgctgaccggcggtccaaagagtttattgacggcgtgcactattttttagagtggccgaagctaacaggaaaaggggttttatttgttgtccatgcaataagtgtaagaatcagaaggagtattctgcatccaggactattcatttccacttgtttgagtcggggttcatgccaagctataattgttggacatcccacggagagcaaggtgttgaaatggaagaagatgaagtggaagacgacaatattccggactttgctcaatttgttggatttgaaggaaatcaaacgagcgaggaggaaatagctgctgatggtaacgacgttgcggatgatcttggtcaaatgttgcaggacgccagggaggactgcgaaagtgaaaaggaggcccataaattggacaagatgttggaggaccacagaacttcgttgtacccaggttgcgagcaggggcacaaaaagttggataccactctggagttgttgcaatggaaggcaaaaaatggggttagtgacaaggcatttggcgatttattgaaactcgtcaagaacattcttccggggggaaacaaattgcccgagacaacgtacgaggctaagaagatagtctgcccgttaggactggaagttcataagattcacgcatgtccgaacgattgtatcctatatcgcggtgaggagtacgagaacctagaagcatgccctgtttgcaaagcactacgatacaagattagacgggacgatccaggagaagttgacgggcagctaacaaagaagagaattcctgctaaggtgatgtggtatttccctataataccacggctaaggcgtttgttcaggaacaaggggaatgctagaatgttgcgatggcacgctgaagagcgtcaacaggacgggatgctgagacaccccgccgatggttcgcagtggcgaaacatcgacagaaaatttaaagaatttggaaaggacgcacgaaacatacggtttggtttgagtacggatggcatgaatccttttggagagatgagcagcggccatagcacttggcccgttacgatgtgtatctacaacctccccccctggctatgcatgaagaggaagtacataatgatgccgattattattcaaggccccaagcaacctggtaacgacatcgacgtgtacctaagaccactggtcgaggatcttaaacagttgtggaagaaggaaggtgtccccgtgtgggacgaggacaaacaggaggagtttaacctacgagcgctgctgttcgtaaccatcaacgattggcctgcacttagcaacctatccggacagtccaacaaggggtacaaggcttgcactcactgtatggatgaaacagaaagtacgtatcttaagcactgtaggaaggttgtatacatgggtcatcgtcgattccttgcagcaaaccacccggtacggaagaaaggcaagcacttcgaacataaggccaaccaccatacgaagcctaaacatcgcagcgggaaaacagtgtttgctatggttaaagatcttaaagtagtgttcggaaaggggcctggaagccagcatatagagagcgaagatggtcacgcggcgatgtggaaaaagaactctatattttgggagttaccatattgggaattcttggacgtacgccacgcaatcgacgtgatgcacctcactaagaacctttgcgtaaaccttcttggcttcctaggtgtatacggaaagtcgaaagatacactggaagcacgtaatgatctgaagcatatggaacaacgcagcgaccttcacccggaaccaaaggagaaaggaagccattacttgagtccagccagctacactcttagcaaggcagggaaggaaagtatgtttgaatgcttggagagcataaaggtaccgtctggatactccacgaatatcaagcgaataataagcacgaaggagaagaagttcacaaacctaaagtctcatgactgtcacgtgttgatgacacaactgctaccagttgtaataaggggtatccttctagacaatgtccgggcaacaataacaaagctatgtgcattcatgaacgcaatttcgcagaaggtcatcgatccggatagattagatgcccttcagaatgaagtggtgcaatgtctcgtcagttttgagttgatatttccaccttcatttttcaatataatgacgcatctgctttgtcaccttgtgaaagagatccgtattctcgggcctatgtacctacacaacatgtttcctttcgagaggtatatgggcgttctgaagaagtatgttcgtaaccgtgctcgtccagaggcaagcatcgccaagggttatggaacagaggaggtcatcgaattttgcgtagaatttatcgaagaccttcgcccaatcggggtacctgaatcacgccatgaagggagactacggggaaagggaactctcggaaggaaagcaattatgacggtagacaacaatttattccgtaaagcccatttcactgttctacaacactcttcattggtagctccttacatcgaggagcacttggctctagttcgcgccaggaacatcggtaagtccgatgcatggattacacggcatcacattgatactttccccgcgtggctacgacaacatctcatgggtaacgagtcgatcaaccaacaacttgccttcctggcgaggggaccgtctgggtcgatcgcgacattccagggatatgagatcaatgggtacacattctacacgagagcccaagacatgaagagcacaaaccaaaacagcgctgttcgtgtcgatgccatgggacacgatggaacaactgccacgtattacggtgccatcgaggacatatgggaacttgactatggtcctctcaaggttcctctgttccggtgccaatgggttaggttgactggtggaggcgtaatgattgatgacagtgggatgacaactgttgaccttaacaaggttggatactcggacgaaccttttgtccttgccaatgatgtaacgcaagtctttttcgtgaaggacatgtctagcaaaggaaagaagggcagagggcctgatgagcctaagcgtcaagtggttctcccaggcaaaagaaaaatcgtcggagttgaggacaagactgacgaggattacgatcagttggatgggcaaccccctttcacggtgacgattgaccctagcatcctcctatcaaatgaagacaccccttactcacgcagcgatcacaaggagggaacaatagtgaggagaaagtacgtgcggtcaaccgtcaccgccgatgtaatgccgtaattattgtgtacacgatgtaaactattttggatgtattgattatccatataaatcaattgatgtatggcatatgttaattacgcacgattattagaggtttcaacaagtttaaatcatgtatatgctagttatatgtgatacttacaatttttaaaagttttaaatcacacaggtggcaatttcatatgtatgttcattacagttttgaacatttaatttactagcattcatatgctaattataattgactagaggatttttaaaagttttaaatcacgcaagtggcaatttcatatgttaattagagtttttaacatttaatttactatcattcatatgctaattataattgactggagaatttttaaaagtattaaatttaatatattttaaaactatcattcatatattagagtttttcacaatttaatttactatctttcatatgctacttatatatgactattcgaatttttaaaaggtttaaatcatgcatgtggcatttacatatgttaattagagtttttagcatttaatttaatataattcctacgctaagtacatatgatgattacaatttttattaattttaaatcatgcagtatgtacatacatatcttaattagagtttttaccaatataataatatcattcatatatatgctaagtatatatatatatatatattggaatttttattaattataagtcatatatttgcttattacgatttatccactaatttttcgaagtaattgtcattaatctttagtactttaaataatgttaatgcattaacttctattttataaacacatatgtaagcgaaaatcatatgcagtgctataatctttagtcccggttcttaaccctaaccgggtttaaaaagaatttcgaaatagcgggaaaagatatttactcccggttgttgagaacaaccgggagtaaagatccgggggtatatatattcccggtgcgccctcgtcttcttcaccaacacttagacgttttcggccgatcgatctctctcggcctctctccttcgccgccactgcctagggcaaatccccgcgccgacgccgccgtatctcgccgtcgtctcgagctcgtcgtcctcgccgccgcctccgcctcctccgctgccgccgcatctctggggtgagagccgccgccgccagatctccctttatctctcgatctctccgatctcagctcgatctctctccgtctctctccgtcgccgccgccacgccacgccgccgccgccacggccccgcaacgccacgccgccgccgccgccgtcgccacggcaccgtcgccacgccgtcaccacgccgccgccgtcgccacgccgccgtcgccacgccgtcgccacgccgccgccgtcgccacgccgccgccgtcgccacggcgccaaccgccgccccgatgccgccacggccccgcaacgccacgccgccgccgccgccgtcgccacgccaccgtcgccacgccgtcaccacgccgccgccgtcgccacgccgccgtcgccacgccgtcgccacgccgccgccgtcgccacgccgtcgccacgccgccgccgtcgccacggcgccaaccgccgccccgatgccgccacaccgccattaacgaacgagaacgagaacgatcgaacgaacgagaagcgagaacgaacacgtcaacgtacgttgccgtgagaacgtgaacgagaacgagaacgatcgaacgaacgagagcgagaacgaacacgtcaatgtatgttgccgcgagaacgtgaacgagaacgagaacgatcgaacgaacgagagcgataacgagaacgatcgaacgaagacaagtgagaacgagggaacgaacgtgaacgagctagggaacgtgaacgagcgaacgaacgaggacgaacgttaacgtgaaatgcaatatatatatatatgtatatatatatatgtatatatatatatatgtatatatatatatatgtatatgttacttcgcatttgactatatgcatctttttgtatcttgcagaaaagacgtgttgtcggagtcgtccgtcaagcctgagtggaagagctagccctagaaggaattggagcaggcaagtgacgtaataatataaatgattgttatatttgtaatgcaattaattaagattattagacctgtaattagacttatcatataagattgtgtagtgttctaatattatttgagttttaatataagattactttatttgtaattagacttagtatgtaattattgactacggaagtggtgcgacaagtagcaattgactattgtagtcttaattagacttagcatatacgcacgaaacacttagcatacatgactattttagtcttagcatgtaatattatttgagttttaatataagattactttatttgtaattagacttagtatgtaattattgactacggaagtggtgcgacaagtagcaattgactattgtagtcttaattagacttagcatatacgcacgaaacacttagcatacatgactattttagtcttagcatgtaatattatttgagttttaatataagattactttatttgtaattagacttagtatgtaattattgactacggaagtggtgcgacaagtagcaattgactattgtagtcttaattagacttagcatatacgcacgaaacacttagcatacatgactattttagtcttagcatgtaatattatttgagttttaatataagattactttatttgtaattagacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtttcttgtatcaacagatggctgaccgcgatgaggaacagatattgtatgatacaatcgcggaggaaagcagccagtactggaatgaagaagaggggaacgaggatccaaaccagtacttgaacgaggaagggaacgtggagagggatgcggaggggaaccagcaggggcacgtggaaagggatgtggaggggaaccaggaggaggaggctagtggtagtcaaccctccgttggacagaagagggcacgcgggcaacgaggtgcagcgaagaagcttgagggtcggcacatctaacggaagtggaagaagatggacgtcctagtgccccggccgaagccgccaagaactatgtacgtcacagcggttgggtgtgcgggataacgtgcctgtcagtagggtgtactggcgaagaacaagggcacgcggagatcatgagagctttgtcccagattcggagaaagagatgctgtggaccacaatgctcgagacattcacccttcctgcgggtacagaggacaaagtgaaaaggtggactctgaagaaaatggcagaacagtttcagagcttcaagggagatctgtaccagaagtatatactgaaggggcagacaccgaacttcgacacattcccaaagctaagggatcactgggacgagttcgttgcatataagacaggtgaacaagggcaggcgatgatggaaagaaacaaagaaaatgccgccaagaagaagtaccatcaccacttggggtcaggaggctatagcgtcgcgatgccgaagtgggaggagatggaggctagcttgattgagaggggtatcgaaccggcaacagccaattggcaggaacgatcgaagttctggtactatgctcacggtggaacgctcaacccagctgatggctcactggtcttcggcgttcagatacgagaggctgcgtgacgactaacagatgcagtggaagcctcctctcagggcacgttccgacccgacagagatagggacgagctgacactcgccctgcagactccagagcatccaggacgaacacgagggaaatgggtgattccttggaagattggtttcaaggaggacatccacacgtacaggagtcggatgaggagcaagagagataccgaggcgaagattgcagacctagagttccgggtatcgagctacgaactcaacatgcaagaggaggtggcaaggaaggttgatgaacgcatggccgcacatcggtcccatgatccccagccgaccattcctcctgcaatggtgagcccgtcaggaaaccgtagcagctgcgcctcaacggggcaggtaggatcacagagcatggacgccatgcaaacacaggacgaatcgacctgtcccgttgatgacatcactcagcggacaccatgtgagctgcatattcctttgaagaacttatcaataaaggtaagatttagccattccgctagttgctgcttatatatgttgattactaataaataatctctcacaacatgaaggtggcgtcgggcatggccatcccaatggacccttcaggtacttaccactgcaggccgattccagcaggatactcgaaggtcgaagttgagttggtcgaaggcgcgtacgaggacctcgagctggattaccctggaggagacggtgagacgcatctacgagacacaagccatgccattattctatggcgcaggcggtacatcatcctccctgggcgacaagcggcgtctcgtgcaccatctcctccggctccgccatctcctcctcaggatgctgcaccgtctcctcctcatgctccgccagcaccgactcctcctctggatcctgcaccgactcctcctcgggctcctacacctactcctccgcaagctcctcttccggcaccttcaaagtcaagggcccccccagctccatcgcctgcccacacaagggcaacgaagaaggcgaaagttgacgccgccaagaacaaggacccggggtacgattgcacgcaagaggagcttgacgcttacgttgcatcagaagtcaagagacaattcaagcctcgaagtccagaaaagaagattcctatagaccccagtgtcaggaacttcttcaggggtatgtctgcatctgtcaaggaggccatcaagctatcggactatgagcgaacgctgaagaaagcatcttctggaaagtccaaactagtccctcagcttggagagcaaccaaaccaggagatcgagccgttggtgaccggtaaagaaatgacgatagaacaatttattactgacaccggtctaactacggatcaattgctaggagtcgcaccaatcgaaaaggcggaagtgaaatacatgtacgaactcggtaaaccgcttgtcaagcctgagctgctgcagtccctacccacacaaatgtacaagttccatcagctgtacatggagatgagcgccaccggtagagagatgatcggagcgaggatcagggacacggacttcttgcaaggagatgacattctctggatcaatttcaggggaatctacgaactataccagctggacgccctcgacgtctctattatgagttgctggattttgtaagtatatcgttcagttagatttcttactatacgtctcctttaattaattaggtccttgtatataagtagactatagaaaataatatactcccttttatcgttgtagaatggagattcaaagggcccgacggcggagggttttcgatactggattcatcgaccctcggaaagtaaacgtcgcaatgctcgaccaatatccacaagaaacagaggacaatctcgtccatctcctgaaggcgcagcattacaagacgttcatactgttgccatacaacacagagttagtttaattttactgtcttcctacataccaaatttcattcccgtacgaacttgctaagtgtttcatatgtaatgcatcccacgcacattgcagattccactgggtgcttttactcttcgacctgtcggcctgcaccgtcaatgtatatgactcaatggataaaaaagagtctacgtttgacaaggttttcgaacttatagacaggtactggcataagtttctctgttaattaagaaattcttgttatgttaattatttctactatgaatcatatctttaaactccatgtagggcttggcatcggttccgtcatttggtccgcggcaactggagagaaagacttaggcggaggttcaaatttcctgtgagtacacatgctctgcatttatatttctccgattcaaattaatacatacaactgtatattaattagatctcacgccgttaatttgtcatttatttgtagtgcacaaagcaaaagcagggaactaacttgtgcggctactacgtgtgtgagtattgccactgccttgcaaaccaaatcatcaccacaagagagctcgatgtacgtacaaataaattcaaaatttcattacgtaacgatttcttgtttaattactaatcaatttcatacattcgtatagtttattcgcatgagggataacctgaccacacacaaggaatttatcgcggcggttcaagaacaactcatgggattcatcaacgaagaaatccttgatcccaagggtgaattctactacgacggaaacacaattcaccggtccttagcttctgagctagcagcgagtactactacgtcgaaatcgtagctagctaggacatataatggattgtaattaatacatgactacatatgtttctatatgcatgtgtacacattttctataatgtaaatatattttggtcatatatatatctatatacatatgtatttgcataacatatatatgtataaatacatatatattatgcatgtatatacatataatataatataatatatatacatatatatatgtatgcatatatatgtattgaaacatatatatgcatggtttatatatatatatatatatatatataaaccatgcagcaacagggccatgcaaaaaaaaaaaggtcagctcgatgtttagtcccggttatttcacccgggactaaagatagcgatctttagtcccggattggtactcccggtttggaaaccgggactaaaagggggttacgaaccgggactacaaagggtttctccaccagtggatagaaaaaaaaatctgaatgcacttcattgcacaatgataaaaaaatatgttcacacatactccctctatcccataaagaagcaactcctagcttcctaatgcaaaattaaagaggtggagaaagggccaaaatatcccttattaatagcatattagtattggtggataagcaggtaataaggggtattgaaggaataaaatgtttgcgaaccaaggatggatgagaaggtagaagttgatttattttggaacaaaatttgaatctagaagttgatttattttgacacggagggagtatttagcggttctgatatccatgccgtacccacactcaaatagatattcatattcaaaattataatcccatcagatgcacattgacatagacagcgagtttaaagtcatacatattctgagtttaaagtcatacatattcttcacatattgacatggacatctcgacggtgtgggtttgcataagatatatattcatatatactttatccacttattattataattgcattcaaccaaaacagaatggatgcttttgaggatttagcacagtttcccatatctaaagcaccacaatgttcttcaaatatggcaaaaattagtggcgtatctaggatttaaagtgaaggtggttcatctatagacgggcatctataggtggcaaaaattagcagctggatgagttgtagcactggttctccacgggagtgtagcactggttaggactaaagcactaccgtgcactacctagtcacatccttaataatactggtcgctaacccgtgcgttgcatgggctatagttattaacaatataaatattaaaaatgtaatcctgtgatgaatatgttggtcatcaaattttcttgaaagttatacattttcaagttggagtctttaaaagtacataattatacattctttatactttcaattgtaaagaaacttatgatttaataatttcaaaatttgtaaataaaatatgaaattgtactcggtctagagccacggttatagattgttcatgattgaagtcccaattgtaacttttatgatttaataattatgaaaatagtaaataatatattttagttgtatggtttggagttcacataagtttcaacttactaattatgaatttaaaaaatgtaattaaattaacaaatttctaaattgggagtcaagaaaggtgaaactctgtgatcactatgatgtctgatttcagaattattaattttgtaaaaataaaactaaagagcccatgttactttttgtgacatattttaatttacacgaattcatatatatagatcgaatatcataggaatgcgaaccacctaatcaactgtggtaagatctttagcatcccagaagtgcacaattaatcttggttttaacacaaattctttgattgatcaatggtcatggtaatacgattgacctaataaactacagatcttttagttaacgtttatagtaaatgtgagtgctctctggggatacccataaataccaacattatttgcaaggggaatatttataccgaccttttattaataagtatcacgtctgttgggatttatgccatcccaaagtctgattatcctgaccttgactttggacgcttccttcgcattgtcaacatcttgaaccatgtcattggtaaaagaaaaggtaagctgcagactatatgatgtgtatacggacatacaaacaggaaatatggaaaattaaatattatatttgcttgtttatatttagatttagagaaaagtcatagataagggtctatgatttgtcaactgaacctgattaccggattactagcacggctcatcatgttaaagatcaacagctatttcattatttcagtcaaaatcagtaatcggtaatttcttaaatagctaggttgaaacatgtacgttcaacggacaccgaacagttcattaaatagagaaatgatcccccagtaattcatcacttaaaagtccagacaaatcatataaaagatcgagaaaatcttaaatagatcactaaggagatcacacagtagaatagttcgaccatacctatgtgaattgggaaacggcggcagatgtgctcgatttttggatcggcgtctggaactcctgaaatttcttgggttggatgatgatgtttcagatgagtctgaatcaaaatcgatgaaaaatcactgtccaaaacataaattagagaaaaaacctataaattctgaaacaacaatctctatttaaatcgatggtctattattttactccttggataaaaaacataaaaagtatgcatcactactacataattaatttttctgaccaaaccctcctttagattgcaagaaggctataactactgtactctgcaaaaatcgcttccctgtgatcggttcatgggcctattaagtgacccacatgcgaaattagctacttgcgagtttctctctcccacactggcatctctccctcttttctccccactccatttttttctcccactacccactcaatcctcccactccctctccccctctacctactcctctcatcgcatcattaaagaatcatcatagcaaaattccacagaggagaagcaatcaagattcagatatcatcacttctttcttgcttgcttgtacgtggtagctaggagcgtgggagattagtgaccatgcatgtctttgtataaatataatactccacttttgattaatgattggccgggtgactcagcttaattatatctatattaatttaatcctcctagttgactgcactagctaggaacttcattatggagtatcttttaataggatcataatcctagctaattatatatacaacacgtgtgttctaatctatctatctatctattatctatctattattattatatactaaaaatccattaaactttctacaaacgctcctaagccgagcgccatgtctgggtgtgtgtgagtgtgatgcattggagacaatacagggttatttaactctcctttgtcctttctaccgtgcgttcccagaaactgggtcattcaacgtccaagtccaagacattgactattggtcaacattgtgtgactccgtgagcaagtgcagggaaagcacaacaagcaacttgatgatgcttgatcatgaaatgattgcttgtattggtatattggaaaaccttgactatcagtcaacctgaggcaaacaacagtgatccttatcaactctactgttcccattccaaaggggaaaaaagggagacttttggtgcataaagcactaacgatacgacgtgttatatatgcaaatccaagttggcaattggtgaactcataccccattccacatatataatggttaaatttattgcaggcttttacttcgaataaaactattgcaggcaggcaggcatgcacttactgaaaataaattttgagtcatgtgactttcttcccattccgaagggggtgaaagacgaccttagtctttgtaagtttgttgtttggctggtgatgcacatacagcctgttcatttgtgcagtttccatataacttctctacttccaaagaaaagagaggacaaagaggtccttctttgggtacatccgagtgaactgagaaaagagaaaacattacatttgcataatttttttaaatacagatgcccccctaaaatatcaggtttctgtagttgttgggaaaaactttcatcaactgcattttttggtgcagaagtgctatatctgggacagggcagagaaagatctggtgctagatacagggtcccactgcagctaataacacaagggaacccagaaactctatcagatgaagaaatcacaaccatccaactctgttagcggagcacatcaatcacaatcattcaactagtacaaaacttcaggaaagaagagcagacagtggccattaaaagaacacacgtttttttttctgatatgtcaggagatcatttcacagtacgccagatggcaaacgaatcgtgttgtgcacaaacaaatcttttgtgtacataggcaagggcaatcgatcactacaggttcactacgcagcatcctgaaccgtttctccaatttcattgctttctttttctatattacaggtaacatgtacagaaaccttgcaaatttgcaagtaatggtcatgtagaagtaagtaaaaataatttgattggtcaagacctgacagtgcagtcggttaaacttgcaagaattttattttcaggtatagcatcattagagaatcatcatagcaaaattccacagaggagaagcaatcaagattcagatatcatcacttcggaaaaaaaaaggaaaaaaagaaaatacctgctaccttcgcgcggttgtgaagggggaatcagtgcgagagagaaggatgtttttactgtacgtgggattttcttatataagtcatacaaaggaaattaaggttttgactacaaaatgattagttggatgtcatgcatgcaacttgtgaaaggctgaaaactaagagtgttgatataagaacttactccctcctttttatattataagtcatttgactttttattagtgaagcttttttaagtttgatcaagtttgtagtaaaatatagtaatattttaaatataaaacaaacattatatcaaaatatattcaatgttaaatttaataaaactaatttagtgtcatatatgttgctaattttttctataaatttgagcaaacctaaagaatttttacagaggaaaaagtcaaacgacttataatatgaaacagagtgagtattacataaattaaaggagatttgtgtccttaattaagttaacacctatgtagaagtactaagccacaggaataacctcaatttgtctcatatcagatgttcaagttagatgttaccactgctagagaaacgatcttttattgtagtccccaaaatacaaatatctcaactagattaaaaacggccggtactaaagccttagtaccgattgtaaaagtccaaatccctagaaacatctttcgttccggttggtgttatcaaccggtattggctggtagcaccaaacaagactaaagctagaagattttaagtccggattggtgttaccaaccggtactataatgcctcttgggttagttaaaaagaaagcatctctatccaagttagatgtgtgtaataagtgggatggtaacacacgtgagggctgaggtgagaaatcttgagcttgaatcccacatcccacatattttttatttagtatgtatctttattaccggttctttaaccgatactaaagatcgagatctttagtctcgatttactggcctcgattgctacaaccggtaataaagctggggttgtgaactctctagcctctcaacgtgatcttgattaattagaaaaatactttcgatcgggtgcccgattgaggccacaagacagtgcatgcatgcatcaggtgatccagtatgaccgtgccaatgatattaaagtcgtccccttagcctccccaagaaagctaagtcacttatacgaagaggatcgatgctaatattattagcgtcgaagacctatttgtaatttatttttgaaaacaacctattcctaattcatataggacatctcagatcttcgaatactgtactcccaagatttggctgtctttgatctttgggggacaaagctagtagatggtgtggaagtagttactaaatgtctaaatctgaagcacgcagagcatctctatcgtggctaatgacatcaatatatataatactcccttcgttccaaattgatctacatatttcataggtacaccaagaccaagaaaaactaataactctctcatactatatttactatatcaacaaactcaatgcatgcaccatccccactatttcctagtcaatagcaaatcaagatattgcatgtgggttgtaaatacttgtgtgcatggatgcatgcaccaatgtccatttactccaatgcacaaataacgaatagacctaatgaatgtagatcatttaggaataacctaaaaaaactatatgtagatcaatttggaatggagggagtactaataagttgacaaagaactggtttagttgaggcctaaattggtcttaccaatatttggcaattttaatagtatttaggtactatttagtttgaagctaaattttggcatgcctaaaaaagtatgctatttcaatagttaacttaagctattttggtttcaatccaaacacacatttgccttgccaaaattagccatgccaaaacatactaaaatttgacattaacaaaaattagtaaggctaatttagatcacaaaccaaaccagcccagaattaaatgcgtcctgttgattgagatgttaattaatttactttgcacttatatgcatgttcgaggctcctccttcctgggccagaagatttcggcccgttggcccaaatctgttgtccattacccccgggcggcccaagtcaggtccaggagctgttgcatgagctatcactatagttaaaattatgatattttctcccgttcattaaaaagtacctcaagatacctgtatcttatggtaccaaatcattttcggtcgttggatctagctgggcaagatgggcattgctaaatccaacgatcgaaaataattttgtatcgtgaagtgctggtatctcgaagtactttttattgaattggagcaaatctctagaattattgttgcaagagaagtacgtacgtagtaaatgtatacattgataaagagtgtaagaccaaaattctgttggcatggacctaaatttgtacgcaagatcaacagctataattaatttaatctcatatatttcaggagtactgcagcatgcacgcacctcgaaaccttaaatcatgttgcattacatatattcatgatatcacaaccgaattgttcaaagtaatagtagcttacagcgcgaaaggtacaacattatatatgtagatcacaccacaagcgcatatagaaaatatgtaacgtaataatcttacctactgatagccttaaccaaaccaaagtatacttcatatctgttgagagattgaggagaaactaatgacgaggtaaaacgaaatgatcattgacgaaacaaacgatatatcgatcgaaagctttaattctacatgcgttcgttgaccatcgtcgtcgttgtggttatcaagctaggtcacgttcaggcttgcactcaactgcttgagctcctccagcgcctccgccatggtcggcctctcgtcaatatcctccataaggcaccgaatcgcaatgttggccatcctgtcgaggcattccatgtagcgaggccgcagagcatcatcggttgatgacaacatgttctggtcgtacatgttccttctcgcgtagtcgtccttgtaatacttggcaaagtttaacgggaggctttctctgtcgtcgtccaaggctttcttccgggtgatgagttccaggagcaccactccaaaactgtacacgtcgctcttctccgtgaaacggcctgtcttgatgtaggcaggatcgatgtagctcatgtcagccatcacggaccagttatcagacttggcgactgacatgagcttggacgatccaaagtcagagaccttgggctctagattgttgccaagaagaatattgccggacttgacgtccccatggacgacgcttttgtggccaatgttagagtgcatgcatgctaaagcttcggcgcagccaacggcgatgtcgaggcgagttggtagcgggagatgcgtatgccgaccatcgccatggagcttttcgtagaggctacccttggggatgagctccagaaccagcatgggcacatccgtatgcaggcagcacccgactagacggaccagattctcatgctggatccgagcctggctcgttatctcatccgcgaaatcctgtttgttaagctcatggccgtttctgacaaagcgcttcacagcaacctgctggttgtcctgggtgatccccttgtaaaccttaccaaagtagcctttcccaatcattcttttctcacagtagttttttgtcatcttcttcagctcctcttcgctgaagattttgatgtccatcatcttgttcagtatgttgccaccatttttgtcaaatgatctatttcgctgccgcctcctatgctccttgagaatgtacagcaccacgaatgccagaatacctccggcgacagcagttgctggcaagtaacaaattaaataattaaatgaaccaaatcagtacttcttcaagtaaaatacatgcatgtgacatttttgatatgatcctactatacttttgaaacttcgactatcaattaatctgttaaataaaaaaaatgttattttaaacttttctaggtcaacaaggtactactttgaatactcaatcaaaaattctcgtttatatggattaaaaaattttatacaagtgtgctattgtaaaagcattcgtaatgacagactttaatatatactttttaatatatatgagacctgtactttaaaacaataactatagtcaaaatcaaattgttgtgattgcatggatcacatatcaatattaaacattatttcggcagaggtagtaatatttgaaatataaacgacgacatgtgtacatttgttttaaaaaaaatactttcacaatgccgtaactaaacttattagattttatgtaattgtgaacgacttgttgatagagagcatgcgagtacaataatatagtcaagctccaaaaattattacatcatctacagccgaccaaatagcctggtcatacaacagctagctgtgtgtctatctatacacacacactacatcattaatatttggctcatctctctttacatagtttatttgagctcgtgctttatttagctggctataaatctatagcttgtttttcttctctctcctctcctctcccctctactccacataagcacaaatgcgatacgataactcataaagcccgattacatcgtattattataattgctctcaaaagtgtataagtttgttgtataagccagagtattttatatttatattcattactttattaaacttgtgaaacctcgacaatcaattaagcccgctcaaatgttgttttcaacttttcgggtcaagaaggtactacattacatctgaattatattttctttatacggtttgcctccccccaccccaccccacccccacaacccctcttcacctcaaaaaataagtctctgatttttggtttgtcccttacatccccaatattccattagttgatggtttaatttcttaaaatgatctattttgcctctatgcataaaacaaacatggaaatttatggacttattgtcaaagcaagtacaataatataatcaactgctagcttaaaaaattatcaaatcatctataaccgaccaaacactactaaaaaaccctcataaggaccggtcttataggtgctggttcatttaaaaccagcacctatgagccttttcccacctccgcacgatgaaaaaatatagaaccgacacctttaagcactataggtatcaggtctattaaaaaaccgacacctatactataggtgccgagtttttttaatagaactgacatctatacttatattttaggtgtcggttctagagaaaaaaccgtcacatatagtataggtgttagtttttttacagaaccgacacctattaaaaaaacctcatccttatctttttgaccacccacagctagcgcccccttatcttataccacatcccacatcgctccttatatatatctctctctctcttccctcctctccctttgccttcctttctctagtggatcggcgacagctgacggaggagcggtgacggctgacggagaacgcggcggcggccctctcccagcccaggggccctccccccttctctcgtcctccagggacggcacagcggtggagaaggccgtccggcgtgggcaaggtaacagcacggcggtggagaaggccggccagcgcaggtgaggtggcggccaccacggaggccagcgcgacgaggtggaggctatggcggtggtggtggaggaggcttggatctcgccggccctctctctcccacgggacctccctccttcccttctcctctagcacagcgtgggttggtggccggcgcgacgaggtggcggcacggtcgtcggatctcgtcggccccctctctcccgagggacctcccccatcttccagcgcagtgttgggtggcgggcaccggcgcggaggccggcctagcgaggtcgcggtgtggaggtcagcgtggcttttttattattttaatagtataggtgtcggttctgaaatcggcacctatacgattggggtaaaggtgtcaaccaatagatgcctactgggaaaccaacacctatggggttttctgtggttgtgaaatagctcggtcatacaatagttagctgtagatatacatactacatcgttaatatttagcccatctctctttcacatagtttattggaacttgtgttgtagctggctataaatttgtaacctgtttttcttctctcttctctcctctctactcgacataagtacaaatgtgataaggcaacttataaagcccacttacatcgtcttattatattcgctcttagaagtgtgtatagtaagtttattgtataagctggactgttacatatttatattcatgcatgactttattgtacaagtattatttgtggaaaagtttatttttacaaaaaaatatttattttatttatttattaaatgaatatgtgtagaatactttttatggtagttcaatatatttgtccctgttgtatatattatataaaaggaattgctacccaaaactatgtcatttcaaaatttcacctcaaatatcacaaaatagtcaaacatcatcttcttttctgtttgaggatattaatcgggggaataatacttaggacttaattagtgcgtggcatgttatatatgaatgcatagaattgaaagcacggaagaaacgaggatccacagcactttaagaagtggaaataaagaaaaaaaaatgctgacctattgttgcgactacggtcgctggaagtatgggtttgcatcccttgtcgattttaccatcccctctatgtggaaatcggcacttgcacttgtaaccaccctctgtgtcatagcatctgctaccaccgtaacagggatacttggtaggctcttctctcctaagctcgcactcattaatatctgcacacaatggttgcgtataatatgtatatcaattagaaaactggcaagcttgtaaatgatgatgccaaatcaataacaagaagtactactacgtacagccgtcccatatgaattgtaattatagattgtttagcatatattaaagtttgagaagaaagactactacgatgtcccttatcaaatggtgtataggtaagagtggaatggtaattgagggtaaaatggtaagaaatttgaatgaaaagtgggaccattagtactatattgtgataattattttggaacaaattcaactagaaatgtaattattataggacagaggtaatagctagctagctatatgcatgccataaaaaactgatatgatatttaattaattccaaatttcagaatgattaaatcgtgaaaatcttatattccaaggtgaattaagatttatactgcctatggtccaaattataaggtctataaattttttacacagtttttaatgatatactttgtacattagtttatttaatattatgttatcaacaactataaatttaatatcacataaaagtattttaaaatttaaatctagtgatttaacatgcataatacttataatagatattgttagtataactattagttgaaagttaccgagtttgattttcataaaaataaaaataaggatgccctatgaattttttttcaaatcattaattatcaattattcatcgaatacatgtaacactacgagcaaagtgcagattaacaactactcccttcatttcaaacgataagtcgttttaactttttttcgttgtcaaatttttctaaatttaattaagtttatagaaaaatatgacaacattacgaacacaaaacaaacatattatcataatatattcgatgttatatttagtgaaactaatttagtgacatagatgttaaaattttctataaatttacttacacttgaagaaagtttaactatgagaaaaagcaaaacgatttataatataaaatataattaagtgtaagaacaaacttatgcatccgccggtgacatagggattgccggcgtatcccgtggagcagttgcataggtagccatccccgttggtagcgtttacgcagtagctgtgggcgctgacacaagcaggagcccctgttgctgatgagcacgatccatttcttctgatggcccagtcaagcactgttgagacacgtctttctccagtactgttgacgaagctcttgctgccggaacgactaaaatcttgccggctgaaattgtacctaaatcatgtcgatcatatatatgcatatgcatcagtaaaactcagtggatgaaaacaatcaagaatttaattggacaacataagtatggtgtatatatatatatatatatatatatatatatattggtatacgtaccagccttgctcggccacgaaggcgtagctacaggggctgtctttccaagctgggttaacgatgctttcgcccaaggaaatatttaagatgccaaggttgggcgggatggaaggcacgtggcagcaacccagccccgtgcagggctcaccgtcgtgggcggcctcatccaagctcgcgcacgtcgtgatgcagccggtcaagtagctcgcatcgtccctgcccaatagaaacgcaatcgtaccacagccgatggccgtgaactcgttcctgctccgcgcaaacaggaacggcgtaccgaggtaggcccacgaggaggcgtttccttcgtactcggtggtattgtccgaagtgaagcagtcggacacgacgggagtgtacacgcgcatctcccccttctccagcgagatgtccttgatctctacgttgcccgtgtacggcctgggaggggtaaagctatggttgcatgagaggtcgaagcccggccaggcgcagtcgacgccgatgccgaaagggaaggggatgcgcacgtcgccgcacttcctaccgcagttcgccgccgtcgacgtacccaccagcacggaaagtactaaaactgctaggagatcatcataccacagcatcactccttgtgccatggctggccagtagctagctaggtgttgctaatttattaattaaaccccgcacgtacgaggtacgactacacggcttccactggctagaatatatgtgcgatatttgcacttgccatgcatctctttatatactgctactgtacgttggttgttgatgggtgactagccacactataagccagctataaacacatattaaacatattaagaagattaaagaggtgagattagaatagcaacgagctacagatttctgtagtattaatagtgtagtatatgtacatatgatatgaattggctattaaatcgactgtagatggtttggagctaatagttggctatactattaaacttgctctctaacacctatcaactccatcccaagatattggatgcctaccaatttttcaattttccgttaaaataatattatttctaaaaaaattcgtatattggacatggttattaagaaaataattagaattaaatgaagcgaggttgtggttagttgagaagtggaaattgatgggtaaattgaatggttataaggattttgattagttgggaagataatgttagtgtagtagttgttatatctctatctctgctattataaaaattgaagatgtttttgccggtattttggtaaatcattcgtgtttgagtcggttttcaagttcgttcgtttttggcaatacagacatgtgtttgagttggattttaagctcgtttgcttttaaaattacaaaaggaatcatataagagatctctttaaaaaaaactcatatgctaagttcaaatgaaagtcgaactcttaaatgcagctcattattttctaaaaagaaatatccaagtgaatttccacagtgaattttatcctatctaaaccgtataacaataataggattaaaatagcattcacctgttggaacgtacgggcattttttctagttttaagataaattatgagtgtgagaactaaattgttaaattttggaatgtagcaagaatctcgtattttcatcctatacagaacttcgaaggagtattgaaaacaaaacaagtgtttatattctctcccattgtattgtacatacaactgttggtttataatccatctactacctccgttccaaaatatagtaacttttagctatgaatctggacacacagttatccagatttaaagctaaaaatgattatattttgggacggatggagtaagaaacatgaataactcagtctataattgttgtctatatatataacatagccaaattgttactatctccgttccacaattcttacgtttccaaaacaaggtttggttaaacaactaaggacatttttaatttcaggggtgaaaagtttttacgtgccacattgaatatacagacacacatttgaagtattaaatatagtcaaataacaaaacaaattacatattccgcatgtaaactgtgagacgattttattaaacctaattaatccgtcattagcaaatgtttactgtagcaccacattgtcaaatcatggcacaattaggcttaaaagattcgtctcacaatttacacacaatctgtgcaattggtttttttgtctacatttaatactctatatatgtgaccaaacattcgatgtgacagcgtgaaaagtttttacgtgggaactaaacagggccaaaaactgtctatcaatatctatctatctatctatctatctattatatactaaaagtccatgaaacttcctacaaacgctctcaagccgccacgtggcgttctaataaaatagagaaaatcctagaaattctacgaaaaaaacaaaacatccgaccattgattttcatttaaattggtggacccattattttacaccattagatttatctcaagaaaaaaacaaccaaatccacctctttccatcgttagattagatctattgagactcacggtcaagcacacctcgcctctttccgtgcatgcgacgcactgtacgcacacttcctctcctctcttttgctgcccctcccctcctattctcttttctatttgtaagcaatcattttttttatcaagaaatcaacagttcgatgtgttcaaaataattactatagttttaatttattttgtaagcaaactatcagatcaagaaaatcctccgtcgatatatggagcagttctacccactgttgtaacaatataagtaaatttcttgaagcttttggaaaataaattaattaattttaggcatttgggttatcaggtggtttttaagagagcgtgccctacctcttcctacgtatgtgcctccctactcttacactctaataagtcttaatttatacaattaaaaactcagttttgaatatattttaaatcataaaaatataattttgcgggaacattatattatattatacactaaaagtatattaaactcccaacaaacgttctcaaacattcacgtgacacagtggcttagataggatttagagtaaaggcggtccatctatatgtaataggtcaattaaaagggtggtccactatataatttttattatattaactagcacatatactatagttttaatcttgatcaatcttttaggtggtccatggcctacagtgccaccttgctagctacgcctctgacatgacgttctacagacgcttctaggatgtcatgtggcgctttaataaatttaaaaataaatcatgaaaattctaattaaaaagaaaaaaaattctaaacattgattttctttaaataggtggacccaataattttaatcttaaaaataaatccggtaaacccaccttcacccccaccgtatgtgatcacgcatgtaagtactcctccatcctcctactctcctctaggatcccactctcctctctattttctagctaactttcctattttctagctaacacaaaatatataaaaaaaacaatagctaaatgatcatgactctcaagttacatatacttttctcaatctatttgctttcttgtgttattgtataattaaatacataatccaagatctatattgcccatatttactatataaaagttagataatttggtcgatctaactacaaatatttgagtaaaatagcactttgaaaatgatggatgaattcaaatatgtacgtctaaagtccaggttcaataaccaccaaggagcttggaaccataatacatactctgaacccgatggacaccgacggcagcagtagcattgacttccacaagttcctaaccctaatagcgtgctaaaggacaaatactgataggaggggcagagggagatgttccgcttcttcagcaaggagtagaaaattacttcatctctaacgccaagccccgccatgtcatgtccaatgtatcaggagaggctcactaatgaggaggtcgacgagatgatccatgagaccgatggtagcaagcggatcaactataacgagttcataagtgaattcataaaaaaaataaaacaagcaatttgattaaaatatacattaaaccaaaaaaaacattaaaagtacaaaaaaacaacatgattccatgtagaatataaaatatcaagagttcgtatgaaagtatgagttataaatagataaaattgggaataataaaataagtatcaaaagaaaagtccaaacacaacacgatacgagattaagtacaatttaaaatccctgaaaagacaatttagactcgaaattagactcgatcactaaattcaaaatacattaaacatttttcaaagaacttttctatgttgattcacatgcataacgaattgcatatatacgaagcaattaaagaaagggttagcagggtgggaaaatacatttattatagtttgtcgatatttcttcagaaaaaagatacaatgaacactcaattaaaaatagaaaatgccttactttaatttcaatttattttttagaactattttcaaaacaaactaatatgcatgccgcgcgaatgcgtgggctatcttcctagtttttttaaaaaatattttgtttgagcacactaaaacatgataaataatttggccttaattaaatttttttaatagaattaaatatataattatattttatatattgtggactaaaattccgaacgttttgtatacataattaagagaataactgaacttgtgacagaagtaaatcgtctacacattcattacagctgaggattaaatgctgggtgaatttgtatggctgaaaatataaagactctgtaacatcaacgcgagtaaaagcttagccgaattagtccggtcattatattcttactgatgtaacctggccgtgtacatacggacattactcttgtaacattgtaacattggcttgttttgaagggcgacgatcgaaacggatgccatggctgagaaagagcattgccacgacgaggaagaattaattaagtttgtcaatagctggacgcgcattcacactttgcgatgtatatattgactgtgtggctcgtggatctatacaatggatacacacgttaaacgacaccttgaagaaaactcttgtgaaattaaactgaagctttcggatcagaatctgtactcgacaaacgccgtgtttagttccaaaatttttttaaaacttttaactttttcatcacatcaacacttttctacacacagaaacttccaacttttccgtcacatcgttccaatttaaagcaaacttccaatttcaacgtaaactaaacacacccaaaagctgagttttgggaggatctacagtatgtatacaaacacaagaagcacttttcaaatcaagctaaaacatgtttactatcatatactaaaaattttcatattaattagttagaaaaaaattcaagtagaaatacaattcaaaatatatgaaatttaaattaaagaaaattcatttagaatacaatatggattcattaaaatttcaaaataaaaatataataccatcactggatatctattgtagttgctgcgtagtttccgaaagctagcaagcacttgctatcaagcaacgaaacaaacagtggccacaccttgtccatctagacttgattagttgacatgtacatttccttggcttggagggcacacaaaacttatgggcaacgacacacttatgatgatagttgagtggacgtcaactcctgatagtagcaaaaccaaaagttgggcattgagtagtggtgggcgtatggatttactgattctccgtttccgttgactttttagcatatgtttgactgttcgtgttattcaaaaaattttgtgaaatatgtaaaactatatgtatacacgaaagtaaatttaacaatgaatcaaatgataggaaaataattaataattacttatttttttaataagacgaatggtcaaacatgtttaaaaaagtcaacggcgtcaaatatttacaaacagagggaataggtttgttttaaatgggtttatgaaaggtctgttttctattaaatgacaaccgaataatgtgtgatcactggtggagaaaccatctttcgtcggtcggccgatttccacaatagtcccggatgcaataaaaaccggggctaaagatgatctttagtcccggttcaaaagggtaacgggcatatttgatctttagtcccggtttgtgttaccaaccgggactaaagatcatctttagtcccggttcgaatgctgtcagggcctgtcaggcccccccgggatctttag

SEQ ID NO: 65314 - DNA, 2157 bp, Oryza sativa
gccgcatcatcctctcctcctccctctccgccgccatctccgctgccatctctgctgccatctccgccatctccgccgccgccggtcgtcctctccgccgctccgtccatcgacttccccgacctccccgaccccgacctccccgacgccgggatccccgaccaccgccgaccgcctcgaccccttcgccactgcctctccgccgccgccaccaggatccaggacgactacggcctgcgccgccgtctccaagtacgccgcttctccaagtatgccgccaccctcccccattcctcctttttttcgatggatgaattgcattgtttagatgaatgaaatgtgatttgttgtttcgattattggtgctgctgtatagatgaattaaatgtgatttgttgtctgtcgatgttttggatgaatgtaggggctagattttatatacatgattttggtgcagtgaatcttgaatgtggatttaagtgcaactgctgctgtctatgtttgcccttgctgtctatgtttgcccatgctgctgcctatggttgcaactgttagttaagtgcaacttgaatgtggatttaagtgccatttggagggggggtgactggcactgtgatgtttctgtttttcagagggcatggctagcaattcctgaggctagccaatatttagcatttatttttttctggaattaactcatcagtgacggttcggaagaaacatccgtcacaggtaacctcacctgtgacggactcgcaaacgtcggaccgtcacaggtgacccacctgtgacgggcctttactttcgggcccatcacaggtgggtcaccctgtgacggctactatataccggagatcatcacctctgacgggcctttatttaggggctcgtcagagatgagacacctgtgacgggtcctaacaagccctagtctagcttagaccaacacctctgacggccttctattaacttgcccgtcagaggtggatgtcaccactgacagccggccacccgtcaaaggtgactggacttaccagtgaccactgatcattgaccaagcccaaaaccgtcaaaggtgagggtttgggcccgtcacaggtgaccttgaccagtgtagtgtacgtaccttgcattgtcttgttaggtgaataagtaggtgttttttgttctcactgcactcggatcgatcatggagaccaaccggcagcgatcttcagtccgttggatgaagatggatggttgggattgggatcgcgcgaggaggcgcggatcgatgacgtggcatgaggccattttaccaatgaaaaaattcaaatcgaattttatcataataaatgaactcatgtgaaaaagttgtcaaaaataaagttgtagaactcattgagatctaccatttttattttggtcatttttccatccgagtttgattaaactataaaaaatttgaattttaaaatatatgaaattcaaataattttttgggtagtaaatgttttcaaatgaaaaaactatcaacaacaaagttgtaaaacgcatcaagatctacaacttttggtttggtcattttactatatgactttgtttcaacagtttgaatttgaatttcaaatgatgactacttcaaacaacattttcaactaataaatgatttcaactgaaaaagtcatcaataacaaagtggtataactcatcaaaatctataacttttattttggtcacttcttcatctaacaaagtgatttgtaacattgttcataaaatgtacatatctcttatatagttctataaactataagagatatatgtaaattttatgaaaatgttactatcacattgtcagataaagaactgaccaaaatataagttatagatcttgatgagttatacaactttattgttgatgactttttcagttgaaatcatttactacttcaaaatattatttaactgtcatgagttaaaatttaactcataggagtattttaactcattagtgaatctactgttggatggggagggaatggacggttaagattgagatcgcgggaggaggcgtggatcgatgacgtggcattaggcgcggatcggtgatttggcggttggcaggaattaccttggcggctatttcgaaccgccaagaatattattaccttggcg

SEQ ID NO: 65315 - DNA, 14938 bp, Oryza sativa
ccgccaataaaatcgtatggccgccaaggatattctgttttgcttggcggctagtttgaaccgctaagaaaatcttgtgactttagataagaaaatcaactggccaccaatataatcttggcggctgttttgtgaccgctaagaaaatcaactggccaccaagaatattccgctttcttgtagagactttagataagtggtaagattggaaaaagcagggcccaacagaaaaactacaaaactacagaagaagagtaattttatgatcctcgaggaggtaccacgaggtatcaaaaatttagtgtaaaatttggtacgtagtatttaggtaccaagaggtaccaaatcttctattatatactaaaagtccattaaacttcctaaaaacgctctcaaactgtcacgtagtttcctcaaaacgctcttatgtcatcacgtggcacatcgagggagttgagaactccctaggggcccgcacgtgcagcgcatgggttagttccataacgtgaactaacgaagattagttccatatataatcgtgtttggagacaagattcgaaattaagcaaaatctaatcacatatggcatgcaagattaggcacgtgcagcgcatggatttgtcatgaataaacgaagattagttccataattgtgtacacaaggcaatatttcaaatctatctcatagcaaaatttaaatcacatatgacaagattaatttcatgagtcaagattacatatacatacatatatacatatatacatatacacacaccggcttgcatacatatatgtacagctcgccagcaacaccttttaatcctccgcaacacacaattttggtggctacatcctcccatcctctacaacacgcaatttgaacacaggtgatctttgtaataagaggtctgcggcaccagcccagcagctgatgcccaatctaactaatcaagggaaatagagaggacatgaccagaagaggaagggatagagagagagagaccagggcggccacctgctgagctgggagataactcccaggaggatgttgaggtgaggacggaatataggagggggacatggatatggcgctgcaagctgcaacagtcattattaggccatgttcggttaatatctatgagagagggattggaggggatttgttccacacctattatggtatggaattattccccctcaatcccctctaatcttcttcaattcccctcctaaccgaacaaggcattagggagagggggtcggggaactacaaaagagtccagtactccaaagtaaagcgtgtggtgtaagatcattagccttagcttttggattgctatcatggacaaattaagttcatttaatgtagtataagcacaacacatgggttggccataagtgacacgtacaacatctccagacgttatcatcgttattactagccaatgtttttgatcaattcctcatggttttgtttcatgcgcgtgggatcaaggcaatgaaatcactaatggttaactgcagttttttcactaataaatgattatttcatctagatgtcttaataaattgtaattaacattcctgtgtttttctgtgcttcatctaaatatatgctcttttcaatcttttgttttacagacgctcctaataaatcaccagatgacacgctacaaacactctacattatcacatgatttaaatccgtgagcccattatcttagatcctttaaaactaaaccattcaattgctaaacttcttcgtgtacgtacaacggtgtataagaaaaaaaaaacttattcctaatctaatgcacgtgtacatatatacgacacaatttctatgtgtgtggaccttttgtattgacaattgttatgcataagaagtttttcaaccataaattttttcaccgagagacaaagtcataatataaaaaatcgtaataacaacaaaaaatgatattttaaataagaggcccgcgcaactgcgcgggctaccttactagtttactaaaaaaaagtagtgcctcgtgacacctctttaaggaccgtaaaattgctcctgtagtatacattgatctgtaagtccaaatttgtgagttttggtcgaaatatatatgattcatcaattcaaaattactaacttttcgtactctggttaatttctgtacagaaatatcttgatcgatctgtaccgtttctcttctcttcttcctatactggcctactgcatgtatatgcattcacgaactcgcaacttctgtgccacatgccacgtgatatgctggatggtagtatctgctgcgctacgatgcacgtacgcaacggctgaaccacctaatcgagcttttttttttataataaatcggtatttaggtgcgccaatttcattgagtatactgggagggaaaaactgtataggaagaagagcgttacaaaagaaaaagaaaaggaaactagaaagtattttctaaaaaaactaaggattgatatgtgcaaggcattttgcttctactagggcccaagttttggtctcctcctttattttcgtaatgagagatattgtcaagagctctatccatatctctcatattgtcagtagtagcatagtgcaaacacctttcctaggtatcctagggtaggttgccaacgctgtacaccaggtatgtgacgtacatggaataattgagagaaaaaaagtgagtaaaatggctcaaataaaagtttaaaaaattatcttgtttgttttgtgctaaagctaatttgagaaagagtgataaatgcaataggtatatatgtatagtgtttatttttcaacctatgtgcttgtgaatatattgcattataaatcatttgaaatcatgaatccttattgctaattcgagcttaattataatatctttgattcatgtttataatatagtgcatgtttgttaactagttaatgaatttatctctcttgtcttgcaatacatgatcatgaattgttttaggtacacttcaaagctctcgaaagaaatataaaatataaaatataaaatggttattccaagtggcgatcatgacatcattgcatatgtgcttcattggttattattctcttttgcattcttgatgaaatcattgttaaaggaggagaaatatacaaaatgcatgcttcttgaaagagggagaattgaattgtttcaattttaaaaatagtcgattttgtgctttgattgcaaattgatgggagaaattctttcttttaaaaagggggagagtttttctttttcacttttgagatttttgttttcatttttcaaaaacacaaaattgcattttgaagatgttgccaatgtgttcatcaagggggagaacgtgaaatcattatcatggttaatatttgtgatgaacaattggctatgcaaatgatttaatcaaagaattagtttgaaaagatgtgtggatgttagtgtgagtgcgtgtgactaatgtgggtcaggttgtgatatttgtgcccagaaatgtttgctttatctgattgtgtgcaggtgacttgaggtcagccttggtcaatggtgaggaccgggattatgttcagggaaaaacagaggtctagtgcggtcgggataccatgtgagaagatgactaaagtcaggattcttggaggtcaacttcggtcaacggtggggatcgggactagactcagggaggagttgagatccagacggtcaaggataccgggtgacgaagttggatacaagatggcatacggtggatgaatactgtatggatgagatcttcgcaatgggaagggttgaggctagaaggatatcgacttttgagagagaaaaattagggtttacttcgaggtttcaatcctagttcgtgagttgagaggggagtgttttaggtacactttgtaaacatatattgatgcaataaagttgatatactttcaagtgtttcgtcgatacgtgtttttctggatcctgacggttggaccggaggcaagtctgcagtctaaccactggcggtcacacccgcggcagggagacggttcaaccggcgacaaggcggcggttagaccggctgcgtgcgagtggttcgaccggcggcaatagaactacgtcgagatttccatcgatttgagggtaacttttattttcggtaaaagcttttggggttttggttttccttgccattcacccccctcctgataggcttggttattcgcgttcgatcctacaaactgcaacgaaccgagggagctaacgagatacaaggttttcacgagtcctatataattagctcggcttctagtctagtggcatttgatgaccctgtggttgacctgcgtggtgttcgtccccggtcggtacagcctcagcgggcacgtcgcgtccaccctcctcgtccggccggcgtgcaccggccggaacctcacctcgccggtgatcttcagctccagcgacgacacctcctcccccgcgcgcgcccatctccttcaccagctccgtcaacgccgcgccgccgagatgagccgccacgccctcgtcggtcacgccgaacctgtccgtctcggccgcctccaccctctgcccggcgtccgcgagatggacggcgtggaggagctcctccctggtggcgaggcggagctcggcggcgagcggccgggtgtactcggcgcggacggccatgttggggttgtgcacggcgacggtgagcgagatgccgtaggccaggtcggtgccgttggcgccggcgaggtcgaggcgtgtcagggacgcgtcctccaccgtgacgccgacgttgaagacgacgccgtacgagaggatcagcagcgcggcgaccagtaagagcaggagggtgcaacaggacgcgcacatcacgcagctccccggcccgcccgccattgttgcgatgacgccaagaaattacctacgtacctacgtgatcgatggatcgatccaccaatgagaacttcgccggaatcaccagcgtttatatatcggtggtagtgctgcttcttattatagttggccataaggcccgaggcccgaaggcccggcccacggcatgcctttttggcccggcccaagcacggcacggcccgacttgggttgggcccatgccggcccggcccgaccgtcgggccgtgcctgggcctccctaccagcacgctgggctggcctggcacggtcgggccggcccggcacgatgggctggcaggccagacccggtacacaaagtatagggactgaaaatagacatataaatgtcaatgtctaaagaataggaaccttaaatagacttattttagctatttatataccacagcacaaagaagagggaggtaaaatagactttttttagctatacaatgtcacagcccaataggagggagaaaatttagacttattctgaggaaaagcacgatggcccatcgtgtcttcgggccggcccggcacggcccgaagcgtgttgggccgtgcctgggctgtgagtgcggcacgtgggctggcacggcacggcccggtgcgtcggtcgggccgtgccggcccgacaagcctcggcctaggcacggccgggcctgggccgtgccatgccgggcggcccacatggccatctatacttcttagcttgatcgatgatcagattcggaccagaactgttttcttttccttttcgttttccttttcttttccaaattcgagtttttctttttcagttttgctaaaaaaaacaaaatttgtacaaacttatttaagtaaaatattttcaaatgtaaatttatatatagtactccctctgtcacattataagcgtagtaatgaatttacgtgtccaattttgatcgtctgtcttatttgaaaactttttgaaaataaccaaaataataagtcacgcataaagtagtcatgttttatcatctaataacaacaaaaatactaatcatgaaaaaaatttcaaataagacggataattaaaattggactcataaattcatggccgcgcttataatgggatggaggaagtattatagtattaattataatgcaactacactatataataattgtaactacagcgtagcgtaactgtatgatggctaaagccctgagcagcttgggccgaaccaacacattctggcacaacataagtgggccacatggagcttaatataatcccgtgcaggcccagcacaactagttgagacaagagagatcgtacgaccaccacctccgatcccctctcccgctctcactccatcttagcggtgctgggggggggagatatcgctaccacgaccactagtagaagcggtgatgatcgctaccacgctgattgaggattaggtgtgtatgtcgtagctcgaccacttgtagagatagtcggaggatcgtaatcacgctggtaaagaaccaggtatgtaatcatatctcgaccatttgtagaagtggtgggatcactatcacgctgatcgaggactaggtgtgtagtcgtacctcgaccactcttagagatgcttgagtcggttactaggtgtgcatcttatgtgatcagcatgacttcacatatattttttaaccaaattataagtatattggatgtccgttcacaatcatacaatcatgatggacaatcaagccgtaaacgatcgcgaggagattgttccgtgaaattacctacgtgaggaccgatggatcgatcaaccaatgcgaacttggccgaaatcaccagcatttatatatcggtgctagtgttgcatgcttagattggtcgatcgatgatccgactcggacaagaattggtttttctcctttttttttttgggagtttattaatgacaagaacttgatttatactagaaaaaatatccgtctatgcaacaagaaaaactaatgttataacaataattatagtttattttaaaaaagagaaaacatattcttcacttattggataacaacttacaaattcaaattgtttggcattttcatgtattcctaaactgtatggttgattcccactagccaacatgatttaaaccatcgaggttttggattttgtcaccctcttccgataggaaactatttctcctgattacttttagaatatttcacaaaaaaaatgaatttagaaaaagaatagatgtgaccaaattttgtttaagattttaaattaattcaaaccaaaattactgcaatttccaaaatatcgatcctatctgtgtctgagataggaataggcaaaccgatagcacgcacacaagcacacaacatcggtggtctcgtaacctaattctgtcttagctccttggatggagcatagccgatggacctacgtgtacgtgaactgatcacggtcaagtagtagtaaaaaaaaaaaaatcaaagtgagggagagacgaacatatgtgtgttctcttagcttttcacggttgcatgcaatgggccctccggtttgacagctctgagcttcgatgcgtcaatggtccatagaccatgtctatggcagcacgaaccattgcatccttaattccttatcgatctctccagtggcagagtgctccatattcacgaattcttttgagaatcaatattatccttatggaaaatcgcaaaagtaggggtcaacccggggaaaatcgcgacagtaggtccctggcgacgggtgcagttcgatagggcgcctatcgaacggccagagcgcgactggcgaggagatcggaaggctgccgttcgacaggacctgtcgaacagcccccgttcgacaggcagggctgtcgaactgcccctgttcgacaggatatccgtcgaactggcgcagttcgacagggtcgtgttctccatttattacgaacagcccccgttcgacaggcagagctgtcgaactgcccctgttcgataggatatccgccgaactggcgcagttcgacagggtcgcgttctccatttatttgtaataagttattttttttaataatatgtaatttattttagtgtgtaagaaaggaaaatatttttgtaatgttatatgtatatgatttagggttttgataatgtttggtcagaaattgtagtatttatttgttggttaaaatatttgaattatttagtttcattatttgtatatttgaatgataatttgtcatgattcattcgaagggtatgctactgagtaattatccgaagaagtttatgaaatagtactgatagtactaagttaatcgtaaagtgtttctcaaatagtacggacagaacataaatgactaaaagtttaatacaaatagataagtcaaggacgatcagtgcccttcgcacgcttgctaggtcctcccttcttcctacgcctaatctgctcagtgggatatgtcaaattatcaggggggtgcctatctctagctacctgctgtggtgtcacgtctggccctgaccggcctccgtctcctgcgtcggctgtgtgacctgaggtgctgcgtgccagtaatccatccctacttccccctggggaggatcagtggaaaagaagtcctcaatgaatgctgtgcgaggggagtaagcaggcattccgtgatgcgtcgacgccgaaccgtactcatcgtctgtttgcacaagagggagaaaccaaaaaatatggcgtagttagtaacgatacatataattagaaactaaagcgtgttattgtttaaaatgacttacatgtgtgctgtgtgtggccctgctctggcgcacgcggagtgatatgaagtccccatgctggtgtgttcaacacattgtcccccgttggcatgtaagggaagtgtgccgacccagatgctccctgcgaggggtgaacataaggcggagtttggaatacctgcggacgtggtggtgccgtgctcgacgtgggtacccctgatccggctgaccccctggtgtactccggtgctagggtgtgctgaaaggaaggacgaccgtgagatgtgtgggccgcttcgtacccgcgacgtgaagaggatggaccactccgatccacgctggaatgtcagggtagtggtggtgatggccgtcagcccgacgtctgcaccacatctgccgcgctccgacaggagacacgacgtagtagtgcggcacggaagttgcgaaggatgctcgccacgtcgtcaggcctgacgactggaggtctcgcctctcttctttgcagcagggtgtcggactccacgtgaacgtgctcaacaaattccgcctgttccacaaataatcaaggcaattaaaattatttaaccagttgcacatttattaagagtatttaacaagatgcatatttgttagaaataatgaaccagttgcacatcatttataaatactgaactagttccacatttatgtaagaaaaggaactagttgaaccaattgcacatttattagacatactgaactacttgctaactttttaaaaatattgaactagttgcttaaattccacaaataaacacataccattgagttgtaagctgatctaggctgaggggtaaaagtgtcagtaatcgctgcctggtgggggacggtgctatctccttgtggaggaaaacacctccatcgtgtaacactgcggtactaatgaaggtaagctccataataactcccatcgtctggaggtgtctgaagtgccaagttatcagctgcgtgctcccactcttgtaccgtcagctgaactgtggtcacaataactagctcgtaggaaagcccgagcccctttctggagtacctgcacaacaataaattcacacatcagaaaaaatgttgtgcagtgatttattttaaaaaatgtaggattaaacaactgtgatgtgaactaacctatgaagactatcagccaaaggacgaccatctctcggagggaagtcctgatacatgcccaactgtttgagaaccctgtggacattgtgtggctcgacgtgcacgttcaccatgaggtgacaagtcgtcatccagagttgcatatctcgcgtgcaaagatccgcgagaccgtgcggtgcacgatcattgacatcgtgctgagtgtagggagtccaccgaacacggtcaggcgtaagctgatcaaagtcagctacaaactgagtgtagacacgacgtgtcgtcccgctaacccactacggctgtaacaagtagtagttttcattagtcatataaggaaagtttgtgaactagtattcataatgataacatcaacgaatttaacgaaaaatacctcacggtgtgtccacaaggatcccatagtgggacgatcgtcgatgtcatcaacaccagacctatacatctctcgcaaactgtagtttgcgtacgagtcaagctgaggcctaccaatgtcgaagcgctcgtgcgcccacaacataagtagcaatgggcatccagggagtgaactttgcttgctgttcctcacgcaagcatcacacagtccggcatatgtcgccgcaagtaccgccgacccccaactgtactgtggaatctccgcgataggtaactctgcaatctgctccgcaaagtggatgaagtgcttgtccacggagtcagcgtgagttcccgtgaacatcacccatccaaacaaccacaacaggtaagcgactaagtgccgctgcacgatccactcctcctggtcatcagggaagacatcctgtcgaaactgattcaaccaacttttcgtaggaccgtgcccatctgtgagatcctccagtgcaacaggcagcacaccaccaaaactggccagaaggtcatccgcccatccagcattcaccattgttgggccaactgctggcccagctatcggcagccccaacaaataagacacatcctgcagagtgggcaccatctctccaactgtgaggtggaaagtgtgggtctcaggcctccatctatccacaagagcactcagaagcgccgcgtcaatgtagattcgttcggaccttgcacgtgaaggctcgaccaaccgtgcaaacgtcaacaacccagctgctctcagcctacaacatgacagggcacaagttattaatacatgaaaatataaacaccttgtattagaaaaaacaatatattttcacacaccttgaaacccaacgaggatcaatacgccaatattgatccggtccttgcatctttagcacattgcagaaagttcctgtactaagacgtcgcgatcgatggttcctatcgatctccttgtctatcagctgcccatcatattgatcagccatacctgcggatcgaaaaccatattagtacaatgcacgtatggtaacagtacagtaaatgtatgcaacataattcaagtaacaaatttgcatgccatttcaatttaaaattacagtaccagcacacatagatacagataagaacagttcagtacatttcaatttaaaattacaagcccacgacacatatattatgatattacaagtgcagtgcagttcgaaatttaaattacaattccaatacaaatacatgacgatattaaaagtgcagtgcagttcaaaatgaaaattacaaggccattacaaatagattcgggtaataaaagtgcaagaaagttcaaattaaaattacagatgcactaaacataaattgaacgataacgatcttcaaagtagggagtccaccaaggataatagcgaactaaggattatttttcttcttcgacttcccctttggaacgcgacgaacatcagcgcctgtggcatcttgccctacattgtacatgttgcaatctttacgggaatggttctccccgcaaagaatgcaagctttcttacgacgagaacgatctttcacttcagcttcatccataaggttcttgatcctgcgcgactggcgacgacccttagtatcaactaataaatttgagtcaggaacccaattggcttgccctggaggaggacgagtgaaatcgcacacggcacgccaaccacgcaattcaccacgccaagttgcctcccacgattcctttctaaagtagggagaaacaaaaatgtttccatcaacacccccttttgcggaagcagcaagaacatgggaacatggccgatgtaacaggtaaggcttgttgcaattgcatttgcaagcgtgatactctggccacaacgtgcattccaatgtgatgtcagtagtcccaatgccgacaccactcttgtcacgaagtcgtatctcaaataacaactctctattcccagcaggccacactctgtggattcctcccttcttacttttctcatccatgtactgtgtaatagcggggctatacttaacactgggtttgctgaggttcagactagccatggaataccttttacagagatacttctgtgtacccctcgtgatgccctctaggatagcaacaagtggtagaggtcgtgtattcttcataacccagttatacacttcagcaagatttgttgtcatcacaccatacctcgatccatctgtatcgtacaacaacgaccatttctcccttggctcaaattctacccactccgtgaagcacttcgtggcccttccacgcttcctgcgccgagtaatacttggtgcttcattaggaatgggttcaagttcctccggctcctcctgtctggcaactataggttttttcctaacctcttccatgtgtgtagtggtcaaacgatccagttgatcccatatggcatcaaactttctttgttgattctgcttgcataacttcttgaacaggtccatcaatctcttactcctgaattgtctataaaaattagccccaaaatgtcgcatgcaccatctgctatataaatctggccatggcacggactgtgtgacatcttcttgaagcttctgtatcgctgatagcaaaccggcgtgtcggtcatgcagaacacacacatttggtctgttttcaacaacacacattttaatgtgccgcaaaaaccatagccagcttgatgtgttctcgctttcaacaaatgcaaaaacaacaggaacgacatggctatccgcgtcgactccgatcgcggttagaattgttcctctgtacttgcctgtcatgaaagtgccatcaacacagagcaaaggaatgcaatttctaaaggcctctatcatgcacccaaatgaccagaaagcccgacgaagaacattctccccatattcattcacctcatcgagaatagccatgtgtgtgcccgggtttcttgcctgcatcacctccaatagtgggggaagattgtgataagaatcctcataagttccaaacctcatctccaatgctttctgttttgccctctgtcacgccccgaactagtcccgaccggaactagcccgtgacgctccaaattaacctgttaatcgataccagtcccaggaaacagtgctggtatcacagggagatagaatatcacagcaacagaggtctctttattatagagtagaggtacagtcatgttgggctgcggacagatcccgagctcacaactgcattacaaaagggaaacggaagcaggacatggaccaaacaacacaggcgtgacttgggaactaggcagaaaccctaaaactcatcgtagccggcttgctcctgaaagaactccgcatcagcaggatccgcttcatcttcttcagcaactggggggagaattatttatatagagcaagggtgagtacgggagtactcagcaagccatgggaattaagtgtttaatgcaggcttcaaagaaaggctgatgtttttgcaattgattttatttgaactcttttctaaaaacaactaagtgagtgcttctcaaacgacacggatgagacagtgcgtctcgtccggtcggagtttgtgcaatgtatcagtctttaggattgaagcaaggttggcacccggccaacagcttttcaaacggccacccgggcctagctgatcccatcagctgcagatttttttcaaacatcgaaccccttttcacaacagcaatttcacaatcagtagtcaaacaaaactacgctaggaatcacctcacatccgcccatgaccgtgggcacggctgttcgaacaatttgttaacctctgcagagggggtacactttacccacacgacattactaacccggatcacccagcccgtggggatcagccacgtcgggagacctccaagctttcatgacaaggcatttccaagccgacacaggtttaccatatgccgacgagaggggtcccagaccaacaacaggttaggtcccagaccatactgtgccaggaagcccaggggtcctccccgacaccaccccgacgaatccacatgtctctcggcatcaaggctcccctgataagctagttactcagccaggggtgtcccattccacccatgtggtcgtacttgtcttatgtttggatgaaattccaaggaatcggtccttaagtgcgagagcgggaaaccgtacacccggtacgtcccccggtccgcggttttggaaattcatttagttcgcaagcaccgacccaggtgtcgggttttccaagtcttttgtaaacccaagttttacccaagttgttattcagatttaagtttgaaggcgtccgtcgatactcgcacagggtgcacgaatattgagacgcaactaggtggttacaaggggacatgatgtaacaattaacaagggaaggatcaaatgcaacaaattaggtaagtccgccaatctgccttgcagacgggacaaacagattaagtgcgatcctatcaatgcataatattttgcaagcaatataattaaatttcaaatataggctcaagatgttcaaaggtggcttgccttgctcgagatctggagcttgatcctcgaaatcctcgcactgcgggtcttcgggctccgaaactacacgcgaaacgggacaactcaacaaacggtgaaaataaagccctattaatgacctctaagcgtgccattagatagtctaaagatttgaggaattt

SEQ ID NO: 65316 - DNA, 8369 bp, Oryza sativa
cattttgaccgtagcacaggtaaaacaaaaacaacgggttggttgaaaatttatgtcaaatttacccttggcaatgatttggaaatagagaagaatacaataataggaaaacatacgaataaaatgccatgttggttggatttgtatgggatttcatgacacaaagaaagtttcaacaccgtagtttgattggcacataagaaaaatgcagaattacatgacactggaagaagaaaacatgaggtggaacctcgtacttattttttctctaaaatttctctacaatagaaatttcaaaagaattggtagggatgtttttcataggattatttctcatagaattcttgtttttttttcctttgtttcaaaggggctgagaaaataaagtgaatatggggaaaggcttgaatccacaatacaagtatctagagtaggggtaaactactaatgaatggtgttgacgtattttaaaacaaatgatttgattgaaattgacaattattctaaatggagggagtattttcttctctcaaaacatagtttctaacatattttcctaattagtgggaagaagatgcgtacgcatactacactcacacctgagaatgcactctctaagagacgaacagcatgtgtgtaaatttttagtgatagcgtaaccgcgtgtgcgtaatattcctgagcatcgggatttaaacctaggggataaaaccttacaccatggattcgctaccacaccgtgtaatgctttcccttgagcccctgcatcttgattcacattgaaaataagaaactgccgtttaatccaaacagttgagttgtcaagtactccctccaatttcttttttaactaaaaacaaagggagtacaaaattttggtgggtgcatcattcataattttcttgaggaaatgtggacagtccattgaaaagaagagaaaacgggtaggcagtcacaagcaggaagctgatcagaactgttgcaagagcttattcttgcacatttgcaatcttcttgtttaaatttcagtacttctatattattcaaaaatcctagtcaatcagaactctcgagcctgaaaactcaaggtagtgcagtagtggaaagacctgctgctcctgatcgatacggttaattgatcaaatttaatttgtgctactgggacctgctggattttcagcataaatttctctttcaagaaccctagttgcatcttttgaaaaccggacttttctcgtaactcatttgagaatataaatgtttgcataaaaatcacgtgaagttccttcagatttcccagttccaattggtgttaagctcatttcacttcaggaaaaaaaaggcggttaagtgactatgatgcacaatgaagatatcacatttataatcaaatacaaaattgaacattattcatatgcaaagtgggtatatttgaaggagattaatgcaaacaattggaggcatttcaaataagcaaaatgggaaaaacaattctaagtccatgaggcaatctccttctactttctactccgtataaagcaaataacaaattcactactgtataatgattgaatgtttacaaattacaagttaggcaacttacaaacaaatatcagtgtgttctcaatgttggagacttggagtgagtttgaagtgttcagaaaaaagagggggccgaatgctacatgatccacctttccgttctgtatctatataaactagatgttccagtgctaccaaaatgttttgtgctgctgggaagatccccaacataataactactcgaaaacttgttctctatcctgatgggttccactttcttaacaggccgaggacccaaagaatttagatctatgagggaaccataatcttggcatgcctccattacagtgtcgtatgattttgcaggaagctcaagcccttggttgcaagccctcatgtacatctcataggcaagcctgggtttaccatcttgtacaagagcttcaatcaacatctgatatgtaatttcatttggctcaatgttctgcactttcatcctatggaaccattcaaaagcagagccacccttattgtttctcacgcatgcgctgattatcgcattgaacgtaacaacagttggttctatctttgctgacagcataccacgaagaacagaatctaccatagcatggttccccttgccaatgtaaattgatactaagattgtatatgcatgtaggttcggcttaacgcctaccttgcacatgtgttcccaaactcggagtgcctcatcatacagctttcccttctcaagcgcactcagcagcgctccgtaagaaactacatccggtgtcaacccttgatctatcattctcttaaatatatccactgcagcagatgtttcagctgctctagaacacgcaagaaggacggcattccactctctgcttccaggcttcaagcccttctgttgcatcttatcaagcagccttacaccccacctccaaatgccccttctctttgcagcattgagtagaatattgaaatgtgacatgatgagctcatacgacaagttattcggtttggggcctttgtccaacaaatcctcataaatctcaagagctgcccaccacttcttagccttgcccatcagccaaatcagatgattgcacacagataagctgatcacgccatcaccacgctcacggatcctttggtacagctccttggcaatggtgtaatgctcctcacctgtacatgcccacacaagccgctcgtaatctctcctgtctggcttcaccccagcttcatccatgccaagaagaactttcagcacctcacctactggattctcaccacccacaagagaccgccgcatcgccatatagcagacacggacagtcagcttctcaaacttgacaaattctcggtcccaatcttcatgattcaccgccaattcacccttgttgtacatctcccttagcttggtgatgaacttgagtgccgcgaatgcatcgccagccttcttgtaggccgacatcactgtcgagtatgtcgccgcggtgggcaccaggccactgccctcgatggtgtcaaacaccctgaagacctcatcaatcttgccttgttcgacatagattgacatcagagtgttgaatgtcacaatgtttgggggaaccccctgtgcctccatgtctgcaagcacatcgtggatcctcccaaattccccactgttcttgaccgcgcccagcaggcagttgtagacgaactggttgacgccgccgccgccgccgccactcccgcttcccctcttgaggtgctccacgacggcgaacgcggcgtcgaggcgcctctccttgcccagcccccggatcaccgaggtatacacctggagcggcaggtgctcctcgccgccgccaccgtcgtccaggaagcccttcaccagggtctccacttcgtcggccgtcctggcgtcccgcagcgccgcgccgaccgcggcgacatcgacgtcaccgcctcccctcgccctcctcccgccgccgccgccggtgccaccgtcagcaccgccgaccgcgaactgcggggtcctagaacggaacgcgtcacactcggaaagccgctcgtccatttcacggaggatacgagggttgagtacaggggttcgggagtacctcggcagcgaacctgcggcggggcgacgaaggctggtggtggagcgggaggtggaggtgcaggtgcggcgggcgcggggggtggtgacggcgagcggcggcggcggcggtggcggaggcggggtggaagacggcgaggggggaagccattggggcgctggtgtggccgctggaagagaaggtgggagggggaagggaggctatctgctgctgcggtggccacaagtttccgccgacttggcgtgcgcgctcctgcagtagacgacaaacgttggcttgtgttttgtggggtcaagttggatgtgcgtcaatgttggatggctatcggcacgcaccgtacgtggtgcgtctttgagcacagtcgtaatgtggaatttttgtccattttctatgttttattttatgagagcctggtatttgctctaggaaaatgcttgtttcttgttactcatatttttagcttctattttttgagttgtgaaaaggttgatttctcaagtataaaaatttggagtagataatactagtgcctatgtattatggaggggaacataaaatacagggcatgtttactttgacgccattttcaaccttactaaattttggcattgccaaaattttagcatagttttcaaaattttggcaacttaccaaaattttggcatgatttcttatatagttacaaaaatttagcggcaaactaaatgtagccacttttttttgacaactttaccaaaatttggtaaggttgaaaatggcattaaagtgaacaggcccacaatagactcgtataaattctgacaatcaacatccaccgcaaattagatccgtgcatgtaaaatctcttaatgacaagaagagctaacttcccacttgaatcacacattgatattacaagaaacatgacaaagggatgacttctaatagtttgataagttgagggataggtttttacaagttcaaaaatagagataaggtaatcaaactatgtcaagagttaacatataagaataggcattatcctttgaaataaaatcatcataaaactattatggaatttgtgcgcttagtagagatttgccgtatatccacaattgtctgcatgcgggattttagcatacagtattttctatccacttttattatattgcatggtaggagcaatttaaatactatttagaaattttaaaaaaaaacatcactttctttcttagatttatttttactggtgtgaagacactgaaaactatgcgagtgatttctaggtcattctcctatgcactccatgatttagggggaaatatcctccaaatttgtccaaagtagtactccctccatttcacattatgacattataagtcatttttgactttttttcttagtcaatttttaaaaatttgaccaaatttatgtaaaaaaattagcaacatctaaaataccaaagttggtttttattaaaactaacatttgatatattttaataatgtatttgttttatgttgaaaatttcgctatatttttctataaacttagtcaaacttcaaaaaattgattagaaaaaaatagtcaaagcgacttataatttggagtataattttaatttaccccaaattaaaaacaataccatgcctaaaatggctacacaaacataatcactcccccctggcccccaattgcacctagtattgacaaactagcactaactcccgccatattaacgttgctgtgcctcactccaattcccctctcctatatcaaaaggagagattaatctatagttgaataaggtcggcatgaaaaaaaaatataaacaagaaataaaagtgctactttgatgaaccctcacatgtgcaaaatctttcctcagcacaatggtttaggagaattgccgaagttgataaatttactaccacatctttcctcgaagcttatattatgcatgaaacattgccagggataacatgatgtttcattcaatcttttatatattttttttgtcaattgtcatatttaatttgctgggtatttcttagagtgggtcaagaagtacccacagatgaggacacaccacctatgtgtgcaaagtacttaaaatgcccaagcaagacaaccttagacggttttattgatgatacgagtataacaatgccaaatgtagccttttgcggattaacttcacgagtaactccatttaagtaataaaaaagagagacttgaaatatcattgaccggagaaggtgtgacttgaaactaatgcatgaattgccatatctagaatatttaaagatatgctattagaccaacaatatgccagatatgcaattttgacaattttcgttcgaaattcacatgttttgagccatgtcaaaacaagatttagcgggacaattttaacaaaattggaaaagttcaaatttcaaatgcgaagtgcaaaaaaaaaatccctatgaagggtatgatgtttgtttttttttaaaaaaatagaatttagatgcgattttggacccctatctattgggaatttcctttagaaaggagaaggattcatgggcaaaaagatgatgaatcttcagcccattgagctcattttagacggaattaataatgtgtgttgatggactttacattatgttgcgataaaatgtggatgttatggacttgaaattgttgtgtacttgtgttgatgaaaatacattgtacattgatctgtcttcaaaattaggttttccaaatgatacaagggtcatgccacagtttttcattaattttttgctatttttgcccatcttccctacatattctaatagttttcaccacttcccaatcaatttctccagtattgcatcttccattcatattctacattcaagcatttgtatatgcgtttgttctatttctagtccaaaacaaattcaatgaatctcgtacaaatggaatggattccaattaattaactttgaatgcattccattctaattttagaagttatacagagttcaaattcaaattttggtttgcgaacttcctttggattttgtttgagccaagatgatgtggtaccactgttcatggtgtgataataacaatttgccatcccaccacgagtcatgccacgatttcttttatcggtatcacaacattgctagaaatatgtttttaagaatttaattaattagagttagtacgattttttttaattttctatacttaccacattttgctgttcacatgaatttcatccaatcaaaaaaaaaacacatttactatagtcacttctttccttccaattcaaatgtgagtgtaatcggagcaaaacttgaaccagagtcactaagcccgtgaccctttttttctctttacaccccacgtgccagaatcttcagtgtcaaacaacccagaaaagctcccttaatccaaatctctaaccccccacgctaaaaaaagcagggaattccccagcaggcaaggcagcctcatcactcaaccgattactatttgatttgataataataaaaaaacaaacagaaaagaagaaaagaaaatcatccgatagcctctcctctccccccttcccctctctttcgataaagcctccggagggcaccggagggcgtcgaccaccaccaccaccaacccccatccatggcgtccctcgccgccttccatccggccgcgccccgcgccggggcgcaccacccgcgccgcccaacccggccaccggcctcctccgcctccgcctccccgcacccccgcgccggagggcccgcgccgccccgcgcctcgcggtctccgcctcctccgcgggcgcgggcgccgcgtcgccctccccggccgcggggtggggccggtccgacgcggcgtcgtcgctggagcggtgcctcgccgcgtccgggtccgccgcgccggcctcggcgcccacccgcgccccgccggcgatgaagggtgggaagcagtacgggtcgttcggcgccgtcacgctcgagcggaaggtcgacctctccaagggacggaagaagatcacgcccgaggtagggtggctaatcatcatcatcatcatcatcctcatccttttcagagataggtttagggggttcgggagataagatagccttcgtgttgttctgaattggatggtagagaggtgaggatatcaatctaaattcgttttgaaactggatggatggactcgaaggccaaaatataatggataaggtttgatgacgcaatggctcatgtgtggggtttgtagaggattattcatgatatgggagcaatttcctgtttgtatctttcagcagaataatatgttcccctgaatttgcttcgaatagagtactaggccaattactatagacttaatgttatacccaaactcatgttatttctctgactgatgttgatctggtggtaggttgggattcgtataactatcgtatgtccaacttcaccgagtgcttcatttctttgctctagaaaaaaaaagtaccgcaccattttgtttttatgaactagatgaaattatcctgtcatgttgagacaagcttgatgagctgttagcttaataagtcagttctgtatgcatatgtatatttttactttgaaggcaaaatatctgttattccatcgtactgccatattaatttgtgagtttgatgactggattgcatatattcatcatatgcctcttcttttaaaatgttgcagctggcaacaggt

SEQ ID NO: 65317 - DNA, 18397 bp, Oryza sativa
  unsure (1)..(18397): unsure at all n locations
gtatatggttttaggttatgcctttgaaatttagggattgttaactgtcccctgatatatgtactattcttgtgagaaatgcttgttgaatttctttatttagtgataaatcgtatgctcatgaccttccacagttgggttgtggttagagttcataattatggatatggctgtggctgcataacgactatgtgaacttttcagcagtgctttgtttgtatcttgagttgttgactaaaagttgtatataggagctaattgtgtatgctagataatttgatcttcattatgcccttgtttagatccaaactttttcttcaaacttccaacttttccatcacatcaaaacacataaacttccaacttttccgtcacatcgttccaatttcaaccaaacttccaattttggcgtgaactaaacacaccctatattataattcactttaattttaacagttgcatatttctgtaataattgctttctttaataattccatcggttcacactatttctattgcccgtgttccagtcttccaggagtgttttaattgcattttatgggggccacactcttgtcactaatcctggtgccatttgtattgcagattgacgaatattcagattggtgaatcatcgagacgcacatggcttggggaggaagctgatccacagtactcagatcggctgctgagagcatataaaagaccagtcgaggttgctggagaccaacaagattcaaggtggtttatatcgaaggatgcgattgtatctggccttggtcttctcggcatcaagcaaggtggaacagaagctgcattgtccaagccccgcaggaagagagttgtccgaaagaaagttgcctcaacctgaatttagttggatgttgtctaatgctggaacaattttgctttagttccactacgccgtattgagttctacccagcaaggcgaacgagggaaaccgtagttggcagccagccttgcagtctgtcgtggaaggcatcgaagcggtggtggtggtcataactgggagggttcagaactggaggccctttaccattttgtatcttttttcttctcgctttctgataagaattgacatcccaatttcttgtactgttgtgagccaagtagactcggcatagttgtagtcctggagattgttaaagatacagtcgttaatatgagcaaaaccattccatttttgatttaggtcatgtagttgcccgatgtattgcttgtagcattacaaagttggatgcctctttatcgtcagatccaagtggtgtatcctggaagcattatgggctttatagccgtccgtttaattgatgtttgctgtaaaatgtattactagttgtgtcaacatcatcgacgagcgaactggaaatttaggggatgtttggtcgacgattaacatggtcaaaccttacattaggggatgtttggtcgacgattaacatagtcaaaccttacattaggcaagcttaactaagaaattctgtctttgaaaattagtatggttagccataagcccatagtaatagtaactaaacaacctaagaaattgttatctgcctaaggtttatcttggcaagttgatgcatctaaccaaataatactccattttgatcaaaagtcaagagggagtacacccttaataccccacgtgttatgagctatctaaatgtctaacatagacaaatgtttaagttgtatttaactaaaatttaaaatcttaaatcaataatactattgaaatttgatatgtaaaaataacatgaacatatttgtcacataggttatttccattaatttttattaatctatgttcgaaaaagtagtgataatgtggggacaaaagaatattttaattttcttttgttgttccaatcatgtgcctcatcatataaatttgaaattgagttaaatccgatatatcccccctcaactatgtgaaaattatgatttacccctctttagctacaaaaccagacactttatataaacaaccttgcagactaggcaaatcaccctatcctagtaaagagcggttctcaatcctacacgaaacacttacggcaatatagtttataaactatcaaagaaaacgctcgaaaaagatctagtccactcacatgttagtctaaaacatttcttcaataaatttcaaacttaccagatttcatgtgttttgtgataacactccgtgcatgtggatacaatgagataaatgtaacaacttctaaaagggcctcaattaatataaagaaatgtgtgtactcaaaatctggatgcacacaaaacataggctgaataaaagcttttgcttgctccgcaaaagaagaagaacaaacctcgtcaagaaagtgttagcatgccagtaattagctttattatcttagtggaacagaataaccatgatgtcggtgacacattttctaacaaaagcttagcgatcgacattcgacaagaaggctattggccacaaaagtagtatatgtgtcagacttattcagctgttggacacaattatggctgttggtgaaagctgcagatattgtacaccacgaatcgtttacaaatctgcccaagttcactatacaatcccttcaataaaaaggtttattatataaaatggtcattaactaatatagcttaaggtataaaattgttggaattaatagatgggctaaggcccactcgaagattatttctttggaaaatcataaaagcccccctcatgggatggcgtgcatgaggagtttagtaccactttgcttatcctaagagagggggacctccttaaaagggagaatgccctcctacccacttgaagcatgtgtggtggagagaagaggggaaacacatgcgcactcgcctcgtctggcaggcgcgcgtgcaagacgtacgcgtcatgttacgcatcgaatggtccgtaaaattggctcctcacccttgcgcagatgcagcttccttttacagttttgttttgctgcgggaaatttcgggaaaaatccggtgcgtgaaaatggcgtggagtctggataagttacacgcgacttatgttgttcggttacgcggagtggagatcgtgcgggcgccctaatcaagcgacctatctctatataaaccgagccgccgcctacacgcaacacacgcaaaatcaatctagggtttgcctcctaatctgtgctgcgccgtcgctcgtagactactccatcccgctcgccggcgtgcaccggcgatcgggcgagcaggtctccaaaacctctgccttcgacgtcctgcatcgggagaaggcggtaataaggtttttgggaagcgcttcgtgtgactgctccctgttcgtccgcgacggctcgccttcctcttcgctcgcgtgctgcgcgcctttgtcgacgcctgcaaccgcaagtagttcctgccgagcaactggtctttctgccatctcggtacgtgttcgacatgttacgtatatttgatctgttcatgttttattgcttagtttacatgtgtagatctaatgatgtgttcatgctagtttacatctgcaatgtcatgatttatttatggaataaattaaatcattatgtgcttataatttcaacaaaaattagtacaactacaaaataaatataaattctaaatgttacatgtacaaataaagctaaattataaacattaaatcaacaaatctgatcatgttttctaattaatttctacccatgtatttcatatgtcaagattgtcatggtggaagaacttttgagatccatgttctacttgtgcgtaattaggaaataaagtatttaaaattgaaataagaaggcagtggtgagtaatgagtataaaagtattcagcaaggaaaaataatagaagaatagaaacctagaataaatatgaaagggcaatgaataaaggtggtgtttgaatatctgaacatgaagatggagataatgattaagtgtttcacgtaaaacgagatgataataacgtatgattaattgagttttaatcattacaaacttaaaaaaatggattaatctaatattttagaacttttatatataaagttttcgcacgaaatacactgtttagcagtttgaaaagcgtgccaacttttatccaaaacgggaccaaagtttattttttatgaacattgattttgttaaaaatatatagattggctactgaacgtactttcaattatctgcagaagccagaaccttccacaaacataagtttaaattcagaaaccaaatagtgatgatcacattttctttcatttgtacaggggttctattttacccacgatatgtagcggcagagccaccatcctggctagctcactagtccatgcacaatagaatttttgcttacacgtagttagatttgtctgagctctaaagttttcctgaatataccactacaaacatataatatatcaatacgcccgcttttaggctacttgacaaacatgcttcactcagcctatccaatttttgtactgttcttaatacactgaggtacatagtaaggaagcatgtgaaaatggttattaacctttccttataaaccatatgcacatgattatgctttaactgcacatttggttggatgtagaggctggttttacccatttccctaaaaaaaaaactgatacacgcagccaacgcatcctctaccagccataaaatgtgttcggacattcccttgttcaaactccaagcacaatggctaatttccagcatttgtttaaaaaataagtttcaggcagattattgttataacacctattagctgcaaatcattttctaaaaaataggacatcaacatgatcaaggtatcagtggattcccaattaacatgtaactgattatatttctcccacgatttacaatacatgatatcaaaatccatattaacgttgaaaccagaaatcgtaataaaaccctacctttgctccctccacccttttcttccttttctcctcctcctcttatttccttttcctttttcctcttcttctgatcttctcttttgttccacttcttttccttttctctcctcctggtactagctgttggaattaatagatgggctaaggcccattcgaagattaattctttggaaaatcacataagcccaccttatgggatggcatgcatgtggagtttagtaccaccttacttattctaggagagggggacctccttaaaagggaggatgccctcctaaccacttgaagcatgtgtggtggagagaagagggggaacacgcgctcgcctcgcctcgccgggcagggcaagcggcgcgcttgcatgacgtacgcgtcgaatggtccgcaaaattgggttggcatcccctcacccttgcgcagatgcagcctccttttgcagttttgttttgttgttggaaacattccgaaaaatccggtgcgtgaaaacggcgtggagtccggataagttacgcgcgacttttccggttcggttacgcggagtggagatcgtgcgggcgccctgatcaagcaacctatctctatataaaccgagctgccgccttcacacaacacacgtgaaatcaatctagggtttgcctcctactctgtactgcgccgtcgctcgtagactactccatcccgctcgccggcgtgcactagcgatcgggagagcaggtctccgaaacctctgccttcgatgtcctgcaccgggagaaggcggcaataaggtttttgggaagcgcttcgcgcgactgctccctgttcgtccgcgacggctcgccttcctctccgctcgcgtgcttcgcgccttcgtcgatgctcgtaaccgcgagtagttcctgccgagcaaccggtctttccgccacctcggtacgtgttcgacatgttgtgcatatttgatctgttcatgttttactacttagtttacatgtgtagatctaatgatgcgttaatattagtatacatctgtaatgtcatgatttatttatggaatatattaaattattatatgcctatattctcaacaatccaaaaaccttattataggcgctgtgattttactatggttggttttgccgatgcactgaggccagataaattcaccggtgtgcactttaagagatggcagatcagggtcactctgtggctgacagctatgaaatgcttctgggtgagtactggcaagcctatcggcgttcttaatgctgatcagcagaaagaattcgatgaggccactactctctttgtgggatgcattcttagcgtgcttagcgatcgtctggtcgaggtgtatatgcatatgaccgacgctaaggagttgtgggatgcactgaatactaaattcggtgctactgatgctagcaatgatctgtatatcatggagcagtttcatgactacaagatggctgacaaccgttctgtagtcaaacaggctcatgagatacaaaccatggctaaggaactcgaactccttaagtgtgtcttacccgataaatttgtggccgggtgcattattgcgaaactacctccatcttggagaggtttcggtactgcactcaaacacaagagacaggaatactccgttgaggggttgatagcgtctcttgatgttgaggagaaagctcgggaaaaagacgtcgcgtctaagggcgatggtgggcagtcgagtgccaatgttgtgtacaaggcccagaacaagagcaaggggaaatacaaagctcaatagaccaccaacttcaagaagcagaagaagaacaacaacaatcctaactaggatgagaggacttgctttgtgtgtgggcaacctggtcatatggctaggaagtgtccacagcgcaaggggatgaaggcacctgcagggcagacttctaagtctgctaatgtgaccattggcaacactggagatggaagcgggtatggtaatttacctactgttttttcagttaatcagtctactaattggtgggttgatactgggccaatgtacatgtttgtgctgacatctcattgttttcttcttatcaggtcacacggggttccaccatcctaatggggaatgggtcacatgcttctgttcatggtgttggcacggtagatctgaagtttacttcgggaaagatcgtgtagctgaagaacgtacagcatgtcccttctatcgacaggaatcttgttagtggctcccgtctgactagagacggatttaagttcgtttttgagtctaataaagtagtcgtgtctaaacatggatattttattggtaaaggttatgagtgcggtggcctgttccgcttttccctttctgatttctgcaataagtctgtgaaccatatttgtggcagtgtggatgatgaggctaatgtttggcactcacgtttatgtcatattaattttggcttgatgtctcggcttttcagcatgtgtttaattcctaagttttccattgtcaaaggttctaagtgccatagttatgtgcaatcgaagcaacctcgcaagcctcacaaggctaccgaggagagaaacttggcaccactagaactcctacattcagatctttgtgaaatgaatggggtgttgacgaagggttgaaaacgatatttcatgacgttgattgatgatgctactagattttgctatgtgtacttgttgaaaacgaaagatgaggctctagactattttaaaatttataaggtagaagttgaaaatcaacttgacagaaagataaaaagacttaggtctgatcgtggtggagagtttttctcaaacgagtttgacttattctgtgaggaacatgtcattatacatgagaggacgcctccctattctcccgagtctaatgggattgctgaaaggaagaaccgcacactgaccgacttggtgaatgccatgttggacaccgtgggactacctaaggcatggtgggggacgcattgttgacctcgaatcatgtgttaaatagagttcctaacagaaataaggacaaaacagcatatgagatatggattgggagaaaaccatcactttcttacttgcgcacatgggggtgcttggtgaaagtcaatgtaccaataacgaagaagcgcaaacttggacctaagactgtggactgtgtctttctaggatatgctcaccatagcattgcatatagatttttaatagttaaatctgaggtatctgacatgcatgttggtataattatggagtctcgtgatgctaccttctttgagagctttttcccaatgaaggatacacatagtagttctagccaaccctctgaaataattcccaattcaatcacaccaccagaacaaactgaacatacacatgaacatgtcactgaggaggatgacagtgaagctcctcgaaggagcaagagacaaaggacggctaagtcttttggtgatgattttactgtgtatctcatggatgacactcctaagtcaatttcagaagcatacgcatctcctgatgcagactactggaaggaggctgtccgtagtgaaatggattccattatcgctaacgggacttgggaggtgacagagcgaccctatgggtgtaaacctgtggggtgcaagtgggtgttcaagaagaagctcaggcctgacggtactattgaaaagtacaaggctcggctggttgctaagggctatactcagaaagaaggcgaagatttctttgacacttactcacctgttgctagattgaccacaattcatgtgctactttccctagcagcctcacatggtcttctcgttcatcaaatggacgttaagacagcttttcttaatggagagctggatgaggagatctatatggatcaacctgatgggtttgtagttgaaggtcaagaaggcaaagtgtgcaaattgttgaagtctttgtatggtctgaaacaagctcctaagcaatggcatgagaaatttgacaaaacattgacatctgcaggctttgcagtcaatgaggcagataaatgtgtgtactatcgccatggtgggggtgagggagttattctgtgcttgtatgttgatgacatactgatatttgggataaatcttgaggtgataaataaggttaaatcattcttgtctcaaaattttgatatgaaggatttgggagtagctgatgttattttaaacattaagctaattagaggtgagaataggattatactcttgtagtcccattatgtggagaagatcttgaatcgctttggctacattgatagtaagccttctccaacaccttatgatcctagcttgttgcttcgcaagaacaagagaattgctaggaatcaactgcaatactcccaaatcattggctcgctgatgtacctggctagtgcaactaggcctgatatctcctttgctgtgagcaagttgagccggtttacctctaatccgggagatgatcactggcatgcgcttgagcgaataatgcgctatctgaaaggtactatagaattggggcttcactattctgggtatcctgcggtactggggggatattgtgattctaatcggatctctgatgtggatgagatcaaagccactagtggatatgtcttcacactgggtggtggtgctgtttcgtggaggtcttgcaaacagaccattttgacgaggtcaaccatggaagcagaactgatggcactggatactgctactattgaggcagaatggctgcgtgatctattaatggatctgcttattgttgaaaaaccggtgccggctatccttatgaactgtgacaatcaaacggtaattgtcaaagtgaatagttctaaggataatatgaaatcgtctagacatgtgaaaagacaattgaagtctgtcaggaaattgagaaactccggagttataacgttggattacatccaaacagctagaaacctggcagatcccttcacaaagggactatcacgaaatgtgatagacaatgcatcgaaggagatgggtttgagacccatgtgagttatactatggaggtaacccagtctatgtgatcggagatcccgtgaattagaacctgggaagaacaaaccattagtaaactagaggagagtaccaatctataccctctctaagtgaagatgcatgtactcttgtgagctgcaaggcaggttggctatgccttaatgagttctgttggctttaattagcgaagatgctgttcagcagagcattcttgaaagaactcacctttgtaagcttgactgttggtcgcagtctatgaagattttaggtgaatcttctaggaagcttactaaagacctagcagtatgacttatacgctccacccgaggggtagtatatagacggtctagtaataaataagactctgagtaaaacttgcttgcacaagacttgcaattcaaggcgtagtccattgttcaagttgtgagtaagtgtagcttggagttctaggtggatgttcaaccttaatcggtctccatcgtaccgctggtatataaacagtacattggaaaaggcaaatctcagtgggattttgagatttggtgggggattgttggaattaatagatgggctaaggcccattcgaagattaattctttagaaaatcacaaaagcccacctcatggattgcatgcatgtggagtttagtaccaccttgcttattctaggagagggggacctccttaaaagggacgatgccctcctaaccacttgaagcatgtgtggtggagagaagagggggaacacatgcgcgcgctcgcctcgccttgcctcgcctggcagggcagggccggcggcacgcgtgcacgacgtacgcgttgaatggtccgcaaaattgactcctcacccttgcgcagatgtagcctccttatgctgttttgtattgctgcaggaaaattcggatttgttctgttgttggaaacattccgaaaaatccggtgcgtgaaaacagcgtggagtccggataagttacgcgcgacttatccggttcggttacgcggagtggagatcatgcgggcgccctgatcaagcgacctatctttatataaactgagccaccggcttcacgcaacacacgtgaaatcaatctagggtttgcctccctactctgtactgcgccgtcgctcatagactactccatcccgctcgccggcgtgcaccggcgatcgggagagcaggtctccggaacctttgccttcgacgtgctgcaccgggagaaggcggcaataaggtttttgggaagcgcttcacgcgactgcttcctattcgtccgcgacggctcgttttcctctccgcacgtgtgcttcgcgccttcgtcgacgctcgcaaccgcgagtagttcctgccgagcaaccggtctttccgccacctcggtacgtgttcgacatgttgcgcatatttgatctattcatgttttactgcttagtttacatgtgtagatctaatgatgcgttaatgttagtatacatctgtaattacatgatttatttatggaatatattaaatcattatatgcctatgttctcaacactagctgcacatgctcctccctattgccctcctcgccccttctttcttcttatgcttgggcatgcaatttttatccgctattaggtatgcattgttccacatatatttgactagaagtgcatctcctctcctgtactagtttgtgcaggatagaaaaatgtagcgcacatttggttctctaccttaccaatttataggtagtaccaacatctagacaaattttggcactatcaatcttttggtaggacaatgttaactaatattttcgaaaatagttcaaatcgtttggtaggataatgttagctaaatttttatagctcaactagttagctaaacattatttttggaaataggcctttgaatccaagtgagaaagtttcaccataaagaatctaactagttgagctatgctcattacgcataagctaatattcccaacagtaaaaataaaatcataagaatcaagggtttgagatttattttgtactcgtaggaaagacgaaagagaaagagaaaaagaaaaaggaaaatatgaaagaaaaaaacattagaggaaaatggaaaaggaggaaaaggaaaaggaaaagggaaaagagaaaacaagaagaaacaagaaaaacgatattaatagaaacaaaatttgtgggaaatcgtcagaaaaaatgataacaaagttttgaataatcaattagtcaaactaaaactattgttttgagatttttgttaagctagaagtaaatgaaacgaacaatatttttataatgttgcaaagctgaaacttagaaaaccaggatacgatggacaatacctttagaaaaaaacaaaccataatatgatggacggtacctttagaaaaaaaatatggtatcgactgtggccctaaaggatgtagggtaaaagtattaatacatactttactcccttcatcccaaaatgtactagattggacacaatctgacagtccatattctatgtttagacggagggagtaacacttttttgcactcaagtagtatgagtacttccagtggtgaactagaatgaaaatgaccaggggtccttttagtattgttttctacacacagggtaatatatatacaatacgatactacctatatcttaaaatatataaggaattatacctatatatctggacaaaaaaaatttaagacatagttagtatatagtaataacaatatatagtatttaacttaagagtcataaaggtgcagtaacttagcgccttagcttatgccttagcttattgaaatagcgatcgatcttacataaatgcacaagaaaggggaaacagattctaatcccttgagtgatgtcccttgacacctttttcttccaaattcaatgaaaggttatttttttaaaaaaaatattaataatatatagttagcaacgcctatcactccaaaaaacaagtttaaattcgacctacacattaaaaaaagataatctagatagaatagtaccactattatttatatggtgaatttatctttttaatatattctgagttgtgtttgtactaactttgtgaggtggtatatatatgttgtacgaatgtcgccaagtattttagaatattttaaacaaacgggaaattttcaccacaagttagtccgttaccccactatgcaattaggttcatccagattttgctttgttgtctatttgtcctctcatccaccagcgagtaagtcggtggggatgtgaaacaaaggccctgtttgtttcagtttaagattgttgtaatccagattattaaatcagattactctaaagttgaattataataagctacgagttatttatttctcaagattattggaggcatttaagggtagtgggtctttagccactcaataatctggaaaaagctcctccagaggagattattagattatactaatctggcttatagattatacttcctccgtttcatattataagactttctagcattgtccatattcatatagatgttaatgaatctagacatatatacgtatccagattcattaacatctatacgaatgtgagcaatactagaaagtcttataatatggaaaggagggagtaataatcaatcataataatctacttgtttgtttcaacttactcctaataatccagattataataatcctaaattgaatcaaacagggccttagagtatccatggatgctggatgggttggagaagaaggctttatcaaatttaattgcaattttcttttatggtatggtcagatataagatgccctaggcgactttgttaaaaaaagaaggtcagttaccccactaaaaaatatgacaagattacaaatgacagtgcagagactaatgaactttggaatatgcttttttcctctttgccgtggcccaaaagagactgagagccaatgtttttattctggggcattttactatttgccactctttgatgtggcatttaactctttgccactcatatatttatgacatgtgcacgtcaatgtatctatgacatatgggttcagctagaaaattattaaacaccatatctaaagtagcaaatagttaaatatctacttcctctatcccaaaatataagcatatttagctatgatttatagccaaaagttattacattttgagacggaggtagtatttatcttttcttgagaaaaggtattacatggagctttgaacgaaaccataacaggatgacaggcccaaatgttggcagacccttgtttgagcaactatataagaagtctgcccctcggattgcacttgaatccatccaaacaccccaccttaattcacgtcatccaacattggaaatggcgaaccgagaggagccttattctaccactggcggcactgctgcaaaagctcctccggtggcgatggacgccaaactgctgatggcggaatgccctgaagatcgcaaacttctcaaggagcttgtgcacaaggaagacgcttcgaagatgatggtggttttggcgtcaaccaccaaccagcctgctgcagagaagcctgcggcagcccgtgcagtaatgaatccgctgctgctagcagcagcatcctttggtgcttgcgaggttttctactttcttttctgcagagaagacgcacgagagccgctgccgacaatgacggctcgtgcatttcacgccatgcttgctggggacgcctccggcgccgatgggcggtggccgtcgacccatcagcaagctctcgacgaagtagaagaaggcggcgccggtgccgccgttgccgttggtcatcagtccactcgacggctaccaccacctgacgcgccgctcctggagggcatcaccgttgaaggtgacaccgcgctgcacgtggtggccacccatggtaacgccgccaacttcttggagtgcgctgaaatcatctgcaacagagccagacgcctactgttggcgactaacgacaagggtgacacggccctgcattgcgctgccagggccaggaggttggagatggcctctcgtctcattgctctagccaaagctagggaagaccacgaagtcgaacgtggccaagcagcatcgtttggcaaggtactcctgagaactgaaaatgagcgcaatgaaacagccttgcatgatgcagttcgcgccggagatggtgacatggtccggcggctaatggacgaggacccagatttggctttgtttccagtacagggcacttcacccttgtacctggctatctctctacggaatggcactattgctgagatactacatgagaagagcaatgggaatatatcctactccggaccacatggacaaaatgcactacatgctgctgttcttcttcgacatacaggtatactcgcttcacaattaattccatgttccttttggaccttatactttctagaaaaagtgttttcatctctcgagagaatatctccacacatgaaagcaaaatttaactcatacaagttgtaacaaaaataacaaatataactacaagtgtacgataactattttcgatttaatttgttctttttgttgtaacatgcagaaatttaattcggtcttgaatatttgtggagtgatatatttcatattaatctatgtagttattttttaattaattttttaataactatttagatgacatgcaagcaacgaggggacatcccctcaagggataaaaatccacatcattactttctcagggatgaaaatccacatcattactttctcgctcattggttgttaatttctctgcaaatgaagttgtgtgtcgcttgctgtccccatatatatatttccacaacccttgaaaaaaagctctcttgtgtctatgttttttttttttagtttcctaacaagtttttcctgtcgtaattctacagaagttgccaacttcaaagcagaaattagtttttcttttacctaatcttgtgattacttagtgtctaaaatgttcttccatttacagcggtgttagaactactattgaaatggaacagccaccttacaaaacaaggagacgaaaatgggagtacacctgttcattttgccgcatcttttcctctatggcatcgaaaattccattggagacatccttggattattcgtgttccccatagtctctcgatgttgttaaacactggtgaggtagatccattctatcaatccgacaagaatggaatgtttcccgtacacgtcgctgctgccgtgggggcagaacttaccgtcgcttttttgctcgacaagttcccaacagcgcgggtttgcgtgatgccaagggaaggcattcctctatgtcgcagttgagaaacagagtttagctgttgttaggttcgcttgccggactacgtcgttacagtggattttgaacatgcaagacaaggatggcaacactgcactgcaccttgctatccaggccaatcaccatcgattgttttgtgctcttttagggaatcctcaagtcaatttagatttaacaaatcatagtgggcatactcctctcgatttgtccagaaggatgcttcccagagggatgaaatatacggcggtacgtacgtatagcatgcatgaaatttcctttattatttcaaacctttgccattcgaagcaaatttacaaatgataacacatggtaatatacaaactcaacattcctctttttcatatagaacactgaggagctcatatatttgacactcaaacaagttggctctgaacactatcacgatcgccgggatcacatcgaagaaatctatagccgtcgtgtggtatcaaaagaggatctggccgaagaattagacaagatgcaagaatcgacacaaacactaggcattggttcggttctaattgtgactgtgacgtttggtgcaatgtttgctcttcctggaggatatagagctgatgatcacccttatggaggcacaccaacattttctgggaggtatgcttttcatgcattcatgatggctaatacgttagcattcatttgctcgtcaatagctaccatcggtctcatgtactcaggatcttctatggttaacttgcggacaaggcaatataactttgggataaccgcatttctcatgaccaattcagtcacaagcttgacaattgcctttgcacttgttgcttatatggtgctagctcccgttgatcataaaactgcagttgtaatctgtgtcttgagtcctcttgttgtaatatatatcaacatcgattcttggataaaattggctgttattgaacaatcgctaggcagtagaatggggttacgttcgacaccgccaagggtcatacggatgatgctatgtaatcttttatttcaattttggccattcatagtcatctttagttttagttggattgtatataaaaggacagccacacacctttgatgtgaccaagcatcaaaatgtttatagggataggatttgcgtacgtgcattcataggggtgagtgtgtgtgttgtgagtgtctgtgttatactgtgtaattctgaaaataggtggtagtcccacaagaaatggagtcatcattgttttcttttatggcgacaatgttttcactcaaccatactgaagatccgaatacagtcatcaaactatgtccattcacaaatattttttaattatggcgtatgttgcatttgttgaagataaaacctacgtaaactagtggatccatttgtacattttgattactttcaaccttgaagtcttaattattattgcccacatatatctctattattataaaaattaaatatgtttttgccggtattttggtacgtcatccgtatatgagtcggtttttaagttcgtttgcttttagaaatacatatccgtatttgagttggtttttaatatgtttcacttttggtaatacaaaaggaaccatataagaaatctgtttaaaaaaactcgcatgctaacttgacacgatcggattcctagttgcagctcatgattttctaaaaaaaaatatatatatatccaagcgaactcacggagtgaatttcatcttaattaaaccatataacaataataagattaaaatagacttcacccgttacaatgcacgggtattttttcatatatatatatatatatatatatgtatatatatatatgtatatatatatatatgtatatgtatatgtatatatgtacacacacacatatatatatatatatatatatatgtatatgtatatatgtgtgtgtatgtatatgtatatgtatgtatatatatatgtatatatatatatacacacatatatatatgtatatatacgtatacatatctatatgtatatgtatatatatgtatatgtatagctgnatatatatatatatacacacatatatatatgt

SEQ ID NO: 65318 - DNA, 767 bp, Oryza sativa
cacaacatatcaataatatgtactaactaagaactaatttaaccgtaaaattacttaaatacctctaccaacatttagcaataacaaatatgtgctaaccatacatactaacatcgaacaatgcgaaacaattaacaactcttaaaccaattttttattaaactttcatatgcattgtacttagggattactaatgtataccttaactttactgctggagggcgtcgccaacccttttctcccgaccggcgcctcctcggcctcctctccggcctgctatcccctcccctcgctccctccggcgctcacggcgacgatgtggcgactctcggcggcggctggcgatgtggtcctcaaacaaatcgaactcgcggccttggtggacggggctttaaaccggcctgtcgaacgcccattgttcgacagggtcggtggagggccccgtcgaacgcccccggttcgacaggcctcgcggcgccgggtggtgggccctgtcgaactccctccgttcgacaggtgagcgtgtcgaacgccagccgttcgacagggctttgtcggctgcccgtcgttcgataggtgccctatcgaattgcatccgttcgacagggacctactttcgcgattttccccggttggccaccacttttgcgattttccataaaaataatattaattctcaaaaaaattccgtacgtactactagctcgatcgtccgattcatgcatcctgtgtaaaataaataattagagaatccactggatggatcg

SEQ ID NO: 65319 - DNA, 2888 bp, Oryza sativa
gctcccgtattgaaggcgaagggagtcctgcgcctcgttcatcacggtggtggcgatgagggcagccccccgctcctcctccacctctcgaccgatctccgccagtgccgtcttacgggcttcaagatctgagacgtgccggcggtgagccttgcggcccgcttccaccatggcctccaccgagcgccgcccctcctcgacacgcgcccatgcagcgtcgagctccgcacgctccgcctgcagggcctccacctgggcacttaacccatccaacaccgcggtgtttgcggcggctaaggcttgcagaagaggctctgcgctcagcggggcgacggaaggcgtggggaagagctgccttggagaagatgccgcgcggctcggcccgccaatggacgtaccggactcggggatgtcccccggacctgtttggtcctgggcgtcgcccgaaggagtgggcccaagcgacgcgcccgcggcctcgtcgcgagctgcctcggaagtcgccatcgcctcagcctggcgagcccgggcggcctcctcccgagcggcttcctcagcctggtgagcccgggcggcctcccgggcggcctcttccgcttcccgcaggcgatctgcggcctctcgccggtcagattctcgcctccgtgcctctgcggccgccggatctttggcctcggactggccggacttgggatggcgggaggaacgcgacgggacatcgctgaagcggaaggaaaaccagaagataaacaagatgggtaagagaaaacttgcttttgggatagaagaaagacggtcgcaaagagcgtgggacgaacctgcgagggggtcggttgaatgaccaccttggcggggaaatcaggtttccccgggatggttctgtctcccccatcttgcgaagccgcttcttctcgcgctccccctcgggctgcgacgtcggcgcggccccctccgggcgcctgctgctggcacgcaccgccccgccccctcggggaggagataggggaggtgttcctcccagcttcctcttcccccgggcgtcggtagggcggttgctccccgagcccccgacgtggggcccagaagcacgaccccctcctggggtagattgttccccccggcggttcccacccgcgccgtcgtggcccttaggagcctcctcctctgaggccccgacccccatcatgatggtcaagatggaggcacggtctggatcgctgcagagggggagaactccttgaggaatgagagacgcttccacggagttgaggttcagcacccgttggatcaatatcttgaagtcctcaggagcccaatcccatctgactccctggtgggtccgcatgtagtcttcggacttggtgtactcccaggcgccacgagcgcgccgctggagcggcgcaatccgacgacggaggtagtcgccgtacaccatggcccctgtgagcccctgggatcgcaggcccgccaggcggtcgaggacggcgtcatagccatcccccagatctaccggcgcccgccagctggaggccggcgccgggggctggctcggaagtcggaggcgcgcttcgtcggcgaggggggtgtagaaccagtcgctcttccagtcgtcccacttcttgcggagggcgcaggggatgtagcggttcagcaccggcccccgcggctggaagtagcaaccaccaaccaccgacggcggcgacaccgactgcacggtgtagaaccaccggaacagccgaagagatgggcgcaccccaatgaacatctcgcacagatgcgcgaagatggccaatgtcatcactgcgttgggggtaaggtgcgccatctggagatcgtagaactccagaacatccataaggaaagaagaaaatggcggaaccagccctgccattgcgaagggaaggaagaagacggaccgccccgggtagtctggtgctgggcgaccctcgcccagcatcactatctcccagccggtggcagattccggcatgaagcggcgcggcagcccggcctgcctctcgctcacgatgcgagaaggcggtagtacgctaccgtcgagcagggcggagccccgtgccatgacgccggaggaagggatgattgggaacgagcgcgtgtggcgaaggtagggcgcagcagagaaagagttagggcgcaagcggcgaaggcaaggggaataatggcgaaaggaagggagcaaatttttccctcggtatctttatacccttgccatcgctgtgcccggctcctcgtttctcgcgcccactatctcgctccctcgtttctcgtgcccatgcttccactaatcccattcgcccgcttgcggcgcgtgaggtggatatgcggttgtggcagtcgagatagatcgtatcgtgcgcgcgttaattacgctcgccaaccgaagcgacgttaccatatctccaggcgaagcaaatcggctcgccctgattcgtgcgctgctcaggtgatgtggcagtcttgaagagactgcccattattgacagccaagttaccattgccgatgtgcatggtttgagaccgttgggtttctgcccaaccatggagaccggtcccacctgtcaccaggctttaggagtggcgtcacgcccgaccgcttcccttgagaagggcaatcgccctggcacaacgccgggggctactgtcggtgatatgggaccgggagtatcgtgaccagaggcttgaggcagacacaatcgcccacgtggcctgacaccctcggggacgtcgggcccgagggtgaggtgtccgccctcctcctgatttccccgaggggggtcgggttactcctgccccggccccgagggccgaggcgccccgaccccttgtgggttttttgcgtcacatgtatgggttaggtgaacacggca

SEQ ID NO: 65320 - DNA, 2975 bp, Oryza sativa
agaggacactaaacacagttctagatattgtcctccaggcatacactgcaaaatgctaactggataatccaaagcagcacaacaatatttaggtctcatcctgtaataccaaagttttggcttggtgataaggcaagcaactgtgcccaatatggaatctactttcgaaatttaagtgtgctaattacgaagtgtcttcccatacttctgctattactagacagttgtgcatgaaacctaacatcatagtttgaggtggaagatcatgtctaggaggtatcgtgtttgtagagatactgtgttgggcatggaaaatagctccgaaacaccactaacacctgtttgacgtatggtagtgctttcatgttcagatacagttaattttattgttgcaaattttaaggtggctttgtccctcttcgatgcaaggagttgaagagagatttttataagagaaagtaagaatcaaagagatgatacttaaaaaacaagcagtcaagcagtcatgtgtcgagccaaagtcatcgtattggttctgcttgattcagaatggttacaatgatctttttgaaactacggttctgtggtgcaccaatgaatgattacagttctgtaaaacattattattgaatttatttctaatatttcgtttatattccacatcaatgtcaatctttttggtaacgtgtacctcaacttactacctgtcaacattcatattagggatctataatctgttctgaagctaaaccatcaatattttgttgtataggcagcttgaacaaaatactcaaaaacaaactgtacgatactgaggtaaaaatattcagcatagatggaagccaggcattacattatcatcaataccatcatgaaggtaatggtagtactcataggaaccatcaatcaatgatataattcctccagatactgcagtaaataagaaatgaaaactcattatctccctaaaaaatatccataggatttctaattatgtttaaattaaaatatagagaaattacgaaccaccgctagatggaatctctctgtggacatcccgaagcaatgatgaacctgaactcgatggtggatcacaatgaaaaaaagaaaattattttcaaaatagaagtgtcaagaaacggaaatcaataagcagccattagacagcaccaaattaatttcattaaatccaacattcagcattattgtcatattatacttttttgaagttggaaatgttgatatgtttttctataaacttggtcacacttgaagtcgtttaacttagggcaaaacaaaaacatcgtacattctaaaatggagggagtataacattctaacaacatatacatatcaccataccactttttgatgctttcttatctgtccctcctatggaaaaatttagtgcatttgaaattcgtaataaaggacgatctaagggaagttgtagccgtaagtgcagatttcttctcagttcacctgcaaattaggtaaagttcatgaaatagattatctcgatgcacgctatgctcactggaagtaattacgaattctcaaaaaaatattagcatataaagaaaattgcatactttgcttttcctcaatctccccatatcttgtgtcatatatagttgttactgggattaacagtccaggaggaacaaaatggtacggagaaagctgaaaacaagggcaataaccatttgataaaaaaatattcagaaaaaaacactttgcacctgcaatcaatttaatataaaataccagcgaaatcatattaaatgatgcaaataaattaaaacaaaagatacatgcacggcaacatcctatataccatgcaacctttatcttttacttgttcatttggtattaaaagtccatgttccaaaaaaaccttgataataaaaggaatacatgtgattacataatgtcacacttgtggcatgccttgtacgctttgttcatgacaagtcaaaatcactagatgacgcgaatgttatgataacttccagattgattgtgtttgcagtcattacatagctgacacgagatataagatgtcaaacattcagaacacgactaccatcttttagcacctgagaattatattcaaactagaaacaaattaaacacggcctagaattttacaagttatccttgctacaactcttgttaggtgaattggtggagtcaaaggaacaatgctgctgctgctgcaccatctttaagcattcacactactgctagagcatctccaatgcagtcaacatggttcatcaaaagaagcatatgcgtaacactgtgcacccatctaagagctcaatcttactaaggaagcacaggtggttattccctaatgtccgcacaaactcacaagagtgacttcatgcaggcacggctaaattaaatatgctcctagaatcacatgaagccatgttttgttttgtacactgcacttagattgtaacatgtaaactagcaaatagttgtgcaaaaatgtaatcacgtgcactgcatggaaaaaatatgtgcaattttgtaatatcgctttatttcttttgcacagtgcatgtgatcatattagtgcaaaaaaaaaatcatgtgcacatattctacatttatgatctattttagaacatcctgaaatgcaccaaaaaatttggaagagctgggtgcccttgcggtgaaaagttcttgtggttcgcattccataactgctgctggacagctaattgccttgccaagcgtgggctaacttattatgtacctggggttgttgagttgtgagctctgatacaatagccttcttcataatgctcagctgatcagctaatcctggaataacaagctcagacacagcagcagctacagggaaatctactgaagtgtagcaaagtatatctagcttcaagttgattgctctcaggctagccaatgcaggtgctggcaaaaagaacaagagcatatttact

SEQ ID NO: 65321 - DNA, 5102 bp, Oryza sativa
cctttagtagataaatttccttaaccgaatatagcaagaatccgacaactaacgacttgacaactctcatcggctaatctcaggacttcgaagccgatgctgactctaagccgatgactactccgggcttaccaaatttcactattaacacatgccctccacttttgaagtatgagaactcatgcttcaaaattatcttctttctctatcttgtaatcggctttcatgagccgatactgatgtactccaccatgctgaaactgatatgcttgccccccgagccaatattgttgttcctccattaaattcaccaccgtgaccatgatcttggaattgacttcttcttcagacatgtggatataaaattcgtggtcccaccaggcgtgctaatttgtgttgacgaaaaaatcgaacacactggcctgggagatctgcttagttcctgtgcaggtccaaatcttgatgagatgcgggcgtgccagtcagtttgatcctgcaactgacaagatatgcaaatagtagatcaaaacagccgattggctgacaagccgatggagtagttccggtcgatagccgataatagccgataccgataccagccgatagcgatagggtttaagtaatcggctatatgtccaatgtagataatgatataaaggcaatcggctgatgatgatgtaataaaataacaatataatctagtataaaccaatcgacaaataatgatatgataaataagcatcgatccgaaggttaaagcacacatcggctggaggtccgatgtcatgaaatccacaagattagattaaatagtgaaacttttgttgtcatcggctaaatccaacttatatgtatagcaatccttatgagccgatgcaacgtctagataactcaccggctgaaaccccaataaaacccttattggcaatcaagaagcaggctagagattatggttctaagcacgacttagtagatcaaacttaactgatgcagcactaagtatgaaaaaaaaacacaatatctagacaatcaagccgttgactgagttttcagggtgatagatgtctaagctaatctaatctagcaacgcgatttagccgataccggcagaaaccctaaaacgagaagcagccgatagagctaaattgatatgctaagactagattaacagagacatatgataaataggtaggcaaatatatcatccaaaccagagcaatccaagaggtcgaatgtactgttgcagccttgaacgacgccgacgtagacgatacaattgcctgggccggcgaaacattggacttatcccttcgccaaagatcgaagacgatgcagccccgcgtcaggtgccaagttccgccggaacgtaaaaacaaaagtggaagtgaaaagggtggcgatgcgccgaattgtattgatcgtgaagatagtttacaatgaccccaggtgtacatatttatacccatgggtagataatagtccttataggacaagaaagaaactttcctaaagataaaaggaaaacataaagtccttataggacactaaacacactttcctaaagataaaaagaaaactaacaaactattcctaattaatagatacaactgccttcttcggactcgatccatacatggcaatcatcatgaagcacatcaacttaatccgacaatgattccaatatcaccttgccggaatcggctacatcggcttgccttgtccgattcggtaactgctgatgcacactgtagccgatgcggttccgaagccgattcataccctgtttccgttatcgatttccttccaaatccgcttcggccttaactccaaatccgatgtaaatttaccaactttcgttgttaacactaccggagacactaaggttttttgttttttctagacaccagagacatgtttacggagtgacgcattttcttatgattaattaaatatttattattgttttaaaaaatagattagtataatttttaaagcaacttttgtattgaaaccttttaaaaaaacacaccgtttagcaatttaaaaaacatgcacacgagacacaaggcagatgagttgggaaatgtggaggaagaacacagcctaagagtaagtttaatagtatagccaactactaactccaaatcatatatagttaatttagtagctaatttatacaatagttacctatagatatatactacacaattcaaacttggtcccacacctgtcatatcttggagtccgtgctgtagctggctacaaatctacaacccgatgctatttctctcttctctggtatcttctcaaaatgtgttcaaggccggtcctaacatttcggaggcccagagcgaaataaaaatagaggccctcaatgggtataatatgtagaatatttttttcttaacgattgtagagctaatatatcttctaaatagaacatacaaatgcaatacacgctctacacacatacgcctgatagataaagatcataagaccctaaatcacatatctaacagagtaaggagaaagcatagataagaggtgtcctactaaacctgaataattgcatcctctaggttaggatgagttactttggcctagaggtggccaaacgggcggcacggcccggcccggcacgggcacggttccggcacggcccgtttcggcacggcccgttaggcacggctgatgaaacgggccgtgccgtgccggcccacgtgccgagccgccggcccaagcacggcccgtggatggccgggccgtgcccgtgccggcacggcacgcccgaggcccacgggccgttcggggcacggcggcccgtgaagcacagtgtttttttttttttaaaaaaggaaaggaaatgtataaggaaaaaaaattaaaaatggaaataaaatgtttaaaaaaaagtaatgatttactaatgttaaaaaatgaaaaaatggtatttaaaaaatggaaataaaagttttttaaaaaagtaatgatttgctaatgttaaaaaaaaagaaaaaatggtatttttttgttgtgttgaaaaatttaaaaatatagattgtgattcattattttgaaataatttaaaggtaaatccacacttgcgaaaatattgcaaaagaatttgttaaaaatagtaatgacctttattaatgtttatatcattacaggatacaatgatacatgctgcctcgttaaaaactttgtcatgtaaaaactcataggggaaaatgagaaaaccatgacaaagaaaagagtacagctcaaaggtcagaacttacttctaacaaaattctactggggttggtctggatccaggtagagttgctcgaagtgggcggccaattcttggttgtccgcagtgtattgggcatgttgtcgagcaagctcccagtctttaacgcttagtagcatttcgacgtggtcgctgcgcagagtcgtcctccggtcttcgatgattcggccgcatagactgaaggccgattcggaggacaccgtcgacacgggcaccgtcaacacatcccgtgctagttttgaaagcacaggatatgttatcttgtggtcattccaccacccgaggacgttgaaatcttgtgcttcgtggtggatggcgtcgctgtccaaataaccggacaactcttcggccacaacatgcgaagaggcgtctccacttgtagccgacgaactgccaccaccttggattgaacttgaagacgatccaccccaaatcctaccccactgtatcttcttcttacctgtagtggggataggagggggtctccgctggcgaacttcctgaaactttacttcatatcttccaaaaacctcatataatttacgtctaacctcagtataaaaagaactataatctacacctatagtatctccaacaagtgataaaatagcagacaatccccttaatttacacctaggatctaaaacaaaagcaagagcatacaacataggtatatttttccaatatttcaaatatttttgtttcatgtgaaagacaggttcagttagaacgtcatcattttcgtattctttaaataaagtagcaatttcaagaaggttgtgcaaaattatattagcagttggataataaacatgtgacaaagttagagtacaatcataaaaagtttctagaaattggtaaaatttttggacaattgcccaaacatgctcgttcagtactgaagacccgtcactgtttcttgggccaccacgtgactgaacaaaatcagaaagtaaactactataaggtaaaacaacttttaacattaaatacgttgcattccaccgatgctctgcatcggtggcaaacttacgagcttctacaccggccgcattgcaaaacctcttccatgcagcaatccgcgggttagaagcagttaaccacgcgattgcttgacgaacagcatcgatgtggtcacctaccctcttcatgccagtcttaacaatcaaattaattatatgacatgcacaacgctgatggagtagaaaagattgagcatacacacaaaataaaggttgcaatatttcaatagccctagaattagcagatgcattatctagggtgacagcaaatattttatcagcaagattaaattcattaattacttccctaattctttcagctatgttttctcctgtatgtgagacatctattaacctaagccctaaaactctcttttgtaattgccaatcatcatcaacaaaatgaacaactacgctaagataatcctctctagctctactactccatatatctgaagtaacacaaacagagaaagtacatgtactaaacagttccttaagtgcagttgcttccttgtgataaacattctctaaatctctagttgatgtttgcctactcacagctttaaacctagggttatgagattgctgaatgtaatgttcaaaagcaggggactccccaaagttcaggggtaaatcttgcctggcgattaaccggacaagagattcccgagcaaccatgggatcgtactcccaactgcgtaccgtaccgtctgggtttagcataagttgctgctgccggagttgtattccttgcttcttggcacacgactccgcatggcgct

SEQ ID NO: 65322 - DNA, 5284 bp, Oryza sativa
cctgcgccccagaaaggtgctcacagaatggtacaagaagtctgcatcatcctactatagaatgcaccaaatatgatatatattactaggcattttcaaaacaatataacttcatgtacttcacatttctatacatgtcagtcaggcaatttgaaacataaactttcattgccagatattgaagctaggtatacttaaaatttgatgccttcatgaacaggcgaaaggtaagtgaaccaagctgacaatgtccatactccacattcctcattcgagctccaggaaacatattctcacaagctcaccaagaaataaatttgtatcaaattggaactaacaaccaatcacaacatggaagtattaagttaagtatcaacttatatggcaggtttagttgagtctaagcttacctctcttgtcaatgagaggctcctctttgctgggaagaattttgaacaagatacaatatttgcatcatactcctctgtgcttccatttcgagataaatggggaacagaattcagatcattgccatgcaagataatagaataatgtgattcaccaggagttgttcgtgggccttcgattaggtaagaaacatgaggatctctgagcttagaagctgttgattcaatgagtgaataaaaccttgcttcaatgcctgcaaaaagtgacacaatacataataaacaatttggaaacatttgaataaacatttgccagaatcaaaaccatacaggtgaagtaggcacatctccaactttgacaacacatgaagcaatttggtccttgcattgctaatagtttacttaggtccttctattcatatcatccaatggaagtattccatctgttttattaaatgtaatgtcttcaagtaaactatcatggtgatatttgtgttgtacaaaccatgtgaatattgatcataacaaatacctgcctactgaaatttacccttaacacttcacaatccccacatcccctactccctattaaaaaaaccattcatgcagcttattataccattttgctatgtgaaagataatcataccaaacacaatttgcttgatgacatcaagatatttacagcatgatcgtgctgtacctaagtcttaagatatttacaacatgatcgtgcattcgtgctacatatttcaaataatgcatgcaaagtaagaaccatcatgcttgcactgcaactatcaaaaaggatttcagtctctgaagctcaaggagaggatcgaacaattaccagacgtatcatccgaaggaacatagagcgggagcttcagcagcagctcgcagcggagaaggcatcccttctcccacagcaacctcccgggatcatcctcccacacaacctccgtcacttccaccgcctccaccccgtccccctcagaaacaacaaaccgaatctccccggtgcccaattccacgcagcccccgaccatgccatggctcgccctctccccgtacagcctctccctcaccgcccgggccagctccagcgccccgccggcatccgcgctcccgacgtgcaccgcccccacgatgtcgaaccccctgacgagcaatcccctgatctcctctgcacggaaccacgagattgtcaagcgagagagcgcactggatagatagaggaaggtggcgagtgaggcgagagggttttacctgcttctcgctggagatcgggggaggaggcgccgtcggggagggagcggagggcggcggcgacggtgagaggggggaggaagcgcggggagccgaggagccagcggagggaaggggtgggtggggagacgagggacttcttcgggcagaggaggcggaggagggttggacggcggcgtgatccgccggcggtggcttccatcggcggcacagtcaatacgctgcctcacttcccaactcccaaggctcccaccgtttgctcgccagttgcgtttcggcttgggctttttttggcctacgggcggcacagctatgggcttcttgggactgtctatccatttgttgaatgatcccaaattttttatacccttagatttatatccaacggactataaaagaatggggatatttcgtttctatccttactttgatgtctaatattgattttacccctactttttagggttttcgtttttaccctcacttttttgaactgaatgcttgttttgcccctactttggatggtgaagttaacggtgttaagtaattgataaaatgatatttataccctcttatgtatgtacattaaatatgttttttacccattttatacatgtagatttggaactttatttttgggagtatatttaaaattagatgacacacattgactaatataacaatttggacaaattatgaatttgatggaattttgacaaaatttcagcattttgatagaacttaaacaaaattttgacaacattttgtaaaatgtaattatctgttccctttaaatattagtcaatgtgcttcatttaattttaaatatactcaaaaaataaagttctaaagctatatgcataaaatggggacaaaaacacaattaatgaacatatatgagagggtataaatattattttgtcaattacttaacaccgttaacttcactatccaaagtaggggcaaaacaagcgttcagtttaaaaaagtgagggtaaaaataaaaaccctaaaaagtaggggtaaaatcaatattagatatcaaagtaggggcagaaacaaaattatccctaaaagaatatagagtaaatttcacaaaactacatgtttcatggttcaagttgcagaaaagcacacacattctgacacttgtcacttaagtacatatattttggtagtttagtttcacaaaaccacactatcgatggatggattcacccctgagatgacgtggttattccatctaggatgaggacgtggcatcatattaatttcatgcgatggctggttataggatgccatatcctcgtcctaggtgaaacagtcacatcatcttgcgggtgaatctatacatcgatagtgtagttttgtgaaactacacaaccaaaatatatgtactcaagtgccaagtgtcaaagtgtgtgtggttttctgcaacttgaaccacaaaacgtgtagttttgtgaaatttactcaagaatataactaatacatatttacttacacattatttttatcaaaattacagtgcacttacatgtcatatcaactgaatttacaaatataattttagttatatagtactgtaattttatattttaaagaaaataacaaatatatatttaattccacaatatttttatcaaaattagaatttgcaaatgtaatttcagttatataggactataattttatattttaaagaaaataacaaatatatatttagttacacaatattttaatcaaaattaaagagcacttacatgtcatatcaactgaatttacaaatgtaattttagttatataggactgtaattttatattttaaagaaaataacaaatatatattgtatttacttacacattatttttatcaaaattacagtgcaattacatatcatatcaactgaaattacaaatataattttagttatataggactataactttatatttcacgacgatgacaacgagaggggtggcgtcactcgctcgctaaacagcgttggtcgtactgccggtggccagctcgatcagaggccaccttggcaccgtgcttctccatcatcgcgcgcgcgggctagctaggtgacataggtcgacgtgccagccgaccggcgggctgcatgcaacgtttgaccttgcaaattgccactcgcatcgcaagacccaaaaaaagtgtcaaatgccagcaaaaaaatcacacgagagatggatagcaaaaatcgttcatggtttagctcttggacatgaaaaaaatgaatcttccagagaagatgctactcactcaatttcaggttacaaatagttttgactttgttcaaaattaaactgttacaagtttaactaagtttataaacaaatatagtaacattcacaatactaaattagtttcatcaaatcaataattgaatatatttttataataaatttatcttggttcgaaaatattactactgttttctacaaacttggtcaaacttaaagtagtttgactttgacaaaagtcaaaacgacttataacctgaaacggagggaaaatattcattgcagttgagtaagagaaaaaaattaaacaacgtgaaatgtcaaaaatacccttaggcccacttatcatatctttcttcttcctcccctttgtcctcacaaacctctttgagatatgatgactacacaaggtcggtgcatcgactcctaaatgacaagagctcttcaacaagtataggctataagcccctctttgtttaggtttatatgtcataagtctaaagctaaacgaacaagcagcttttgatttgtttttttaaaccataagccactttaacactattaagacaaaagctatgtttgaagattttttatttcttatgtgagatagaggtatggttccaacaccaaacttaagatattaaatctactaacttataaatcattataagccaataagctaaccctaacactactggagtctccaagtctggagagggagaagctccctagtgccaaaaaggcaaaaacccatggaagcatcacctaattcgtctatggagccatgtgagatgagcatcacccatggaagcacatgagaaatacggaaaaaatacggaaagaactctgtctggccattgatttccgctaatcattctggaaagagaattaaaggatgcattgcaaatccatgcagatctaagtattatgcaactcatgtgttacatgtgtagtccataggggttgcataatattctacaagagtgaagacataagatatgtggaggggatcattctcattcattcttttatcggtacaatagtgagcctcctctcctttatataggaaaaagtacaccataggtccctcaacttgtcttcgagttacaaaatcatccttgaaccacaaaaccggatatgacatatcccctatgtcgaggagtgaccctctctagcgggaggacgtgagacccccctttgtgagttcggccaaggaattgggcgcgatgatcgggagcgcgatgtttacttggcgaatcggattcgcctagggttaggctagcgaggtgaatagtgatcgagacagagacaaggtattatccaggttcgggccgctgtggag

SEQ ID NO: 65323 - DNA, 692 bp, Oryza sativa
ccgtcctggttccggccggacggagtagttctccgcgactttaaaaaagataggttagcaattgagatatatatatatatatatatatatatatatatatatatatatattgcagtcttaagctgtgtaggtttgcaattctaagcctcggctaaggctccgcaagttgctccaaattccgagcctctctacggtaggctctgcgttcggagcccgtggtaggctgaattcggagccactcaaaaaaaaaaaaaactacgtacgctcatgcacatcaacccgtgcgttcaacttcggctggcctccggcgcggggcatgcctccacatcgagctccggcttcgaccttgtgaccccgctgatgcgcgataggccgtggctccttgccggctccacccaacggcgccgggagctagcgccgcgccgcgcttcggcctcgcgtggtgggccttgaggcgccgacaatgctccgcgtggactcggcctcgtcgcgccgccgctgttccatgcttcggccatggcgaaacagcgtcaggccccacgacgccgcttccgtgtcgtgcttagactgcttcgcggaggcttcgtccttgtgcgccgccgctgaacaacggcgcggctactagcgccctcaggccgtcagaagcgcaagaaaaaccagaaagaaacatataggtggtgcgcggcacagca

SEQ ID NO: 65324 - DNA, 2459 bp, Oryza sativa
agcacaagatgaggagtgtgggatgaggagaaatggctggggttcatgccctatttatagggcgaaatttgagattttttggaattttttcgaattttttatgaattttttagcctcccaacggttattttcaaatttgaacggtcaaatagccgttagtgccacgtgtcgccttcccgttggaccgccgcccgccctgtcagtctgtcacgcgccgccggcgcttttcggcctgacgggccgtgccgggccgtgccgtgcgcgggccgtgccgtgccggcctgctacaggagccgtgccgtgccgtgccggcccgcgggctcggccagcggcccaagcacggcacggctacacgggccgtgccggcacggcccgttactgtagcaggccgtgccgggccgtgcctgctacaggaacggccgtgccgcgggccgcccgtttggcccggcccatttggccacctatactttggccccactcccaccatcataaaataaaccagcccaaattacgattacgatgacactacgctacgctaggtaagcttatacttattaaattattgtaattattgtagagacaacattgcaaacacaatccaatttcctattaatagttccacgactttgagaaaattgtgacagtatcaagtaattcatgctagcatttttataagaaaatgcagtgataactataattgtacgtatcaacatgtatcagtgatcgatcctgtatttagtggtggttatattaaataccatcaataatcatctcaataaagaagagagaggagaaaatgtgtggaacggtgaataaataatccagtgttaggattaatcaagactgatcgaggcccttatcacggcggggcccagggccaccgcaccactcgccctaccccagggctagcgcaaaccgaactcgagccaagcacccgaaaccgaattcgagccgcgctgcggatccatcacaaagcccatctacccaaaaacccaatcatatagcccacgcgcgggcttggcggcttgcccccgtttgcgaaacccgatcaacccccaccgtcgcatccagatcgtacggcccaaacgcaccaactcgaaaatcccctcctcttcctccctccctccggccctcccgagccctaaccctagctctctctccccatcaccaccggcggccatggcgctcgccatccgcgccgccgccgccgccgccggcgacatggcgccgtcatccgcctccgacccgaccctcgggttcctcaccaagcgggacacggaggtgaagctgccccgggcgacgcgcgtgaagaacaagaccccggcctcggtccagatcaccgcggagcagatcctgcgcgaggcccggagcggcaggagcccgaggtccgtccccccaagcagaagatcgccgactccgtcgagctctccgagtaccgcctccgccgccgcaaggagttcgaggacgccatccgccgcgcccggtggaacgtcggcgcgtgggtcaagtacgccaggtgggaggagcggcagggggacttcgcccgcgcgcgctccgtctacgagcgcgccctcgacgtcgcccaccgcgaccacacgctctggcgtggcgtggatatgccgagttcgagatgcggaatcggcatatgaaccgaatgtaatgtgtgtgatcgcgccgtctccctcctgccctgggtggaccaggaccagctctggtacaagtacatccatatggagcaagtgcttggagccgtcgccaacgcccgcaaggtgtttgagctgtggatggcatggcgtcctgacgcagctggttggaactcgtacatcaaatttgagctaagatacggtgaaattgagcgtgtgcgggccatctttgagcgttttgtggccgaacacccgcagccacatacattcatcctgtacgcaaagtttgagatgaagcgcggagaggtggagcgggcacgacgggtgtacgagcgtgcagcagacctgctggcagatgatgagcatgctgaggttttgtttgtagcctttgctgagtttgaggaaaggtgccgggaggtcgagcgcgcccgtgcagtgtacaagtatgcacttgacagggtgcccaaaggccaggctgaagagctgtacaggaagttccttgcctttgaaaaacagtttggtgaccgtgaaggaattgaggacgccattgtgggtaagaggagattccagtatgaggacgaggtgaggaaaaaccccctcaattatgattcatggtttgattacattaggcttgaggagagtgttgggaacaaggacaggatcagggaggtgtatgagagagccattgctaatatcccacctgcagaggagaagcgttactggcaacgatacatttatctatggataaattatgctttgtatgaggagcttgatgcaaaggacatggaacggaccagggaagtttacagcgagtgt

SEQ ID NO: 65325 - DNA, 3687 bp, Oryza sativa
ttggagacttcgtgggctcacgccgtggggcgcaccgacctgcatgtcgatcccctgctgctgatgagataggacatacctgcccccacgccgcctgacacaaggtaggacgtgggtgcgctgctgcctgtcccgtccgtctgtcaccggtcgcagaccggtcaaggttgcctggcgcacgtctctcattgggcggcacatgaccagccacatcgcattaaatgcaatagggggcggttggggtgccgcccatgaatacgcctggcagcgcccgcgtctccgcccgctcaatccctcacgtggcggccgagcgagggcctcggggtgacgccgcctctcgggcccgaggggtacgacgagatcccccgagcctcctggggagacatgggcaccccttggctattcactatccgtgcatccgatcccccgatgggggatccgggccacgcggccacgtggtagaagggaaaggaccccttcccctcagcgtaggtatccccgggcctatattaccgacaccctaacttacaaaaccagtgcaaactaggtccctcagcaattttaactccggttttatcctatgtggcagctgactcagcgtgggacctatgtgggccccacgcatcagcctcttcttccctcccctctccacctctcttcctctctcctcccttctccaatctccacgggcggcgcgtgggggagcagctgcactggcggcagccagcggggcaggagctgggcggcggtgcacgagctccttgccggacgaacgctagaccggctccgccgcgcccgccgcgaggaggtggcgcgccttgtcggctcgctcagccggagtgccgccgatggcgtttacgcaaatgacctgagaatttgagatcattgccatccacatgttctccttcaagccctatcaacaagattgacacgattaagctctggatcgagatatgatcgatcgcgcagcaccgacgaactagccgctgatcatcgagtcaaatgctcacatctcataagctccaatccacgtggacgaatcaatccattaaacttatatacgcatgcacatcacgcatgaacaccacaagaggacatgaagcttcacctgcaaatctctctataaatacatggcaaaaccatcaacctagctagcacataacaacttacacatgggcctcatgcacgcactcctccccttagcagcagcagcattgctgctccttgccgcgccgccgccggcgacggccgacgaccaggggcggatcccatgtgattcatggttattcacgtgaatgcccatagaattttaccaaaaaaatatatatatatataggtatgttatgcatatatacgtaaaaagttagaggaaagtgcagcatgtatagcccaaatgaaaaaaagcccacttattagcagcagcccgtaaattcctccccaccttgccccagcgaataagcccactgctactggcccaaaaagagactaaaccctagtcccaagtccacactccacccaaatcctaatccatgcctccactccccgccgacgggcgacggcgcattgagggtcggcgctcggcagttcggcgacggcgcgtcgccactggcctaatctccctggttctgggctccctgtcccggtgtccccagtctagttctcactcctcccaatccacgcctccactccgcaacgacgggcgacgtcgcgacggccgatggcacatcgagggctcagcgctcggcagcttagcgcgtcaccaccggcctcatctccctgactccctgtccctgattcgacgcagcatcgccatcaccgaagcccagctgccgaggccttccgctgccgccgccgcgccgccgagcggccgaggcgtcgtccggtcgtcgcctcacacctgaggcctcgacggcgactgccgacgctgagcagctgagggatcaagatattggtaatgcaattgaactaattaatacaaagatgcaattgcagctattgcgtgaggatgatgaagatgaatggtaatcttttctgaaagatatgccacttctttttgtgtgaagcatggcatcaaagttgttgatatggatggcttctacaagccggttggaagatctaaaagattattcaaaaaggtcaagaatttccctcgcttccatgttgacatgttttatgtttataagcatcattgatagacaacttcgagagtttaatgatagatttgatgaggtaaacacaaagttgcttctttgcatggcgtccttcaatcctattgattcatttgctgcttatgacaaggaaaacttggttaagcttgcacaattttatccaaaggatttcacaaaattagatacaaaggatttgcacaatttatttcatttgtgatgtaattcattcaaaccatttataatttagatatctttacttttgtgctactgtttgtacctttaaacatgtcattgccactatgttgttatgctattatttatactttaaattttgccagtccaattttttgagttctgtaagattttttttcaactttgaataccctttgctgaaatcctggctccgccactgccgacgacccgggccttgccgtctactagggccgccacaaggaagaaggctccctgagagaggcctgcgacaccggccactacaccaccgtcatcatcaccttctacaacgtcttccgctacggccgatactcgtcgacatctccggccacctgctcaccgccgttggcgctgacatcaagcactgccagtccaggggcatcaccgtgctcctctccatcggcagccagggcggcggctactccctccacatcaacgcctccgttgccgacatcgccgacaacctctggaacgcctacctcagcagccaccgcgctggcgtgcaccgccccttcggcaacgacgcggcggtggacggcatcgacttcttcatcgatcagggcggcgccgaccactacgacaacctcacccagctgctcaatggctacaaacagtattacatcgatagggcttgaaaacgccgatgtagtcctgcaggttgaacgtgctggggtgagctccgccgtctcggcgaccacgctctgcatctcctccgtgtcgttgtcatcgccggtccaccgccggcccatcagcatgcgagagacaatgtcgctggtgaggcccatcagctcctcccccgccgaccgtcgctcgctcgccgcctgcgcccagcccgcacaccgctccgccacctgtcacccgcgcgcggctcctccccacgccacctgtgcccgccgaccgccgtccgtgcagctactcccccgcgcgccgcccgtggatatgggagaagagaggagagaggaagagaggtggagatgggagggaagaagaggctgacgcatggggcccacgtgggtcccacgctgagtcagctgccacataagacagaaccggagtcaaaaccgccgagggatctagtttgcactggttttgtaagttaggggatgcgtcattgtcacgccctgaagttcccctcccttgctttaaaatttgtaaaataaattgccggaagaaattgtttaattaacctagagctaaatccctaattaataaatgcaaataataatcagaatcggcatgtggaatttttcttggttccccatgctctaatatattaacatgagtttta

SEQ ID NO: 65326 - DNA, 3094 bp, Oryza sativa
tttttccttttgtcgccgcactctcccgagcctctattgccgccgcgccgctctctcctagcgccgagccgcgccgccgcccttcgcgccgtgcgccgcagccttccgcgctgtccgccgccacctcccatgccgccggtcaccgccagtgacagtgagcgccgccgccgctagccatggctggccggccggcttggagccgagccgcgcccagcagccacctctctctccttgagcctctgaccggtgggacccgcatgccggcccctctccttccccttgtgccgctgacatgcgatgcccgcttgccggcgcccaccccttgctgatgtcatccacctaggtttattgcgcaataaatcaattaaggccttttctttttctagtaaaaatagagataatcttctaaaaatcatatctaattcatccgagctctgtttaagtccattcaagtctcagtaaattcaaaaaaaatgcaaagaatccattaaaaatggttttgtttcttatttcagtagtcttatatcatgttttgcttgtgtgctttgtttgtcgcgtagatttcggccgtttcgtcgatccgcgggctctcgaaggcgttgctgaggtctcatcagcgcgagaacaaggcaagtcatgcattacaattgatcatattgtactcaatttacaaatatgtcgcattttctattaaatgttgcattattttacaatatcatgtgggatgggtcctattctcagccatatgttgttcacctcatgccattgataacttcggtattaaaatgactagatgttggcttaggagatgcttagccatgcttagttcaactagcacacaatggaggaaatacattaatgcatagacttcaggttctagtattgatgttggattagtgccaccgcaatggtgttaattaattaaaatacactacatggtgggttgtgggtgcatggtttttctagtcgtgcccatggcgattaaggaccatttcgcgggatgccctggaagaacttatcttatttaccacaagccagcgtgggcaatggctgggattgtagtgtagtgtagctttcctctagccgatgtacccaggcaagggtgggtgtgatggagttgggtcggccggggtgttcggttgatcggctttcggattcaccatggtacgagaggggggccgcccgttgcctgctggggacgggggtgaaccctgaggtgtggtgcgatctgttagagggggttatgcgaagggtcctgtcacgggctctttccggtatgtcgtggtgcatgtcggagcacgaaaacgtgttgtggggccgtgtcttgtgggttataagttcatgtgccttaatttggttttggtgattaatgacaaatctagttatatgagactaacatttttatgagcttttctttgactagtctcatttggatatgaaagtaaaaatgattagaggtatgtattaaacttcacatattctaacttggtctctcttgtggatccaaaatatagtgtgagctccctcattgatcttgattgattatgtgcatatgtgttcctttatatccatatgtatgcacatcttgagggggagcttattctatattttgtttattataagatttctatcttgatttgaaatcatctttcatctcatctctctatattgtttatatcggattattatctatcacaaaagagtgaaaagattgaaagatcttggattaaacaatttgtgtaattgttgctttggtgatagatgataaaccgatgtttatgggattaacctctcttttacataagttttcaacaaggttatttcccgataatgagatgtggtagatatgcattctttggtgatggaccttaatcatgacaaggatgaaattcatggagataaagtgatatgtatcacttcttatctcctactttttgataggttcatatatatgatttccatgttattgttatataagtgtgggactaatgtttacttgagccttatcttatttagtctcctttacattgagaatatggagatcatgaaggtatgtgtttttttggtttatctttgtcattgctacatgccttctccatgtgtataggataaacccattagttcttcataacttatgcatacacttgcctctcttgtatatttatttgtatgcatatttttagggggagcaaatcctatacatttattgtgcatgttttagatccacgttgttcacctattatttatattggatctttgcatttgagcttgcatacaagtatatgacacttgcgatgttaatgaatactcaacaaacatatccacatctttcatatgcaaccggttggtcaccaagtggaggatgacaaccgatttgttggtactaatgttcttctttgagatgtgcaaaggaataggtctaattgtgatgaagctaatggatgacaccatgggttgatggtcaccaagccaagggcatcgccgtgtcgacaagaatgaaatcaagcttgtgatgagaagaaagtcttgacaaatgatggtaaataccttggtataaacatggttgaatcaaatggtcacaagtgttgatctcgactcaagcttgaccccaagatggatggcgcaaggcaaaggtataatgtagctaagaatgttttcttagtcttttcccggtcttggtgtttggtgtagaccagatctgctagataggcgccgtactatcaagaggggtctatgaagcgagcttgtggatgatcttgtgccatattagttcatatgcatgtaggtgcatttggtgggcttgtctagccaagtgtgatgagttttctcaagtcctaaacaagagagaagtgggcatgtccaataggagtgaatgacattttgtggatatgtacggtggatatcctttggagtgtgagccctttatccttgacttaagttgtgtttcttggatagtttttcatgggttggatggccctttgaataagctttccatagagtccaagaacgccaaattccgagacccgagtcaagagatatcgctgttttaccaacggtcggttgagcagaaaagtgacctgcggtctgaccgtgg

SEQ ID NO: 65327 - DNA, 1642 bp, Oryza sativa
tacacgagaagaaatagcacaaacatacgtatcccacaggttgaatacaggaacacgagagcgctagccaggccgttcccgctgaacgggcgagcggaaccgcgatggtcctacgggccgaaactgtgaaactgtgacagtcccgcggctcaaaaacgcagcaccaatgcagtcctgcggttccattgcgcggaaccagctctgtgaacagtagtaaacagagttaaacaataactaaataaacaatgttttgaacggtattaaaaactcatgcgtgcttagatgccggtgccgcaccaccggcaccgcaagtggtgccgtgcgaccaatctgcaggaccacgtcggtcccgcggcaccgcccctcctgtccgttccgtgccttcgagctgcactgatggcacggtgccgtgttcctgtaccgcggaaaatgtatatttctgtaaatgcatgtatatatacaaaatagagaaaaataatgtatactttaaaatttaattgccggctgtgatgttctatcactaattgttttggctctgacgttgcagatatgatgaggttgcaatgttagtaggatgtggatgggtaaagttaggagcatctcttagttgcagaggagattccaaatcaagcgcccaattcctccaaacgaatcggacgatcaaatgtttcagtaaaaataaacaacaattaaaacttttaaatcttgtgaaccccctcccgtgtcgacggttccttcaccgccgtcggccgccgctcccttctctacccgctctcccgctccccctaccaccacttcccccgccgccaccgcctccatccaactgccgcacgtcgttcatctcaagttgccatatgttcatctggactctgaaagctggccttggtctgcttcattttggtgttgttgtgtctccatccggagaccagagcccgcactcactgctagttgccatccccaacctgccccaatatttctccaggttttgttgctagctctcgatctgtacacgctgtgggataattgcttgttgacaagtaagatcaaatcctgatggtggaagaatggcaccccattttgtttttgtatcagggctgcatagagtataaaagctttgtccccctatgcttgcactcagagactcttccattgctgtcatcgcatatggtgttgcaacttgcaagtaacactgtcatctcaatgtgcttgcacgggtagcatacatattctcactaactgctcttacactaacaaggatgaatcagactagcagagagagagtgtcgaaactagatttcggcaataataaaagggggtggctatcaagctggaaaagtgtatgggtttggagacaaaggatttatacaggttcaggccttcttataaaagaagtaataccctactcctgtccggggatgaatccgccgagtgtattattgattgtatgatttgggaaaaatcaacatatgcccctagaggcacccggaccccccttatatatggggaggagtccgtgttacaaaagataatctatatccctaacggaatatgcagatacagataaaatacagtcgtaaccgactaagtcccagggtatttccttgatgcacaagttgagaaacaaacccgagatacacataaa

SEQ ID NO: 65328 - DNA, 17100 bp, Oryza sativa
tttccacggtgacgataaaacaaggtatggtctccattgcactgtttgtagcccatgccacacattgcacgtctaaatctatcaaaccaagcccttggtgactgctacctggcccctagcttcattttgcagctgtttatatagagtcacaagagcaaatcttggatgattcattagtaaattacctccattattatgcattaatgacgtgtgtgaggtttgattaatgaccgtttctcaaatttattgcatgagtatatcgttcaattaattatttttctatatcattttacctatgtcgtcgtttagtgtccacctctaccagcgcaaaatattccagtgttcaaacaggccttaatgtacccatggggtatgaagcaaaagcccattataaacataagcccatggggtatgaagcatgtcaagctaccagtgaagcccacgacaaaggcccaaattaatgtttacatgcaaaccacattcctttttcaggtcagaatattccctcttttttttttgtttcagccagaaataagaaaataaaagcagcacatcatctactcccattttcaatcacatttttacaccaactataaattgttgcagaacctgaagcaccatagatatattcaattcaaccgtaaacacatagaagcaaagggtaattgatcactgggtatacactgatgctattcctaatacagaagaaatggatgcaaaggatatatatatttcattcgctcatataccacgagagagcgatgaatcactgctgcacaacgctcactgtggttgccatcaatttgacatagtcctttctaatcttgttcagtgtcacgaccacatcgctcatcgccatcctttgctcgggggagtcagccgaacagagcaagcccagctcgaacactggcacaaggaagtcatgcatgttacttgaagaagaagaagacccatcctgtagaagtttgcagtccaccacatggacaagctctgcaggaaacgcctgttgaacccactgcctgatgttcagttctcccacaaacatagcatctgtgggtctcttcgcagtgaacacttcaagcagcatgatgccgtaactgaacacatcactcttccgtgatgcttttcctagagtcccttactctgctcaagaaaaattagacaccaaaaattagttgcaccctatctactcaataataataaaagatcgggcaaagtttgagaaagacaagaaaaactattaagtacctggtgccatgtacccaactgttcctggcatgctagctgagatcatggagttgtcatcacctaacaacaaccttgcaataccaaagtctgccacatgtgccgtcatatcatcgtcaaatagtacgttgctaggcttcaaatcgcagtgtaagaccacctcatagtgctcatgatgcaggtattccattgccattgacacatctagcataatatccaacctctcgagaaagcctaattgcttcccttgttctgagtgcaggagtgcttctaagctacccttgggcatgtactgaagtaccagtgctttaaagtccaggttggaacaagtgttcagaatctttatcaggttgcgatgtcgagccattcggagcacacgacactcggtgtcaaagcttctcatggcatgttccagatgctggtgtataacttttatggcaaccaccataccgttgctcaatcgtcccctaaaaacttttccaaagcttccgaagcccaacatgctatcatcgctgaaatcatcggtggcacgaagaagctcttgcaatctgttgattatagcttaccgggtcagggcttttgccccaatctgttttcgacagcatactgtcgttgtaagctctttaattgtattgtacccttcatttcttaatgaaattggtcgaccgaacctttcggctgacccggcaaaaaaaaaaaaagctcatgctaggagagcaattgatggctgataaggtcagccttaccagcagaagtattttgatggttagctttctttctaatcactacatacaggcaacaagctacaattcaactactatgattatagtaggtagcaaatattttagcatgtgaccattatttctgttgggggaggtggtttggcatggtgggaatcctaaacgggcagcaccacatagccctgagtttccttccaagtattgtaaagtgatgtttgcaaagacacctccttccggtatttgaccatgtagtttgttgaaagataggttcaagctaacaagggtcgtaaaattagccaagtagtttgggatggtaccagaaatactgttatgggatatgtccaaagtttgcaagccagttaaattaccaaaagagtctggaacagaatcatagaatccgttagctgatagattcaggtgtgttaacatctgaagttgtcctatcgaatatgggattctaccagaaaagtggttgtcagagagatccatgatggtaatttgcttcaaataccctacatcaaccggcagtgcaccactcaagaagtttcgagaaagatctagcctgacgattttatcaagatgaaataagcttggtggtatagttgacgttaatttgttatcagacaatagaaggtgctctagattagtgaggttcctcatgtcctttggtatggagccagaaatttcgttgctttcaaggaacagttttacaatgttccttagaagtgcagtattcgatgggatgaagccagacaagctatttccacttaggtcaagccattggagattctcaatcgtcatgattgattctggaattgcattgcgcagttggttatgtgaaagatctatcacctcaagagcagttaaatttgaaatggtagctggaagcgtgccagttaacttgttgttagataacgtgaaccatttcagctgtgacgacaggttcccaacatagtctgggaggattccggtgatataattcaggtccatttggagggtagaaagcttcctacaattggaaacagtagaaaggaagttgagatccccgtgtagattgttttcagtaacatcaactgccgttagtgagttcatgctatcaactgtcgatggtaatgatccatccagcaagtttcctttcagtagcaggattgccaacgatgaaaggttgccaagagaagcaggaataggtcctgttagttgattcatcgcaagatgcaaccatgaaagttggcctaggtgcccaatatctgcagggatgtttcctgttaggttgcacgtcgtcaaatctaagactgtcagcatggtgaggttgctaagttcagtagggatggggccagcatcaaagttattcccacccaaggagatggcatcaagattggtcaacctgcccagccatggtggcaaaacaccctcgaataaattataaggcatggcaataacttggaggtatggacacgctgcgagccccagtggaatctgaccaaagaaattgtttttactgatggcgaaccatcgtagaactgggaggctgaaacttgtattaccagggatagggccagttaaaccattcgatataagagaaatggtacttaatttagacatgttgaagatggctggtggcaccgccccagttaagttattggcctgaaagttaaggtgttggaggattggcaaggaaccgatgcaacccggtatcagtcctgacaggctattgttaccaacgttgagataagttagcaaaggcgtgttgttgaacagatcgtccggaatcgatccagtgaggtaattgtgacggagattcatgctgccaagactgtgcaacccctgcagctctgctgggattggaccgtatagctggttaaactgtagattaagtagctgaagcctcgtgaggttccctatggcgattgggatgccaccagacatggcattgtggccaagatcaaggagctcgaggcgatgcagccttcctatttcgttcggcaccgagccagcgaggccggtgttggtgaggttgaggatgaagagaaaagaaatgttaccaaggtgagagctgagttctccttggagcggtgacgcgctgccgccggcggcggtggctgctgcacgagacacccacccgccggcagaacggcgttccggtggtccaattgccggcaaggatgttgttaggatcggagagctgggctttgaaggccagcaatgcagcgaggtcggtgtcgctgccgttactcttgctggcgatcggacctagagagggagcacaaggcacagtactggacgaagcgattaacaacgccgcaacgaaaatccatactggcaatcgaacaagagccatgtctggttgtgtgtgatgcattggcagcaagagtatgcatcatacttcacagtgacgatcaagttgagctttatttagcacagtagtgctagtttgctttcgacatgtaggacgaccttgactgttgctctcagaaagcgaaagaaacttaaatgatactccttccggtcataaatatttgacagcactactaggtaaacgctggaaaataaagacatcacaaaatatatattcagcagatcgcggtgtgcacgacacgctagatatgatagctgtgtcgctccgtcatcagccataggctcactgaaattttttttttctgtcaaacaatttgacggcaacggccttacgtactcttttgttgattgggtggttagaacggcaacgattgtgtagttagagcaagtttaatagtatagcctgctactagcttcaaatcatctatagctaacgtaatagacaattcatacaatagttgtttactatactattaatatctggtctcacctgttatacacacattacgtcttgtaatccatgctgcagctgactacagatatgtaatctgctgctcttctctctcttcctttatttctttaaagtatgattatagctggtatatagcctacttttgtacttgctcttaagcagtttcaatagtattgctggttgccagctccatccatgtccacattaactagagtaagctagcagttaatctcgagatgtatttctttttcttgtgggacccaactgactagcatctttcattgcattcatctcactacttgtgggcctatggccatttttaaaaattgaaaattcctacctcgtagactttttcaccttagagctcatgtagagctggccgactattgtcacccgttcctactaccttttttcttctctgtcctacagcctcgttagttttactgagatggctatcggttattgtacccgctctcatccggctttctgatcttttttgcgtgcatgacagcctgaagatgtgctctctgaagaccctgttgtcttgtggaccttttgatgttctgttagcctggaaagcttgttaagtttttctgcttaggtgtaacgacccgcctctcccaggccgggcccacttacatcggtagcttttataggtcatagaatgccctcacaccacttacatctggcagcttttataggtcatagaatgccctcacaccacttacatctggcagctttcataggtcatagaatgccctcacagaccaacacatgtcttttctgcaacactttgtcctcactcgtgtgcacccgggaagaatttcccggtcggtcacccatcccaaattgcttcaggccaagcacgcttaaccctagagttctttggagattagcttccggaaaagaagttgcaacttgttgatatgagtattctattaatcttattaagccctaggccgggatgttacacctgtcacgccccgaactagccccgaccggaactagcccgtgacgctccaaattaacctgttaatcgataccagtcccaggaaacagtgctggtatcacaagaagacagaatatcacagcaacagaggtctctttattatagagtaggagtacagtcatgttgggctgcggacagatcccgagctcacaactgcattacaaaagggaagcagaagccaagacttggaccaaacatcacaggcgcgacttgggaactaggccgaaaccctaaaactcatcgtagccggcttgctcctggaagaactcctcgtcaacgggatccgcttcatcttcttcagcaactggggggttatttatatagagcaagggtgagtacagcagtactcagcaagccatgggaaataagtgtttaatgcaggcttcaaagaaaggctgttgtttttgcaattgattttatttgaactcttttctgaaacaatctaagggagtgcttctcaaatgacacggatgagacagtgcgtctcgtccgatcagagtatgtgcaatgtatcagtcttttaaattgatcaagattggcacccggccaacagctttcaaacggccacccaggtctggctgatctcatcagccgcagattttccaaccatcaaacccattccacaacagcaaatttcacaaggcagtagtcaaacaaaactacgctaggaatcacctcacatccgcccatgaccgtgggcacggctgttcgaacagtttgttaacctctgcagagggggtacactttacccacacgacattactaacccggatcacccagcccgtggggatcagccacgtccggagacctccaagctttcatgacaaggcatttcgaaagccgacacaggttcaccatatgccaacgagaggggtcccagaccaacaccagattaggtcccagaccatactatgccaggaagcccaggggtcctccccgacaccaccccgacgaatccacatgtctctcggcatcaaggctcccctgataagctagttactcagccaggggtgtcccattccacccatgtggtcgtacttgtcttatgttcggatgaaaattccaaggaaacggtccttaagtgcaagagcgggaaaccgtacacccggtacgttccccggtccgcggtgttggaaattcatttagttcgcaagcaccgacccaggtgtcgggttttccaagtcttttgtaaaacccaagttttacccaagatgtttttcagattttaagtttgaaggcgaccgtcgatactcgtgcaaagtgcacgatttccgaggcgcaactgggtggttacaagggaatatggtataacaattaacaaaggaaggatcaaatgcaacaaattaggtaggtccgccaatctgccttgcagacgagacaagcagattaagtgcgatcctatcaatgcataatatttttcaagcaacatatttaagttcaaatataggctcaagatgttcaaaggtggcttgcctcgctcgagatcttgagcttgatcctcgaaatcctcgcactgcaggtcttcgggcttcgaaactacacgcaaaacgggacaactcaacaaacggcgaaaataaagccctattaatgacctctaagcgtgccattagatagatctcgagatttgacgaattttggaagttgaacggagtcaaacggatttacggttgggaagatattgaatttctaaggttattggatttttggtctaaaggaaaaggatttatttaaatcctttttgaaaaagaaaagaaaagaaaagaaggagggagggaaattagacttccctcgggcggctagggcgtggcccgagagaaaggggcggctcggccgagcttaatgggccggccggcccaagaaggcggcccaaggcacgcgcgcaggcggggaggggagagagagagccggtgggccgggtccatcccgcgtggtcccgggtgggacccgcttgtcggtggctcggctcaccgtgcggagggagcacgcggcgcgcgctagggttcggggagagaaacgcggtgcacgcgcgcggttcgcggaggacgcggatgcggcgggcccacgcgcagcctcacgtctcgcggtggaccgcgcccgcgagcgtggtcggagggagcggctggccggggtcggctcgacccggtcttggccaacctggcgccgacgtggtgcctacatggctgccacccgggccggcgggaggtagacgacgatgtcggccgaaacggacggcggatggcggttgcaaaagacggggcgacccacggcgatccagcgaaagcaagcacaccgggtggttgcacgagacgaggggagacgacccaacggctcggattcgccggagggagctcgacggcggggattgcgatggcggcaaccgccggcgagggaagggggaaacggcgatgaggtcacgatgggccgattcccggcggtgagagcatctacgcggctacgggaatccgttgctagtgtcggattgggtggagcgacgccgagcgaggccggcgacgagcaggcgttacggagcacgggcggcgacggcggcgagcacacagcgagcggcggcaacggtcggggcggcgccagctagctacgggaagactacacatgctactaccgaaaactaaggggaggagatggaacgaggagagtgaacggaggaaggcactaccgagatgaggcggggcgctgtgacgagaggccgacggcactggagtgatctctccggcctcgggccagggagaggaaggagagggtgcgtccggagtccccttccgcgtcctaacgcgcaccggctcctccggcacacgcgatggcggcggccggcgagagagacagcaatggcgcgggcgagaaacggggaagattgggaggggaaagaggaagggaggcgcttgggtttatagggcggcgatgtcggtttggaaaccgaccttgggcggtcaagggagcgagctggcgctcgtcgctcgtggccaaaacggcgacagaggcggatgacgccggtggggaggggaaaaggaaaaaggaagggagaaagggagcttgccccttgccactttgggaaaagaaggagggagcgggggcgacgcggcagagggaggaggagctctgcctccgtcccttggaggctagcgcgtggagtggcgggggccgggttgtgacgacggcgatgacggtgggggcggtgtggagcggagcggcgacacgggcgacaggcgcgggcaggcgcggcagatgctgacggcggcagcgaccaggcggtcggccaccatggcgcgcgcgcgcgcgtaaagcaacgggcggcgcggcgatttcggcggcgtcggcgggaagcggcagcgagggaggagggcgctcagctcggcgcggttcacgcgcacgcgtgtgcagcgcacgggcagagcgggggagagggggagagagagagagagagagagggagatgggccgagagggattcggcccatcgaacccgagggaggcgaaatagacttttgcggagggatttgatttgggaaggatttggattcgggattgaactcaacgatagatcggggatctgagatctgagatggtacggacactagtcaacaagcaaagaaacggatttcgcaaatagggtttttaagagatagttttcccgctaggcgccacgacggaacgggcgctacattaggactgttaattgtggttgtttaaggctgaatgagccggagttgtgatgctgtgccgataatattccttttttatttatttattttggccagaaataagaaaacataagtagcacatcatctactcccattttcgtgatgcaaatttattgaccagcggttcaatcacatatttacaccaacgaaattgttgctaaacctgaagcaccatatatatatatatagagtattcaattcaaccatacacaaatacaaacaaagggtaatcgatcactgatgctattcctaatgcagaagaagaaaatgatgcaaatgatatgtatttcattcgctcatatacaacgacagagcgatgaatcactgctgcacaacgcttactgtggttgccatcacttttttgccgggtcgggtggctgccatcaattttttttttaaaccgtagccaggctaacttagagttatattaaagagaataaaaagtatttacaatatcatcaaggaaggaaggtgaaagagagagaaaaaagaaaacatgaagaaaaatagaaaagaaacacacactaaataaaatgaaaatctaagcggatattctcgcaatattttttgccccacacatgcgccataacttgacatagtcctttctaatcttgttcagtgtcacgaccacatcgctcatcgccgtcctttgctcgggggagccagccgaacagagcaagcccagctcgaacactggcacaaggaagccatgcatgttacctgcggcggctacacgatacaccaacccactggcagaacggcgtgccgacggtccagttgccggcaaggtgaaggatgttgttaggatcagagagctgggctttcaaggcaagcagtgcagagaggtcggtgtcgctgctgttgctcctgctctgacctagagaaggagcagcagcagcagcagccacagtggatgaagtgatcaagaacaacacaacggatatgcataatattggagatgcaaactccatgtttgggctctgatgcattgccaagatgatggttgcattgtttatggggattatcggcttgagatttatttagctctccattcctcttgtgcatgtatgtatgctgcatccaaccatctatgaccttcaacatccaagactttgactatcagtcaacctgaggtcaacaattgcaggaaactacattatgaatcttttttttttctggaatacttctttgtgcacttttgtattaagagactgtgaaccttatctagctcctgtactgttcccattttaaaagggggtgaaggagaccttgatgaaaagaggccaggattaggatttgtagttgggtaccaatctgagccgttggttcttgtcgccgggaacggagaggagttcgccgccgccgccgccgcgggctccctgtcctacccaggaccctgccaccgctcccacctcttccgctgccaccatctccaccaactgctcatgcggcccccatccccctcttcgctccgcccagtttcaagtcgccgccaagatccaggacctcctcgacgcggcgcgctcgccggagtcagcatccccaagatgctgggctgctttcagtccctgatgaaggatttcaaggtatttgatctctgacaactccatgaaaacgtgtctgcttttcacaactcgtatgctgatttgaaccatctcctgtctcttcacatcctaatcgtggtagctaattggcgtgattcttcacttatctatctatctatctatctatctatctacccattggttgattaattcatctagatatttttgttcttaccaaagattatctcttggactgttgcgtactcgttgatttcggtatcatcgatttgtcctaaataataagaactataatcatatttccatttcccgtttgggcagtgtgttcattgttctctccatttcaatgttataaatcaaacattgcaaatcgtaaacaagatagtaatatataaggaaaactatcctgtgacctatgactatgagcgtatctatgcaacagatcatttcctgccatgtcatggtgcaaatttatgtagcagcagatcaatcacagatgtacgcaatttaactattgtgtaactaactaagaaacagaagagatttattcatattcatccatacacataaagaagtaaagagtaattgatgctattcttctgttattcttaattaatgcagaagcaaatatggatgcagaggatgattcgttctttcgtatacgcagtcaggcagggtcaatggaacactgctgtttggttctcatctcttcccatagttgctatcgacttgacgtactccttcctaatcttcttcaacgtcacaacaacatcactcatcaccattctttgctctggcgagtcagacgagcagagcaagcccagctcaaacactggcataagaaaggcatcaatgctactggtagaagaagagctgtcctgtagaagttggccatctacgacatggacaaggtttgcaggaaatgcctgaagaacccactgcctgatgtttagttctcccacaaacatagcatctgttggtctcttcgcagtgaacacttcaagcaacatgatcccatagctgaatacatcgctcttccgtgacgctttaccaagggccccgtactctgctcaagaaaaattggtcaccaaacattagttgcaccacttgataattactctataaaagatcaacaggttttatcaagcacaaatgcgactaattacctggtgccatgtacccaactgttcctggcatgctagcagaaatgatggagttatcatcacctaacagcagccttgcaatgccaaagtctgacacatgtgctgtcatatcatcatcaaatagtacgttgctaggcttcaagtcacagtgcaggaccacctcgcagtgctcatggtgcaggtattccattgccagcgacacgtctagcataatgtccaacctctcaaggaaacctaattgcattctttgatcagagtgtaggagtgcctctaagcttccgttgggcatgtactgaagaaccagtgctctgaagtccaggttggaacatgtgttcagtatctttatcaggttgcgatgtcgagccattcgaagaacacggcactcagtatcaaagcttctcagggcatgttccagatgctggtgtataacttttatggcaaccaccaaaccgctgctcagctgacccttaaaaacttttccaaagcttccagaccccaacatattatcatcactgaaatcattagtagcatgagcaagctcattatatgagagtaattgatgatttatagtgtcaaccatatcagcaggattctcttgatgcttaactttcttcctaatcattacatataggcaacaagctacaactccaactgatatgaatatagcgagaagtaaatattttagcatttggccatttcttttgtgagaggtttggcacagtgaaaatcctaaacgggcaacaccacatagccctgggtttcccaccaaggattgtagcgtgatgtttgtgaagacacctccttctggtatctgaccatgcagattgttgaaagacaggttcaagcttgtgaggatggtaaaattggccagatattctgggattgtacccgaaattctgttgtgagatagatccaaagtttgcaagcctgtcaagttgccaaaagaatttggaatcgaaccatcgattgaattggttgataggttcaagatggttatcatctgaagttccccaatcgaatcagggaggctcccaagaaagcggttcctggatagatccatgctgtttattcgcttcagttggcctatatcaattggcaatgcaccactcaagaagttttgagacagatttagctggataaggctttcaagacgaaataagctgggtggtaaagtggatgataattggttattagataaccttaggatctctaacttggtgaggttgccgatgccctttggtatggagccagagaatttgttgccttgaaggaataaatgttctgcattctttagcattccggcatttgatgggatggagccaaccaagctatttccactaagatcaagctcaaggagattctccatctccatgattgactctggaattgccccttgcagttggttgtctgaaagttctatcactctaaggccagttaaattcgaaaaggaaggtggaagttgaccagttaacttgttcctatgtgatctgaattcttgcagtgtacctgataggttcccaatgtaatctgggatgcttccagtgaagtaattcatgccaatatagatccaggaaagatttctacagttggaaaacgtagaaaggaagttgagatccccatgtaaacggttttccgagacaataaagtctgttaaatagttaatgttccctattgatgctggaaccgatccatccaactggttttcgttcaataccaggcgtgctaatgaagacaggttgccaagagaagctggaatcggtcctgttagttggttccctaaaagttgtaactcccaaagttggtctagctgtccaatatccaccgggatggctcctgttaggttgcaaccgttgagatctagtgcagtcagcatggtgaggttgctaagtcctgcagggatcggaccagcatcaaagttattccaactcaaggtgaggccagtgagattcctcaacttggacagccatgatggcaaaacaccctcgaatagattgtcatgcatggaaatggtttgaaggtatgggcatgctgccagtcccattggaatttgaccagtaaaattgtttatactaatgtagatccgttgtagtgccgggaggctgaaacttgtgttgcccgggatagggccagttaagccattcgaggcaagagcaataacagttaacctagacatgttgaagatggatggtggcactgggcctgtgagattattgtgctgtaggacaagccactcaagcatgtgcaaggagccgatgcaacctggtattggtcctgacaggctattgttgcccatgatcaggcgacgcaatgaaggcgtatggttgaataggtcgtttggtaccaagccagtgaggtaattcgtctggatatttatgttgataaggctacgcaggccctgcaactctgttgggattcgaccagatagctggttaaactggagattaagaagctgaagcctggagaggttccctatggtggctgggatgccacctaacatggcattgtggccaagatcaaggagctccaggcgatgcagccttcctatgtcatccggcaacaagcctgtgaggccagtgttggtgagattgaggacggagaggaaagataggttaccgaggtgggagctgagctctccttgcaggggaacgttcggcagctccagggcaacgacacgctgctgatggcggctgcacgagacgcccacccactggcagaacggcgtgccaggggtccagttgccagcaaggatgttgtcaggatcatggaactgcgctttgaaagccagaagtgcagtgaggtcagtgtcgttgttgctgctctcggtcagacctggagaagaagcagcagacacagtggacagggggatcaacaacaaagctgataagcatactagagatcctaaagccatgtttgggctctgatgcattgccaacaagatggcgctatttcaagggatgattggcttatatttatccaatacatcattccgctgtgcatgcagtcatcgccttcaattgtaaactcttttccctaccttgcttaatcaatcttgtcggcgtcaatctggttgctcggtgatgaagtcaaccaagaagatgccataatttcaggggatgattagcttgagatttattccactgctcaagtaaacatctgccaccttcaattataaattgttttccctccattgctcaataaatttgttggtatcaatctgctggtctggtgcggtgaagaaatcaaccaagaatatggcattattttagcggatgattggcttgatatgtattcagcgctcaacattaccctgcccttgcaaccacatggtatggtgccttcaattgtaaaatgttttcacttcccatatgctctataaatttgggtgtcaatccgcggccggcgaaaaagtcaatcaagaacatgacattatttcagaggatgattagcgctgagatttatggagttctccattctttgtggatgcaaccatctgggctccttcaattatgaactgttttccctccatcgttctatacattcgggcagtgccaatcggtggacccggcaaaaagtcaaccaatatgtcattatttatgattggcatgagaattattcagtttttctctatatctactgaacgtgtcattgttttgttgattgcatccatccggtgccttcaattataatttttttcgcctacattgtactccctccatccctaaatgtttgacaccgttgatttttttaaacatgtttgaccgttcgtcttatttaaaaaatttaagcaattattaatttttttcttaccatttgattcattgttaaatgtacttttatgtatacatatagttttacatatttcgtaaaagtttttgaataagacgaacggtcaaatatgttttaaaaagttaacggcgtcaaatatttagagaatgagggagtataaatttgggcagtgtcaatctgccgaccagcagccagaggtgaaaaggtcaaccaaccaagaaaatgtcactatatcaggggatgattgggttaagatttattcagctttccattaattatgccttgcatgcaaccatttaatttggcgccatcaattataaactgttttcaagggaataactagtcaatctaggcattctggtaaaagtatgcatctccgttgtctggctgtatagatggacatgtgttgacagtaatgttcaggttcagattatatgtatcctgattcctgaattgagtactacatccttcggttacagaaatatgtcgcccgccgtccgccggtcgccagcggttgcaatcttcacaatcacggtggtcacacgcctgtgcgtgagtgtaagacggaagcagatcctctaatatgaactccctactaacgtgatcactgataggtgggcccgcaaccgcaagcgatggggccctcatgtcagccaccatgttcctcttattttacttcagaggatcctaatccgtgtgagataggggtgaaaacgatatagaaactttccggattccagacttattttcgaaaacggaatctatcagtcgtaattttttcggaaacgtaaacgaattcggaaatattttctcggaaacggaataaaaaatgataagggcaattttcgctggaactcagaatcggtcggaaacttttcggaaatttttgtgactgaaatactctggattcttttttttaagcactaaatagtgaataccatgttatttggctgttattttttaaagagtaaatttcaaaaaactatacgttttgtggtccaagttgcaaaaaaccacccactttgacacttgacacttaagtacatatatttt

SEQ ID NO: 65329 - DNA, 2126 bp, Oryza sativa
ctttgcagtcaaccatcatagcctgctcaaagataataatccgagtgcttcaaacttttcatgccaaggcctgccgagtagtgaagacgaagactgtaaagggcgaaaagataaagaatatggtgcatcgaatagatgcacctaattaggtatagcccccaactatgtgattagtcaacaaactaaacatatagttgagaacaaaataatagcataattatgcatcatatgacaaaagcatacgcggcgcctaaagaggcattccagccgactgcttttcagccataataaaagaaatccgagtggttaacactctaaaaagttcacgaatgaacacacttgacaggcatccgaatataagactctaaagattacccaccaaatattataaaaatcatggtaatgaataagtctaatagcctaggctatgactatttaccataatgaaaacaggcatataacataccgaggaaatgactatgataaaaacaagtcattccaagttaacccagacagcttttgtagcctaaaaaagcgtacaaaaacagcataacgcctttctgtcgggcaccttttaatttgcatcgcaataattccaaagaattatatgaccgcgtaaaaaggattttatcagcattgggcaacactattgtgtacataaattgccaaagcaaagaatgcctaagtccctaaggaacacaatgggccacgctgttaaaagtattgggctgaggtactgttcaggcctaggcccattcgcacctccgatacccttaacaagaaaacccgagatccaaacgacgcttcgtcttccccgccggaactctcgccattttccccactccttgctacagtacagagctgggccggcaaactagggttcaccattccactcaaatccaccttcaaaaagtgatcaaaatccttcccgtgatccaccgcctcaattcctcacctctcccaagccatccctcgaatcaaatcagcgcattcggggaaaatcgatggcggaagagaaagaaagcttcgaaggccaatgggcgccgtccgacgtgacggaggagaacctgaaggagatggtggcgcacggcgttctccctgccaaggagatcatcgggtggcggccagcgtgcggtgaggcttttccgacccccgatacacacgaggtcgtggtcttctctcatttcttttatggtggatttgctcttccaacctcaaagttcttccgtgggatactgaatttctatggaatcagcgtacatcatttgaatccgaactccatagtccatattgcaaatttcgtccatgtctgtgaagcttttttgggcattagacctcattttgctctgttccgccgaatctttttccttaagcctcaaccgaacaaaaacaaaccatgcgtagttggtggggctggatttcaactgaggggcactctgagccagaagtatttctctatgcctttcaagacttcaaacaaaggatggcacgccaactggttttatattcaaaatcccgagcccgctcttcctgagtactcctgtcttcccccagtataccaagatacctggaactctcttcccatgggagatgaagccgcccaagccttagaactgatggaacgcatgctgaagctcaaagagcaaggcttacagggagagcaaatcactcggcatttcattaagtgtcgattatctccaatcaaagagagatcccgcacagcatttgagtttgacggcaagcatgatccaaaccgtgaagacccagactctctggactttaaaatcatgaaggagagaatgtataaaatcttctcaaatgctattgtcgtcagctactcacatcagctgccagttgtaccatataatgcattcaatccgcctccgcaggtatgtatctgaaaccttcaactcatgaccaaaacataattttatcttcatgttgagtgagctaaccgtggaagcatctcattcaggagtacgtattgatgaaatctgatcccccaattgctcaacgccgatctcctcgccagcacaccgttcagggaagtggagggccgacaatcaggtcagacccgcaacctcaaacctccaaaccggctgggcagacaggttctcgcaagagaa

SEQ ID NO: 65330 - DNA, 15582 bp, Oryza sativa
ctatcaatgaaaggattcacccgcgagatgacgtggctgtttcacaaaggacgagggcgtggcatcctattaccagccatcgcacgaaattaatatgatatgccacatcatcatcctagatggaataactacgtcatcacacgggtgaatccattcatcgatagtgtggttttgtgaaactaaactaccaaaatatatgtacttaagtgccaagtgtcaaaatatgtgtggttttctgtaacttgaaccatgaaacatgtagttttgtgaaatttactcttttttaaaaaatatttgctatgcaaatatgatgttacataagaatatttttttcctgcagtgggatttaccaccagcattactctcttaaacatagataatttattccatagattgtgttttatgatgtactgttgagaattaacaattggacttatatgattgtgttttataaataattgttgaccgttgagacctgagaattggatttatcagtttgaggggttgttgtattccgataaattttcgttaccgtattcacgccggttcgttttcactccgttttcggtttcgataatattcaattccgttttcgtatcggggtttccgattccgaaaaaaatatgaaaacgaaaacgataaaagtggcagaatttcagaaaggaccattttgcaaatattacatccatatcaggtgttgtttcgtaaatttcagtgccgaaaatttaatgtcggttaaagaaagggatttttatgaaaaaacgtcaggaggaggaggagagttgggtaccaatctgagccgttggttcttgtcgccggagaccgccgcctctctctgacgccggcggcggcctccccgtcctacccaggactccgccaccgctcccatatcctcctcgtccacctcttccgccatcgccatctccagttcctccaccaactgctcatgccgcccccatctccagtacctcttcgctccggccagctgcaactcgccgccaagatccaggaccacctcgacgctgccgcgcgcgccggagttggctgagtggcgaccacccgcaacccaagctgctgtgctgcttcagtcttggaggaaggatggatttcagggtaatggtctctgcgaacccccatgaaaatatgtgcttttactgaactccaatgctcacttgaaccaactcctacccaacatctacacattgcttgatctcttcatctactagatatctttgttcttagtaatgattatcgcttggactgttgcgttccatttcccattgggtagtgttcgttgttctctccatttctgtgttgtcaaaaaaaaaaattgtgcaaattggaaagaggatatgaggaaggctatatatcctatgggccataacagagcgggcatgtcaggcaaccagtgaagcacatgtcttaatgtccagtgtttgcacccaaacttgattccttttctaggtttgcaatgttcttttttctattattattattattttcacctgaaagtaagcacattcaagcagcatccatcatttactcccatttttacagtgaaaattcatgaagcaaaagatcagtcatacatgtacaccaaacaaatattgtataactaacgaacagaagaaatatgttcatatttgaccataataaagatatagaggcaaagattaattgatcactggacatgttgctgatgctattctcttgttattcttaatgcagaagcagaaatggacacagaggacaattcattctttcgtatatgcaggcaaggccacgcttcctgtcgttgatatcgatttgacatagtccttcctaatcttcttcagtgtcacaaccacatcattcatcgccatcctttgctccggggagtcagctgagcaaagcaagcccaggtcaaacactggcacaaggaagccatgcaagctactgggagaagagcaatcttgtaaaagtcgggtgtccagtacatggacaagctctaccagaaacgcctggtaaacccactgccttatgttcagttcccccacaaacatagcatctgtgggtcttttcccagtgaacacttcgagtagcatgatcccgtagctgaacacatcgctctttcgtgacgcttttccaagagcaccatattctgcaggaataaaattggtcaatgcttattgattgcaccatacgataattatgaaaataccactactttgagcaagagtacagaagctgctagtacctggtgccatgtacccaactgttcccggcatactcgcagagatcatggagctgtcatcacctaacaataaccttgcaatgccaaagtccgatacatgtgcagtcatcatcgtcaagtagcacgttgctaggcttcaaatcacagtgtagggccacttcatggtgctcatgatgcaggtattccattgccattgaaacatctagcataatgtccaccctctcaaggaaacctaattgcattcttccttcagagtgcaggagtgcctctaggctaccattgggcatgtactcaagaacaagtgctctgaagtctaggttgctacaagtgttcaatatctttatcaagttccgatgtctagccattcgaagcacatgacactccgtatcaaagcttctcatggcatgttccagatgttggtgtataacttttatggcaaccaccaaaccgctactcagctgacccttataaacttttccaaagcttccagcccccaacatgttatcataactgaaattatcagtagcacggacgagctcttggtaggagagtaatctgttgctgatcatgtcaaccatactagaagaaatcttttgatgcttcttaactttcattcggatgactacatataggctgaaagcaaaagctccaactactatggttatagcagggagcagatattttagcatgcggccatttcttttggaagaggttgtttggcatgatggaagtcctaaacgtgcaacaccacataaccctgaattccccaccaaggattgcaatgtgatatttgagaatacacccccttttggtatctgaccatggagattgttgaaagacaagttcaagctaataagtatggtaaaattggctagatacttggggatggtaccagaaatattattatggaatagatccaaagtctgcaagctagttagctcaccaaaagaatctggaattgaatcatcgaatgaattaacagataggttcaagtaggatatcatttgaagttgcccaatcgaatttgggatgctaccagtaaagcgattggtagagagatctatgttgttaatttgcttcatattgcctatatcaaccggcaacacatcactgaaaaagttatgagataggtctaactggataaggctagaaagatgaaatatgctcggtggtacagttgatgataattggttatttgatagtactaggtgctctaacttggtgaggttgcccatgtcctttggtatggagccagataatttgttgctttgaaggaatagcttttcagcattctttagcattccggcatttgatgggacagagccagccaggctatttccactgagatcaagccaccggagattcaccatttccatgattgattctggtattgtactgtggaattgattatccgaaagtgctagcaccatgaggccagttaaattcgaaatggtagacggaatttcaccacctaacttgtttccagctacaacaaatgactgcagtgtgcttgacaggttacctacatagtctgggaggtttccagtgaaataattagagtcaactcgaaggaaagagagctttctacagttggaaacagtagaaaggaattcaagatccccctgtaggtggttttccgcaatatttaatccccttagcgagttcatgttaccaactgttgctggtactaatccatccaacatgtttcccatcaatagcaggtatgataatgcagaaaggttgccaatagaagcaggaatgggtcctgttagttgattcattgaaagatgcaactctgaaagttggcctaggtgtcgaatgtccaacggtatgggtcctgttaggttgcatgatgcgagatctaggacactcagcatggtgaggttgccaagtgcagcagggatcggaccagcatcaagtttattccctcccaaggagacgatattgagattcgtcagtttgcccagccatggtgggaaagcaccttggaataaattattaggcaggccaagaacttggaggtactggcatgctgcaagccctactggaattggaccagtgaaatcatttctagtgatggagaaccattgcagagctgggaggttgaaacttgcgttgccagggagaggaccagttaagccgttcaagccaagagctaaagcacgcagcgtagacatgttaaagatggctggtggaactgggcctgtgagattattgacttgcaggacgagagtctgtagtattggcaaggagccaatgcaaccaggtattggtccggacaggctgttgttaccaatgttgagataagttagcaaatgtgtattgttgaatagattgtttggtatcaagccaatgaggtagttcctacggagattaatactactaaggttctgcaggttctgcagatctgctgggattggaccagatagactgttaaactggagatcaagaacttgaagcctcgtgaggttccctatggtagctgggattctacctgacagagtgttatagccaagctcaagtatctcgaggcgatgaagccttcctatatcatccgggagtgaccccgtgaggccggtgttggtgaggttgaggatagagaggaaagagaggttaccgagttgagggctgagctctcctagcaaaggagtgtcccgcaaatctagggcagtgacgcactgccggtggtggctgcaagaaacacccacccatcggcagaatggcgtgccgactgtccaattgctgccaaggatgctgagaggatcactcagctgcgctttgaaagccagcagtgcagcaaggtcggtttcgctgccgttgctcttgctcggacctggtggagaagcagcactcacagtggacagagcaatcaacagcacaatgtatatccataccagcaatccaagcgccatgtctgagctcttatgcattggcacggcaggaataatcagcttgaggttaatttatttagctctccattccattgtgcatgcaggcatctggttctttctaaatctaagatgttgactattggtcaacctgacatgaacaagtccaactgtccaagcatgcatgatgatttttccttccctagtctaaaagcatatgagcacatgcaactttttccctttcccacttgtgactaaccaagaccttgatagatacaggacaaatagctatcagtattcttagaaaagattatctccctgactgttgcatactcgttaatttcggtatcattgacctgttctaaataatgactacaattttataaatcaaagattttgcaaattgtaaaaaaaaaaagaaatgaggaaaattatcctgcggcctataagcagagctggcctgtcaggcaaccagtgaagtccatgtcttatcttgaatgtttacacccaaacttcattcctttctaggttagaatattctttcttatgttggcctggacataaagcatattttaatagcagatcatttacaaccatatcatggtgcaaatccatgaagcagcagatcaatcatacatgtacacaatttaaatattgtgtaactagctaagaaacataagagatttattcatattcatccatacacataaagaagtaaagagtaattgatcattggacaagttgctgatgctattattctgttattcttaatgcagaagcaaatatgggtgcagaggatgattcgttctttcgtatacgcagtcaggcagggtcaatggaacactgctgttcggttctcatctcttcccatagttgctatcgacttgacgtactccttcctaatcttcttcaacgtcacaacaacatcactcatcaccattctttgctctggcgagtcagacgagcagagcaagcccaattcaaacactggcataagaaagccgtcaatgctactggtagaagaagagctgtcctgtacaagttggccatctatgacatggacaaggtttgcaggaaatgcctgaagaacccactgcctgatgtttagttctcccacaaacatagcatctgttggtctcttcgcagtgaacacttcaagcaacatgatcccatagctgaatacatcgctcttccgtgatgctttaccaagggcgccatactctgctcaagaaaaaatgatcaccaaacattagttgcaccacttgataattactctataaaagatcagcaaggattcagcaaaacagatgatactagcttacctggtgccatgtacctgactgttcctggcatgctagcagaaatcatggagctatcatcacctaacagcagccttgcaataccaaagtctgacacatgcgccgtcatgtcatcatcaaatagcacgttgctaggcttcaaatcacagtgcagaaccacttcgcagtgctcatggtgcaggtattccattgccattgaaacgtctagcataatatccaatcgctcaaggaaacttaattgaattctttgatcagagtgtagaagtgcctctaagcttccattgggcatgtactcaagaaccagtgctctgaagtccaggttggaacaagtgttaagtatctttatcaagttgcgatgcctagccgttcgaagcacctgacactcagtatcaaagcttctaatggcatgttccatatgttggtgtataacttttatggcaaccaccaaaccgctgctcagctgacccttaaaaacttctccaaagcttccagaacccaacatattatcatcactgaaatcattagtagcacgagcaagctcatggtaggagagtagttgatgactggccatgtcaaccataccaacagacatcttttggtgcttaactttctttttaagaattacatgtaagcagcaagctacagctccaactgtgataattataggagggactaagtattttatgatccgatggttttttttgggagaggttgtttggcatggtgaaaatcctaaacggacagcaccacatagccctgagttcccaaccaaggattccagcgtgatgtttgagaagacacctgtttctggtatttgaccatgtaggttgttgaaagataggttcaagctggaaaggacagtaaaattggccaggtattccgggatggtaccggaaatattgttgtgggatagatccaaagtttctaagctggtaagcacacgaaaagaatctggaattgaattttggaatgaattgactgataggttcaagtaggctatcatttgaagttgtgcaattgaatctgggaggatgccagtgaagtggttgctagagagatccatgatattcatttgcttcaaatagcctatatcagccggtaatgcaccactcaagaaattgtgggacagatctagtttaacaagtctatcaagatgaaataagctcggtggtacagtggatgctagttggttatcagataaatctaggtattcttacttggtcatgttactaatgcccatcgatatggagctggagaattggtttgttccaagaaataatctttgaacattcttcagcacgccgatatttgacggtatggggccaaacaagctattttcactgagatcaagccactgtagaatctccaaatccatgattgattctgatattgtactgtgcagttggttatcactaagatctagatacttgagactagttaagttccaaactgtagatggaaggacaccggatatattgtttcgacgtgcgatgaatgcttgcagcgtgcttgatagattgcccacatagtctgggaggtttccggtgaaataatttgagtcgatttcaaggacagaaagcttcctacagttagaaagagcagacaagaatttaagatccccctgtaagctattttcgaaaataacaaagtatgtcaaagagttcatgctgccaactgttgatgggacagatccatccaacaggtttgtgctcaaatccaggcgtgataatgcagataagttgccgagagaagcagggatgggtccccttagttgattccttgcaataagcaaatctgaaagttttccaagctttccaatatctgctggaatggttcctgttaggttgcacgtgctgagctctagggaagccagcatggtaatgttgcttaacgcatcagggattgaaccaccatcgaagtgattctcacccaagttgagcttgacgagattcgtcaacttgcccagccatgatggcaaagcaccctcgaataagttctgaatgagggaaaaaacttggagttgctggcacgccgcaaacccctgtggaattggaccggtgaaattgttggcatcaatggagaaaaaccagagactcgggagtctgaagctttcgttgcctgggatagggccagttaagccgttcaaggcaagagcaataactcctagcatagacatgttgaagacgcctggtggtactggtccggcaagttgattaacctgcaagtcaaggaattgaagcatgggcaatgagccgatgcaggctggtattgatccagaaaggctgttgttggcaatgttgaggtaagataacaaaggtgtgttgttgaacagactgtttgggatcgacccagtgaggccattgttctgaatgttgatgctgcgaaggctgtgcaggccctgcagatcggctgggatttgtccagagagctggttaaccgcgagacgaagaacgccaagcctcgtgaggttccctatggaggctgggatgacccctgagagggcattattgccaagatcaaggagctcgaggcgatgcagccttccgatatcgtctgggattgaacccgtgaggtttgtgatggtgaggttaaggacggagaggaaagataggttaccgatgtgagggctcagctttccttggaggggaactccgggcagctccactccggtgacacgctgccactgccgccggctgcaagtgatccccatccaccggcagaacggcgtgccggcagtccagttggtggcaagaatgttgtagggatcggagagctcacctttgaaagccagcagcgcagcgagatcgctgtcgctgccattgctcttgctcgtccctggaggagaagcagcagcagcagcaaccacaggggacaaagtgatcaacagcagagcggacatgatgatgcatactggagatccgagcgccatgacgacgctgaagtgatgcttttgtggcaattaactttgcaacaagctaagaactaacaaagcattatatgtatttccctcctcctgattggctgactgacggtaatcaatgagcccttggatgttgttttctctccacatgtgggattgtggggcatgaaacttgtttctttcacactattgacgaatcaagaccttgacagatacaaggtacatatagctatctttgccgaatgagtcgaatatattgactgttgaccaatcatgcacgcaccggttttgattggaaccttgtttgagctttcttttttaaagctggatcaaaatatcgtcacaatccgctggtggaattagaatggcaaaaatgaaccgttctgtctgattgagatcagttacagcactggaatattcacttgctttgggttggttggtaaaaccacctgagttaacttgttgacaagctgctctacagttcgatccatggcgtctgcactagagcgaataaggtaaatttgacagtgaaaccatttcttgcgttcaaaaaaaaaaaaggctaaaccatttcagtcgcaagaaatctattctgatgggcaaggcaagaaactcttacatgattgcgtgacagaaatacatgttatgatgttaaattggtaattttaccatccttaagaagataccaagagataccatattttctaatgtaaaatttggtatctttaggtactaagtatctcaaggtataatttagataccttgatgtacttttctaataacggtaaaattcttctttatagtaatgtttgtacaaatatcaatcagcatgatgctgcatataactcgctagaagatttacatgggccggccccgagagcaatcaggcactgggcctttataacggcacatgagatgacggcccaaataattcaggagtaaaaaacggcctcagggccgacgaatcgaagcggtctgaaaaattcaggagctgttttttaagattgcgtggctagtatcgttatatttttttttatataatagcacatatatttttatattttattattaaaatatatcaaaatgtattttatttttttaaaaatagtggagtgagtcgatcagacaaaacaaacgaacggaagaaaataacaaaaactaaatatcaatgtttgtgcattgaatgtattagtttctatcgattaacagtcggtcaaagaataataagctagctagagagagagaataattaatgtggacgaattaacttgagtaacatgcacataattaaacactacaggagttcattgcttgtgtcaaaattatgtgacgaagctttgtttcgtcactgtttatcgtatttgtaatgataaaataaggtttttgccactgtaatatcaatcattagtgctaaaatgttataagtcatcacaagatatagtattagtgacaattcttgagcgagaaattattagtattacatgtaaacaaaagacactacaataaacactgcaacggtaacaatagaaacggtgtaattaatactacaatgcggcgtcacgcaaactcaaaccaacgtgcgtgatatctgctgtgctgggtaacgagaggcaacaagctagcaaagtcatcgacggaccaactgaccgagaacctgaagatcgggcttgcattcatccagtcggcgtacgtgtaaatcgatcatctaggacgacacacgcgtgcatatttgctctctcaactgcttaagctccttgacaacatccgccatggttggtctcttctccaccttgtttttgagacaccggaccgcgacggccgccatcctgtcaaggcactccatgcagtaaggatacagtgcatctgtagacgacaacatgtcctggtcatacatcttcctcctttcgttgttgtctttgtaccggttgacaaattctattgggaggcttctcccatcgtcgtacttggcctttttccgggtgatgagctccaggagcacgaccccgtaactatagacatcgctctccatagtacagtacttgcccgtttgtatgcatacagggtcgacatagttcatatcagcacacacatgcttcattttcaatgcgagctcagatgacccaaagtcggagaccttagggataaggttgtcatcaagaaggatgttggctggcttgacatctccatgaacaacgctttggaggccagatgagtgcatataggagagagcctctgcggaaccaatggcaatgtcaaggcgatttagtagcgagagagtttgccgctcgaatccgtgtagttttttctcgaggctcccctgggggatgaactcaaagaccagcatggggacctttgtctgtaggcaacatcctatgagacgaaccacgttcacatgcctaataagtgattggatccttaactcatcaacaaattcttggccacgcgctcgcgatgatggaacttttgttggaacgagaaattttggccaacgaaaagcattttgtgttcgtgttgcaccctttgcgatggagtatttgacggcgacctgctggtctttgtaggttcccatgtagacttcaccaaaggcaccctgcccaatcttggtgcacttcccttttgttatactgtccagctccttctccgtgaatatagtaatgcccataccctcaagcagccggccaccgttattatcaaagaaccatctacgcctccatttcttttgcaagaacaaaagagcaagaaaagcaatcaccgcgcaaaccgtggctgtatatatagtgagagaaatagtcaagagagaaagtcattatgtcttttttttttaccaaaggttagagacccggcttttaaatgaaagccaaaacaatatagtttagctggggacgccagcgtacagtagaggaagctcccaaagggatcagccaacaccggagcccaactagccatccaactcttaagcaacgaaaactatttgattgaactcccaaatattaacactactaatcccccacacattacgtctttttgccggtcattgaaaaataatcctcccttccgcattgtgccattgtaaatgatccaaactaaagtagcactcagattttaacaaataccaaaaataacatgaaaactaaattatggccacttaataatattcatagaagcataaaactggtattttatgatattattattattattattaaatattccacgggcatgttttggtatgttttacaaaataatgtgtaccatagaattatatatatgcatggtatatcataaatatttttttggaatataagagatatgcaatatatatatatgaagtgtgaaaatatttttcttcaaacattttgtttttgagctacatgtacaaacatttcaagctataattaaaaaagaactttcctctcatctttttgaaattttcttaccataaatttgattacaggcactacttcaaaaccactcataggtatcgggacataggtgccggttcttttaaaaccggcaccaataggccttttcccatcttcgtgtgataaaaaaaatcggcacctttgagccctataggtatcgtttatagaggaaaaacaaacacctatactatatgtgcattttttaaaaaaaagagttggtacctataatatattataggtaccggttttctaaagaaccgacaactataatatattataggtgccggtattttaaaaaaaccgacaccaatagaaacagaccgaaccaaacccccaccgagccgatagcccccaccacataaaaaaaaaccccatctgccgatccgcgcaaccttatcctctccccatcctctgtcttctcacaccttcctcccccttctcgatccggttctctcccctccccttcccccctccgtccgtcctcctcctcctctccaactacgcccacctcctcctcatcttgagaagctcgtgaacgatggcagtcaccgtggccgggagatgcgaggaggtgtgctccaccgacaccactcctctgggatcacctcgcgccagcgccaaggccagtgacggccgagaaggcttcctccacagcttcttcactgtcggctccacaatggggcatgaaggcggctgcggccgcggctagaggaggtggggcaatgtggcggggttgtctcagggcggtgttcctggccgtggtgcagctcaaattgacgcggtacaagaaagcagagcaagaagtagctcaaattggccatggtggagcgctctcacaaaatgaactagagaggtggagctttggtttaggcagctcctcaactccactccagactcaactcctagagttaaatttaggagttggagctataccaaaccaaacaataccaaaatttgccttgagctggcggctgagggtgcgattgccttagcgtggagttgtgatttgggatttttttatttggatgaacttgtttttgtcaaatgaagattgtgatttggggatttgtgtgtgtgtgtgtattgtgagttgtgatctatggatgtggattaaatttgctttggggcaacagggagtaactcgatgcatcggctcgaatcgagctgatggatcgagattttttttttatcgtgtgttccttaaaggtgccagtcccacaaccggcacctttgactttggactattggtaccgctaaattggtacggtaaaaagaaaaataaatactagcggaagatctaaaattttgatagtggaagagggaatatggtctcaattagtggaaacaaagaaataaaaattctcaatatatagttaatgatagtacccgcccgcgatcggtatattttagctacctactttgctattttattcgtattgatcaatattaatagccaaaattaagtgagcttaattatagaataattaaggtcaactcaccaagtatcgctacgataggtgctggaatcatgggcctgcatccctggtcactggttttaccattccctttaagtccaaagcggcatttgcagtcataaccaccaactgtgtcgatgcatctgctaccacggtaacaaggatagagtttctcgtacttggcgggatcagctttcctaagctcacactcattaatatctgcacatcggtgataaaaaagcactaaatctgtcatattcaaacagactatattcaatcaactaatgctgtaagcaaattgaatactgtagtaagctacttatatgcatgaatggtaacccatgtcatatggaagaaaattgcccgagatcagtagtactacctccttcccaaaataattatatttctaggattcaaaattcatctcaaaataattgtaattctagagtactaattgccccatcaatcatctctcattcaaatttctccctattttaccctcaaccatctttccactctcacataaacaccatttaacgagggacatcatagtctttcttttcgaaccttaatatatgttaaacaacatagaattacaattagtatatatactagtactccgtattaattaagaactaacttgtgcatccgtcgttgccggtaacatagggattgccggcgtatccctcggagcacttgcagaggtatccattcccgttggtgacattgacgcacttactgtttgcgctgacacaggcaggagctacctgtcctgcagctgatcttgcagctgatgggcacgatccatttttcctgatggcccaatcaagcaccgttgggaccatgttcttcccattccggtgtccaaacctcttactgccggcacgactgaaatctttcctggtgaaattgtacctatattacgtagtaaaaaattatatatgtatgcacaaggtacagtacattcatagataacactgacattctaaaacatgacatcaggagtaccatatatggacactttagcttttttctctagaatttatttttatttcgaaataaatttactatgttttagaattaggaactataaggttgtatgtgtgtgtgtgtgtatatatatatatatatatatatatatatatatagagtagctctattatagatcccttccctagaataactattctacatcccctcccccctcccatccgtccccacctccctttccccatcccacgcgcggcccctcctcctctcgcgcctctctccccctcttttttccctcctctcgtgcttttttttcttttcctcccgatctctct

SEQ ID NO: 65331 - DNA, 1699 bp, Oryza sativa
tcctagacggcttgtggaggagttgcccggtgacctctccgagaagattgtggaggaggccggcgccgtttgtgagtggtttggagttcaccaccttcggagtgaaggaagaactaccctagtgatcgaggcttgggtagtcctctccgtgggccggctcccatcttgcccaccccttgacgaagggggcgtgcggtggcttcatggttgagcggtggagttaggctcgcctcaacggggattaggaaaccgatgagtttccgaacctcggtaaaaaattccttgtctcttgtctcatttatttgttgcatttacatttgtgctatttacattcatagagacatatttgagcctatatcacttaggtttgtaaaacttaacttagttgcttagttaaccttacacctcaccttgcctagcaacttaggttagttttgtttaagtgccattaagttttaaaactgcctattcacccccctctagtcggcctccttatcctacatgggtacagttgtacacatctgatcagagtaaaactattcgatagccgtgcccacagttatgggtggtcgaccagatttaccgtaattagtctcatccctagtttagcttaatgaactggtgtagtttaggtggttggttgggcctgttgcaacgtggtgtagcgttggacagtgattggttaatattgcttaatctactatagctgttttaccgctttcaactactgcttttaaatgctagctttatgcaaatgaacctttagcctcctttggatatatcttgcatcatacctcctcttccggtatgacttgctgagtacagtgggtagaactcagtcttgctctctcttccccacaccagagttgaagttcttcccagttggagccgtctcgaagaagttggttttgtcgctgccgtcaaggatgcctgtggaatggagtcacccactgcaggagtcaagtctttaggcttagttcgcttttaccttttccgctgcatttgtaatcttttatatttttgtaagacgtggatctgtatgtcgacaattgtcgtttgtgtaccctggctggtgctggacaggggtttaatgcacattcagcttagaaattctggttcgtgaatttctgggcgtgacaagttggtatcagagccgaattgaacacgtagtctccttagtatctcacctatcaagcagttcgtgaagatatgatggatgctattcttttgacttcacctctcataaagttgtaacaaatattttgtgctctaaacaacaccaataaaaatgtcatcaactaactacttgtagattgcgttgagcattacaactttgatatagagcatctctccatccgaactcaattgcaaacctcaaaaaatattttatcaaaatagaactaagagtgtgcaataaatatttggccaccctaatcaaacttaaatgaaaaaagcattcaactataaagttgtagatctagtcgagaactacaattttttagaaagtttatcatgatcctacttcatatgaatgagttctattttttttcatattttagtggtgctcctatttataagggtggtttttatttgaggctagttttgttgagaatccaccttgtaaaaacattttccccttttttcttaaaaatatctaaactttaaaaatttatagaaaattcatgctaagtccaattga

SEQ ID NO: 65332 - DNA, 9618 bp, Oryza sativa
gaaaaggtaaagaaaagaaaataatgtaaaggaagacaacaaaaatcaaagtatgtaatgagctttagtttcagtacctcttctgcagacaagggcttgtcacgttgacaagatccaccttcattccagtcaccaccttcaaaatgcctaggagattgagtgcggaagagtttcaccccattgggtctcattgctttgttcacaaatattatctgatggacattgtatatccatagaatgaggaagataggttgagtggcataacgacagaaaacaggaagttagtaatgttcaccttggatacatacgaaggctactaaggcccaacaatcaaataaaattcacaaggtggaaatatatatattcaagtaaaacaaaggtggaaaaatattttctatatctatactcctttaaagaaggtagtgatggtggtactgaatctgccaccctatctacttcttaatattttaaaaaataacaaatctaaatggatagccatgcataaaatcaaattaaggtgaatattccctatagtaaaaggatgaatgacacatttatggaaaatatatttgtagttgttgtgggcaatattataaatatgttttcttttatccgtgggaaagtatgagcattcagctagtttaaggaaaaggcaacaagaacaaattgaatttactgcttgatgaagtacaatctctctctctctctctctctctctctctctctctctcatggagacatggctaatatttaagcttatagcccattggtaatataatatttcacaaaaaaaaacacctcattctgtaatcagcaaataatttcgggacaaaattacacaaaaagttcaaaaatacttaatagttatgcattatcaagaaaataaaatgtttttttctcaaaagacaaccgcagatatccataccatgtgtttaagagccaaatccagtcctgcaggtggcaataaaggaggtataactggaatccccttctcaaagaatagcattggtgactgtactggattaaattttgaaggggcccaccacctgtacaaaatacatgagtttgaatcccagcaaagataatatttatgcattttaacaaaataaacgagagtcaggaagtcaggagatagcttagcaaattagcccttatcgtgtagcaagctgcatacatctatagatatatctagcattctagctaagaataaaaacagtttaccaaaacagtttgaatgatattatgcatgctaatgagaagtctggtgctacacctgctaatcaaactcgtattgacatttttcaacatcatatcagaaatattgatcttatatacctgaagtataatggcccagcctacacctagtcaaacaaaagagatggtaaggatctggtccttgaacatcttgtttgttgtttaggaaatgttgaatggtgtgcattttcctaatactactgcctaccatttacctaagctttatagtgatcatactcaaactatttctattttaaatcctaaaaacagaaaacctaaaagaactttcaaatttgacaagtggtggaatttatttttttggggggtggggggtggggggtaagattttcaacaggaagctcaggcagcttggaaaaattcggagcatcttaattaccaaaagagaactactttgcttggagcaaaaggaagaaaccccttcagcaggaagccagaaactatgccaagtagaggaaaaaatcctgaaaaatccagagctctccgaatagagattaactagcccttcaagagagaaacttggctcagcaacaaggattttcacaggcaaagagctaagaaatattgggtccaaataggtggttgaaacacagctttctttcagcaagcagctcaaaaaaggggaaggaaaaacaggataccaattgtcatgcataataatcatctaacaactgatcctgacgaaattgctcaacatttatctcttatttagatcttttccagacttcaaacacagattaaggagtcacatcctctcaagatcagcaagggcaacacacttttgagccaccggaagttccaacagaggagcaaaattttcagatcctcaaacaaatgcgaagagatgcatctccaggactagatgggctaaatgtggcgttttatagagcagcttggcaatggattgagaatgatgtcaccaaaatggtacaggagttctacaatgcagttaaatttgcaaaaaggtatggacgctaccaacattgttttaattccaaaaaatatccagtcctgccactcctgctgattatagacctacaagtcttcgtaacatttcttacaaaaattattgcaaaaacattggccaatcatatccaagagaagcttccagacttaatttctcatacttggaaagtgtttgttaaaggtaggcgtatttccaaattactatatgtcctggcaaaaattagttaataagctagatcaatagcaacacaaatcttgattggtggataatatctagttagatatccgaggtttgagggagaaggcaaatattggaactacagtacaaggaagattaacgtaataaatttctgctgttaactggttactcaaagttttcaaacatgaaataacattcatggatcaggatctacttaattgggcatctaagtgaaaaaaatgttatctggcttatgattgatgttcacataccaatgccctgtgttgaaaataagaacatcatggaagcttggtgcctctgcccatgtttggtcaggaatatcaacgtctactctgtagccttgcttgtatccaagagattctaggggacccccatttggactggctgaccacctacaacatcagcattatacggctttgagtaataacctcagcaatatatgagcaacaacatcatgaaagaaaaactatgacgcagtgaaaaacattaagaaagcggcagagtctactatatttaaaaattaatgaaaatataaagacaaacagtagtcaacagacaagagaaaagtttactactgcctactggtaagcattccaatactactagtaagtaacagctacagtccaaaactgaaagcaaaatagcaaatgcccaaagctgcagaacaaaaatatgtactactgtgcacagaattgtacttatataattaaatcagttgtaacacagaagggaattgcatgatgtggagtacaccatacttccaaagaactataatttggtattactcaaatgacacttcttacctaccatagcgtaccaaaagattagtcctgtggtatgcgagggtgaggttatagcgcaggaatgtgaaaccccggtctgctcctgcaggacgccacttgcgaacctccccactcgcccccctaagcatgcagaccaacgagacaaacatattccggttcaatgaatcacccacaaatcctgcaacaaaccattaaacataaatcatgaacagcaagtcgagacttcttgtccaactaagattctttacatgtatgagagcctcaacaactgaacatgctccgccacataatcaaactacaagattgcaggtaaaaatttacacgtcttctatatatttgacatacaattcacgcatggcaaaatatactaccttgaattgcaaattaatcaggtggaaaccacgttccttccatgctgatctttccaagctaaaagcggcacgcacaatgcacgttgctacactccacaaagatgccttcattggcaatgtcaaatgatcctcgctacagaatgaactgcatctagcttgtaaattgcagcgccacatttaccttgcacataactccctcctcaagttctactattctagtcaccatagaacaagctgcagtggtaaaaaacacacgaaatgggaacgagcacggaccaatgctggtgttcctgtggcactccaggaaacggagcgggtcgagcctggggagctcgcacccgcgtggcctccaccgccatcggagcagctcccggccgttgcgcttcccgttggcgaggcagttccaccccttgaagatctccctgcacgtctggtcgtacctcaggccgccggacaccgcgggatcgtcgtcgtcgggaacccactcgccggacgcgtagtcgcagggcccgcgctgccggggctccccgtcgccggagccgcggagcagcggggagttgggggagcgggcaggcgaggaggtcaggtgcagcagcaggaggaggaggaggaggaggaaagcgagggggaggagcgcgcctcgcctccgcacgccggcggccgggctcctcgccggcggcggcatacgcggtgggggaagcgaggcgtgggggatccggtgacgtggcggcggagtgaggcgaagacgcgagtcgatcgccgtgtgggcctaaaaaggctactgctgggccatcataagtacttttgttggtgggctgggcccaagatcgctaaaattggtaagtactggtatgaacatatcactggtatgaaggaaatgggaagggtgacaaaccgaataatgcaggctttttggttattagaagatgaaggtggagcgaaaacgaacgtttcgtgtccggcgaatcagtcagaagggacacgccaaacatgaggacacatcattttcttccgttttcattttttcccttcttttacgtgattctcttatgtaatccgttgcatcttttacgtgattcttctgtaataggtatttctatttctttccttcacttctgtttatttctcatatttcttttttcgttatacatagtattttttatatattcttaacggaaattttctatacaaacaatttctggggaaacttttctatataaagtgagacttcatatatgtaaactttatatatatggactttgaatatataaactttgtatatgtagactttgtatatgcaaactttatatacaaattaaatctataattaaaaagtttagtgcataaattttactagaaatataaaactaatgccgtttttagttccaaaataattctttaaacttccaacttttctatgatatcaaaactttcctacatacacaaactttcaactttttcgttacatcgtttcaatttcaaccaaacttttaattttggtgtgaactaaacacagcctaaaaatactaatatatttttcaaaaaaaaagtataatccaatctgatcaaacctcctaacagaaaaacgataaaaaggaaaagattatcttttaccatcgcgtgaaaggaaaacgagaaacaggaaaacaattttttttgcgcggctctatttttctttttgtcgttttctgttcgctaggttcgatgctagcgcgcgttcgcgcattagacccaccaaggtggaccatgtctggacaattaaaaattctaatattttagtggtgatttacttaaaagtaatggactaaaagctataattttctctagctacatcctattcctttccttacctccaactaattgtattagtctcttacggtaacgaatgccaaggttaaccttcgcattaatattattcatcatcatcggttaaacaaccaattttcctgatacaacttctccctttacgtgagatcgatatgatataattatgtgtgtaatttttacctagaaatattaatgtaataactcagcatggcttttcttttgccttctgcataatcactcgttatgtggcttcacataggataaccaaccgctccataggtctcataagtcataagattagctcactgaacacaatgggaagttttctaaaaaataaaaggtttctcaaattatagcaaaactttctcatgctcaatatttcgtattggaagtttttccgttgaagttttatttatagttaaagtttgtatccatgttcaaaaatttcttatatgaagtttttctatttccaaatgaaattttttaatcataaaaatactaacgaatatttcaatagaaaaaactagatactatgcatagcgataaaaattgtgtgtgcttacctttttcgtttccattgatatctagagggaggacatgcacatgtaacttgcttgctaggagacatatgactagttacgtatacccatgtaaatattcatgcactagcatcttttgatgatcatttataatatgtctcgtagatctgagtgcttatttgattcatatggtttctaaatcataggaacacgaaaagtaagaattaggattagggtgttacgtactctaatccttaggaattttttcaagagctctcatctcatgtcaaaaatcaaatggtactagattgtaagaatataatctttaagaattagatgtgatctatttctataaaacaaatgatgcatgtaaaaaaatttgaaaggccttatcttttcgcttatgctaatacttatcaaccaaaatataaattcgtaactttaaatttggagctaattttaaggtttttttcattaaacaaaaaacaaagtaattataatcagcctttgagccttctcccgtgagtggcatttggctgctcctattggatcgagtgataagcaaggcaaagcatccccaagaacgaaaccgccgtggaactttccggaacagcccggacatgtgccccactgccccctccctcctcacctcctccccctcttcttcttcttcttcttcttctttcactgcggcgccctcctcttctcagttctcacttctcacacaactcgcaaccctaataaagcgcaaaaaaggaaaaagaaaaatcgccacggaaaaatcctcgctgccccccatcgggcaggagcaaccgccgcatcggcccccgatccggtcgccgccgcctctcgcccggttcatccgccgcttgccaacccctccgctcccagcaaccctagtcccccaccccaacgccgccgccagctcagctcgcctcgcgcggggcgcagccgactctctacttgtggcctcggcggctcgggccctctccggattccacgtatggctcgatcttctgcttttctttttcttctttttttttttttaattattcgggaattgaagcctcatcctattgggggcatacgcgacttggcggagaggacaatggcgacgcatttcagagctaaggggggaagggatatgattttgaggctgtaattgcttgcgaagttctccttttggaagggatcggtcctagccattctgagctgctaaaaattttatttgcggtacggagcgtcttctgataagaggacagaacgattagggtctcccgtaatctgcttttaaatgcttgatggagtcctagaacctaaaattatggaattttctctaatgttaagctaggaatgagggtactggtttcttcgtagatggaaggcgctctacttgttgctgccggaactctgttgagatcttgtgcttaaatgcaggggtttaactggctgtgtaatcttaggcgtggagtgagttgactatgaagaattctgaacatgtctaggaatcataatttcgaattttgtagcttgtggtttatgcagcatctgatactattcagttcctcgttctgtaggatgtctgaagatgcgtctgtcggggccagcagttcaacagtaaaagctggcgatgatccagaggctaccattgagatcaacatcaaaaccctggattcacaagttcataagctccgtgttaagaagaatgtatgcttcgccccaccttgacagtttgctattatgtctctgtgtgtctgttgagtgttgcttgcttgaagagatactagaaatgctatagaatgtcagttccttatagttagaacgacaagatgaattctcccatgtacttgttttgagacaatctaatcactgaaaaatttttaggtacctgttctggtccttaaagagaagatagtagaggcaaccggggttcctgtggaccaacagcggttgatttttagaggaagagtcttaaaggacgatcacctgctatcagaatatcgtatcctttttgttcatgcttcttcttttgaatgcttgaagacaatcaaaccatctagagactcacctcgcttgttgctgttgagaacttgagctatatacactatttacctgcattttgtttcccatctttagttgcttagttataaataggccgggaagatacacaactcttttgggccagtaagggtgatttcgttactgctagaagagtagagtgcctgatgcttttgttgggattagggctgcttgctttggtagtgatttcataatggccttccaatgagacaaaataaagtagtaaaatgtcaaattgaagtatctaagcattaattctttgcaaatatgggcaagaacctcaatcattgtagaccttgatgatatttgttaagttgaggtggttgaacaccagtatttaactgcatcgttggtggtaatgaggggttccttggatcaacgattttcatcaccacatgatgtaatttatcattttcggttttcttgtgatatttcgtttgtaaacacgacagttgtgatagttatatctttgacaacctcaagatttggaagatgggtacacattgcatttggttgctcggcgtgcagctgctgaaggccaacattcttctggtacttctgatgaaaacacccatgctaatggtaagttaagttgggggttgctttgaagagtatactatcaatatagaacgcacctgatatgcctatgacctattagtcctcagagccatgtgctgcacaagttttcgtagtatcgtaaacaatttatgtgcgttttcactcttcaataccatgtttccatgtgtctgttctatatattaattgtgtcaagctcatactggataaaatattattgccctttgaagggcagaaaaatagttattgctagttattgtaaaaaatagctaggtaagcatttcaggctaagtagatgaaggcttgaacagtccttcgctttatttttcatttaatttgtgaactaaaaacaccattatttaactgtatttatgtaagcattactgtgtttctagttattacaatatatagatagagcataacaaatcaacttgggttatattgactggcactaccttttgtggtaccagagtgtatttcctctgtacctgattttaggtatattacagcaatatgctgggtatgggtctgataatctttttacgtgcagttaatgttgctggaaatggactgttaggagatatctccagggtatgcttctaacatcgctttgtctcgtatacttaaaatttccaatctgcttaactcttagcaacaactacaggttaactttaattttctttgaattctttttcattaactctcttctaggaaattatagaggctatgcattctgaggggatgatagatgacctggctagggtatatgctttgttctagtgttatatgtacctgtctaaatggggaccagaacctttatatgtttattgatgtgatttcctcccacctgttatctgcagagtgttcgggatatccttggctccctaggtcttgcgacgcctggtggcatgacaaacactacattttcggtaataaggtgttacttctttaggtctagtaacctg

SEQ ID NO: 65333 - DNA, 3639 bp, Oryza sativa
ccagattgagagcccttgccaaggtgagtaaggataaggaacgggttgctcggcattataacaaaaaagtggtgcctaagtctttttctgaaggagagttagtttggaaattgattttgccggtaaggactcgagacaacaaattcggcaagtggtcacctaattgggaatgaccatttcaaatacataaggttgtgtccaagggagcttacatgttgcaaggacttgacggtgaggtttattgtcacgaccggaaataacccaacgggcgttcctgacgtgcgtgcattaatccttgtcccaggaggcaaggtacaccaaaagttgatacaattcagagtttaacaagcggaagcgtaaatagttaacttattacatgggcagcgaaggcccagcacacacagagacaaacgataaacagcggaagactagggcgacgaccacaggcgcttgacggcaggcacgagctagacaccaaagccttcatcttcaaggagctcctcttctgggcttgggaaaaattgagcaagactgagtacaaccaccgtactcaacaagacacacccacaaatgcagaataaatgcaagggagtacaagggaattataccataaagggttagggttgcagtaaacagcatttaaagacatttagttgctcaaagctattttgtaaacgcgatcctagaactatacaatattatttatcaaggccgtgaacccacacgaacctgccttaacccaaggcctatgatgattaagaccgaactggcaacccgaccctgggtcccagctcgtcccaagccaacccaggccaaccattccaccttttagttgttaagcaggttttaagaattgaaacactaacttgggtacattgctcggcttgcccataaccgagggcgcggctattcgaatagattatactctgatcagaggtgtacatctttacccacaagacacatcttcctcacgtgcaaccacgtgccacataccaccacggtatacagacggaagacgtgacatagtttccaacccatcctagccatagacaagagtaccgacccaatcccgcctacggccggaacccccgggacaggcaggcaggactgagcccctagcagcaggacaccggccctgtgccatgacatctcgactaccgggccgcagctcgtgtagccttcatttgccctggagaatgtccatcgacccccgacttcatccacctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttggggattttgaatagagggggcggtgtgaatccaatttcacaataatccaacaattccaaagtgtccaggtgatatgaatatcccaaagtctagagttgtaaaaccacctaatgttaactaattaaatagcgaagcatctacctaaaatcatactagtggtaccatgagtagagtgtccactagtggggttttgtttattctagggtgaacaaggaaataataacaataacaataataaggtcataacaaaggtaaataggcatggctagataaaacagtgataacgcgggaatttaaataaagcgataatgcaataatttaaagcaacataattttataaactgggattcaatatgttcaaagatgatgtgacttgccttgctcgctttcccaaacatcggcttcaacctccacgaagagcagatcttccgaagctgcagcatctacacgaccaacggaaaagaaaaggcttttactctaataaactccatataacagaagaaacaaagcacaaaaatgggttcttgacttcttaaggaaaaattagagacttgaacggtccaattccgagttcaaatggccaagttatggccatttgaagtttatatgctctttaaatggatatttgcgaatttcttcatttaaattttaattaaaaatcggatttattgcgtcagccgagggagagggcacgcggaccgggtccacgggagtgggggccacgcgtcagcctcacggtacacggtggaccgggcgcacgcggctgacgccggccggcgccgtgggtcccacgcgtcagccgcacccgcgggcgcgggcggctgacggccgggccccacctggcaaccgcggggcgcgcccgaaggcggccttgccggcacggccgacgggaggcggcgcgcccgcgcccctatggtcgccggcggcggccataggcacggcggagcggcggccgagagaaaggagagaagagggaagcgaagcggcggtcctcggctcaccccgggtcgacggcgacgacgggaacggcgaccgaagcggagagaggcggcggcgcggctcgggtcgacgaggacggcgatgctccggcggtcggcgggcgaaacggaggagcggacgaggtcgacgagaacgcggcgaagccgaaggaggcgatgccgaagcgggaggaggtccggggcgacgacggcggcgaaccggagctcggcggcgacggcggagagggaggacaacggcgcgagctcgaatccgacggggagagagtgcggcgagtggcggaaacggaggagagaggcacggggagcgattatatagcgtcgggagggggagagagcggccggaggggaaggaatcggccgcggaaatctcggccgccattgatgcgccggcgaggattgcgggagcaaatccggacgaatccgaggtagagagagagggaaaagtgggggaaaagagggagggaatcacggggagtgatttccccctctttatggcgcgcggggacggcgggatgcggcggattcggcggtggcggcggcgctagggcacgggcgggcggcgggcgcggcgcgaggtaggggatgacaggtgggccccacccgtcagcgagggtggcgggcgggcccgcccatcagcggcgcgcgcgcgggggaaggccgatgggccgcgggggagaggagagggagggaggaagttgggccgagccggcccaagaagggaagggggggaaagaagacttcttttagggtttttctttttataaacctttttaactttgtttatttcttctcaattattatttgtgctctgaaaattccactaaaatttatttacgcattttaggcttttaggaaatatacaaaaatcctccaagccttatttgacttttatatttgcacattttaattgttggaggctttcacatgaattttaattattctttgcacaatttcgaggatgtattttagagtcgttttgggacgcgacatttatgaacgagcgcttaatggaaaatatctgaagaaatattacccaagtgtttgggtcaattcatgatcggctggatgctgccgatacatgttagctgatgtgttgacaccgcctagagatggccgatataagttatattgcccttagcagtttttattatcttaattggttgtgttttgccgatgtatgatggccgatgtcgcgtcccaaaacgaccctaaaatacatcctctaaattatgccgagaataatt

SEQ ID NO: 65334 - DNA, 10523 bp, Oryza sativa
ccaaagatcagaacatcttccaggtataaacctctcggtaccattttattccggcatgcttctctcatagaaattacgctgaatattgaaaggacactttgcaggaaaccgtccgatatagatccaactggaaaagatcctgatccggctgccacagagtcaaatttatccaaagatgctgagccgactgccgaaagccagccgactgccgaaagtcagccgactggtgcccatgcttcggatgacaaggccaatccgagtgaccagccgccgactggaaaccagtcggcagctactgaaactgcaacaacccaagagcccccgactggaaaccagtcggatgtaggtctaaatcaagagattcctgaagctgaagcgcaggcgacaacttctcaaggaccagaggctggtaatgactcagtgattgggtctccggataaagagcagggatcacctcacgctcagctaggcacatcctcaggtaactcatcttctcaagtgatgccgttctgaataactccagcttactcgtctaatgtcttgggaatacatcaggtccactaggcggcgacgaagaagaaattctccgcataaaggcagctgatgactctcgtcctcctatcttactcaaatggtgggacgagaactctcaagtttccggcattgtcataaatcgccaaaaagaagatgaggaagtgtgccagctgaagaaagtacttggagaagctactcgcattgtgaatgtaagtcttctaggtgactgcctttgatgactttgttttctcgttagcaaaactaatccatgaaccaccgtgcagagaatccatcttcgcaatgaggccaagaccacaaccttagaaaagctggttcctcatttgggaactcttgaagctgttaggagccagctacacgaggccaaggagcatgccaagaaaacggagaaggaattaagggaacgaattgctcagctccaggattcaaactacgagctgagtggttcatcaaaaggtaatctctagatctgtcccatttatgctgtcataactggatcctcaaacattcggatttcaaacagcgcaagccaccaggatggctcaaatggagaagcaaattgaagctttgagaaaagacaaagcagaactagctgcagaaagggactcggccttgaaggaggttgaaggtactgccagctgacaatctgaactttcctctttttaatgtagcagattcttattgtaaatgtgttttgtagaccgtaaaatcaaatctcaagctcagtttgacgtcctggttgataaaatcaagaggcttaaaggagcaagagatgaagttgccaatgtcgctacaccacttgtccaagctatgttcctcaataacagtggtccgagtgcacttgacgcaaccgaaatctttgacaagctgagagttgcaccggatgtatatttcaagaacatcaagaaagctggaagtatgggagctagcatggcattggcgatgaccaaatccttgtacccgagaattgaaatcgacaccattgatggatttgcagacgggacaagcgaagaggctgctcttgatcttatcagcaatgctcaaaatgcggctgataagattgcaagtgacgttgtagagcaattccgcaacaacgaccttcagccgagcaacaataactctgatgatgaaaggactgactctgactgagtatgaatgtaacaaatggaggctcaatttgtacaatactggtgtatttatgctgtgcttgatagttctagccaaatctttgatttcttaaaagcttttatcaagctttgttgagcctaaaacccaaagaagctataaaaaactttcagtcctcgcagactaagtagaaaaatcgaacaaggcaatgataaaccaagtaagcaaattgaattgataaaaaatcacactccattattataataatagcccccgactgacaacttcaagaagaaaacttgatgttgacagtcaagatagggaagtacaatgataaacttaagcgtagaaacgacgaagatgttcaatgttccaagagttgtcgacgagagtaccatcttctcgcttgagtcgataggaacctggccgggtgacttcagagatgataaatggcccctcccataaaggagataacttgtgccgatcccgtgtagtttgaattttcctcaaaaccaggtcgccgactaaaaaggcacgggatcgaacattgcgattatgataacgccgcaacccttgtaagtatcgagccgaccgaatcaaagctgcttcacggacttcttccaatcggtgcaagtcatccactcggtcctcttcgtagcgttcttcacggaaatttcgaaagcgcaaagattcgaattcaacttcactcggcaacattgcttctgccccgtagacaaggaaaaaaggtgactggcctgtggcccgactgggtgtagttcgcaaagaccaaagcaccgatggcagctgttgcacccatttgccggcatagggttttagccggtcaaagacacgcgctttaatcccttgaagtatcatgccattggctcgctccacctgtccattgctcatggggtgtgccaccgaggcatagcaaatcttaattccaaagtcttcacaaaagtctttaaaaactccgccagtgaattgtgtgccattatcagtgatgatccgattgggcactccaaatctatgcacaatgttgatgaagaagtctcgagcattatctgctgtgattgtgacaaccggtttagcttcaatccacttggaaaatttatcaatggccacaaagagatgcgtgtaaccgccgactgcctttttaaacgggccaaccatgtcgagcccccaaaccgcaaacggccaagacagcgggatagtttgcaactcttgagctggtaaatgaatttgtctggcgaaaaattggcaaccttcgcacgtgcgcacaattttgtcggcgtcggacactgcagtaggccaaaaaaaaccctgccggtaagctttgccgacaatggtgcgtgcagcagcatggtttccgcatatcccagaatgtatgtctttcagcaattgtctcccttcctctaaagatacgcaacgttgcagaactcctgaagggcttttcttgtataactcagcttcatgcataacataaagtttgctccgccttgaaatccgctcggcttcatctttgtcttgagggagttcttgagaagtcaaaaatcgtatgaggggctctcgccagtcggcttcaatcatagctacgtcatgagtgcccgcaatttgagcagtatctttgtgaggtaccgtcggcgtataaaggtgttcgacgaaaacatcggaaggcgccacctcgcgcttggatccaaagttggcaagtctgtcggcggcttcattattgtgtcgaagaacatgacttagttcgagtccatcgaacttgtcttccaatttgcgtacctcttgtcgatatgccatcatattgtcatcaaggcaggaccactctttcataacctggttgactaccagctgtgaatcgcctctaactattagacgctttatccctagggaaattgcaatccgcagcccatgaaggagggcctcatactcggcgacgttgtgggacgccgaaaaatgtatccaaagtacatagcttaatctttctccagttggtgaaattagaaccactcctgctccagtgcccgaaagtctttttgacccgtcaaaatgcatggtccagtgctccatcttctccgcgggggtatcctcttggcactcggtccattcggcgacaaaatcagctaacgcttgggacttgattgaaattcggggcttgaatgatatgtccaaagacatcaactccaaagcccactttgcaatccgtccgtttgcttcgcggttgtgcagtatatcaccgagtggaaatgatgtgaccaccgttaccgggtgaccttgaaagtagtgagatagcttcctggtagtgattaaaataccatataacagcttctgaacctgagggtacctcgttttggagtcggctaggacctcgctgacaaaataaatcggtcgctggactttctggacatggccttcttcctcacgctcaacgaccaagacagtgctcacaacctgggaggtggctgatacatacagcaacaacggctcctgcaggtgtggtgaggctaggaccggtggctcggtgaggagtttcttgaaatcttcgaaggccttctgtgcttcaggtccccactggaaatcatctgttttctttagtagcttaaagaagggcatcccccgttcgccaagtcttgaaacaaatcggctgagcgccgccatgcatccagtcagcttctgaacatctttctgggtacttggcggtttcatgttgaggatagcagtaactttctccgggttggcttggatgcctctatgagacaccataaaaccaagcagcttccctgacggtactccgaatgtgcacttttcagggtttaatttcatcctgaaagcacggatgctcgcgaaggtttcttccagatccgagatcaaatcatccttttgcttggtcttgacgactacatcatccacataagcttcaacgttacggccaatctgcgttgagaagcatctctggatcatacgttgataagttgctcctgcgtttttcagtccaaatggcatggtgacgtagcagtatgccccgaagggcgtgatgaatgaagtcttcaagcagtcggattccttcagtcggatctgatgataccccgagtagcaatccaaaaaactgagaagctcacagccggcggtcgagtcgactacctggtcaatgcgaggcaacccaaaaggatctttagggcaggatttgttgaggtcagtgtaatcaacacacatgcgccattgccctgttttcttccgaactagaactgggtttgctagccagtcgggatgaaggacttctttaatgaagcctgctgctaacagcttggttaattcctccttgatcgcgtccttcctgtcttgtgcgaatcggcggagtcgttgtttgataggcttggcgtcttctttgacatgtaatgagtgctcaatcacctctctaggaataccgggcatatcagatggtttccacgcaaagatatctttattgttctgaagaaaggtgatgagcgcactttcctatttacaatctaactcggcgcctattacagcagttttagcaggatcagagggatctaggggaatcttcttagtcttagcttcgctttctccacttttagaagtcttggtagcaggtatttctccttcgctcgccgtggctgcagccagtcggatatcctctcgggcagacgccatctcgcgggtttgggccatgtcgcaactctccttgtcgcatgtgacagcttgcttgatgtcactccgtagggataggactcctcggggaccaggcatcttcatcatcatgtaagtgtagtgcgggacggccatgaacttggctaatgccgggcgtccgagtatggcatggtatgctgtctcgaaatcggcgacttcaaagctgatattctctgtgcgaaagttttcccgagtgccaaaagtgaccgggagggtgatctggccgagtggagttgcggataatcctggaattacgccgtgaaaaggcgcattgcttggttttaactcggagcgaggaatctgcatatcatccaaggtcttggcgaaaaggatattgagtgcactgccaccgtcgatgagggttctgcgaagcttgacattacggaccactgggtctagtaccagggggtaccgccccgggtggaccactcggtcaggatgatccgagcggtcaaacttgattgcaatctctgaccatcgaagatattggggcgtgtcgggctgaacggcattgatctcccgttcggtcaacttttgcttccgtttagactcataagccagggggccgccgaagatatggttgagctccttgcggtggtcttgaaaacctgccggggtgtcgccgtcgtccttcttcctcgacgtgctttgttcttcatcggagttcttccgtgtagtcttggtgtattgatccgcgaactgcttgtagacgaaacaatctttggccacgtggttggagttaggatggtgcgggcattgggagttcatgatcttgtcaaacgtgttgacgcgcgaatgctgtcgagaagagtgactggcggttgcaacaagttccgcaggcttacgcttgcggtccttatgattgttacttccacctcctcccgaagccggcgtatccttttttggcttccaactgggacccgactgctttgacgcggtgacggcgtcttcagctttggcgtactcgttggctttttcaaacatgagcttgactgtcctgggaggcttacgcccgaatttgccaaccaattcttcgtggcgaatccctttggtgaatgcggcgatgatgacgtcgtcggtgatgtcggagatcttgttacgctgttcagaaaatcgccggatgtaatctcgaagggattctccggacttctgaatgacgttgtagaggtcgtattgtgtgccgggacgctcgaaggtgccttgaaagttggcgatgaagtggtcacgtaactcggcccaagatccgattgtaccacggggcaatccatggagccaagatcgggcggaatccgctaaagccactggtaaatagttcgccatggccttgctgtctcctcctgctgcgcggattgcgagaccgtagacggtaagccacgattctgggttagtggtaccatcatacttctctattccagtcggcttgaagccggctggccaatccactcgacgcaggtcgtcggtgaaggctgctactccgtcaaggtcgtcgtcgtggcggtccggcgagtgatgatagcctcgagctgctcggcgctgtatgattgtgtcgcgaagatcgacggggcggcgacgaggtggtgagcgaggccgttccactcggcgctccctatggtgatcgggaggtgagtgaacagaccgctcgtcgtggcccctgctcctgcgattggatcctgcgccggtgatgctgaggcttggatgacggtagtcatgagatcggaagtgggggactcggctgccagtcggcgtatggacgctttcggagttaactgggaccgaagccgcaatcatagtcttcgtctggttcaagatgttgacgacgtgatcggattgattgagctcgttttccctgagtagggtgtcgaggagggtgatcgcggcaaccgcattctgttgaggggtgcgaaaaaccggcgtcccttcaacatcttgctggccgatgagatcacgcgcccggcgccctgcttccaaagctcgctgccgtcgatcctcagcctccttcgcggtccgctcacgctcctgctgctcatgccgtaaccgttcttgttcttgtgcttgatgctcctcttccagtcggcggcgctcagtctcgcgacgcgcttcggtctcccgggcttggcgttgctcctccgtctcgttattggccatgaagacgccaaagtagagaggggtgtagttgtcatctaggcttccgtcgaagtcgtcgagatccgggtcgtggtagcgagagctaaactcgtcgtactccacgatgtcggtggggcgcgagtcgacggtgggagagctgtagtcgccatctagctgatccgtctaaaccgtgccgagtggttggaggatgacgccaacttccctgaagctaggcgaaatcggtattgaagccgacttccgcctaggcctacgggaaagagacgctgtcgtgatggagacggccgtcaaatcgtcggggagcttcatcaggatcggtgggtaagccccatcatcttgatctggtgacgttggtgaaggtgcgatctcgcccgagtggtttgaagccgactcggtcgagatggtcttgaagtaactttcagccgcgtttgggagtccaaacggggccgaaatctggttctctcccgactggtccgactccgagtcaaggagagagatcttgccgaagttgctggtgacgaagtcgaggctgccgaaccgaaacgtctgcccgggtgggaagacgaggtcgtcgatgccggagatggaacccattgcactgatcggcgaaaagcttgacgctacccctacctggcgcgccaactgtcgaaactagatttcggcaataataaaagggggtggctatcaagctggaaaagtgtatgggtttggagacaaaggatttatacaggttcaggccttcttataaaagaagtaataccctactcctgtccggggatgaatccgccgagtgtattattgattgtatgatttgggaaaatcaacatatgcccctagaggcacccggaccccccttatatatggggaggagtccgtgttacaaaagataatctatatccctaacggaatatgcagatacagataaaatacagtcgtaaccgactaagtcccagggtatttccttgatgcacaagttgagaaacaaacccgagatacacataaaatattctatctatattcggtatcctatattcagcccaaatatcatcgccgtgtagatatgggatatccataatctccacagagagagagagagtttccaagcaaatttgatggcacatatccacgaattgtgattttcaatagtttgcattataaacgcttcatcttgtcctgcctccttttttccttaaatttatttacatggtgtgggaggcagtatttcctaaacacttataagtaggactcactaaattgaagaaaaaacaagtagctctaccttgcttatgatggtccttcatattgcagcacatcttccatgggtctgtagcagctcatcctgctcaaggttgactatgagttttggtcagtgaaggggatacaattagtaatggaattagaacacaggtaacactcgagttaattagtgttttgcttgcagtttcaatgcttacactacaatttcattctctgcaattacattcacattttaagctttggttttcttctctactcccaatcaccgaacttgtttttttaatgaaaacacaacttggtatttgcaagttttctatctgttttttgcaacaggaaaactgttacatgttctagacaaaaatatcatttttaagaactgtaacaactaacaagcttatggatgaactttgacaggttccttgacgaaatttgaagatgtaacctgccacccatgattcgcagccatcgcccgttatggacttgccaagtttctggtggtgcccattgttgatgaaattactgattgcctgaagtactcaagtttcatgagtataacaaagattacagcttgggtatctgtaaagtggttatgttgagataaaaggacaataatgtgagatttctgtttacatctcaaatgttccctttaatttttttatgctactttctaacttcgcctttcagtttaaatttcataatatgcattgtttcttatatccaggattgaatcttctagcctctacaaaactgaattgaggttctgcatatttctccaaaataaaacaagtatgaatgtgctaggcttgcttgtttgattcatgcattataaatcttttcattgagaatactagcatttaaagtcaaggatatatgtgaaaatctcagtagcgtttgattaaatttacattttatgcaaataacaaccaacttgacatcaccttctccaagcatgagggaatgacgtagttttacgtgcaacctgcatctatacgattgatcccttgtggtgatactatgcctgtccatcactacagtttttctctagttctgttacaacttaaaacaagctgtattgttctatgtgatatgattctcttcttgtgcttattcactgttgccctgctagaagcaatttctatgcttactggttacttgatattggaattaggaataagtccacttggactccctcggatatatgtataatctgatttgtatctctcaaccgtaataccggatatcttaacccctcaactatgaaaaccagcgcaatttaactcccttggttgttaaacgaggaatttaacgcggtcgacgaggccggtgccaatgccatgtcccccgctctcatctcctctgctccatcgcatgaaaggacgctcagaggacgagggagtggggcggtgggcagcaacacgatgaagcagaggggtggcggggagatctctagctccccaatgccttcgccggccaggccacaccaaccccgtcgcgtcaccgccgccaatgaactccatcatcaatcaggggatcatcctcaacgccgtcgctagagggcgggcctacccgctatcggtgccatccttcgggtccccaggtcatcaccaacacgccgccgtaaagatcccgcctcgacctcaccttaggcacgacaccaccctggatccagcccctacgataggccgacgctttctcgtgagctcgcagcattcctctcccttcactgctgccgc

SEQ ID NO: 65335 - DNA, 559 bp, Oryza sativa
aaattatgtgtttctgtagtaacaggattctaatataattggtgacaaagtaatttcagttatttctagtatactcaccatattgcgtgcttggtgagctcggcgtcaccacggacatttccatgcctacttaatttcattgacgctgcttcggtgtaacactaatctatctgctcatccatgttgctcagaagtgcatttgaaatccccccacaaatttttgatgcaaaatttgtgtattcaagcctagagctgggacatgggctgtgcattctggggccgaggcaggcccagggaaggcagcccggcacaacgaaaaacactatagcctcaggccgatttgaacctagccgggcagttgggccgtgcctgtgcctgaaaatttggcacgatggctgtcatgtcaaagtcctattttggctgcactatgatctggaatcatagttgtgaggatcagaccatgcgtgaaaccgttgaagccctcgatttactgttcgctcagtacgaccggttctaccactcgttcaacacgactcaaatatactagcactaatggccg

SEQ ID NO: 65336 - DNA, 5812 bp, Oryza sativa
gatccttccctcccgatctgcctctctccccctcttttttcgtttttctctccctcctctcctgccttttttttcttttcctcctgatccttctctcctccctcccgatctgcctctctccccctcttttttcgtttttctctccctcctctcctgcctttttttcttttcctcccgatccttctctcccccctcttttttcgtttttctctccctcctctcctgcctttttttcttttcctcccgatccttctctcctctctattttttcgttttctttttctttctcttctctccctttgcttcaccttgaaagaaaattaaaaattaaagacaaaccaagacttgaacccatgatctcatgtttcatagcaaactcttctagccaattttccttatgatactatgtgatttgatcattgtttgcttgctttgtatgtatgtccaaattttatgagaacaaattagctagttatgttactgtaataatcatacattgttattatgattcggcagtaacattaccatgtaagggtagtaacatgatatgttactacaaaatttatatcttgttactggcagtaacaacatgacgaaatttgtagtaacaaagaacctgcatagtaacagcggccgccctatagtagtaatgttttttagatctagagtattttaaatctcaatctttatagagtactaatgtacacgtcatgtcttatttttctaacccatttacatcatggcgttcgtaaaagaaaagtgcttaacgaaactagaactatcataactattttttaacgttgttactgcgaaaagcagaagtgttactgcatattggccatcgtgttattacgctattccagtgagacgaggactaaaaaaagaggtaaatctcaatctttagagagcaatatctctcacatcatatcttgtatttccaatctgtttgcaccatgaagtttataaaaaaacgcttaacaaaactagatccatcatggctactttttgacgttgttattgcgataatgttgtcttgttactgcacgatgaccgtcctgttactgcacgattcctgcaagacgagagcagcaaagtggtgggcgggtttgattggcgggaggatgctttgaccgaggtgggaagggggttttgggccctaggaagggtgggggaggtgggtttgacccatgggagggtgggggtgtagaatagttattctaggggtggggtgtagaatagattcactctatacacacacacacacacatactttacatactttatctataaagttacaatccattaggtctaaatctcaacaagcaaccatgccacatcatcacctactaggaacaattacatatttaacttcatgcaagcatgtaacatcatctacaatctatttaattctacaaatcaacatgtaagcatatccaatcatcaaccctcacatcatttccataatattttaacaaatctatctatcatttttataatatttaacatataattattaatatatacgttttatgttaaagcgtgtgtatcatttatttgttttatatactaataaacccaccacctgatgtttcattatttttttctttttacttctatctcgattgttgaaaaaaaaatattgaagattgcttagtaattcccgtagtctcgcagtatatcttgaacttctaacatgcaccacttttcctccagatgtagtcgattcatttgtttcttgtttttttctacttctaaaacaacatttttgttgtgcagtatgtaaaatatctttgttttgttcatacatagtctggatgattcaatattacaatttgcatgataatagaattagtctagatgcattattatgcttatataaaccataagacctcatcttttcacttatgtttatgcttatcagctaaaatatgaattttcaatcttaaatttcgagctgcttttgggatttttttttcatcgaagtttatttttcagtttttgcttttagatcgctaagaacacatgtataaaaattttatttacaaattacttttcatttgcaaatatgccgtttcgcttatttcacgaataagtgaaacaatgaggctttatataatttctagatttatactctctccgtcctataatataagtgattttgggtggatgtgacacattctagtacaataaatttgggcgtataggatgtctagattcattgtatactagaatatgtcacatcaatccaaaatccattatattatgcggcggagggagtataaggcagtgctgcatcccaattttcgggtgaagttttaacaaatgctgtgcacttaccagcctttctcggcaacgaaggcgtagctgcaggggctgtctgcccgcacgaggtcgtcgtcgaagccgtcaccccaggaaatatttaagacactaaggttgggcgggatggaaggcacctggcagcaacccagccccgtacatgggtcaccgtcgtgggcggccttatccaagctcgcgcacgtcgagatgcatccggtcgagtagctccctttcttcctgccaatcagaaacgctaccgtgttgcagccgatcgccgtgaactcgttccttttccgcgacaagcgagatttgccatggagcttcaaccgcgtggagacgtgctcctcgtggtgtgatgagtcgtagcattggtgggccacatgagtgtagacgcgcatctcccctgcctccagcgagatgtccttgatctctatggtgcccgtgtacggcctgggagggctaaagctatggttgcatttgatggtgaagcccggccaggcgcagtcgacgccgatgccgaatgggtaggggatctccacgttgccgcacttgctcgggcacgccgccggcaccggcgccggcgccggcgtagccggcactgccagatcagaaagtgtcgccgctgctgcaggagcatgaagaaaccagcatagcacaactactactatgtgtggcatggcaattagtcgtcgtatgcgaatttcgtcgtttttgcccatttctagtagctagctatgcgtgcggatttgcagtgaccacgcatgtctttatatagtggatcgagttgtactactagtagacatatatacggtgtttagctagctaacgtttttaatcctatattatgcatcaagatcgccaatgatggtctcctaacatacaacctccgcccctaaatatttgatgccgttgtcttttttaaacatgtttgaccgttttaataatctgttagatacaatcatctagagtaacctgaagcaccatgattgtttactagctagatcgttgtacccattacttgagtgcaagctattagacgtctacaacttgaaggcaaagtaaattttctagcaccattataatttttctctattcaagataataaatagattactaagttagaatagataaaaaaaaacacaaccatgttttcctctaaattagaatagattaaaaaaaagttgttgtatggtacacagtctatggagttatatgtgatttgttatatatccgttggcgttgttaattggggcatttgcaaatttgccaccgttttttcaatattgcaaggatgtcactcgaatgatagttctagtggtatttttgcaattttctattggcaattttacaataacgatttaaagtagtggaaaatttacaattgccccttgttaattaggtttgcctaggctcacacaaatttctagatctgccactgtatggacattttctattatgggactcaagctaggttaaccgtagtttcgccactgtttaattaatgctatacgcaaatttcacattcttaatactccctcccttccaaaaaaaaatacaatttatacccggcatggatgaaagtgagagggtgtggttgggtaaaatggagaaatatagtcagggtaggttgttggaggggaaatagtactataaatattctagaaatttatttttatgggataaaatttaaatgttaggattgaattgtctatggcatgggttggagggaagtatattgtctatgccgtctttggataccattactagtatagacgtcggcgatgttgggttaaatatatataataattggcatatatagacgttggccatttctggagtatatatgccgagtagctgacaagtatctttgtaattacgtcgtcaacgagtaaagtcaacagttaattactacaaaaacgtgcatataaattaatgcacatgtataccagacttaatatctcgctactcgcgcgcgttgttgccaagtttcacaaatcataacactaacaacaactcgctatcagacaatgaaacaaactatatactctatgtcaatacagtggtctgtgtcattctgtccatctagctgaggtttgacttgtacatcgcttatttaatggaacgaaacagacggcggacgatgacttgtaaatggctgataaggaggaattttttatctggtgtgtactagtgatatgattgacgaacgatgtattatttgattaaaggttggcgccaaagattattacagcatgcaagttgtagggtggattgggcgtcggaacagcagcacacacactccagacgaaaccttttacgttgctgtggaaaatggtagaaaattaagtgtaagatgaatttatttgttagctagacaacgtaattttaaatcgaacgactcctaagtctctaacatctgcggtgcccttactgtctcgctcatctcccagtttctctttatttaggatgcggtgcttcacgtacaactctcgccagggggtcgaggatcgtctcgtttggcgatggatgtctgaccagcgctgctcagcgcattcggcgtaccaggcattcttctatggcctccattcttttgcctgtactaatcttctctgacacacaaaggatcctgctaaatgcaggttcttcctttagtttgcattccagcagtgctgctggacggctgatctcctccagaaacgtggtatcgatagtcactcggcttgccccttttgtactcaggatcttgagacagtgaaccacattctccttgattgcgtgttcgctcggcaagtctggttatggttccaggactggtggccatcctccagagcttgcttacctgagcatctctgtgccggcttcgaccccctggtgctcctggtctcttagcagttatggaaggaacggaactctagggtttttgactccgtgctctcttccgtcacagtggttctgtagtccatccgttctgagggccatctgtggtctttagctggcgttgccgcttttggggacttgttgagagtgtagcgtggctaggcccctttccgctgcttggagtttgtgtttagccaccgtagtttctctagctttaactttttattttgctttttctcccttcccctgccataagctggtctggctgattgcgtgatgtaactaaaattccgaacgttttgtatacataattaagagaataactgaacttgtgacagaagtaaatcgtctatacacattcattacagctgaggattaaatgctgggtgaatttgtatggctgaaaatataaagactctgtaacatcaacgcgagtaaaagcttagccgaattagtccggtcattatattcttactgatgtaacctggccgtgtacatacggacattactcttgtaacattgtaacattggcttgttttgaagggcgacgatcgaaacggatgccatggctgagaaagagcattgccacgacaaaaggaagaattaattaagtttg

SEQ ID NO: 65337 - DNA, 5919 bp, Oryza sativa
cccatcgcgaggccgagccactaccgccacacaccgccttcagccggccgttgccgccgcgttagtcgtcgctgcacctcgccgcttgcgccgtcggcaacgccgtgccaagctctaccccggcctccgctccgttttcccaaatcgccaccgtaaccacccctcccccgtcaacccgagccaccaccaccactggccgactccagccgcgtcgcaccgctgctacagtcattgcagacccacgccgttgcctccctcggctccacaaggacgaggagaacctcggccatctcttcccatcgccggaaactcactggacgtccagattcccgtgcgccggtgagcccttcctcccttcccttcctctccagccggccatgtcgccgctccgtcctccctaacacctcccctcccatcctagggtgcagctgccgctcatccgcctcttcccgagcgccgcccgtcgtcggagcgtcgttgtttccgtccgtcccgagctctgccgtcaccgcctcgcgttgccatctcgccgccggccacctccttccgtcgtatgctactcggtgagctccccctcccttttcccgccgcactccgccgctccccggtcggccggtcggcgagccggctcgcgcccgcctgaggccgcccgatgcacctcgagtgaatctgggccgtccacgtggccgttcggcgccgcccgcgtcggtgccctcgtggcgccacgtcggcgccacctctgccgcatgtccgccgtggccgccacgtggccgtccacgtggtgcgcccgcgcctgtgccgcggtggaccgagtccaccgtgggccgcccccttggctcgctgacgtgtggggcccgcctgtcggcgccggccctttgctgacgtcagcacttgtcatttcctttgagaaattaattattaattgcgcaataattcggtttaattctagaaattcatttaaatggctcaaaatttctaaaatccatatctaattcattcgaactccgaattgagccattcaacttgcaaaattcatctaaaattgagctctacatgtttgtttagtttttatgtcctgtttccttggtttttattagagttttttctcgttttgcgtgccagcgtgtagtttccgtcgtttcggaagtccgcggtcgcgaggaaaagagttcggaagatcaaagtgaagaaggcaagtcacacattccccttgagcatgttgatcccaatttacaaatgttttactgtttgcaaacaaatatgcatgttttgctaattacatggggtcagggttttacctatctgctcgcttgtgccatgtttacttgatatctgttctttgtcaaccttgggtaatgaatcgactagctcatgttacttatgtgacctagctagaactatatgcttagccatgcttaattaccactagctcagttgatgggataactgcagtattagacctttttagtatcagagtgagctgcgtgctcgagacacctggccatgcttcatggtcgtaattatccaactaaaatgcgactgaatggtgggctgtgggtgcatggttttgctggtcgcacccatggcagttaaggaccggttcgcgggatgccctggaagaatttatcgtacttaccacaagccagcgtgggcaacggctgggcttgtagtgtagcttttctctagccgacgtacccaggcgagggtgggcgtgatggagttgggtcggccggggtgtccggttgatcggcttccggattcaccgcggcacgaaaggggggctgcccgttgtctgctggggacgggggcgaaccctaaggtgtggtgcgatcggttagagggggttatgcgaagggtcctgtcacggcctctttccggtatgtcgtggtggcatgtcggcgcacgggaacgtgtcgtggggctgtgtcttgtgggtacagttgtacacctctgatcagagtaaaactattcgaatagccgtgcccacggttatgggcggtcgaccagattcaccgtgattagtctcacacttaataaatcgacctaatacactgtagtttaggtgggttggttgggcctgttcaacgtggtgtagcgttgatcagtggagatttaatgttactttaattactcaacagttttactgttttgctcaataaaatgttttacaaccgcctttatgcaaatagccacaaaccgtccttgtgttccccttgcacgtctgcatcgttggtgtggcttgctgagtacggtggttgtactcagtcttgctattattcccccttttcagaagtgtagtgcttctgagctgaagacgaagttagaggaccaaggctcagaccccagttgagttttgcctgtggagtggagctgaagccccgctaggatcgcctttttccgctgctgctgttttcgtttcggtgcgaggactaagtgcctcttttgtaagtattttacgctttatttacgtttggaactgtatattacttgtcgttttgtgtaccctggctggtcctggacagggatttaatacacaaaatagtctggaaatttgggctaaatttctgggcgtgacaattctgcatgaaccaaaagagaaatgggccaaggcgtatgacacaggtggtgcatcatatggaataatgacaacaaatttggcagaagtttacaactgggtgatgcacggtgttcgtggactgccactagttggcatagtggagttcattttacatgggacatgcagatattttagggatcggttccaggcaattcttccctctatgccgaacaacagcattttgtttggaactttcatgcagaaaaagctagaggagttgcgtaaaaaggccatgaaacatcgagctctagtgcaaggtactcaacaacaaaggtttgagatactttgtcaagataaggcaggcaggggtatctaccgcaagagagtgaagcaggagtgtgttctcaaagccaacggcacatgtcattgctcttgtgcaaagccgaagctgctccacaggccatgcacccatgtcattgctgccgcagcggagtgtggcataccagatgcagtatatgtgtcacagtacttcagtaagcaagcaatatatcatacatggagcagcgagatttatgggttcggcatagctggggagttcacagagactaacgatgaagtactcaatattcctgacccatcgaagctccgaggcaaggctagaaggaggaggactcgtcgcatccgcaacgatatggatgagtcggatgctggtagggtgaagcattgcagcaaatgcgatgaacgtgggcacacctacaagcattgtcctaaagacaaggagaaaccaaatgcggcggaggcaggactatcaggatcagcagtagatggagctcgccctacgggtgaagacactacctacactcgaccacgtcctaggcgtcgtcgtgccacatctggctacgtggtgtagttcttatgttctatgttggcatgtggctttgcttgtaatttgtttcgaacttattgatgtgtttatgtttcgtcatgtaatgtcagacttcggcatgtcatgtctttaggtctcgtgatgtaacgtcagactaaggcacctagtgtgtttaggtatgctgatgtaatgtcggacttcgatacgtaatgctatgttatgttatgttatattatcgaactctacatatatgttaaattgcacgtcatcgttatgtacccttagtaacgtttgctatatttaaatagcctgtactcttgttgtacataattattctcatgattttattactatttcataattttacaacttatcttttgttttacattactactttttgaattgttctaacacgaaacactatatttttcagagatggcacgtcaggatacacctcagttgttggacccggcgatagatcaccgacaccggtctcaccttactgcggtacagggggctcagattgggacgttccgggcacggacgtgcggtgagctacttacggttcacgactcctttgtcgagaggtacaaacagtgtattactataaattagttgcgctgtaataattattataatgacatgttaatttgttattgcaggttgcgtgaggccggcctcctaccgatgtgtcggctggtggaggctgccgccggcgacgtggacccggccagacgatggactgtggaccggtccctcctagcagctttggtcgaccgatggaggccagagacgcacacttttcacttgccgtgcggtgaggtagcccctaccctacaggacatatcgtacttgttggggctaccgctcgcgggagacgctgttaggccagtgaccacgggtgtggactggcaggacgatcttacggcacgtttcgcactagtacagcgcgcaccgcatctcccgctcgagccgttggcacaccaccgcaacaccggacctacgaagaggtggctgcttcagttcaccgtgagtgtttttgtaccgaaatgacaaccgtactacatatttagtccacagttaaggtgcctaacattttatcgaacgcttgcaggtcgagcagctacaggcggaggctgacgagtactcctacagccgctgtttggaggcgtacttgctctggctttttggctgggtgatgttctgtggcggtcacgggcacgggtacaaatcctaccggctttcgtcaatggctagacgccggggtgttgaggatccgaactggcgtagcgatccttgtgtatacctactaccaccttggtgccagcgtcctctttgcctatgcggtgatcgatgccaactaatggcttcgaggaatcctgatattcgaggaaggcacttttttaggtgccctaactatgaccgtgaggtattttattatctgcatatgcttattcattccgtatgggcaatcgctttattcttcgtaacactactctattcgacagacccgcactacggcttgcgcatacatcgagtgggtcgatacagaaaatcccgttctcgacctaaccacttgtttacaagaaggtcgctggtatttcgcatccgaaagtactgagcaatacttacagagaaaagcggcttatgaacgacaatgtcgtgaacaacagagcgactggcgggtgctaactacagcactccctccatgggaagcccgtccagatgcaggtgtggtgatcgttgtcaggttcttcgttctataaagcctacaacattgggtcgaaggttctttgtttgtctaaatattcttgacgatgatttcatggtaagaatattttgattacatgaatctttattttctcacaacatttactaactttgctcgcttgacatctattctttcctctcaggaaccaccaaggagatgtcaatatagagaatggatagacactagaagggttctaactccacctagccatgttgtgcagcttgaactaccagagcaatacagggttactaaagcgcggtttgagagaggagagggatcctcacgtaggggttagctattatcggacaacttggcatattgaaatttctactgtcatgcttccttgtcccattactgcatcgtcgttgtgttcaactattgcactacctccctcctagttcgaatctaatatcatctatgtaaccgcaatggaaatagttgtatcatgttcaaattgtactactatttcttcatgttacataattctccttgtttaagtccatataatgtttctacgaccgagactgcgataggcctatattaattatccgagtactgatacgtcgaataaggtacaaaataatacctcacttaacatatgaaattgcgaaacaaccaacttcaatacatttttataacaatattaacaagttttaccaataaatacttctttatttattattaacataacatagaaaaatcttt

SEQ ID NO: 65338 - DNA, 23020 bp, Oryza sativa
  unsure (1)..(23020): unsure at all n locations
ccatcgggcagcctgtccctttgtgtccaccgtcgcagtagccacaagcgacgccctcgctgtcggaccctcgccgccgaacgccgccgtcaccgaggcggaaggggttgagaaccctcggccttcacccgcgccgcactcttgtccttgtcattgtcccaacggctgtgatgtcagctaccatgcaccaagtaaaagaaaggaggagagagagggatagaggttattagagggaggggatggacatgtggggccaactttttttttaatttagttgatgactgggctgccacatagacatcacgtcagcgaaaatcactcttaaaacagccaagagagtctttttacatagtttttatatttttttttgggggggtggttgtcaaatctgtttatacgatttagggatacgaattagattcaacatatattaaggaagtgaaattggactttttccctcgaattatatacacatgtttgtctcaagtcgtgtagatgcccacatgtacaaaacagcccatttataaaggcccacagagaaagcacacaaagctagcccaaacaaaagccccaaatcatgatccattaacccgttagcaaatgtgataggcctactagatgatgcactagccagttagcaaaataggaataaatctattttgcctctccaacttatttctttggttgaatcgcatcccttaaccacaaaatcgggtataacccgtcccccaacccctaaaactattgcaaattgactccttggatggtttcggaagtggttttgtcccacgtggcatctttgaccctgttgactagctgagtcagcttgtggaacccactgccagtgctcaccgtcgtcgcacgcgttccccacgcgttgccttcgccgcctctaccgcatcgcctacaatccaccaccatcgtgtttccccctccaatccgccaccactgtcgccagccgatgccccctcctcccccatcgccgtcgcccatggggagaggagtcgtcggccgaccgcaaattggggagagaactcgccggtcagcctcgcacggggaggatctcgccaggaggccgcacaccgagcgaggagctcaccggcctaccgtccacaggaggaggagctcaacgggaaaccgcgcgtgggggaggagctcgccgggaagctatgcgcgggggagaatcaaccggcggacaacacacggggagaggagcttgtcggctgctactgttgctgcttccacacggccacaggcgcctcctgctgcttggaccgctgccgccgccgcaacctcctatcccgctgtagcagccacatgctacttccacttcgactccgttgcagcagcctcctctctcacgccgccgcagtcgctgcctacagctgttgctgcttccacgatgccaccgccgccatctccgcaacctactctccttccctccctcgtcgtcgccgccaccctctcataccaccgcagccctcacggcctctgttgttgctggaatgtgtgtgtgagagagaggataaatgaagattaattaaagggaagagagatgggaggtgaaaaaaatggtgatatgaggtggaagtcgctgacatgtgggtcccactcccacctgccaactcagtcagtcaaccgtggtctagcagccatgtcagcagcaatcgcttgccaaatgctgaaggagtaagttgcactagtttttgaggatgagggatgcgtatacccagttttgtgggtgagggaggtgattcaatcgaaagaagagatgagggaggtaaaatagacttattctagcaaaataggactggaaattttgaaactttcagtcctgggcctgttacatgatccaataatccattacaaaatgtaactgatttttttttcttgcataattacatgcatgtctcctatattgattgcattagaatctaatggattttctttttcctcttctgttttaaaatagacactaaacaatgcagtcaataatttgcattttttcttatatccacctatgaaatacacaaaatacatgcaaaatcatcatacttgctgaccatcaatgaatcgattggattaaccaaccaaagttggtcttactcattatgcccttaaacatgccgggctttgttgttggccacaatttttttaatctaactgggccccaaatatgctgcattttctcacttgcaatctactaaaaataaagataaaacctcaagaagacttgtcaccagccaagatttaagggtagtgatcttggctgggtttgcttggctgcatgcaagaattatagcagtctctgaatgacccagaaacatttaccgttgtggagattatggataccccatacctacacggcatgtatagtctgactgggtatggggtgccatgtatagatataatatccttaaaaggactcgggttaaattccaaacttgtacgtcaaaggaaatacctgggatcctagtcggttacgattgtatctcatctgtaactacctattccgttagggatatggattatgctttgtaatgcggacccattcccctatataaggaggggtccgggtgcctctagaggcacgattttcacccaaatcatatgatcaataatacactcggcggatcaatccccggacaggagtagggtattacttcttgattaagaaggcctgaacctgtataaaattccttgtctttcaacccatccatttttccagcttgatagccacccccttttagtattgccgaaatcttgtttcgacagttggcgcgccaggtaggggaagcgtcaagttcttcgccgactactgcgatgggtttcgtttccggcatcgacgacttcgtcttccctcccgggcaggcgttccggttcggtagcctcgacttcatcaccaacgacctcggcaagatttttctcctcgactcgaattcgaaccagtcaggaagaggccagatctccgccccgttcggtatcccgaactcggccgagatctaccccaagaccatctcaaccgagttggcctcaaaccactcggacgagatccaatctactacaacacgacctgatcaagatgatggagcttatccgccaatcctgatgaaactccccgatgatttggctgtcgtcttcaccacaagggcgtcttctccccataggtctaggcgggatctggcctcggccccgatccagcctagctccaggaaagtcggcgtcatgctccagcctctcggcatggtttcgacataacaactggatggctacctcagctcccccggcgtcgactcatggcatacgaagatcattgagtacgacgacttcggctacctctacgactaccgcaacctcgacgacttcgacgaagactttgaagataactacacgcctctctacttcagcatcttcatggccgacaacgagacggaagaacagcgtaaagcccgagaagccgaagaacagcgcgtgcgacaggaagccgaacgacgccgattggaagaggagcgccaagcacaagaacgagaacggctgcagcgtgagcaacaggagcacgaacgggctgcaaagaaggctgaagaccagcgacagcgcgccttggatgccgggcgacgagcacgagaacttatcaggcagcaagacgtcgagggaacggcggtttttcgcacccctcaacagaacgcggttgcagcgatcaccctcctcgacaccctccttaaggaagacgcactcaatcaagccaatcacgtcgtcaacatcttgaaccagaccaagaccatgatcgcagcttcggtcccgattaactccgcaagcgtccacacgccgactggcagccgagtcccccctcttcaatctcaagactatcaccaaccgagcctcagcgtcgttggtgccggatccagtcgcaggagaagggaccacgacgagcgctccgtccacttacctcctgaccgacgcagggagcgtcgagctgaacgtccccgctccccgcatcgcaggcatcccatcgatcttcgcgaaactataaaccagcgccgcgcggcgagaggctacatcccccaccattcaccatatcgctatgacgacgacgtggatggagttgctgccttcacaagcgacctgcatcgagtggattggccggccggcttcaagccgactagaatcgagaagtatgatggcaccactaaccctgagtcttggctcactgtctacggtcttgcaattcgcgcagcaggaggagacaacaaagctatggcaaactatctacccgtagcactagcggattctgcccggtcctggctcctcgggctaccccgtggcacaatcggatcttgggcggaacttcgcgaccacttcatcgccaatttccagggcacctttgaacgccctggcactcagttcgatctctacaatgttgtctagaagtctggagaatcccttcgagattacatccgacgtttttccgagcaacgcaataagatctccaacatcaccgacgacgtcatcatcgccgccttcaccaagggcatccgccacgagctcttagtcggcaagtttggacgcaagcctcccaggacggtcaagcagatgttcgaaaaagccaatgagtatgcaaaagccgaagatgccatcaccgcatccaagcagtcgggcaccacttggaagccgaagaaagatatgccgactatagggggggagtggaagtaccaatcacaaggatcgcaagtgtaagcccgaggaacttgtggcaaccactacaccatcctcccgacaacgttcgcgcgtcaatacctttgacaagatcatgaattcccaatgtccgcatcatccaaattccaatcacgcggccaaagattgcttcgtctacaaacagtttgcagaacaatacgctaagaacgcacgcaagaccactgatggagatcaaagcacgtcaaagaagaaggatgatgaagatgatgccccgactagttttgaagaccatcgcaaggaactcaaccacatctttggcggaccactagcctatgaatccaagagaaagcaaaagctgaccgaacgggagatcaatgctgtccagcccgacacacctcaatatcttcggtggtcagagacaacaatcaagttcgaccgctgggatcatcccgaccgagtggtccacccggggcggtaccccctagtactagacccagtggttcgcaacgtcaagctttgcagatctctcatcgatgatggcaatgcactcaatatccttttcgccaagactctggacgacatgcagatccctcgcacggaattaaagccaagtaatgcgccctttcacggagtcatccccgggctatctgctacaccactcggccagatcactcttccggttactttcggcactcgggagaacttccgcacagaaaacgtctgtttcgaagttgctgatttcgagacagcgtatcatgccatactcggacgcccagcgttagccatgttcatggctgtcccccactatacctacatgatgatgaagatgccaggtcctcgaggagtcatatccctgcggagcgacatcaagcaagccgttacttgtgacaaggaaagctgcgagatggcccagacccgcgagatcacgctcgcccgagaggaaatccgactggctgcatctacagcaaccgaaggagaagtgtctgcaaccaagatgtcgaaaagcggagaaggcgatgccaagaccaagaaaatccctctagatccctctgatcccactaagactgctgtaataggcgctgagttagattgtaaataggaaagcgcgctcatcacctttcttcaaaataataaagatatctttgcgtggaaaccatctgatatgcctggtattcctagagaggtgattgagcactctttacatgttaaggaagacgctaaacccatcaaacaacgactccgccgttttgcacaggatagaaaagattcgatcaaagaggaattgaccaagctgttagcagcaggcttcattaaggaagtcctacatcccgactggctggctaacccagtcctggttcggaagaagacggggcaatggcgtatgtgtgttgattacacagacctcaacaaatcttgtcccaaagatcccttcgggttacctcgcattgaccaggtggttgactcaatagtcggctgcgagttactcagttttttggattgctactcaggatatcatcagatccgactaaaggaatccgactgcttgaagacttcattcatcacacccttcggggcctattgctacatcaccatgccttttggattgaagaacgtatgagcaacttatcaatgtatgatccagagatgcttttcaactctgattggtcgcaacgttgaagcctatattgatgatgtggttgtcaagaccaagcagaaggatgatttgatcgcgtatctagaagagacctttgcgagcatctgcgccttcaggatgaaattaaaccctgaaaagtgcatcttcggagtaccgtcagggaagctgcttggctttatggtatcccataggggcatacaggccaacccggagaaaatcaacgccatcctcaacatgaaaccgccgagctcccagaaagatgttcaaaagttaactggatgcatggcggcgctaagccggttcgtctcatgactcggcgagcgggggatgccctttttcaagctgctaaagaaaaccgacaatttccagtggggacccgaagcacaaaaagcctttgaagacttcaagaaacttctcactactccaccggtcttaacttcgccacatccgcaagagctgctgttgttatatgtgtcggcaacttcccaggttgtgagcacggtcctggttgttgagcatgaggaagaaggtcatgttcaaaaagtccaacgaccaatctatttcgtcagcaaggnctttttaggctcgtatctctcaagtatcaagcactattccttcaggntctcaataagtctatttattattggtgctttctgattatccatcaggcaaattatctcactattttcaaggtcactcggtcacggtggttacatcgtttccacttagggatatacttcataaccgcgaagcaaatgggtggatcgcaaagtgggccttagagttgatgtctttggatctatccttcaagccgcgaacttcgatcaagtcccaagctttagcagacttcgtcgccgagtggaccgagtgccaggaagacacgcctgcagagaagatggagtattggactatgcattttgacgggtcaaagaggctttcgagcaccggagcaggagtggtcctaatttccccgactggagaaaggttgagctatgtattgtggatacatttttctgcgtcccataacgtggcggaatatgaggcgcttcttcacggattaaggattgcaatctctttgggaattcggcttctgatagttcatggagattctcagttggttgttaatcaagtcatgaaagagtggtcctgccttgatgataatatgactgcttattggcaggaggtacgcaagctagaagataaattcgatgaccttgagctaacacatgttctccgacataacaatgaggcagccaacagactggccaatttcgattcaaaacgagaagcaactcctttcgatgtgtttgtcgaacatctttatgaactaatcgtaccgaggaaagaaatggtcgaggccacgtacactcaagaagtaaacatgattgaagccgactggagagagcccctcatcaaatttttgaccaagcaagaactccctcaagataaagacgaagccgagcggatttctagacgcagcagactttatgtcatacatgagaccgagctgtacaagaaaagtccgtcaggaattctgcaacgctgtgtgtctttggaggagggaagacaattgccaaaggatatacattcaggcatctgtggcaatcacgctgccacacaaaccatcgttcgcaaggcttatcggcagggttttttctggcccacagctgtgttcgacgccgacaagattgtccgaacatgtgagggttgttaatttttcgctcgacaaactcatctaccggctcaagagttccaaaccatcccgctgtcttggccgtttgcggtttgggggctcgacatggttgggccgtttaaaaaggctgttggtggttatactcatctcttcgtagctgttgacaaattctccaagtggatcgaagccaaaccagtcatcacaatcatagcagacaaggctagagatttttttcatcaacattgtacaccggtttggagtacccaatcggatcatcagtgataacgacactcaattcactagcggagtatttaaagatttctgtgaggacttcggcatcaaaatttgttatgcctccatagcgcaccacatgagcaacagacaagtcgaacgtgccaatggtatggtacttcaaggaataaaagcacgagttttcgaccgactgcatccctatgccggcaagtgggtagaacagctgccgtccgtgctttggtccctgcgtaccactcccagtcgggctacgggccagtcaccgttttttctagtctatggagcggaagcgatgttaccaagcgaggtggaatttgaatctttacgattttgcaacttcagcgaggagcgctacggagaagaccgagtagacgatatcaaccgactggaggaagcccgtgaagtagccttaattcagtcggctaggtatttacaagggatgcgccgttatcacaatcgcaatgttcgatcacgagctttcttagttggagacctggttttgagaaaaattcaaactacatgagatcggcacaagttatctcccttatgggaaggaccgttcataatttctgaagttactctaccaggatcttaccgactcaaacgtgaagacggtactcatgtcgacaactcttggaacattgaacatctccgtcgtttttatgcttaggcattacattttgtatcttcctctctgactgttaacatcaagtttttccttgagttatcagtcgggggctattataataataatggagtgtgatttcttgtcaattcaatttgcttacttgatttatcattgccttgtttgattttttggcttggtcaatgaggactgaaagtttttcaacaacttttgcgggttctaggctcaataaggtttgacaaaaacttttaagaaattaggagctgagtttaaatcatcaagcacggcataaattcatcagtattgtacaaattgtgactccatcatcatcatcattgtcagaatacaacatcaatcagtttcagtcttttcatcatcagagttaccagacccagtcggcctaaggtcgttttcttggaacctctcaactacatcaacggctatcttatcggcagctttctgcgcgtcattgatgaggtcaagagcagcttcttctcttgtcccgtctgtaaagccatcaacggcgtcaatatcaatcttcgggtacaaggacttggtcatcgccaacgccaggcttgctcccatacttccagcttccttgatgttcttaaaatatgtatctggggcaattctcagcttgtcgaagatttcggaagcatcaaatgaactcggaccattgttattaaaaaacatggcttggacgagtggtgtagcggcgttggcgacctcatctctagctccctcaagcctcttgattttgttaaccaagacgtcgaattgggcttgggatttgattttgtgatctgtgcaagtagatttgtatcagcaagtgggcgtgaagataagagtggttttttgaagtttcagctacaagtaccttcgacatctttcagagccgagtccctctgcttcgtcagttcgcccttatccttttccagagccctgtttcgcctttccagctcagacatcttggcagcttgcactgtattgcctctcattggttagttgcacatggatagcggcatggaacaagtcggataaggatgagaattaccttttgatgaaccgctcagctcaaaattggagtcttgaagctaagcgatccaatctctgaggtcatgctcagtctttctggcaagctctttggcttcacacagctggtctctggttgcctcaagggtttcaaggtggggaactaattttttgagggttgtagtctttgcctcattcctaagatggattctctgcattacaagtgcgtctttatttaagcaaagtggccgatggaatgattgaagctgagcgtatagagacttacatttacaagacgagtagcttggccgagtgtccttttcagcagacatacttcctcgtcttctttttgtttgtttatcacaattccctgaggttgcatttcgtcatcccaccatttgactaatatgggtgggcgagaatcttcagccgatcgtatccggaggacctcttcttcatcaccgatcattgggccttaaacagtcatgaataatggtaaaataattgaagagaatatgtcggattaaaacagatttagaggatttgtttacctgttatgatttctggtcggggatgagcaggtccttccaccctgacaggagagttagttccagagccagcgccagtgtttgtcttgggagggctattggtttgagcctctgcttctgggatatctttactttgctctgtacccgactggtttccagtcgggggctcctgatcagcactgaccttagctttagctgactggtttccaatcgggggcttattgctggttgctacattgtcggttgctgattggtcaccactcgggcgatcttcggtagtcaacccggtttcagtcgaaggaccagtctccgtgccagtcggttcagagtcctttccagatggatcgatgtcagttggtttcctgcaaatttgagatattcaatcaacactactttaatggtgagagaccggtaatacgggggaaattgctgaatgactcatacctggatgacttcctgatttttggtatgggacgactggatgttttcttctttggattagtttgccttggctgtttctcagtcgccctttttgtcgcctgccttttccacatcgtcgccctcatcgtcacttgaaaccaacttcctcttacgagaatctggctggttagtcggcttcgaggtgttagattggatattcgactggatcttcggccctccgctggcttggccagtttgctggcgaggtgagcggtgttgagcaattggaggatcagatttcatcaaagcgaattcctgtgcatggtatttcaagtttccagttgaccttacggaagataaaagcatgctttgagaaaggatgaggtgtataatacgtaccggtggaggagggttgaaggcattatatggcacgactggcaataagtgtgaatagttgaccacgatggcattcgagaagattttgtacattctttcctgcataattctgaactcaagagactctgggtcctctcgaactcgaaagctgttcaggatctttctttgattggtgccagccggctcttgataaagtgccgagtaatttattctccctacagaccctgttctttaagtttcagcatcctgtccagcaggtcaagcgcttgggcagcttcttctcccataggaagtgaattccaggtatcacgatataccggaggaagacaagagtacctgggaagcgttggctcggagttttgcacatagaaccagttcgcatgccaacctttgttcgaggtcttgaatggcatggagaagtatttttggctcaaggtccccctcagttgaaaaccggctcccccaacaacacatggtttgctcttgtttggctggggcttgaggaagaagatgcagcggaatagggaaaaatgcggcctaatccccagaaaagcttcgcaggcatggatgaaattggcgatgtggactatggaattggggtttaggtgatgcaggctgatcccatagaagtccaaaattccccgaaagaagcttgaggttggaagagaaaacccgccatagaagaaatgagaaaataccacgacctcatgtgtgtcaggggttgggaatgcttcgccgcatgctggacgccacccaatgatctcttttgccggaagaacactgtgcgccaccatctccttcaggttctcctccgttacatcggagggcgcccactgactctcaaagctctctctctctctctctctcttccgccatggatgcgatctggatgatatgatttggtttggagtgtggctgggactaaatgggagattgatgcggtggttgcatgggagattttcgtggagttttggaggatggattggagtgaatcggtgaaccctagtttcgtcggtgcggtttcgtactgtagcagagaatggggaaagtggcgagagtttcggtggggaagatgaaacgacgcttgaccttcggtgttgtttcattaagatatcgggagtactaatgggcctgggcctaaacagtacttcagcccaatttttctattggcgtggctaagttgtgatcttagggacttaggcatttttgcttcggcaacatttgctcacaacagtatagcaatgttgttaaaatcctttttgacgcagttagataattctttggaactgctacgatgcaaataaaaaggtgcccaacagaaaagtgttataccaattttgtaggcctttttacgctacaaaagctgttcgggttttgttgagatggctggtttttgaatagtcattctctcggcaagttatatgcttgatttaatcatggtgtgggtcatagcctaggctatttagacttgttggttgtcatgatttatatcacatttgatggatctttttaagattttttactcggatttttatcatatgtgtggatttatagacctttagagtgtttctcactcgggcctctttatatctccttttttggtgtattaaagctaaagcagttggctggatgttttattaaacatcgcatatgcttagctgtatgatactttggatgatttggttgtaaaaccactcggttggatgttatttgcaccttgactatatgtttagtttttaactaatcacatagtcggggggctacacctaattaggtgtatctagtcaatgtacccgattttttctattttcagaccttcacagtctttgattttgatactcgggagattatggcagaagaagtcggagtactcggattatcgttttggattacgggagaagactatttcgtcgactgtaaaggtttcaggggctactgtggagattatggataccccatacctacacggcatgtatagtccgactgggtatggggtgccatgtatagatataatatccttaaaaggactcgggttaaattccaaacttgtacatcaaggaaatacctgggattctagtcggttacgattgtatcttatctgtaacaacctattccgttaaggatatggattgtgcattgtaatgcggacccttcccctatataaggaggggtccgggtgcctctagggacacgattttcacccagatcatacgatcaataatacactcggcggatcaatcttcggacaggagtagggtattacttcttaattaagaaggcctgaacctgtataaaattccttgtctttcaatccatccacttttccaacttgatagccaccccttttagtattgccgaaatcttgtttcgacaaccgtaactgtaacctgttgcacttgcactgcataggattctcatttgccagttggtcaccatagagtcagtagtcagaacacattggtactccactgttcagaatgaggtcagaaatcaaatacagagcacgccgatttcaatccgagagagatggacacacactctccctcaattcaactcctcacgattgcaaaataactaatcgaatttatgtcagaaagtttgtttaaatggtgttttttatgttcctttttgtttggcggaccacttaaatttggggttcaacagataaggcctggtttagttcccaactttttcttcaaacttccaacttttccatcacatcatttcaatttcaatcaaactttcaatttttgcgtgaaataaacacaccctaactagagcctcaaaaagagtttgacaaattaaataaatttcttctcccattgattgttctgcttgtttggagtttggacaacaagtactagtagtaatagtagggccatgtttagttcacatcaaactttccctaaactcctaacttttcatcacatcacatcacatcgaaaacttccctactcacataaattcctaacttttttttcaaactaccaactttcttcaaactttttcctaatttcaaaaactaaacacagcatagatgaagaacaccacacagcaagacacaccacatgacactgctatctatgcactgcagccacatgctgcctattagcttggttcagtgtcactgtacaacactggtgcaactaccaggcaggcagtgtatcactgtatccagtgtccacatcatctcagcttggcagcagcctttttggaatcctgaaaaaaatctaaacattagctttaaaaaaacacaaagcatcatccaaagagctaaagtgcaaaattactgttcctaaaggtaatttcaatccccaccccactcctgggcatccggagtactatctttgattcagaaaatgctacattgatctctgtgcatgctcatcatctttgaagccaggggacatcatcccccttttgcttactagctttcatgtgaggaagtttcccagagcatcttggcatctcatccatctcaaagatttcatgtttccctccttccttttcttttaacctttttctgttgattcatatgctcaaatcttctagggtgagagaacccaaattcaaacaaaagttgcatgtcaaagttagagttggtgttgaattcactgcaagtttaaaaactgtgcaggaagttactttggatagcctaaagtttgcattggccggtgttatcttttgcccaaagatgattgtgtggcttcgtttgttccctccccctcctcttttctaccctgcttttgatgccaaattgctactaattgctgcatcgtcagagtgtaacacgatgattagttcaaatatatatcaatgccaggtcgttggcctctgatgtctgacagacaatcagcaggtttaatagcaatgatacatgaaagaaagccagtagccttggaccaaaagatcattgtaggagtatatctaggggatgaaatcataaaaaatggcctacatggaccaccctgggattgaatgacatcagctgttccttgcgattccattaattttggatgctgattgcatgctttttctcagttttttcttctgtcttgagaaaacgtgatgtcattgctagctgcacccacgcaatagaatgagcctgccacattgcgaatgtgtcaaacatatatagagagagagtttacttgtccatctctaaatgttattctttaattctttttcacctgccattgcaaatgtgtcaaaaggttttccacggttaatgcacatgatcatttgcatctaacgctgtcattcttgcagacataataaattcttgcacagtatatctgttgctcacttagcctggcagtatgcatgtgttgctctgtgaaaataatgtgaagcggcagtgtggcggcaacatttgagaaagcagccaactcacccggccactgcacagtgttgagagttggaaattcgtcggtgactcgatcggtgtagggtagcagatggtagtagctagctagtagctagggttcaattcgcctgtgatatgatgatcgaaagatccattgcgcatcacccaatcagtcacacaagtaacgtgtgcagcctctttgctttcatgtgctgtccggtccatttcccgcctttttgcattgctcccaagtcccaacttttagaggtaaacccaaagatgtgttttgttaagtttggaaaaaaagttagaagttcacgtgtgtaggaaagttttggatgtgatgtgatagaaagttggaagtttgaggtagttgggaatgaactaaacatggcccaagggcatctgcttaatttaggaatcttaataaaatacatggagttaactacttcttatcatatgctccctctgttttaaaatatatgacattttgttttgttaggacaagcatttaaacaatttaaataatgattgcttcattaatatattatttatatgataaagtataatcgtatgactttgaagacgaatctaataacatcaatattttactggttaaaatctaatcgcaacgaaacatatatcctatatttttaaaatggagggagtattaacttcagcaagatcgtttattttaggagacggaaaaaatcagctaattacttcctgttatcagtcaaacacgattgttttaagttaactaactaggaccctatttagatgggactaaaacttttaagttcctatcacatcggatgtttaaacactaataataaatattaaacgtagactattaataaaacccatccataatcttggactaattcacgagacgaatctattgagcctaattaatccataattagcctatgtgatactacagtaaacattctctaattatggattaattaggcttaaaaaatttatctcgtgaattagctttcatttatataattagttttgtaagtagtctatatttaatactctaaattagtgtctaaatatagggactaaagttaagtctctggatccaaacaccacctaagcatcaacattcagtatttaagttgatttcggaaggagtagacatgcaacccagccctcttcaacacagatactaacaaaaagcgtgtctgcgtgtgtgtgatggcaacacaacggtgatcgatcgagccggtcctgcattttttgcagtagtcaggcagtcagtcacggaccattgccactgtagtgacgcagtcagccaagccaagctccactcccatgttggatcggcttgcgcaggcaggaaatcggtcatcgatcaggaggtggtggtggtggttcacgtgttggctggccaccgatcgagcgccggtcggtcgatcgatcgatcgccgtgcgtgcgtgcacacacagcgtgcggcgcgcgcggctgccggaggaaatacgtacggcgcggcagattcaacccgtcacgcacgacggcagcggcggagaaccggtttggactcggacagttggacggacgctgctgatgctgagagagagggagagagactggatgcaagcgagcatccaggcaggcaaacggacttttttttcccgcttattctacttttatttcttttataaattttataataccatataaaaaaatagactaataaataggttttatacggtagcgagacttctcacttacattctattagaagaggacggcaacaacgatgtgcgcgtgtgacggacgaataacgatgatgtcagaggattgcagtgcaacgacagcagcatcgtcgtcatctacctcccctcgctcaggattctctgcagctgcccatgctgccagcagcaatggagccggcgcgcgtgcgcgcgcgcgtgcatcccgatggtctagtgtactctagtggcggatgaaacaagaaaatctgaaacccaaggcaacgaacaaaagaaatgaatttggatgcgtctcgtgcagtactaatctggctatttgaaacgtggatgaattaaaatctttggtaatgacatcgatcccctgcgaccgattctcctccgcgttgtacaatgggtttgagctgagctaacatcatctccaacagagttgctatctgcctcttcaagtaaaattttagcaactctaggtgaaaatcgtactccaataaaattgccatctcactctccaagctattccgctagcaaaataagcccttggaatggccaaccttggagagtcatcttgcctgaccaaacgtgggtaccactgctccatcccatctctctctccttgccataacctcgtaagacggcagtagaccgtgcgccgtcagacgatgtcaccacgctgtcgcccatcattgtctcgcgccaccactgcttccccttcgatgccgatcgcctctcctcccatactcgcctcattcaccgttgtcaccgaggttgcgtcggctgtcgttgtcagatccacatgcgacgaagaagcggctgtcgacagatgcatctacgagtgaagccgccactgccaccgcggatttttcatgagtagcagtgtcaccgccgtcgtcagctccacatccacaggcaacatcgccgcccgggtcaacatcatccttctccccctatctcactagagttgctcgcccttctatacgtatgttgaggtagcgatgttggcttgggtggcgccgagacagttggctgtggcgggcggcttgggcagaggcgatactgcaggactcatgggtagccaacggtgaggagaggaaagattcgatagagaaagaagtatatagagactaatatatggtacccattgttagattggatagtgtaaataggaaggttgttggagtggaaaacaaaattggctctctattctactgtcaaattagctaaatgagcatctggagagtcatatttaaagagactgttggagatgctataagggtgcgttagtttcttgtggttgaagggatatttttagcacacgcaaaaaaaagttcattagcatatgattaattatgtattaactattataaattctaaaaaaaggatttattaaagttttaaagaaactttggtattcatttttttttcacgaaacacattgtttagcagttttaggaagcctgctacggagtaaaaaaaaagcaggaagttgttgtgagtgaaaattaaaaaatggcctaattaccatgagcatgtctccccaactgttaaacaatgtgttttgtggattaggttcctatgcagttcctagtgtgactgcaacttaagcagacatatagggtctattaaaactccatccaacggttgagattgtttaagcactgttcatggaaaaaaacatcacatctactatagccagtggcactgtagcacttaatctacacccttcgttgggaaaatgaatggatgagatctcatgcagtcattaactttcagtcgtagttgtgactgtatttgatctcaatccgtgttttgtgctaagggcaagaatgtttgtgactgtatgtgtatgggtaataaggatgggacccatgagcaatagttatggacgtgtctataatagttaactcttttgaagaactttatgatgggtccactgaaaaaaaaaagcttcctaacaagccagagaaatagatattgaacagtgaaaaaatatattaatattttcctgtgatcatgccttaagattaaggctatctgactatgaagcttaaggctgtgtttgacacattgagttggggctaatccttgatgcatacaaaatggggtgactcattagcacatgattaattaagtattagctattttttaaaaaataaatggattaataggatttttaaaagcaacttccctattttttttgaaaaaaatgcacggttttgatttggtaagcatgcgaccagaaaactaggtagtgaagttggaaaagtacacattccaacacaacctaaggtgagctcccaaaataactaaagtcacaacacttagtgctttttggctaactttttggtatatttttgttgtcttaaaactttatacagagaaatttcttaaaaaataataaatctatttttagagtttacaatagataatatttaattaataatatgtaatgacttacatatcatttttttctacatctaactagctaatcctaaccactatagagaagatatcactactgaaaaactgatctttaatgggtcatgtataatctacattagtcccggttcgagtaggaactttgtgatatcttctctatagcggttaggattatttagtcctagttcctactcgaactagtactaatgtggattttgcatgacccatcaaagatcagttttccctagtaatatcttctctatagcggttaggattagctagttagatgtagaaaaaatatatttagtcccggtttaaaattttacgatctttagtctaaagatcatttttagtcccggttcaaaataggtcaggtgtcccaccaactttattcccggtgcaccgtatataattcctaagacttatcctcacctcctcctcatccgtaactacctttcctcctcctctctctcttctctctatcttatctctatcctctcatcctctcatctttaactattttctagcggcgaggtgcagtgccgggcgagcagccatgtcgggcggcggcggggggccggtggcggcggccagcgccacgccgggcggggagcagcaccgggcagtggcctgtgcagagatcggaggcgggctatgtggatgcaaatttttcctgtgaatttgttcatactgtggatatgtgaatttgtgatgtcaatttgagtatgtttattggatctgtgaatctgtggataattttgtgatgttttgttaatggggatgattttgttgttgagattggtttgaaatcaatataagtagaaaaaataattaaaaataaaagaaaaaaaaggagtacagatgggaaattcagccacgtgggaactaaagatgatttttggtccggttatttcaaccaagatctttaatccttgattcatggtctacagtcataaatttacggtcccaattgtataatcggcggttgtataaccatgactatattgttacgaacggggagggaaggtcctttctccggcagtgtatggaacagctactcaagtcagaaagttaatccgtattaataagctggttaattcaacattttttacgtgggcgattcatgaccttttctccacctgttacttgtatacgttgaatagtgtacttctgactgatttgctggtgcgataatatccttgacagcctggaaacatgttcccatatttagacaccagaaagtaagctgtacacgcttcttaatctgtccaatacaagacggagacaaaacatgtccatttaccctgaacttcgatatctagaaaacggactatcaaaaaaacctttcacaagttatttggatattttttaaaaaatataactataattataatagttaacttttaacttatatataactggtatataatatactacaacccactacttttatactgtctatatattagtgcccaaaattttctgatattatgcaatagtctaatatgtgtataaagcaaattaatatcatatatttaaataaacagacaaacaatactagcatatttgataaatatatgtatatattttgcctatgacatattattatacattttttgggagttttgggagaaaaaacttaaggatgatatattttttcttcacatcatcccctaatatataatgttccgtttcattgattgatgtatggaagttgatatacttgactataaggataagtttactatttatatatttttgcatgttgcctaccaccttatcataaaagccccaacacccctccaccacccaatttttgccaacacacattctttaccctactgacgggcagaccacatttctccaagagacctctgcacgccgactccattgtactccctccgtttcgcaatgtaagtcattcgtttcgcaatgtaagtcattctagcatttcctatattcatatctatctagattcattaacatcaatataaatgtggaaaatgctaaaatgacttacattgtgaatcgaaggaagtagccgccatgtccacatgaatcaagagaggcgacttttagccgtcttagtttctaggcaccacctccacccctatcttgaaactcccccgtgaccatatttggaagctgatgggacatagtgaggggcaccaaaggagagaaagaggcatgtctagcaattgagaggactacccactgcgatcatctgtattgccacgtcaccacaagggcccaactaacctaatatgccctttcgtggcctagatttagaccaccgcgcacagttagtcgtccctaccaacttacagtagcctatcaactaacatccatagtgacccggacggatataagataagattagaggagggactcaaatctccttcttagtcattcagccccgctactctctctcctctctctctcttcttccctctcccctttctccttctattaatggtgatccagcagggtagggggactcgagtccccccagcacacatactggatccgtctttggacctacccacaccgagaagcatgggccgccgcacattcactgtgatgcttcgcccttattgtcttactccctaccatctcgggccctcggctcttttgtgctatcaccgcactatctcacccgcaccacttgccactacccctgatgtaagatggctcgtcacggcgtcgcctctaatgtctttgttcctgctcctcgctcatgccatttctaaagctcagacgctattttgaatcccacaatcgttagttctatgtgggctttttagtagctcgctctgcgacgaggagggcatcggtggtggcctggcgggtagttagacatagtttgccattaatatcatctttatttagaagatgcttccaccctatatcactcgagtacttgcccatcaaatatattttttttgaaactacaaagagtaagcaattaattgaatgtggctgaaaagtttggctcttcatctcttcctttttccagatttggttctccatgtgatatctctggcacgctgaaattgctgccgcaagtacaacaagagcgtcaccaccatcgatcgccagctcgcgaaaaccagaatcgtagtagtaggagcaacgtgtgtgtgat

SEQ ID NO: 65339 - DNA, 9278 bp, Oryza sativa
ctttggctttggacataaatggtgcaactggatttccaacctactgggtactttctcttctgcggttcttcttaatggtatcccaggtcaggaaatagaccatgctagaggtcttcagcagggcgatcccctttcccccatgcttttcatccttgcaatggaaccccggcacaaattattcaagaaagcagaggatcttggccttctctctagtctgcaaagacagcggcgcttcagatgttctctctacgcagatgatgttggtctttttataaagcccattcgagaagaaatgctagtccttcgtggaattctttctgtctttgcagatgccagtggacttcacacaaacatggaaaaaacagagatcttcccgataagctgtaacggagtcaacctagatgactgcctttccatcttcccaggtagaatttcaaacttcccatgtaaatacttgggcctgcctttgcacacaagaaaattggggaaattagagcttcaacctctggtggacaaagtgggatcgagaattcctggttggaaaggtcgcttcttcacttcggcaggtagagaaacactctttcctctaccccaatttatcacctaacaattctccagcaaaataaatggctttacaaaaggatcgatcgccttaggcgagctttcctttggaaaggcggcgatcctgaaaacgttagcgggggcagttgtcttttgaattggacagccgtctgcaagcccaaacctttgggcgggcttggaattctcaatttagagaaattcgctcgggctttaagacttcgatggctctggtacgaatggaaagaggaaaataaaccctggatcaatatggaaattccatgtgatgagatggacagaaatctcttcagagcaagtacacaaatttccctaggaaacggaaagaaatgcaagttttggtcagacaattggctgcaaggatacgctcctaaagacatagcgccgacattattcaaattagcaaagaggaaaacaaactgcgtagcctttgagctgcacaacaatcactggatcacttccttaagaacaatcacttcaataaatgagatcaatgagctggtgcacctaggcagtaagctgcatgagatcagattacaccccaattctttggatagtatcacgtggaagtggactaatcatggtgaatactctgcaaaaagcgcttatgaaatgcagtttgtaggatcagttgccaacacaaattttatgccactttggaaagctgaagcggaacctaagcatcggttctttggctggttaattttacatcaaagaactctcacagctgaaaacctccttttaagacattggccatgcgattggatttgcagcttatgtacagatgcttttgaggacgcaaaccatttggcaaaggagtgcagtttcactaacacggtttggtcccaagtttgtagctggctggacatcatgcagaccccaaatcaactacaggatgcaaacattttagaatggtggacctcaatcatacattcaacttatggaaggagaagaagaaaactgataggggcactttttataacttggtggcaggtgtggcttgagcgcaatcgaagaattttccatcaaaagcaactaagtgccacccaagtagctttcttagtaaaggaaaatatagatgccattcagattttgcgccatacataaaggcttgtgcttagctctagttgatagcatcatgtatgtaaatctctgaaaatgtcacctagtggtctgctctttcttgacctctctaactgcttctccttctaatatatccggcagagctcctgccgtcttttgcttcaaaaaaaaataattttaaactcccccaacgggccctaaggctgtgttcttacctcaggtttcctagctcatctccctctttttcgcacgcacgctttttaaactgctaaacggtgcgtatttttttacaaagtttctatacgaaagttgcttaaaaaatcatattgatccatttttgaaaaaaaaaaattagctaatacttaattaatcacgcgctaatggactgttacgttttccgtgtgcactgttctagttgggaactccctccagcgaacacagcctaatggtatagccaactattatctccaaatcatctatagtcaatttaatagccaattcatataatagttacctataaacatatattacactattaatatttagttcatctgtcatacacaaattgtatcttggagtccgtgttgtccgctactcttctctttcctctgtatccccgctactcttctctctcatccgttatacctgctcttatatccatttgcaaacctttgtggacagcagcaagagcacctaatttggaatcctgtgttcgcacaaaacaccggattccgatgtactccacagttgtatactccctccttcccaaattgatcatcatgtaataaaatccaaaatttctcaaattgatcatcatataactgcatgatatggatttcatcagaatacaattaatgcagtatgggagaatgtgtgcatgctatggtgtaattggcatggggttttaatggatgcatacattgtgggagaatatgtgcatggtgtcttgtttgatgtgatttaaattatccttagtcttggtgcataaacttagggcaagtgctatgctagaggtgcctaccacctctaattttatatattttattcactcataaactaagagtcaacccatacaatgtatcacctctagtacacaaataccaatatctctaatactctcacatcctttttaaaatttgtgtggaggttgtatcttgatttaggggtggctcattatctctcttctcacttctctcctccacctcatcactcaattaatatggcactcttagggacaacatatggggtattatagtacttgcccttatatgatgatcaatttgagaagaagggagtaacctagaattggacaagatacattctaatactacaaatataaacattactgttagatttgtaatagtataatgtgtcttcttcggtactaaattattatattttaggatggagattattatattttagagccgagaaagtatcagtcaataaatcaccgtcagagcacaggctgataggtccccgtttccccaataataacacgaagctagccgtacagtactagtgtcaagtgtgattgtgtgtgaagggttagcgagggaagaagagaagaggcgccgccgcaggaccggtgctgcatttgcatcgatcgcataggcatgaagtcatgcaagcgtacacctacgcggtcaagtgaccagctgctgctgctgtgcacacgcagccgcagtggttcgccatgaatgtgtctgcagcatcatcactcatcagcgagcaggaatcgagcaaccgaatgtgccgtctcctttgcgcgtggaaccaatcccggaagatatgccatgccaggccgttttcatcccatctcattcatcggaccctgacctactgacctcatcccaaattattatcaaactgtttctgttcgcgtacgtaggcccctggttcatatggtatacctgtctttaattttttttaaagaattacgcagtatactcacaacacacgcatactcacccctatgaacgcacgtgcgcaaaccctcataatgcacgcacactcaccactgtgagcatcttcgaagatcgggccaacaaatcataaagattgacgaagtcaccgtaggcgcctcgctgtcgacggatacgtcgcctaccactgaaagcacgagaccgttaaatcctagaaaatttgctcccatgaggagtcaccctccgtcacaaaataagtttatctttcaccacacatatcactacaacataaaaaaaagatcacaatatagtcactttcttaaatcctgatttaattatttctctctttatctattcctgatgtatttattttctactttcataagctccaataaaattattatttagaaataaacttgttttaaaacaatctaacggagtaaaaaagtcattttgaaacgaatggagtacatgcttgccaacactaaagcctagctactctgtgagacactgacggtgatgcactattgggtactgtacactgccgcgtgccatgctgcagcgtgcaaaacagctactgtagccggcatgctaatgtcgtagtaccacgctacaaacggaattgctgctcatgtctctagtcacaccatgacaccacgtagggtacttgacacttgctctagtactagtagtactgtagtaggaagtaactgaggcctgtttagttcacacacaaaaattatatcgaacgtttaaacacctgcatgaagtattaaatataggttaataaaataattaattacacagattgcgactaatttacgagacgaatcttttaagcctaattgctacatgatttaacaatgcggtgatacagtaaacattagctaatgatggattaattaggcttaataaattcatctcgcggtttactgacgaattctgtaattagttttcttttattagtatccgaacaccatatacgataccctatatgacacgtcaaaactttacagccccttaaactgaacacccctgagtcgtcactgttgagcctgtgatctgcacgtacccctagcagccaggctgccaagcccaagaccagcattagcgcagctagccactgtagctggtttggccagcatgtccccttcccctccgagtcaaaaaggtcgtcgccgatcgagacgcgacgcgacggccgatcgacccacgtgaccgatcgaccgcgactccgccgtatgatgtcccgtcctggcgagcccggcgcccacccgcacgcgcatttgccaatttgcttgctgccgccaccgcgcgtcgctactcgctgcagcctcgcctcgcagtcgcagcgagcgccgaggggtcgtggcgcggtggccgcgccgcgccgcgtgtggcaacggggccgtggcttgtccggggaaaagaggcaaagagcggccggccgacgccgaaaaggaggtgggaaaaagcgtgtgcgtgcgtgactagctgctatagtgtgcggtgcccggtgacgcgaacagtaaccgaaaccacggccggcagcgcgggccgatccaacaaacaatgaggctgctgctgttacgctgacccaccgccggtttgactcacctgcacccagcaactgcaccgagttactactcctactgaccactgagttcctgacacgcatggatgaatgccagcccgtgactctacaggaccaccccaagccaagccaagccgttgacatatttcacttatgtttacgcgacagacggcgttcgcattggttcctgaccaaaccaaacgagcagctgccagctgacattgaccgctactgaatgcaacgttacgttgcagtttctcagcatcccaggctaacctgaccacctcgctatacatgcatcacccaatcctgcccctcacaaaactggcatattagtattagtaaaacaaaatcaaacactattcatcgatcgtctactaattgatggcagttcctgtgacctgcttgtcctccaaacaaacagtgctcacttaagtactcactttgtcacaaataagttcatttttaagccatcctacatataccaatacaaaatgagaaagaatagaataatctcactttatcaaattgtaatacaactattccctgcattatctactccgatattctctactttgacaaactttgatacaatgattacttaaaattttggacaaacgggagcagaaaaaaataaactcacactgactttctcgagctcacactgaatgtcacagactcacagtcccatctgtcctctgatgtccttgtctcttgcggtgtttcagtcagttgaaccccatggctgcacctgcatttctttcagtggtgtcgtcctacctgcctggactgacttgaatgcctcgcccaacaacatctaatgattctaatctcaacaatatctaatgattctaatctaatcccatgactttgctgcctctctgattgtcaggacaggagcagtgtgtacaaatgtggagtttataaacatcttggtttgaattctccgcagttctgcatgagacgacgctggaacagacaaattccagctgaaaaagcgcattgccatcgccgtgcgccgtgtttttatccgtggtttttttgctcccacttctcaaatctgactttgccttttgtaaaagtagtacttatatatgagtctagtcagagttctgaagatgtgttcttggaaaagaattctgacgatggccacatcaaaaggatttctgaagatgctcttgcaaatatggatttctaaagaagctcttgcatatatcttcagtggtcaaggctaaaatgttatcatactggtcaactcagtgttttgctcgctggcaattctgtttaaactaaagcattcaaatgtgagcatatttttttgtataaacaacattcagacacctgattaatgtgatttacttccgaagaatggaacttgtgagagttgtaaaacacgttatcaaggtgagaaacgaaatgtttgttcagttcttttactactccaggtttccttgtctgacttcgcagcattttattatattctgtacgaatttcaggtggtagcatctgcagttttcgcaattctgtagtccaacattcataccaaaacttgtaatttttgcagtaattcagtgaagtcctcgtctgaaaacattcagcatcaatcatgtgaaaacgcatttgttgtacgcggcgtcggtaatccgagtgcaaaattcttatatctttgtgcatgaagttaatacaaacgacaaagccaacaaggaaaactcgactacatgttacgcttaatctcttcatcagtgagatcttaaaatataatgacatgacctaattttaactctgaatcgagcagttcatacagcaaaagtcgcaattaagcttacaaaggagcagcgattggcattgttttatcgatccaaatcacgcaacaggctgatctgatgttgctacttctgtcctcttttgctacttacgctgcatcttctttgttcggtgtacacttgattctatgtttccatctgaccaagaacaatggatatgaatgaaggtttcaacctattttactttgatcaagagttgtcattgtctggtttggccctggaagaatatttctgatgaagtttgttcaaggatcagatgacgatacgcgtcacaacgtcggcattacctgcttgtttcgatcatagtttacagcgttttttgcttgtgaactctgaattttcagatattgccagcctaatgtcattgttcagcatcctcttgttgatcggcaagacctccttgtcggatcttgaatctaggcaagtgtcaattcggcaaacatgtaaacttcagaatgaggtgacagatcaatcatcaagaccagctatggcaataattccgactactttctaaatgactgtcaatgtgcgtgattattcagagaaaagcacaaactaattcctccggtaattttctccttttttgtcacctcaatacaacaaaccttgtccccaaaagatagaaaagagtaaatcttgttgatttgttatagtcaattttctgttactagctacttaaagcatgatattcctgagggccttttttttggttcaaactggcatattgttctaagaatctttacatgtaccaaactaagtatgctgttaattctttacccagcaaagtgccagtgtgcagtcactgtttgtgtcgccaaagtgtgggcacttgcccatgcttttttgctctcatggccgaacagtaaccatttgatagagacataaacacatctcaatttcccatgtatatatatacatagcccacacactgcttgctggcttatcacaaaagcaagatttcagagaaaaaggggaagccgggcacatcccacatgccacataatgccatgttgaaacaattgctggcttgttattttgctagatatcaaacattccctgttttaataaatattaagatatttattacagattatttacaaagattgaatttcgttgcattccagcatgtcagctcatccaatgttgggcccctttctttttggttgatggggccaggattatttgcgaattattcgtaccatgcttttaatagtatgatttctctagaaactttctgcatcaaagttacttaaatcacttgttttaagttatttgttatgttcataatgtataatgtatagcgtttaattcttctctataaacagatcgatgtgcatcaacctttctccgcattacatatatgttctacatatatagtaaaatttgatgatttaatactctattcattgtcactttgattgtattgaattgtgacaatgctatgtgggacatctgagtacatgacactgggtcaggatgtcaaataatcgaagcggaatttatgaagtgtaaaaaaaaaatcaaatctctccattacatataccatgaaatttaatctcaccatttttcacaccaaccatcattaattactactacaaatttatcctagtatctgaattttaacggcccaatcttttgcagttaacccatcgctgtcaatgccgctgttgaatccatgcaagaacagcaggaatgatccaagctgggtagctcccacgcaaagtacggactagctaagctaaggtaagttagctagctaccttaccagctagcatcaaatcaaccaggaaaacaaaagaaattcagagctaaccagctgctaaaactctcggcaaccatgttccatgcaggaccagatatataaagatcaatcgcatcgaggcaacagtggataaatctccctgaaatcttcagctgaaaaggtttgggtaaagtttgtggcgtggtgttttggttgctgttgacgcatcacatcgaggtatctatagctctgatcagcagcagtgtagtagtacagtgaatgaaaaccacctgaacggatgaaccgtgagtggctaatcatgtcaagctggctagctagcctgggctgcctttctgcctgataggtagccgtagtagttaggatcaattagccggttggtgacacaggctcaagctagcgcagcaaaggatgcggccgtgcacatgatggatggaccggttggataacacaaatttttgacaatttgaccctttgcaaaactaattttacaaatg

SEQ ID NO: 65340 - DNA, 1637 bp, Oryza sativa
  unsure (1)..(1637): unsure at all n locations
gtgcccctgctcgcaacctaggtacaacgaagttctgtggtcctccaacatcttgtccaatttatgggcctccttttcactttcgcagtcctccctggcgtcctgcaacatctgaccaagatcatccgcaacgtcgttaccatcagcagctatttcctcctcgcccgtttgatttccttcaaatccaacaaactgagcaaagtccggaatattgtcgtcttctacttcatcttcttccatttcaacaccttgctctccgtgggatgtccaacaattatagcttggcatgaaccccgactcaaacaagtggaaatgaatagtcctggatgcagaatactccttctgattcttacacttattgcatggacaacaaataaaatcccttttcctgttagcttcggccactctcaaaaaatagtgcacgccgtcaataaactctttggaccgccggtcagcgtacatccattgccgatccatctacatgagtcaaaaaaaccgtacacaaataattattcttcttataataatgacagtcatacaataattataagatatctttattcatacaaaaatcataaaataatacaccaaataattcttaaaaactatttgtaaagttttaaactaattttaatgtgttttacttcttttaattttcattttagtttgttttctattatttaagattaactttcactagagttttccttctcaactatnttataaaaacttgtttagcaaatgaactaaatttctatatattctttcttccccacacacattttctctctcatcaacttacaactaaattttggagacaaaaaaaagtgtgcaaaacataggtgcaaatgtagtatgacaaaaaaaaacattggaggatgaagttgcaaaccttttaggcacctccgatttgtatgtaatcaccaaaatanattcaatagaaattttggcatgacctcccctcttttttgaagaaattttgaagcttgctcgggcagctggaggaggaagaagacatatatataggggtgggactttagtcccggttggtagcaccaaccggggctaaagatcccggtgatctttagccccggttggtgctaccaaccgggactaaagtcccacccctatatatatgtcttcttcctcctccagctgcccgagcaagcttcaaaatttcttcaaaaaagaggggaggtcatgccaaaatttctattgaatttattttggtgattacatacaaatcggaggtgcctaaaaggtttgcaacttcatcctccaatgtttttttttgtcatactacatttgcacctatgttttgcacacttttttttgtctccaaaatttagttgtaagttgatgagagagaaaatgtgtgtggggaagaaagaatatatagaaatttagttcatttgctaaacaagtttttataaaatagttgagaaggaaaactctagtgaaagttaatcttaaataatagaaaacaaactaaaatgaaaattaaaagaagtaaaacacattaaattagtttaaaactttacaaatagtttttaagaattatttggtgtattattttatgatttttgtatgaataaagatatcttataattattgtatgactgtcattattataagaa

SEQ ID NO: 65341 - DNA, 2975 bp, Oryza sativa
ccacccttcctcttcgcttcgttttcttctcctcgacccgccgaacagcagcccgctcttttgatcttttcctccctctcttcttctccctccgaaccacgagtcgccgccaatggcctcctgacaaggcctcgtctcggttctctgctcgtggttgggggcttcttggcgttcttgattttttggtttgggtgccttggtgctcgttcttgaggcgttcgttttcccttggtttgatgcggcggcggtggtgagggtgggagcagccgcaggtcgggaatggaaggggacgagggcgcggcggcggcggcgaggataaggctagtgcggtgccccaagtgcgacaagttcttgccggagctccccgcctactccgtctacgtctgcggcggctgcggcgccgctctccaaggtgcgccgcccttctcttcattgcctcgccgtgtggttccctttcgcagccaattggttgaattttggggccttttttttttctgtttgatcgtcgattgcattcgtagtatagtttgcatgatttttttttcttctcgttttttctgttcattctcttgcgacccattctgcaaagaatccgggttaattagttagttagttaattaattgattggttgattgattgatttcgtgtgcttgctgaactgtgatggatttgggaattgtcgggattattggtgcatcaaagttcgcacatggactttgtctttggtgacactgacacttgcggctgcggaaaatttttgatttgctcaactagtcgtcatgtttgcagcaaattttaggaagactttgtttaatgccgacaaatattgtcagctgttttatgctttcaagaaagttctgtactttgagggtttaatctgaattctcaacttgccctctttgaaacgaacttttttttatcaatttcaacctagtgccttattacaatgggcagatagtgtttactcaattcttttggaaaaatgtaaatttctacactgatgtaatcttaatatttgcgaaaaaaatcttgctcactgaaacttgaaagatggctgccagtctgccaactacaccattgcagactcgttctctcttcttttgcagttacttctatgccttcctgaatagattacatggggcttgacaaacaaaacatgggttggatttgacctaaatatcttaagattttgggtgatggttgagtagtttttatataaatcctgtggattgcgattattatgggattctagttgcattttagtccccaattgtgcttgccaacgttgctttggggggtcaatcgcaatgccattggtgctggggcttggagaagtggtcttcttgtgcagcacatccttgtcatatcctagttaataataacataatttgacttgcatgagttgcatcctttaaccctcctttgttaggaatgaagtggtcaattgaatattgagatgacatcattcatcttctgaacatttttcagcaaagaagaagtactcagcccaaggttctgataactctgataatggacatgtgaagtaccttgaggtactagagagtgttgcggaggcgcctgaagcaatggatggtgctaccgctgatggtagatctatacccaatagaatttcagctttgcacagtagatcagtttacaaccatgaagacaatcgaatggcaagaggtccaagtacttcaacaggtgaagctactattagaaacgatggtagggaggcaaagtacatgcgcatccgtaatgtggaaaatgctgacatgatgaaatcagtaagaggaagaggtatatctgacatatctccgaggtctccaatcgatggaattccacccacctcttaccaagcggaaagccttgtcaactaccaattacagtcaaaatacagattctccaacagggagcatgccaatgatagggacttggatggtccaagcagagttaggggccttgagaaagatcgtgctgagctcttgaagatgcttgatgagttgagagaccaggtgcagcaatcatgtgaggttactgatgcaccaagtagaagtgctacaactaatagacctgcagatgcctcaagttcacatggtgcgcatgatcagccaaatcagctgaggcatgatccatctgtattgcattggaatggttctcatcactcgccatccttgaatgtgcaaagtcctaatatcccacaagtccatgctccattgcctactcgacagaatcttcatggatatgcagagcccatcccgcatgcgagagcctctagctatcatgctggtgctggttacccctgcagaaatgttgataatttcttctttggacatcatgatcctgaccctttgctctcatgtcaccatgaaggcttgtaccatcagcccgtctgttcttgcttcaattgttaccaccgagagtttttgcctgtacagggaactccccttggttttactgatcaaagggcaccataccttatgaacagttatggagcatatcctgtagagggtcccctatatggtcagcagagatacacttcaagaggtactaatacttctttacagaggaatcacctgaggaccaatgtaaggaagaaaccggcacaaacttgtgagccgattgcaggtggtgcccctttcaccatatgctacaattgctatgaagtgctgcgaataccaatgaaacattctttgttgggaaaggagtataagctgatgtgtggatcatgctcacatgcaattctagtcaaccttgatggaagcaggctcaatgtttcagaacctgcgcccggtataaatttatctgctgcactgcaaaatggtattggtgatagcatgagaaacaatgggcatgctaatgctgatgagaggttgcttccacaatattgtttttctaatggaagtcatgaatctcaagaaaaagatctagaatcaaattcaagtgaatcagatagcaaacacactcctctagg

SEQ ID NO: 65342 - DNA, 16138 bp, Oryza sativa
  unsure (1)..(16138): unsure at all n locations
caccttgtcatttacaaggaaatatagtaatatcaggttgagttgggccactcaatgcatatgccctccttacttgatctctaatttcaggtggataagcttcaattggtttgtgaagcctggatcaccaattatatccgaatgactaaactctgccctaggcctctttggctgacttaaattctcgatactagctgaaggatctgtgttgcttgaactagaataatacgtgagtagtgttctttttaacatgttgataatctaaaaagtaaaaaggtatagaaaacaattataagtttaaaattagacaatcactagctcactgaaattgaagtcactgaaaatctgaaattgaagtcttgacacaatttctaagttctaactgtctattcagagaatcagaggttagtagtttacccactgcgctgccgctggccgcctgcggcctgcacgcctcgcgccctcactggctcgcggtcgcggagtcgcgggttgccgcctccccgacagcacggcggcgctttcccgccgcctcgccgcctcctgcgctggtcggctggccgcgcccggcgctcgcctcctgtcccgaccccgccgcggcaccgcgctgccacctgcttgacgggcgctctgcacgccggtatcgccgcgccgtgccggtatcgatgtcgcctccgctcgccggctacctcccgttgtcggtcgcccgtcagccgccgccctccgcgcgccgcccagcgccccagcccagaccagcgccgcgccgccgccaacagctaggtttaggctaggaggattggggattggaatggccggttggagacttggattagtggccgagtaggccaaaatttattccaatgggctgggccaaaatagaaagagtgagctcggggtggtcctgggctgtcttccctccgtatttctggcccaaaatcacgaatttctcttcttcaacctccagccgccccctctccagccgatctaactaacctcaagcccccacatcccataaaaatttttagtgggggcttaggggggtctccactatcccggaagcggtagtagggtctcaagacccccccccccccccgcccgcccccacangaaatccgcccctgattgctcaaatttatacattagtgccatgaacgggtggtgctaggaatggtggagaggggggcacatgttcttcctcctccacccccctcttcttctcccttccctctttttcctctccatggggatgcagcggtgtagggtggcttgaacccctggcacccatgttggatccgctcttgtttccttgcgcaagattaaaatgaattattttttcacacctatttaatggtcaactaacggtcaacagatgcaatgggtatagaagggatgaaaaaccaaaacccctgggtattgaagggaatgagcaaaacttagtgacatatacctaaattgctgaaatctaagaggtacacaaggaatttaacctttgtataatttcccatctaaaataactttcgacggttgcaacaccgtataccattattattaggaaaaagtcccaattaccttgtgaactcgaatacctgattattcatactgaacgaataacccacttgagcactgttttgggcgcttttgacttcagcctacatatgtggccgccaatgtggcatccagtcagcaaagaaaataaaaaaaatatctcctaggcccacctgtaatctctttcctcaagcctatccctccccattccccactcccctcgctttcctactctctctctacatctatggctggagaaggaggatggagagggcctcgttcaaggagacggtagtcggcggtggaggcggatcggcgcaagcctaaccaggcacgcggagttcctccttgtagtcctcctcatcctcgtagtcgtactcgtagctcccaacatctgagctcccataattgttgccttcgctgacctggagcacgcgggcaagggtgatcgctggcgtcaacctgctgagtgctgtgaatggctgccgtgtctctgttgccgctgctgccacggccacgtcggcgtcccctccagcgtcagcggccagcgccatggtggtagccgggcgggtccagattcgtgacggggttcgcgttggcaccaggcttgtcactggcggcgctactgctcccctttgaatccaccatcaccactcgcgttcatgaggacggagaatggtgcactggtgcaggtgtgtgggttggagaatagtgagcatgcgtgcctagctaagctcacgtcgatccgcctctgccgccagccgtcgtctccccgagagaggtccctatccgtcatcctccagctatagatgcatagagagagagagggggggaagaatgggggaatgggtagtggggagattggcttgaggaaagagatgacaggtgggcgtaggtttttttttttattttcttcgctaactggatgtcatgttggcagccatatatgcagaactcaagttaaatccacctaaaatagtgctcaggtgattatttgttcggtataaatagttgatggtctaaaatatttggtattcgattgcaggggtaatttagacttttccttattattataatatattttatataattcttacttataacttttgcatttaaatacgtcagttatatgcatgctatatataaaatttttacaaataaatgtaggaacttgtagaatttttagaacagatggctaatacagtttttcaaacttggcaatcccggtaatatatatacacacgtatatattttttacacgagggagcgtaaattatgggctttgcattggctaaagttcattggctgaaaatgattttttaaacgaggacttaattttactaatttcactaatactttgcaacgtatggacatttggctagtcggtctataaccaaactccgccattgatatgacgcgggccaaaaggagaaagttttactactacggaaaactccgccattgatatgatgcgggccaaaatgcgaaagttttactagtacggaaaacggaacaaagagcaaggggacggggagagaggttgccttgatcgcctttgagtcagttcataaaatcctctgtccttgaaagttaatatacttggttgaacatatatagtttttttttatttttttctagagcagtggcaagcaaatctttttagataaaaattggttagcccagttgatacttcattcagacccattttttaccaaaggatgacgtagtcaagattacaacatgaatggcattcttagttacaaagtatgtgaagatttgggaaatagaaagtgttgcatcattcatgatctcttgattagttttactgggctaatataatgcgacacccggcatgtcctaatctagctggagcatttcacatttattatggcctgtagatatagaactagactatcaattaattgttctggcaaatggacgtaacagtactcagtcataggaagcttttgtaacatggcatttcttgcaaagtcatcaattggaatcttgatcctcgcgaaagaaaattttaattggatttatggatggaccctaaacccttgactcctgatctaggcacagttgtgaagaaaactaaccctaaatccctaaaccgtgtagccacaattagcatatatatagtataaagccctcattttcttctgcattataggatatccttttgaatcaaagctagctacaggctacttacctggaaagaaggaatatccactgtaccaagataaggtaaagaaccacaatcctatgttttatctcctaattaatcaaatgaaatagagcccggggccgctacacaacacccgaggtgaatcctaagctatttcgcacgttgctgtgggagagttatgtgataaaatagtacacatgagttgtaaaattttctttgttacttattatacaattttcttccacatgcttattatatattttgtacctttatcaattatccaaaggttataaatgattgggttgtatggtgtggctattggggaggagggatgcattttgtaccttatgaatgatctaaaggttaaaaacaattgaagtgatgtggtttcataagagatgagagaattagtattaactatacttagtgaggataaactttattgatatataggatccaaacaatactttttttactgtatttgacaagtactccctccgtcccaaaaaaagacaaaccgtgggttcctgtgtcaacgtttgactgtccgtcttatatgaaatttttttataattagtattttcattgttgttagatgataaaacatgattaatactttatgcgtgacttgtctttttatttttttcataattttttcaaataagacgaacggtcaaacattggacacgaaaaccagggtttgtcttttttttgggattggagggagtagaatatttttttagtgtctatcaaagtatggagaggtaccaaaagtagcattcgaaaaaggtgaactgagagtaaaaaaaagcataaaaatgtgaaacctcgaggtacattcttaaacaaaggattgtgaaaaacctctaatttcaaattcatccctaatatcaacatctcaaagacacgaggatacacttctagaataggatggatgttgtcagattgacaacttgtgtttgtttcatatcttaggataaatttggtactctatttttctaagtttgtaacgaattttctggtactacacaaatatttttcaagcattctggaaccattttaatataatatggtggatttgctagaagaccctgtgttccaaaccactgatagtaaacacaacgtttattgagggtgctcaccttatttaattcctacaaaatttccacattcaaaataagcccttaactgcgcctaagaaacaatataatgccctatagtccctttaattaatttgttttctatgtccgatgagttgtagcttcccacctgttgagattagagagcattgttaccttaaaaaaaagttccagctagaagtggcccttatagagtagtgtaccctacttatagatttagcaacctagtattttgatttttggtaatccttttctaggttaggccaataacatctacatacagtacagaacacacaggaccagtcatctcattagagtgccctatgcccaattaatccttggcgatctctatttgcttttactaatgcagcatgcatgacacatattggactccttagtcctatcaaaagtgaaagatctctatgtccggatataaatctaactacagaaagaaatttcagtcatatgaatagtttcccaaaagaggtgatatgagccaaatcaccaaaaactaaaaattcaaacaaattaaatctgaacatgacaatttatttattttgggtatgaattccaaacacatcttaagattaaaaaaacacattttaagatcattctgaaactaaattttggtttagaaattcagggtgactatactgaaaaaatttgctcattagaaaatttcaccgtcgttcctctgacatttatataactttactggtttaggcaattcatccacttgattttctcattgttgaagaaattaagggttttaatttttgagaagagccttatcatctatggttaggagcagtgggaatttggtcattttggaaaaaagttaatggtcaacactggcgtcaactattataatggacatgtagggggttgaaaaataaactaaaacttaaggacacataggagataaagcataacttagtgacatgaatattagtgagatgaaaggaaatgagtaaaagctcgagggtgtaaaaggattttctctaaaatttaccaacttttttcctctatatagtactgatagcagagcaatttaactaagcttagacatatatatatatatatatatatatatatatatatatatatatatatatatatatatatatatatatatatatatggcaatcaactatatcagggacagttcaagctccaaaccattcatgatggatattatgataggcagttcaaaaatttaaagtaagacagttcaaagaaccacccacgatgatccatcacttttgtagtgtggaggtttgtacaccgacatcttgtacaaaatgtcatgttgaattcaactggaaaaaaaaagaggggaagagtgctttttttgaaaattggttatcggttagaaagaatattgagtccataaaattggttactggtgcataaaatgtttgtccataaggcgcgccgtttacatggccgttcacttaagacagccatcggaataaattgaaataattttcacgggcgacgggtgtcatggtattttgtttacatgggtggctgttgacccatctccgctaataatgaacttcaagtaagtgttttttatctgcctataatataaaattaaggttgagtgacttacggaaatcgtttttctactagtgaggattattttgttgatacggtccaatagcattgttagccgcacggatgatgattgcgtgcatctggtcgatcatgcattcacaaaagcacatggctcttgcaagtacgatagcgagagaaattaacattggtcatattcgagcatcaagtactactccataggggttagctagctgtcctaacactttcttcttttgacactagcgaagtgataaagaggctatatatccttgtactaattaatttatcgcattgagctcatcactatcatcaaaacagtaggggatactttttgttgaaacctacctagctatccacccggactgacccttcttctatgtgccagcattttgtacagcttggaaattgctctagcttgtagcattttgggtttgatacccataataatcagctttccttaatttataatgtcaaagagaaatatatataaatttgggagcaacactcacttgtactatatatacaatattaattcgatccgatattttattctgctgtggcttgtaagctagctgtgacacgtgaccaaagtaacggaaaaataaattagggtagcaattttatacttctattttagcggtttaaaagccaagaacaaaaatataaaatgatgaaaaaacacgtagactattttgaaataaagttttaaaattcaaatttaattgcggcttataggctgatgagctaccaatttctaaatagatatctccttaacaagttcatcctcttagagtgtctgactggtaatctaagtaaaattttaacagcactacatactagaaaagccttcttaaccaatgaataagtcagatttatttccttaactaaaaacccatgtaactatgataccaattttttatatataccatgcggattaactccctaagttcaaacacaggatggctttattcatacgtggtgcatacgtggtggtggccccacatttcagtcccctcctttggtctttcctccctgtttctctttcccgggtgtagcctacaggcacaaagaggttgccgaccggtgcgttagttaggccaatcacaatggtagtgcagtgcaaagttcacgatgaaccttgtgctcccgtctccacatgtacagggtcggctttggcaacaacagaattccacaacatgatgtggtaaggatgaagatcatcaagatggaatgcggattagtccgattttacattcctaaagtattgcgccagttcaatttacactcttaaactatgatacctaaacattcaacaccctaaaacttcggaacagacaaaattctccgcaaatcacaaggtggcaggatggcgttaattctacatggcacatacgtggcatcatctaaaccactttaaatccataccaaagtatatggttcagttcatatacttttaattgaatagtgtgtgattttaaagatcagatctatttatttattttgattcaggattgtgaaaataaaatgttcctctaactacataatcagctaaatttggaagtaaaagtagagtgaaaaaaaaccccgcatcttttctacgtctttgtgaaacagaagcccacaaaaagtaatgggctttttaatgccatttccgaattgcaaattccatagcctaaattaaattaaattccatagctataaaattcttgagaggcctgctattgtttttgggaagaaaagtctgaaaacattgacaccataatgagtcattgggatggtcacatggggatattaattgctatactgaccggcgtggtcaccacaaaagagtgtcacggtttatactctataaatagccgccttgtgaacttaacacttgaacttgaccttgaaaggcttgttgtctgcattgattttgcacaatctatgacttgatgctttcatgattgctgtcacgaagcattgagatcagactttcaattaatagtggaaaattacagatacaatcataaaccatcgatctactaggccatacaaaaatacacacacacacacaatattatgtttcaatttatatctttatctctcagaggttgttgtttccagcaatctgtcagctgaatctgccttcttccacacaaatcaatcaaatttaagtaactattgttccaaggaagttagttatgttgtactaaaactaaaattaaatcaaactcattactcatgcatatatacataaatggaaagaataacattgtacaactatgccctgcctgtgttaggggcatactcgtgggtgtgcgtgcatggtggtgtgggcgtgtgtgtgatttccgtgtaatgaaaaaaaaaaacattgacacaacacatattattttattttctgataagcttgaaataatattatcatcggtgttttaaacttcaattgattgggcaatcactgccttttttgtgttttaggtgaaccaaattatatatcatcacaaaatcacaaatgaataatacatgcaaattaaactacatacaattttgtgcatgcaaagcaacaatgaagaacaacagcgacaacagccgcgccactagaagtacccagaggaattgagccccatctctggtcaacatcccgagagcgataactctaccaattaacctgtattagacgatcactgcagagctgaaactctttcaattttgtgccactgtcacgagtcacaatattgagaggcatatcttagcggctcctatatttacgcccccgtttaattaccaatgcatgtcactcttgaacatttatgatctgcaagctttattttcaccggccactatatatgtttaaatcgatggtttacctaattaacatactattgctaaattttgatagtatcctaaatactttttcacaaagattaatttatatatcattttcgggtggccaacctttgagagctcctttaaatcgtttaattgaaaaaaaatggaagaatagaaaaaacatatgatttaaataggaatgtaaatgcaaaatagagaattagaatatacatgaaaaaaatataggaatgatcatttgaatagaccatatgaaaaacacagtaattagatatgtgagatagacttaaaaaaattcaagaggtatgttgaagctttttatttttttcaaaaatctctataggattgttcttacatagaaatttcaaaggaaattataggattcaatccattcttttagaagaactccataggattattttctataggacacaaataatttataacttctatgtttttcgtttgtttcaaaaagagcctgaaattattattgcatacatgcatgcaagttaggcagaagattgtgttgctgaaagaatgaccaaatgatctaaaaaactatcacattaaaattccaaaatgtagcttttaagcaaaacttgatgcccatgactttctctattttaatcatgttgaacggtcaggatttttcttatatatgaagtgccttagcgaggccatagactttagatcaactttacaagtatatatgattagtggtcaaagctgcatatgcttgattaagcatgccattatgccacacacatgcagatacatatatatatttaaaagaggaagtgcgcgtgtgtccacactatgctttggtaggtgcttcttagcattttcttataagtatctccataagtccatatctacaaagcttcatgcatatgggtcctaaatcatgtgtatgctatctctgataaatcactattgcagatcgaccagctcccaattctgactgtattataaatttgtttttttttcaaaacacaatacagacgcacacgcttgtataaacatctcactgcagacgcaactcgcgatcaacgggtacatctttttttttaatttcaatacaagcgcacacactcatataaacatctcacatcagactactcgtgatcaacgggtatgtcgtctaccactaaaagaataattagccataaatacgagcatatatatgtgtcaaatatatgaattaaatccaggttgataggttttaacaaaaaaaaaccctaacgaattgagctcacctctacatttattttcaacacttctttctaaacctatctttgttagaagagctagtccgtttcaccctaaactattgtgacacgactaaaaacaactacttagctccctttttctttcactgttttttcttaccactaataataaacgaaagtttcatgattatatttattaggatctaaagtacttaaagtttacattagaatagtgcctagtgtcaagaatgtgtaaacagatcagggagtattatcaggcaatttaatttagactggcaaattctagaaaaaaaatacacaaaaaatatcttagaattagtcacatcaatgcataatcaggcatcgctgtccaagtaacaggatgcaacataacttccccccttaaccaccgtccaccggcttggcttgctgctgtgggctttgacatggacgaaaccgatcgatcgatcgatggatccatcgatcagtactggcctgcagtccaggacagcagagaaacgacgccaaattgtagctaaagcgctatatctacttgttgcgacgcatgattcttcctgcgactctcgggatgatagcactgttgatgagaggggaatatatgtcccttgcttgtgatcatccctgtaacttcggatctcgacgttgccttaacggaaaatcatgtgcgtcccagatctatatatattgtcggcagtgctccgatcgataatgagtcgaatcatcggagcactgtagctttagtacataaaattatccatgctcaattgaggatcattttttttttggatttacgtcgagaaatgaacccatagcaattgagaaaaagatacaaccatagattcgttatcatgtctcgtactacagaggatccatgtccttctattggatgattgtatgtacatcatattgagaggtgtacagtggcatgctctctcttattgagcagaattccaattgccccccaacgatctgaaaacgactggtcaagccaatccatctgcagtccatccctgaccctcgtggctgagagaagattgaaatattgaatgcacttcgctgttgataacctcccagtatacaacaatatatactttttctctggtcgataatatttgacacgccgtgcaacgaccgagtaattaccattttacttaattataagacgagctgaaatataccatatgttagattaaccaaattaaaattgaaattaaaatatccagtggctactagccagcgtcagggtccatgcgtcgtccatgctggcgatgaggcaatttggccactgtttgtgtggatgattatttcttggatgcaatgattctctctctttctctctctgtgatgcaatgcatgcatatgtggtggtgtagctagatcaagaagctctctgctgccttaatggtgtttgtccaccggtttgcttccaaggggctaactgttcgttggtgtcaattcattcatgttaccaaacatatgcatatgagggagattgctacctcttcctagagagcatcatttgatggttgctgcaccggcacgatcgacaaacagtcctagcttctcactcatcaaagcctcgtgcatgcaaatattggcattggttgtattacattgaagctagcttctcatgttactattacacataggggcagagctagaacaaaatgaaggggttcaactcgcttactttactctggtttgaatcaaatttaacttaatacgggtgcctaagttatatatatggtgaaaatagataaatatattgtagctaaaaattttttaaaccgggttcctgggcaccccctagctatacatagctccgcccctgattacacatactctcttccttttttttttcttacttgtcatttaggaattcgacatcgatacaatcatatatgttttacagttaatcatgcactcaaaacataacaacatcaaagtaccttaatttcacggtgaatcgatagtatcatcgctctatgcaagatcagatcgagaaagtattcaagttattcttagttaggactaggattgagaacacacaaaaggtaaaaaaaaaatggttgttgatatggtatgagattgtgttgtggataggattcatattgtcagtgtcatgggaaagggatatactagttgtcatagagtctgagtaggacatgactactcaatgtatacggctctaagacatcaaggacatggtcagccatgagtatggtaccatgaattcaagagggatttagtagagtcatgggtatacaagaaggatccctgatcccaagattgccaagagattctgatcaaacttttataaatcaatcaagcttacatacatacataggagccatgccctcgttattagaggagtctccatgattaaccttaccgctagctagggcttaataatgtttatacaatatatcttttgtcctaaaatataacaatttcaaaccagattaaagatatgatcaagaggtttaggttaagaaataggttttgggatagtctacttttaaaataaaaaatatgaaaatctcaaaatagtaaagatatgaaaatctcaaaatagtaaaaatccacgatcatatccttcaaagaacataaaggcaccatgtataaacataacacatgttgggacattaacccgcgatatatacatccatcaccaatatggaaacttaacagccttatttttatgaatcaaccaattaactcggataaaaaaaaaccctccaatatctaatagagaatgacaaacgggcagggttcaccaaactattttgggtggggttactgctaccccgcaataaggtggttatcgcagtattaagtggttaccataaaaactgtatggttaccacgagtattaccataggttcaaaaactgaaaaggttaccgcacgtgataaccgaatagttttgcaaaccttgcaaaagggatcaagatgcatgtgtagggtattggtggactcgtctcatgtggtgacgtttaagtggtaatggtcagtactactggagaaatgatctttactgggtcgacccaaaaccacaatagtcccggttccaaaaagaacctagactaaaaatgatctttagtcccggttgaaaaccccacagccattctatgatctttagtcccagttggtaccaccgacagggactaaagattagtcatctttagttccggttcatcccctgtcagtggcctatcagggggccaaggatcattaggacaccaaccgggactaaagatcaccactcttagtcccagttggtaatactaaccgggactaaagatcaagtcctggttagtattaccaaccgggactaaaattcaatacgtagtatataatccctcgcacttatcctctccaccacaatcgcaaccacatcctcacaaatcccttcctcctccccttcctcacacttatcctcctcacagatccctctcctactccccctcctccccttcttcctcccctcccctctccttcctctcctcccttcccatccggcggcgggcaggcgggcggcggccgtagcaggcggcggcgggcaggcggggcggcggcgggcacggggcgagtggctagcagcggcagccgggcaccctctcctttgccggccggcgtcctttctcctttttttttggataattagtgattcactgagatgtataattttgtgattcattgcatggatctgagatgtatttgatttgtgtgtatttttttaggatttgtgatatatttgatttgtgtgtataagtaacttaagatttgtgatgtgaatgatttgggatgttacattgaatcggggatttggggatttggggtttgatttggggataagcatggcactcgattcgggagaaaatacaaagattaactctggccaaagaaacaaaagaaaagggaccaactgggaccgctaccctatctttaatcccggttagtaataccaaccgggactaaagatacctctctttagtcccggttggtaacactaaccgaaactaaagatgggcatctttagtcctggatttctagtcccggttggaaacccggaactaaagagggttgccaactgggagtaaaaacggtttctccaccggtgggtgccaagaactataaattttattcgctaagatgatctaacaaatgcaaattttgtttaaaactcactagggcattgtaaatcttaaattagagtaaattgcatgcacggtgcaacaagttgataggtgggagcgatttagtgcaagaacttaagaatgtgacttctaagtgcaataacttggcatgtgggtgcgctttaatacaagaatttgataatttagtattttggtgcaataacttggctagatatgtgctattttggttaatgagagctatgcaagttcatgatgttaatatccacatagcaatcccgtagatataatcaatgtttgatgtaatctgtaagaatatattgctcacctaatttacaccatcgatttagatatttttcaccatactcaaataccaactagaaaatttctacacagtaaaatttatttgacttttaattactagagtgacaaaaaagaatattcttgtgcaaatctacataagtatattaataactgagcacatatagccaaaaaatactcaaaataattaagtttttacaccacttctcaagttattgtatcaaaatcacacccacctttcaagtagttgtacccataagcttatttattaagttttgtttattaggttgcacccacttggcaagttgttgtcctagcatgctcatttctcaagttcctacactaaattgcactggatttttcacaattcggtccttttgaaaaatttatttcgcaaatagaccgctgaaaatcttatcacgaaaatggtcttttttagggcgccagagtcgctgcctctctggcgccgtcctccagcaaccgtggcaggtcggcgctgaggtggcaggggagcgcgtcgtcccgttgaacgacggcgccagcgactctgtggcgccgtcccgttggacgacgcctaaaatggactattttcgggataagttttttttagtctatttgcgaaataagtttttttcaaaaatagcaaattgtaaaaaaaatccagctatatcgcatcaacttgctaagttgatgtaccgtaaatgcacattaaattattatggaggccaagcccctgctcgtctcctgttgtctatgccactcgatttcaggagcaataattgaataaattcgaataatacaagtacatttatatacatacatgtttttttttgcttctatttaaaatagtgcagactttgtttcggtagtactgccagattctatatctttttcatgacgtcaaaaacatattttgtacaggaaactttagttttttctgtactgtatatgagtatatccccacattttcctgacattggcacacactgctacgtacgaccactcatggttttgacgtgtgtacttgaatatgtctaagatgcagcaagtgggaacagtttatactcaactattttttggatttgaatgatcgggaaaccaaaattaa

SEQ ID NO: 65343 - DNA, 14250 bp, Oryza sativa
attgaaattggaacgatgtgatggaaaagttggaaatttatatgtgtaggaaagttttgatgtaatagaaaaattaaaagtttgaagaaaaagttagaaactgaaccaggcttaaaagtgcatatgtacgcaccaaaaccgagccagccgtccaagccttattacagtcgtaacaggtcaaattgtttttaaagtcgtaccccctctcctaaaaacccaaaggaaaaacgtttgaattatacccttagtctactgagtaagtacgaattataccctatacctaaaaatcagacatatttcattcttaattattacttaacaccagacaaattaccttctaatttaaataggagtggttttaattctacgtgacagtgtagtaaaaaaatataaaaacttagtactcgatcttgtctagattctaacatctaaacaaagaaatatttttgtgtacactgttaatgaaatatctgacatttggaatgtaatccctccgttcaaaaataagtgcagtcatctcgttcaaatttaaactagaggactatatttattttgggacgaagagagtataaacttttgcatgaaaatcaaataaaactccttgctcggtagcttattttcaccttattcatgggatccttaccgctgataatttgctcaaagcttttaacaatatgtttccttaaaaaatcattcttttactgaatagttagattacttgttctaaactagtagcatttgttttgttttcttctaaaaaattaatttatccctcataaacaccttttttttacctactagtattttattttgccaatactcctgtagcctaataaccatatacagctttcccggccagacaaccagtcaaccactacccatctggtctgcttatttgctgctgtacgtgtcaaatttccattttgatcaattgcacaaaaagggttagacatgaaaatgattagtagaaaataggtgcacccaagatgattaattgctgctgtctgtgtgccttcaaacccaattttgttctcacattaactcaaattccttgttcccgcattaactccaattgatgtctgaaaggcagacgtagacaaccaaacacgccgagctccctctcacgcgagccaccacaaatataagatccgctagatcctatagagatagaaaaaatcaaaaagaaaacaaaatcatgtgccatattcttatagtttataaaaatgtgtcattttatgttggtctacaaaatgtaattctgactataatttttattgcagaaatatagggaaaacctgataattatgaaattatttttggaggaaaagctatgtatattatcatacaactaatcaaaatattgaaaaataaatcagttttttaaagtttagcttgaaactaaccaagtctataagtatatatttttcatgactggtgggagtagtacttctattgctcgagtgtagggtggcaacggggcgaggcggggccaggttgggttggaacgcccctgcccccgcccccgtccccggccctagaaaggaagttgggtgacaaacatcacccgtccctacccccacatgggacccgacgggtgaccggggccccacatcacccgatggagttaatactccataaatatattgaaatacactgaataatagtatgctaaaatttcaatagcctcgggcggtgtgggttgattgaagaaaggaaaaggattacggttgaggggaactagggtgttgagcttttatatgccaattttgaatgggattgttggatctatattattgcaatgggcaacttttagagaagtaactcacatctggggctcctcagggtcacccacaggttaatttcgatccccgcccccatctctggaattttgcggggccctgtccccactcacccgcgggtgagaactctctccgcccccaccctcgtagacgggggcggatccagaaccagattgaaggggggactcatctccttctcctttcttcagtccctcattttctttattttctccctcttcttcccctttcatctctcattctatcaatggtgatccagcggggtggggggactcaagtccccctagcacccatgttggatccgcccctacccatagcggcgggtcccggcgctaatggggaaattgctacccctacacgagtgagcaatggaaacttgtttggacttgtaatataaatctgtactacaattaaaagacactagtattggtggctcaccaccatcatatataatcactgccatgtaggccatgaaacaagtactttcttttactctatacgctgtagttctttaacttttctaaggatggcatttttctttttctatttttaaggtgaaaaatcctgcttcaatcaatattttttcaacaaggactattttttctttcaagttttaataattcgttgtaacgcgtggatatttggctagtaatataaacttatttaggtaatgataacaatgatatcgacattaggggatttgcttaccacagctctagagacaactactgaagattccctaagtgcacgcatgcatatatatatatatatatatatatatatatatatataaaagttgcttcatcaggcatatagattgtgtaagacaagatctatcctcgatcacgttgagtcattttcctcacatatatcaaacttattttaaacggttgtttcgcgttcgcgaaaatatttttaaacagctgtttcaccatgcgtatgtgcatacattactattacatctttcttcaattcttctcattgtcataaccatttttcttccatccggcttgtcgatattccaccctgctgtactttcaatgactcccccttttagtatcacctttaacttattggtgagataaaatgaaagttgcatctatcttgagaaagagattgtctagctttaaggttgatgaattaatctttaaaaatttcaaacactccactcatcccttaaataaaaacacaactactttttccctaaaaaaactactgtcgagtttagttccaaactttttcttcaaacttataacttttccatcacagcaaaactttcccacacacacaaacttttaacttttccgtcacatcgttacaatttcaaccaaactttcaattttagcatgaacacaccctacttccgtcgcacccttactctatttaaacgcaatccattttttcttatatggaaagttgaataagaataaatttaatgcacaactgaaagttgaaatataaagtatacaacttacattaaaaaaataagtaaaactacataaattaacaaaaggcagtaaaataaactaaatttccgcacataacaacgtaatcttaagacttaataatggtgtaatttcaggtgattgaagaaaacaaaaaaagggcagttgaaatgtagcaaataccctccagagatatacaaaagctgcgaaatccatgtgaaaatcattttaagtccactcttacattgtgggacagagtacactattccctcatcacaaccttccggatgctcatcttgaatttaaattaaatctacccaaagtaacgaacctggacaaagatcacatcttgtcgaattcactacagtgaacttactacatcgtggggcatagagagtacagcatcttgacaatcacatatgtagctgcatcaggcggccagatgatgagcccccacatcctttttgctgctaagtagggtgatcagtacaaaaccaccatggcccccatctagcgtccaaatcattccagccagtttataccaacaaagttaagcctctgtttggtacagctttggattcaatatttcttaaagctatgtatgcctagcttcacaaatctataaatctgaatatacgattgcattgataacatttggatgaatcatttttttcctattttaaataaaatataaaactttaaaccactaaaatttaaaatacaaacttcaaatccatggttaataagtttctcccaaaatccaaagctccccaaacagttcatttttttatttagattatgtgaagatatagctaacaaatacaaaagatgaacggaaaatcagaagtttgatttattttttttcatttttttctatatttttaaaaactggctaagtggttatcaaccagatgcttcttaaaatctcaaaatatctccaaacatgcccataagatagccatagcagattcgtttcgttctaaaaaactgtgaagatgtagctaccaaatacaaaagatgaacgaaaagttagaagttgtatttattttaatcttttctagatttttaaaaaattggctatcaacaggcttgttagaatcttaaaaatcttcaaacatgcccataagatagccatggcggattcgtttcgttctcaacctatcacccataaaagggacaccaaccactctctttcccacgaactcctctctccctccctcagtccttcctcctctcgtctactcactcccctcaactgccaattcccctctctctcctctgcttcttcttcttcttgagctgatccattccatttcccgagctgctcaccaactccttctagaggccgacgcggccggcgccattgattgcccatgcactgacacgaccacagatgcctccttaactcctccactcccccacgtactgcgcgggaaccgatgcgcccatgcactccacgtagctagctaagacgcgccggagtggtggcgccggcgatgatggcgcggcggcgattcttcccggcgtgggtggtggtagtaatggtggtggtggtggttcttggttcttgctcggcggcggcggcggcgggggatggtgatgcgctgatggatgtgaagaatgcgttcgtggaggatcccggcggcgttctggcgggatggggcggcggtggcggaaactcgtcggcgttctgttcttgggcgggggtggagtgcgacgcggcgggggcgagggtgaccgggctgaacctgtccggcgccgggctggccggggaggtccccggcgcggcgctggcgcggctggaccggctggaggtggtcgacctgtcttcgaacaggctcgccggcccggtgccggcggcgctcggggcgctcgggaggctcacggcgctgctgctctactccaaccgcctcgccggcgagctcccgccgtcgctgggcgcgctcgccgcgctccgggtgctccgcgtcggcgacaacccggcgctgtcgggccccatccccgccgcgctcggcgtgctcgccaacctcaccgtgctcgccgccgcgtcgtgcaacctcaccggcgccatcccgaggagcctcgggaggctcgcggcgctcacggcgctgaacctgcaggagaactccctgtccgggccgataccgccggagctcggcggcatcgccgggctcgaggtgctctcgctcgccgacaaccagctcaccggcgtgatcccgccggagctcgggaggctcgccgcgctccagaagctgaacctggcgaacaacacgctggagggcgccgtgccgccggagctcgggaagctcggcgagctcgcgtacctcaacctcatgaacaaccgcctctccgggcgagtcccgcgcgagctcgccgcgctctcccgcgcgcgcaccatcgacctgtccggcaacctgctcaccggcgaactccccgccgaggtcggccagctgccggagctcagcttcctcgcgctctccggcaaccaccttaccggccgcatccctggcgacctgtgcggcggcggcggcggtggagcagagtccacgagcctcgagcacctaatgctctcgacgaacaacttctccggcgagataccgggggggctctcgcggtgccgggcgctgacgcagctcgacctggcgaacaacagcctcaccggcgtgatcccggcggcgctcggcgagctcggcaacctgacggacctgctgctcaacaacaacaccctctccggcgagctcccgccggagctcttcaacctcaccgagctcaaggtcctcgcattgtatcacaatgggctcaccggccggctgccggacgccgtcggccgcctcgtgaacctcgaggtgctcttcctgtacgagaacgacttctccggcgagataccggagacgatcggggagtgctcgagcttgcagatggttgatttcttcgggaaccggttcaacggcagcttgccggcgtccatcgggaagctctccgagctggcgttcctccatctccggcagaacgagctgtccggccggatcccgccggagctcggcgactgcgtgaacctcgccgtcctcgacctagccgacaacgcgctctccggcgagatcccggcgacgttcgggaggctccggtcgctggagcagctcatgctgtacaacaactcgctcgccggcgacgtccccgacggcatgttcgagtgccggaacatcacccgcgtcaacatcgcgcacaaccggctcgccggcggcctcctgccgctctgcggctcggcgaggctcctgtcgttcgacgccaccaacaactccttctccggcggcatcccggcgcagctcggccggtcgcggtcgctccagcgcgtccgcttcgggagcaacgcgctgtccggcccgatcccggcggcgctcggcaacgccgccgcgctgacgatgctcgacgcgtcggggaacgcgctcaccggcggcatcccggacgcgctcgcgcggtgcgcgcggctcagccacatcgccctcagcggcaaccggctgtccggccccgtgccggcgtgggtcggcgcgctgccggagctcggcgagctggcgctctccggcaacgagctcaccgggccggtgcccgtccagctcagcaactgctccaagctcatcaagctctcgctcgacggcaaccagatcaatggaacagtgccatcggagatcggcagcttggtctcgctcaacgtgctcaacctggccggcaaccagctctccggcgagattccggctaccctcgcgaagctgatcaacctgtacgagctgaacctgtcgcggaatctcttgtccggcccgatccctcccgacattggccagctgcaagagctgcagagcttgctggatttgagcagcaacgatctcagcggcagcatcccggcgtcgctcgggtcgctctccaagctggagagcttgaatctctcccacaacgcgctcgccggagctgtgccgccgcagctcgccgggatgagcagcttggtgcagctggatttgtccagcaaccagctgcaggggaggctggggagcgagttctcgcggtggccgcgtggcgcgttcgccggcaacgcgcggctctgcggccacccgctggtgagctgcggcgtcggcggcggcggccggtcggcgctgcggtcggcgacgatcgcgctggtgtcggcggcggtgacgctgtcggtggtgctgctggtgatcgtgctcgtgctgatcgcggtgcggcggcggcggtccggggaggtgaactgcacggcgttctcgtcgagcctcggcggtggcggcaacaacacgaacgggcggcagctggtggtgaaggggtcggcgcggcgggagttccggtgggaggcgatcatggaggcgacggcgaacctgagcgaccagttcgccatcggctccggcgggtccgggacggtgtaccgggccgagctccccaccggcgagacggtggccgtgaagcggatcgcgcacatggacagcgacatgctcctccacgacaagagcttcgcgagggaggtcaagatcctcggccgcgtccgccaccgccacctcgtcaagctcctcggcttcgtcgccagccacgacgtcggcggcggcggcggcggcggcggcagcatgctcgtctacgagtacatggagaacggcagcctgtacgactggctacacggcatcgccgccggtggcggcggcggcggcgacggcgagcgcaagaagcgcgtgctgagctgggacgcgcggctgaaggtcgccgccgggctggcgcagggcgtcgagtacctccaccacgactgcgtcccccgcgtcgtccaccgcgacattaagtccagcaacgtcctcctcgacggcgacatggaggcgcacctcggcgacttcggcctcgccaagtccgtcgccgacaaccgcaaggacttcaccgactccgcctcctgcttcgccggctcctacggctacatggccccaggtaaaaaccaaacttccgttgtgtcaattgctcgccaccatgtccatgtcgcggacgccattgatgggcatcttggatcttgcgcgcagagtgcggatacagcttgaagacgacggagaagagcgacgtgtacagcatggggatcgtgatgatggagctggtgaccgggctgacgccgacggacaaggcgttcggcggcgacgtggacatggtgcggtgggtgcagtcgagggtggaggcgccgtcgccggggcgggagcaggtgttcgacccggcgctgaagccgctggcgccgcgggaggagtcgtcgatgacggaggtgctggaggtggcgctccggtgcacgaggacggcgccgggggagaggcccacggcgaggcaggtgtccgacctgctgctccacgtctcgctcgattactatcgagccggcgagcacaagcgctaggctacgaggacgatttccaaacgctggaaacttgtcctcctgagcattttcttttcttttttctttctctgattcttgtttctggtggctaattagatcatctttgttgggtgaaagaggtaacaaaaaattgtgcatttttagggggggtgtgtggttgagaaaatcaaatcaagcaaagaatcctcttcaattggattgtttttaactgttccaagtgtaaactgtgtatggagattgatttcagaagcatctgatgaattctgaacattgtttcatctcagcattgcccagtcctgtttcaagtgatgctctgaaaaatagttgaaacagaaatcgcaacatgaaagagacatcagctaaagtctcatgatagggtaaaagaagttacttcaactcacaacattaaggcatggcaaacacaagtataaggataatcataacaacaaacagaaaaagagcagtggacataaggatggaggagcagtgaagaaaaggaatgaacgagcaaggtgacatatcacatcactagaacctcacaacatatgggtaagcagaaattctaactttgtaaaagcgctaccgttggtactaaacaatgactttgcatcagggaaggtataccatcagagccgagttcgataattggtttctcatacaagcaaaatatcacatcctttgtgaaaacaacagtttattacagcaccgcagttgaaattgcgagccgggtgttgatacggcgactacagatggatggtccaaaccatgtgtacagaccatacaaactgaaaaaaaagagtctggtggctgacaaaccaatatgaaaatagctaatcatcatcatcatctgcagaaacagaaataagagattgataagccaataaatattaaacagagaaaaggtattgtatttataactattcataaaaatgagcacatggttcaacagaaatagcatagaacccatctacaaacaagagctctactggcttcagtaatatttggacgactgagctagcaaaggtacacaaatatgttgcctgaagctgttagacaccaaaagcaacacgaatcactactgccatttacacaggttgtgttcatactgatcagccagcccaagtcttaaaaaccagatatcttgttctagcctaagctttgtttctagctccatttcatttctactacaacaattatcaagcaaacaagatagccaaacaaatggaaatatactacatgtctacatctaaaagtgtgtagttcattcatgctacaactaaagattggcatatcatgccatacactaatcatgctcctacagtttttgccactttctttcttctatttgcattctcactaaaatggtcaattgaaaattttcagtcgcaaaatctatttactcacaacttttgagtattgatatggtttattgatactgaaatgaatttatattttacattatatggtaatgaacttttcaagatatccttttgtttacatgtaacctccatatattgatggggaaaaaaaatcattttactgctgccttgcttattagctgtttatgtgtgatattccaaacaaaaattagtgataaaattgaacttggctatcacaccaattcctcattatttacccaaccttatgtgaccttcagctttagtatgaatgtgtcatagagacggactgtactgaatttcccaaacgcaatgaatactagttctttgatcttttggcacattgtgcgcttgagactgctctcaggtaatattgtcctgatgtcctctgccacaatttaacttgaccatagctgccatgctgttgcacttaagccactatatgaaggtctctagagaatttcctgaacaggggagtagtatgagaatggtacatcgtcctagctttactttttttattagtgtaatggagagtggagactacaaagtacaaactatagaactcttcagctgaaatccaaatttgaccccaggtgttctatgcttttgtacctaagtcgatgccagtgaaccactagagtgaacatgtccagataatttcctacatgggaatggtttaaaaacggtgtatttactccaaggtttgatgtttttgctatggacgtaccaacagtgccctcttttcttttgcagtattgtgtttgtcattcatactagcgaggaacattttgcagaaacatagaataaactgttactccctccatctacttttgatagtcatatttccaaatctgaaaaatttatttttgataggcatatttcaatccaacaacctatcctcttaatgactttctcggatttaatgcgtgaccctccattcctccacacaagattggctatatgggcattgagaaatgtagatattaatgaatcgcttgtttacaaggaatgactagtagcatgtttaaatggatgataagtagaattacttatccttggtctatgtgccaagatgaaatatgactatcaaaagtagatggagggagtatcttgtatgttccttatagatctaatctatttagctactttatgttgttagttttaaacacgattcctttaaaatgcaatcttcgttgtttgttctcaagtacgtgataaatggttacccaagaattataactgtctgcggagatggagactatctgctggttatcaataaatccgggtatttctgcttggccaggaggaggttccagttcttccatacctccgttgctatctatcatggaatatgcattattatacatcacttgtgtatgccactcaaaatgctatcccaactgttcccaaggttgattgaatgaaccatgctaaacttaacacttaacaatctgaatggaaaacagattattgatgtgccatatttaagttccatggagtctaaaaatattattgtatatactagtaattattctaactactgctttgattaggaggcactactgattctttcaacagagtagcataaccattacggagtaccagagattgcaaagtcaaaattacagtagtaatttggagaatacaacttgttattactatcacttattctttaagtggcaatgctaaaacgataggtcgcatgtgggcaatagtaataacagaaagcagaatcgaagaaagagtaatctgaattcaaaaaaaatgttagaggaattaggcacgaaccaaagtaacgccgctcgttggcttgctttgcacgctcaagcatcttgtcgagatcctccttgagcttctcatcccacttcaccagctggttgacgaacaccgcacccaggcccattcccaccacatgctcccagggatctaaaaatacataaatcgtagcatcaagaaccctcttcaataaaaagaggctgccattttgatggtatctccctcaaatcaagtgaaatgggcaaatccatagcatcataaaactgtactaaagctaaaagataaccaacattgtagagctcacaaaacctaaaaaagtcaagaaccgcatcacatctagaacacctaagaacacgcggagagacggagccccccaacccgaccaagatacacgcgtctccggcagaaacaagtacagatcggacggaatcagcaaccagcaacacgtacagaatggcaggacgcgacgcgaggacagatcgagagagagagagagagggggggggaagagaggaggagggggggggggttacgtatcgaccgtacggcgcatgtaggggagcttgcggagggcgttggagtacatctgggtgccgaggcccaggagggcgccgatgatcgtcggcgtcgccggcatcttcggccgccgcgctctcgatttctcctctttctcgaggcggcgtggggggaaggagaggggagacgaagacgagatgggtgggaggagtggacggcgaggtctcggagaggctcttgggagtggtggtttgctgccactgtggtgtggggcccacgagtcagcggagattgagaaagaaaagcccatgggccgaaatactccatggactggtaccggatctcaggccatggggcatttgccatggctgaagcccatgggtttcttcctcttttttttttccaccttgtgtaaattgaaaaaaaaagtcacaagaaaaaatggaccaaaataatggtgaaaccttttttttatttgtttcctcattttgtggttgattattttattagatatattattaatcctttgtaaaaacatttgtatgtgcttgattttttttcattaccttattttaatcaaatgggcagatctcctgtgttcgagttttcatatttagttgatatcgtacatatatttgtatgatccatggctccatgctaagatttttagatatttgagcatagtataccggccagcattttttcatgtttataggctctgcaacactgtcatcctagcttgctgccaacctcactcatggctccaacagtccaagggcacatgcataccgtggtctggttgcggcttcattgctattcccaggttttacaattagcaaaatttcgtgatttctaggcgccccggaatcatgtttcgaatggtttttgagaaattcaaatttaaaacagtaattcaactgagattggtcaaaatttctcagttttcgacatcttgctgggtcgaaattcaacaccccagcggtattgtgaaccaaacctagtctattgcatcttcagtctcctaataatcccaaaggttgtcagtgaactatagctcagccagcgcataaaacagtcttcaagtcatacttttaaactctagcaattagtacactgcatatagtacattttttatattgcagatttggcttgaagctcttcttcctgctcctcatcactgcagttgctgaaaactatcttctttcctgcaagacaatgacgaatactgttattgtccttatgaaactacgcatcaaatcgatgtttgttcttcagttcattctaaatggtttgtcctcttcatgaaattagtggcatgtgcttgtgttttacttttgggacaattgcttatttgaccccgttttgaaccctaactaccaatttgaccctacttttcagagtttgcttatttgaccctccttttcaaaaacgaagcccccgtatgaccctgttctgttaagggcatctaacggtgttaactgaagcatagaatatctcttttgcccttactcatttgaccctattacatgtaggacccacccgtcagttctctcttctcctctcctcgtctcctctcttctctcttttcttctcttctcttctccacggatcggcgagagggagagcaggcgccgatggggcggcgacttgcggcggcggcattgttagggcggcggcggcggcgctctgaggaggcggagggaggaggcggcagcggcggctgacgaaggggcgagttacggtggcagcgcacggagggggcgagcagccgcgccggctcgtggagggaggaaggaagcggcggcagctaggggcgcggaatgaaggaggtggaggcggcggcgccggcgcctgcgcaggcgggtggaaggagggagaatgcggcg

SEQ ID NO: 65344 - DNA, 1491 bp, Oryza sativa
atcaactatctgaaggcccaatcaagtctaacattgattggcttgaggctcgcaagattgaccttttagcacaacttgaagaatgtaacgctgagctggatatggaacacaagaaactagccgatctccccaagtctattgaagaacagaaagcgagactcaaatcggctattaaacatgttgctgaactgaccaagtccctgaaagttatcccaggaaccgatgctcaagatgcccaagccaaagaggaagtagagcagattaggtagaaggctatatcggctatccagcgatacttatcgcggtaatctttgctaaaacattctgttactgtactgttggaacgatcctttgcgccgattaatacgactttgaaatttgcgcaaacaaaatttaaaattttatactgcatgctgatatatatatatatatatatatatatatatatatatatatatatatatatatatatatatatatatatatatgcccccctagttatacaatgtcgagagcattgataaaattatgaaacaactaagggcgataataatatcggccattgtacattggcaaaacacaaccgatcacattataaaaacaactaagggcgatataacaatatcggccatctcaaggcgatgtaaactcatcggctgtcatgtatcggcaatagtagccaatcatgcgttaacccaaacactgtggtaatatttcttcaaatatttgccattgagcgctcgcacataaacttaaccgtcgagcccttgcaacatatatgctcccttagacacaaccttatgaatttggaacggtccctcccaattcggcgaccacttgccgaatttactatcacgagtaccaatcggcaaaatcagcttccatacaagttctccttccaaaaaatctttagatataactttcttattataatgccgagcaacacgttccttatccttagtaaccttcgcaagggctcgcaatcgtgactgaaccaaatcctccctctcattagccataagattgtaatactcatcggctgttaaatcgttttgcagctccgttcgtcgagagccgattctaacttcccatggcaaaacagcctcgattatatggaacttgaatcgatccatgacaggccatcctataagaccacaatgcttcggccaaccgagtatgccattgccgaggataatcagaaattttttgcttaaccaatttgatcaaacttttattagatgcctcggcttgcccattagcttgtgcataataaggtgaagaattcaacaacttgatacccacgctatcggcaaactgaacaaactcgtcggacacgaagattgaaccttgatccgtagtaatagtctgaggaagaccaaatcgatagattatgtgttcctgaacaaattgaatagcatccccagaatcaaccttcttcaaaggaatcgcctctacccacttggtgaaataatcagttgccaccaatataaa

SEQ ID NO: 65345 - DNA, 13254 bp, Oryza sativa
tgacgaagtatttgacacattgctactgacttggaaaaaacagtcctacaacgtggcacaataacagtagtccatgagactaacagcctcagttttgagatcatgaagggatgatctgtattctttcgagataatggaagctttagtaaattaagttaattgcatcaagatgtacaatcaaaccgagtcacttcttacctctatataaaatgcacatggccaaaaaaagaagaagaaagaaacaactagaaatatctcccaagcgtaaaagtttaaaagaaacatatatcttagtggttatcaatcagtagtctagaccaccacccatatcctggataaaaaaaactcctacgccacttggtccaactgtcgtgataccactgcaatagtatcctgtagtctcggtccgtggagattagtctagatatgtagtcaccggataacttaagtttggacttaagattggtgtaaatgcaatttacgtttatacttgtattttttttattaatttagagaacttttagcttatttgatgattttgactttcctacaaactaatccattaaaccccctagaggcctaggctatctcgtgtgctagatgaaattatatacacaatattttcaacgtaacttgtctctgtatatgttgtttatgaagcaacaaaaatgaaacaatattatattgtatggactattttaaccatcaatagaaaatttccacgcctaggactgaactaatgggatctcaaatatttttataaattacatagcatttttcaagattataatggggattatggagctaggtatggggcccaagccctagctctgcctcatgcctgattccgccatttaaatatcttatcgcttgtatggtactttttataggaatataaatatgaaacctccgactgaaaatagcgttaccgcccgcggatgaaatggaggtgagaagcggacttggaggagattctgtcggcggcgtgaacggcaacggcgagccgtcgacgacgtgccctttgccccctatccattttccagtagcgcagaagttggggggaggcttatcatagtgggccaggccagctcgtgaaatccacgcgaggggggaaaagcagacaaggaataatggctcagcatccagcaggccaggcccaatccataaggcctaaatactacttgtagtcactgcacagcgttacattacaactttgcatctaagaaagcacagcaatttacgaaggataaaaagtctactttaactccctccaatatatgcctgatccaattcgtatctcaaccacgaaaccatatatatcgcctctccaagtattgaaaccagtacaaaataactccctttgacagttttcaatatggtttcaactaccaacatggcatggttgacatcgtcttcaactgatgtgtcgcttacatgtcactagaagtaaagataaaattaaaatgaaaaaaaaatgagaccccgtgtcagttggacttagatttgaaagaaaaaaatacagtggacccatgtggtgttagtgtcccttctcctcttcccctctcttctattccctctcttttcgacaccatgagtaccttaacaacaacgctagtggattgacggtggggatgcagggagtgcctcggtacaggggagatggtggaagagagaggtcggggccccaacctgtttagtttgcttcagctcatgtgtgtctttattatagtatagatctagcttcttggtgcaattcagcaattagttgagactagttattttaggccttaaattgtgtaaaaccgttttgatttacgcttccgcatatataacttattttagttaaaagttttaaaaccgccaattcacccctctagtcggccttcttgatcctatgacggggactctcccggggattagctcctaacgaaaagattgctattataataaaatctattatattttaggatagaggtaaactatagtaggctagtgtagctaggttttattgcgctccgtcaaaggttgagcacggaggacgcacaaaataatggccgtgtcccaaccacaataaatcaattcgtgatggattatgtctcaaaggtgtaactaatgtctgcttgatatgattgtatgtgtgggccgggttgccataactcacaatctattcatgtgtcatcttgtgccccctcttctattttctgttaatatatgctcgcactgtatttttcatcaattttcatgtatcatgtatattattatctaaaaaaatgtaccatgtatattaattgagttttacataaacaagctgcagatatatgcatgaccatctcatctttatcacacaactttatgtgaaacttagcatagtatatatccgtagttttttcttttacatatcaaattaggataggatgaatgtgtaaatctatcttaacaaaatttcgaataaaaaagttcaaatacttatatgaactactatcatccaatagtagcttatatagtagaaggtaccatataagtaaaaaacaaacacctaacttatcatctaagagtatttacaacgggatgacatggcgagttaccttatgctttcatatcgaatatgagacggcatcttagttatggaagttgtcgtttccatgctagatccgccccggatggaatgcttcttggagacgtaaattaaagccgatgtcggtgcttactttggatgccacatgctttctttctctcctttattaattttctttttcagaaaacaaaaatgcatgacgaggctgtgccatccgtccgtagcgcacgcgcaaagaaatgagatcagcggtggggtatggcccacgtgtcagcgctatcatgcatacgtgtatctccgcggtaaaggtgatccctgattgtttttttttgtttgaaaatttcaatcaccttgacggtacctgcgcacagctacggaagaggcttctctgacgtagtgccctcttacgtgggtggctaacatgtgggtccattatctatggggtctacatgtcatcctctcaaagttagaaggcagtatgttagaggatcacgttccatagcgtactactcattcataatcttttctttcctatacccttaatttctcttaattggtcatcttctcttttttttttacaatccaataatgcaaaagaacaaagccggctttactggaataagaaggtagatcacgaagtaagcttaactcaaccaactaataactaattagattcttttttaacctgttcatctccatgttaaaaatctaacttaaacacaaatattcgtacttacgatgatgtgcaagttatagacttgacatgcatatttgtattcatagcttattatttttccagtgctagatgatatactcatcaacaactttctcaatccaaggtataccggtctagctatagtcccaaagggtgctaacatgaatagagtgtatatacatatttatatggataaatgtgcacgtaattaattatactagcgtcgggattgtattgtgttttaaaataggaaaaagtacgaattaccccctaacaattgtggtcggccgaattacacccctaaactcgaaaaccggacattttacactctcaattattgaaaccagacaaataacccccctaaacactgttttgagtggttttgattagaaattacacacgtggcgccaacgtgacaatccagtcagcaaaaaaaaaaaactccctgagcccacttgtcaaacctatccctcaacccaatcctgtgattcccccctgctctctcttgcgtatgtcagcggaggcggcaggcagccggcggtggaggcggacctcgcctgggtggtgggtggcggaggcgtaccgggcagccggtggcggaggcggacctcatctgggcggcgggtgacggagatgaacccaacagccagcggcggaggcagacctcgcccgggcggcgggtggtggaggtgaacccggcagcaggcgacggaggcggacctcgcccgggcgacgggtggtggaggcgaacccggcagtaggcggcggagcggagccgcctgcctgagcgcgcacacgggagagagaaagagagcgatcagggagagagaggtatgaccggtgggtccaagggagttatttttatttttatttgctgactggattgccacataggtgccacgtgtgcaaactctctggtcaaaaccgctcaaaacagtgttgaggggggtaattcgtttggtactaaaagttcgggggtgagtaatgtctggttttctggtttagggggtaattcggtcgaccacgatagttcagggggtaattcgtactttttcctctaaaataaataatgaggtagagtcaactatgctcgctggtagaggttttttccttgcggagcacccggtaagttgggcttggtctaatggactaacaacaccttcggtctatcccaagtgtaactggtccaatacgaaaagttattcaagacaactctatacgtatttatacgtataaagtgtacacatataaattttatataaaaaaacttttaatgtagaacattttataaagaactatttgaatccgacagtcgcattgcttcgcttatttaattatatgattatctgaatcgcttattggtaaataaaaaaatatttgtgagtataaattttatatatgtctccttagcgacttaaaagcaaatgttgtaatttgtaaataaactatgatgaaaaaaatcaaattcaaaattaagttctaaaatttaaattttatcttataaacataagcctaagcgatacaatgagacttcgaatcggaatcggatataaatttggatagataaacttatcaaaatttaacatggtgcaaaaagaaagtgtaggcattcgcacacttagacttcccacaaactttcgtgcgatagccctttgatagagttatatatggagacaaatgcttcttatttgattctctcagaaatattaggttcaattcaataaaaaggagtttcttattcgatggttgcataattgttttactactctattgtcgattaattcctggaaaatctagtagatcacatggaagcatatagactttatatgacctcattctctctccattaccgtgaaatcacaacctaattctcttgccccgcacgtctcaccatgcccgctatgtcggtgagaaccatcggccacaccttccccgtgacgtcttctccaaatacttctttgcaatgccgtcgtcacccctcttcacaagctttggtgagtttctacatgcttcctttctcctcccctatcaatctctagcagcaccgacaccaccaccacttcaccgacgactcatctccaccacatccttccacttcttctccccatcctcctttgtgatgctgttgtcacccatcttcaccaacgttggcaagtttttgcatgctccctttctccttctcctcccctatctctagtagcatcgacaccaccaccgcctcaccgcatacccatctcctccatcccattgtcggttcttcaccatcttagctttccttctaaacctgtccttactagccatacctcctcctattgaatgcttttgcccaatctcgagattcaatatgacgtacgtgatggaggttcgacgtcacagctattgagagagatgttgccgtggagagctcatcgaggaagtcactgttgacttcgctggtgagttctccccactatctccctccctctctcatgtatatcctactttagttatggtgatagtctaataatcagttacaaaactgtagtataatattatattcactaaactgaaaaccatgaatattaagcaacgcctttcatagcctttgaaattgtgttttttccattaaggacttgaatatccattagaccggaagatgtttgaatccgaacttgcttattttatatttagaaaacgtagacgcatgagatccgcacattgtttcttagagagaggggagagagttataacatgagtagaataacactcataataattcctccctacgatgttatttgaggcttcatgttacttaaaaatttaatgtaaatatgtagtaatataaaccatgtttaaagccacgataaaataaataataattataatatttctaaaatacaaatattattatgaaaattaatagcgttatttttattagtttaaaggtggaggaattgtcctcctcacctaccatcgtagtttttttttaagaaaaacgcctttcaaatgaaaccgcctcatccaaaaaaactcaaataaaaaactaaacacagtagtttcaatcccattacaacgcacggatacgacacaagtgtatttaaaaacggagctaacacactgtatatattactccctccgtttctaaatatttaacaccattaactttttaagcatatgtttgaccgttcgtcttattcgaaaacttttgtgaaatatgtaaaactatatgtctacatataagtatatttaacaatgaatcaaatgataggaaaaatattgataattacttaaatttttttaaataagacaaacggtctaacatatttagaaaaatcggtgtcaaatatttaaaaacagagagggagcattatatagtgccatggctgattgcttgggtgacgagagattccagagatcgagtagtgatctgatcgacttggtgcacgcacgggcggtgggtgatggactgatcagatgaccaactcaccgagatgagcacgcacgcacagctgcaacgcatcacgtgatgagtacgtgatcttctttcgggtcatataggacatgaaaccgtgtcaagcttacacgcgacgtgcatattgtatcacgttctttccctcggttctggagataatacctgttggggccaaggttatttcagggaagaagaaaaaaggttttaggtacgtacgtgctgatgattcttttttttttctgatttttttgtcactttacttgctagcttacaaaattaagtgtccacatactatttaatttttgtgaatttggtcgctttatcagactttatgcatacatacgtcgattaactcttctattttttttaatattttttttaattttgtttctaagtatagttttttacttatttgctaacttacacctgtaccttattaattaggaggggtcatctcgttgatcaaccatttatatagatagttccctacaacacgagtacttaaaaaatactccctccgtcccaaaataagtgtagttttacactatttatgtttaacgtttgaccgttcatcttatttgaaatttttttacgattaatatttttattgttactagatgataaaacatgaatagtactttatgtgtgactaacttttttttaattttctcataaatttttcaaataagacggacggtcaaactttggacacagattcccacgactgcacttattttgggacagaggtagtacaagataattaaaaaagtagaaattttggtttggaatctactagaaaaactactccacaacacaaggtttataatttacaataaaaaaatattgtttagaatataatattcatttttaaaaatatttcttttaatgtaagatatgacgatatatcctattactgttctaagataggcaaatacattaaattatatgtgcctatttcttgaaataaaaacagattgtggatcacttcgtcagctttgtcgccttcagctaaattgtacaatattaaactatacggataaaatatatacttttgcctacgtcattttaaagtcaaacatactttgattgaactgtatggataaataatgaactatcaccaacataatccagcatgtcaccatggttactctacacataatttggtttacatcaggcaataataattcatgagaattatcatttacttctatcatcaaccagaggtacatagaaacaacaatgagagtgtatttggataatgggttaggagaggtggaattggtaaatggaaatgaatggagggatacgatgaaatggagcgagaagaatgaatggttaggattgaaacttatcctttgagagataagaaatcatatcccaaacctattacatggtctgaagtaaataagatacttgagccacagccacaaaaaaagtcatggtgaaaaaccacagagtgtgctgttactctgcagtgcaaaagaagggagtagaaaataacctgaaaatgaatcgagcggtgggtcacacaaaaagcacctgcccactgccttccccttcctcgttggcagcttcccccggcgccacctatgcctcgccgcttcaccctccactctttcccgttttgcccctcctcctgcctcttcttcctcttcctccagccaccgaactcaccaacaacgagacgactcaggggagatcaacctgctctccactactgtggactgcagtggagtccgtggtgagtgaggcacacacacgcgtccttctccggcgaacgatggggtggggtgagccgccggcgccgcagcagaggaaggcggcagggggcggcgggctgaagctgctgctgtccgtgctcctcgtcggcctcgccctgcgcctgctcgtcaacccctccgcgtacctcctcctttcgtcgtcgtcgacgacgaccaccgccgccgtcgcgctagggcaaggggacgacgcggtcctcgccggcggcggctcgctgccttccaacggtgagatgttcttgggatcgatgctgttgttgctttgctccttttcaaccgtttgtttttcttctttttttttgtttctttactttttgggttgtttctcgtgacatggaaacgcagctgaaggaaaggaagtactctagtagcagtactagtggaggagtattagtgtgacttttcgctctcaatttgatattttggcacaaattcagcatttttttgatcgaattaaggggattcggaacatgaaaagaaattgtatatatcttttttggtaactgagaattttccattgattgaacttgaagatggagggatcaccggatccttggttaaacaagggaagaaaatgctgaaatgtttattacacatgagagtaaattgtaaatattttcttcttcgataaaacgatccaatcatttctgaatgagagggttaatttctcccttcttatcatgttcgcgtgatattatagttaattactcccgatatagtttattgttcaggtgccaggtctgtggacctcagtcttgattcttgtgatttgtgtctgaccccagatgcagtttgaacaataggtccagtgtcaccttgcaatatttttgagcgagagatgactcctgatgactccagctgtaaggctttgattgatcactttcattagtttagtgaaaaaaaaatgaggttaaatcctctatggaagtgtcggtgtgggatctggagctatggaagctttccctttttaatatgccaaaagggctctctttgcgtgtaccctcaatttgttccatactactacatgtttagttacatatacttatagtattattccctttgtaatttaattaccatacatttcctgataaatgcaggaagttgtgatttattccatggtaaatgggtccctgattcatctggccctgattacactaacaacagctgccgcttcatcgagactccgcagaactgtatgacaaatggaaggcctgacagtggctatctttattggagatggaagccctatggctgcgagatgtcgcggtttgagggcgagaagtttttggaggccatgcggggaaaacattgggctcttattggtgattcaatcctccgaaatcacgttcaatcgttgctttgccttcttgctaaggtattctgtggtttatgtgatgaagtctttaatactttatagttcagaaaaaaaaatactgccatcgtgtagtaattacaagatagtatattgttgaccaatctatctctagtacttcactaataagctcaacctatgttcagtgaaatactagcaaaataagcacactggcatactttttaccagctagttctaactatactaccatttgcaattctccaggcaaatttcgtgggattgaggatgtgtcgatgattttttttatgtgaacgctgagtcagagctgaatatgtttttgttattactgaaaaacgacattaatttctgatgttggtggattagttctgcttttttgcacatgcagattttttagagcaatgctactatttatattgttaatgtgctatcagctgtgcttgcttgaatttgtagtaatagtacttatcaacaaaccagaaattcaagagaagtgaataattttataatctgatttaggttgaagagcctactcaggtctaccatgacaagacattcaaatcaaggaagtggcactttgctttgcacaacatcacagtctctcttatctgggcaccgttccttgtcgaagctgaaatatttgaggatgatgatggagtatcaacttctgagctccaactgcaccttgacattcttgactcaaactggacaaggcaatggaacagcttcgactatgtcgtgatatcgacaggccaatggttcccgaaaaccgcagtctactgggagaatggagctgtgaccggctgccactattgccaggacaagagtgtagcggaactgacttttgagtatgccttccgcaagtcactcagaaaaaccttccaattcatcacgtcctcacctcacaagccagtggtcttctacagaacatggtcaccgtcgcattttgagaatggtgagtggtccagtggcgggacttgcaagaggacagttccattcaagccaggggaaaccggcgatcgagaatcggacatgaagatgtggaggatcgagagagaagagtttgccaaggcagttgtgcacgacaggcacaacaacgccggccgtctgaagctgctcgacacatttgagctctcactgcaaaggcctgacggccaccctgggccttaccggacgtatcatcctttcgagaaggcaacatcggccaaagttcagaacgactgcctgcactggtgcttgcccggtcctattgatgcgtggaacgatataatcatgcagatgttggcaataaactgaaacctcctgaatcatctaaattttgacaaaaagtgttgattcagacctgattattatacataggtaaacttcttagcataatcaagtgccttcttttttggcgctcattgaagaatttccagtcggtaagtatcggtctcttgttgtagcctgtctgattgcggcacccatctgcagccataggaatgtcccctggccgtaattatcagttatgaacttgggttgtgttgtacaacttgagatagttgatttaaagagtcaaatataagtctcatcagctactcgtcttctgttttcagctaattgagctctgaaatgatcagtccttttataccttgacaagttgaaaattgtaccacctgtaacgtgaaaaataagataatgatgtaaaaaattggaaaccacttgtaacgtgcccatcattatacagtgtaaataaaacaagagaatgatgtagaaatattatacctgaattgcttctaacgtaaagaatagttggtaaatcgtatgaagaaaattggcatgtcatacggagcggagcaagttggatgacaaaagaaaaacaggcacatacatgctcgtgcatagtaagctcgaaatttattgaaagaaaacctcttttgtaaaggcatgatgattgcttgcgacatgctcaccgtcatgaacaaacgaacatggctttcgtacagacatacgtcctgcattggtgcactattgttgtgacgtattcggcaccgaataattcgatccaagcatacaaagaatgataaataccaaaaaaaaaaaccaaagataattgggcaacacttattagatttcagcagcatctcgtccatatttacaggatactccaaaggcttcactaaacagtaaggccacgtattcttattctgcagatactagaccaaatatacacaacaggcgaggaagatgagataagtgagcagtgtcttgcagtcaaaagtgtacaatgtgcatttagcacgatgcagaattcttcttcttgcttgccttatcttcgctttgcccattacggctaattttaaatttgcaccggtgagtagcaaggactttctgctcaaaagaaacctcaataaacaagagaacacaaaaaatgactgtgttttaagttgcactgagaagttgtggtatttgtacatattttgtcatgtacaatttcaacctaaaaataataaaactttgaagatatcattattcatatatatctattgcagactgaggtaaataatacaatgacacagaaagtacaataactagaccatatgaatgtctgatatacagaagtgttcactaaatgatgctgcgaacctcacaaagaggcatagtagggtttaacataaaatctagctgtagaccacattattttaaaacaatataaaacattcatggatcggatagtcgatcttcacaattttatagccaaattgctagtctttcaattggtttcatgaaaagcaatcaataattcaaatataattttggtgatgttttaggctttagctatatgcacatgtaggatgtttccttactctgtcaagtattgtttgctcgtgctaactgtacaaacaaatcaaatcagtgtttcttatagcttagtggtattttgtctataaaacttatcctaaaaaagggtttcacacaataccaatgttttaaaaagtggtatgcggtttcatgcggtcaccccaccttgtagcgcttatgcggcataatcagacacttaatgtggtataatcggccgcttatgcggcttaagcagtacgaggttggggcacccgttcctgtatgtggccatgtagaccttattctaaaacactgcacaaaaccataaccttaaaacaactaagtagaattaagatggtcacttgttcactaaataccaaaaatgtttaaagaaagctatttggaagcgatggattgccaaagttacagaaaacagttccctagttatgtgtgatggaccaattaccattataagcaaaattttaatcaatgctgataaatttaagtcataacttaacagaataaagtcatgaacttgttctactataaattgaaggaatctga

SEQ ID NO: 65346 - DNA, 11936 bp, Oryza sativa
cccggatccgctgaccgcagctcgagctccaccgctcggactcgccgctgccactccttgtcgtcgtcgtcgtcagcagggccggtgccagctcgccgtctcgccattcactgcctctcctgtggtggatccgtggaggagaggagaagaactcgccgccgccactcctcgtcgtcgtcgtgaccaaggccggcgccggctcgccgtctccgccgccccatcagcgcagccgccgccccattagagcaccagcaccgccgcaaggagagagagaaagtgtgtagagagagaaatgtggatagggttgagggtggatggatagggtttcctaagggtattatgggtattatgaataatagttgcatttctttttttattttaaatcaaaacttaacggactagcggaaacagggtcaaacgggagcttcgtttttgaaaaggagggtcaaataagcaaactctgaaaagtagggtcaaattggtagttaggatctaaaacggggtcaaataagcaatagcccctttacttttacctgtaccaggcccatcaggagagatatggcctgaccagaatttcctgcccctaaaacattcagacacacacaacttgtggcctccaagttcagatccattcagcctaagtgcttctgaatagtgataccagctttcgcactttaggtatgctttcctgccaaaaaaacacagataattggggagacactgatgacataggtcaaagattagaatatttattagagactatcaaagtagcaacaatgaaagtgcaggaacttaaacaagagctattggaatcaaactaattaacaaccattactttgcaggttgcatgccataaaaatagtattcactatgttctttttttttatttgttgacagagtagaacaggtttcatcaatattttttttagaaaagtctatactgactaactttttcttactaaattcttactaccattgagatgactgttagtacaaatttagtacgtgtagcagtgctctatttttttctgattatatattgataaagaatagtaaaagtatagctacatggaagcatttgtcacggcgaatctgcaaatgtaaaatcttgatatttttgcacatattacgttgagatttcaaggtcttaatgcatgagaatagagggaatgtgaattaaaacaacacgtatcactattcactaccggagaccggaaggctcccgtgtgctcaaaacctacggtaacaggccaaaaacacacggtaacaacgttaccgggtaccggaaggttcccgtgtgctcaaaacctatggtaacaggccaaaaacacacggtaacgacgttaccgggtgctagtgcacgggaacagatactcggcggcttcatcagtttaccatgcgcacttcccgggtgttttacgattatgcgcacgggaaggccaaaacacatactgtgtgtgctgaatcacacggtaaggctgccgtcgtagctggactcttgtgtgtaacggagctcctaacggaatggtggcttaccgagtgtccttcacacacggtaacatttggtgtgttaccgtgattcattcacacccggtaacatgtggtgcgttaccgtgtttgaagcacccggtaagagaacatgtgttaataaaaaaaaatatatgctatttgcaatttgtttactatatccatcagagcttatttccatcacaatataaaccaccaacaagcacacaagagcacaacacattccaacataaatatatatttcagtaaagaggttacaattaataattagcatacaagcaattcaattcatggttcatgtcagttaaagcaatagccaaagttacaatagctaggaacatattatttggttgatgcaaggggggtggcggcggttcggtggagaaccagagtgggtcagaggtggcttgctagggttgaagtgttctatatatagccatatctgttgatgaatataagccgtccgatttaaatccattcgaccatagtttacaagcagttttgcttggaaaaataatactattcacacgatttctgtactaatccctttaatgagaacttaaatattcaaattatatataattgttattaaaaacttagtttgtttgcaattgttccaaacaatatcatgtgtttgtatattaacagagtggggaataacactacttgtttatgtgcaccgcttgaagtcacaccgagaacaacacacaggtgggaaatcctaattataacctactcaattaatctcatccaaaacgatatgtggttttgtgttcgtatttatactcatctatgtccctatccaagtagaacatgggaatcaagccaggatatggttcatctagttctgttggtcttgactagctagtgcgatcacaactgacgttgcctttctatttaaaagataataatacctttcttgcacttttaaccatcctgctctcttctcaatcatttgagccatattgggtactgtgacatcctagcccaattaggatttggcctgtgtggctcctgtgagttgtgtgcgcatgtttagtaccaccttactagtttagcatgagttgaaccaatttataagacatcttccctctaaccatgccactcccgggttaacccttttacacgaagcgatgacgaaagtataagtgaagtggtgtgtgtaagtgggtccgcccgtcggatgggctaggctacgcagttctgaagggacggctgttataggtacattatctcctacttgtctatgaactcttgatggcgacaatgacaagcggtgatggaccgcaacgatgacctagctagggttttcgagtttttttttgaatttttatttttgcgtccatccacacacaaaaatctgattttggcatgctggtgcgccacccatgtggaaagcgattttcacatacacttttgggcaaatggacggctcaaccacacgaaaaaaaggttttggaatatatggaaaatgccttttagtagtgcgtaagattaaccaatccaaaataaaaatattggttaaaaggatgatccaaagagaaaacatcggtaataaaagttagcgtaaagtgaaattcaatctaataataataaatcaaaattagttgtattatgtgaattttatcgtctactatattgggagtgtctagattgtagcacacgtcatgccaaatttattttcactattttcctcattttctatacttttacaacttttatgtgttttttagattttataatattttcctgcaattttcagttatccgtaaaaatattgtgtacagtgagttgtgaattatagataccctattattgcgagttgtattgtctactactctactatctttgagagtgtcgatataaataattttcccttacattttacaattttcatgcattttttatactttttaaacttttcttttaatttgaaattgttagacattcccgtatgtcaaaacgaaaaaataggcgggaggattccgctccgttgccgccaacaaaatcatagtgcgcgccaacaaaattcaaagttcgtgccaacggagtgaaaaccgaagtatggaattcagtcatgttaccgtgctccaggtggtcccacacggtaactttcctgttaccgagtgtttcgtggtagcgcacggtattgttgggacgttaccgtgttcctagtcctacacccggtaagttactgggtgttttgttaaacccacggtagcatctggttgcacacgggagctttcccagctccagtagtgattcataactcacaagctacagatgcatgcatgacagcagatgtttaatttacaaacaactacaattgaaatttgcctacaatttgagaggaggaattcagctaaactgaccctatgcttgatcccatagaattcgttagaatgataacccgttcttcatcagaggtaaagtgatctgcgagtatggttctgatctgggaaaaacaaaattaagctaaatgtaaataaaaatgtcaagggctagtaataaattatgtacaagataaaagtgcacctccaacaggaggagatgaatcaaaaccttcaaccaaaagggcacaatttaaatctccaggtatctccaagatatatgatgtatctctaagcaaattgcagataggggacgaattcacagagagaaaaaacacatcagatacctgcaaggttgacaaagcacaagtatttgcacgcgcatgcacagtgcttatatagagaaagggaggggggtgggacttgggggatgtcctctgccattactacacatgcagttgttccattgacatgtagagccatagtaaaacaggatccacgtgtcaatgactcaactgtatctgtagtaatagcagaggattttcttctcgggaatggttcctaaggagtcaatccccttttaagaacatatgtgtcattgtcgaagaatgaaaccttgagttggccacatgcatgacagcttacgtttagcaagtttataaagagcctacaagattgatgtaaagtcttatatagaaatcaattaatatatgggtaaatttgctagaaatcggggtctaaagatttcatgaaaccacaccatcagaattcatgtggccataatacttatggttatgtgcaacttgaatcaaaatatatgaagttttgtggaatttattcattaattatccattgccatcgtgcgaaacaatgatcaacaacttgatattgccaactttatgtgttgaaaaatcacaaataacaacaatcagatatcataagctagtttacctcagtggcagctctgtgtgacttgaaatcgacaatcaaaagacatcggaatatattgtgaaatataccaacaatagcagcaccaccatcttgaaagatgcagtccctacggaagcagccaacccatgaaaaatcgagagtaaaatgtgcgagattttcatgtgcacttttgagagaaaaaaattacctcaactgtatgctgatactgctaccaaagttccaaattataattgtggccacttgtggtacctcccaatgagttgtggctacaagatgaggggcctttgattctccgtcgaaaatggagagattagcaattccataagattaatagaacccttcaattgggaattaattgaaaccgaacagttattagtgtgtggtaggcttcatcatcgtacgtcgtcgatgatctgctcaccttctttggcggcggcggcggcggctcgtggtggccatggagccgtagccagcgacgagtaaaaggtacgcgagaccagctggaggcaggccccagtcgggcatggccggaggaggcggaggatgtggtggcgtagaaagcagcggagggacgcacgagcctcccgttcctgacgcacgtccccaccggcgtctccacgaaccggaaggtgcgacggaccgcatgcttccaacggcgacggctcgatcgatcgccgctgccaacgagacgaagcggtcgatgtggagtggagatattaaaccctagtccaaacgggctgatacgtagtacgggttgtgttagctagacgactgaatttagtttctctcgttttaagtggtgtactacatgtttcaattttttctataaagttctataaggtataactatatttctaccatcgcccacgaagaattcaaatcccacacatgtatgcgcagtgtcgccgtgttgggagcttaactataatcaagcaaggtgttaatttttttttattttttttaaattatacggtacaacgcagagactcacaacgcacgcacactcacccctataaacacacgcacgcaaaccctacccctatgagcatctatatgcactggataatgaatagccagttgcaaattacgtgtgtatacatatatatattacaatttttgatgatatttataacttaagtttgagtttacgtgcacaggatatgttctctagttagatagacaaaaatataaggtaaaaaatagataaataaagatatatgatgggattttagtataacaaaatggcacttgaagaatcgacaaagatatatgaatgaaggatttagtataacaaaatagcacttgatatatttcattgtgacttatttcacacgtgcggtgtgcatgggatcgaggaactagttatcaattcataattaacgagataacgactttgaaattaaataacttgtattattcgtagacacatgtccgggagatagcgaaattaatcatgttactgatcagcaaaagaaaccctaatattttgagtaaagcctgtggcttaggcttaggtaggaatactccatgaaatttccaccttggtgtcggtaaaagtgaatcaagaataatttttgaccgaacattgaatatattttgatagtatgtttattttgtgttgaaaatgttgctataattttcatataaactttgtccaagctttaaaaaagtttgacttgaaaaattcaaaatatcttataatataaaacatagagagtagctattgtagaggactatagtgaatagaattaggcagtggcgtagccaggaatttttcgctgggtagtcctactcacaaatacatatcacatagctaaattttcaaacgtcgtaaatcccatatacgagtacaaatttaatgaaaaagtaatataaatgtaacaatattgtcttatatcgtcaatatttgactaacttaacaagcaagctcacacgtgcaaatattacaacataaatattgcaaatataaaagatcttgggcacaaatagaaaatcacaatgccaatatgttagccataaaagtttttagtattatgtcttctttactaacttaattcataaaagatatctcacttgatatatgtgacaaatcaatgattcaataaatcatatattgtttctcctcttggtcatcactagattaaggctaacatacaaaagagcaattccatatcaaccacatgtttacaaatcctacatactacaatagtaccaaatagcaacacattcacattcgttgattcacaaatcaaaaatcacattcacgtattcactgattcacaaatcacaatacaatgatttactcacctaagcatgggattccaaggggtagacggagggaaagcgtcgaggcaaggatcaattagggctaggcagccagggtcctaggctcccagctcctggcaccggcggccggtggcggcgccatgtgaggagccccggcgaccggcgtaggcagcccgcacccaggcagcgtggcgtggggactggtgcctctagcgcttcgccattcggccgctgtagatcgagctagggaagtggcggcggcggcggcggtggcggcggcggcgaggaagcaacggcgcaagcgcgtagcagaggcgacgaggacgagtagagacggcatcgtggtcgtcagatgcctcgactcccagaaggccaaacctagcgcttttttccttctctcttgtgggcttgtttttctgggcttgaatgagaaccaaggtttgtgggcttgtttttctaggcttgaatgagaaccaaggtttgtgggcttttaggggggtgggggtatcctgggccaaaatcggggtagtcccgagcccaccagtaccaccccctgtctacgcccctggaattaggatcaatcttcgcaagttgttcaacaacaaacattttcacatggttttcatatgtaatagagcacataatttgtagcctcgcggcattttgcttggttactcccaagatgcgttttcacacggtttttccctctgtaatagagcacaagctaatcaaaatctatagcctcgcttgaggcattttcgcttggtactccggaaaaatatgtagtacaaaccacatatctagtgaaaacctagaaactatcgttgaatctaaaagtagacgtatgagatttgtccacgttatcaagagtaaagttttactttcatattcaatcacgagttaaattttactctaagtgacatggaccaatatcaggcgtcaattttttatccaacggtagtttccatgtttctactatacatgtggttcgcactacatattttctccggtactcccctactcagtagtgtactcccttagtttcaaagtatttgtccatagttcaccgtgagatcgaagaggcttccccgttcaatctccataactagagaaaaaattttatggcacacaaaatgagaaaccttcttagcacatgattaattaagtattaactattataaatttgaaagtagatttatttgcttttctaaaacacttctatatagaaacttttttaaaataatgcaacatttaacagtttgaaaagcgtgctaacgaaaaatgagaaagttgaaatttggatttgaagttgaacacacatggttaaggagtagaaagttttgcaataactatgtcttaatctacacagttgtacaacgaaagggcttagttgagaacaagaagaaaagccagacatgtatataaaaaagcatattattggcagaaaagctatatttttacttctttccccaacaatcgatacatcaaattggtcttgatgtacatacaaatgctatcaacatacaagaaaaccatatatacaacacgttaaaaatgtaacccttctgctaacaacgtatgatgatctgtcctgcaaatgacccttcacaccaaacctgattctttataagttgtgactggatcacagaaacagtatctgcaaagatacatagagcaaaacagcagaatgagctaggagtgtacttaaatatatacatccaagcttttggacatcgcattgaaatttcaccaaagatcaagaaaccgcagcgcaatcaacaaagcagacaaaacaggtgattcaacgcagagatttcagatcagtagaccgaagagagcgcatggatcttagagagcccgggtcgcgatggggcgctggattcgcgagatcgtcgcagtgaactcggagaggaagggaagggagagaagttcctcatggggtttattgggagatccatgaaaatatttatatggaactgaaagggggaagtacgatctcggtggccccaacggctagcagcgttgcccttgaaaaaaaatattatccgtctatccgtaaccatgttattacaatatgtaaaacgttggttccattcaacgtcatacatcacaagcccattttaactcgttttctttctattgtattttcgtatagtcaaaattatccctacccgtcaaaaatactgacatcggcgaccccctcctacggtgagtcagcgacctcatgcgtctcgatcggttgaggagtgcccaagctgctccaatctccccaagtcctccaccacctcccccccccccccgccccaaaaattttttttttaattttttaagacctttttatgttttagttttattaatagaccattccaaaaaatatgtccaaatctgaaccttttggccacgctagccctagcgtggcagtgctggccagccactcggctggcgtggccaaaaggttcagttcatgaaaatattggaatggtctattaataaaattaaaacataaaaaggtctaaaaataaaaaaaattcccccttcccctaaactagtgagcccaagctgctccttgccaaccttatgagcatcgccgagctccttgtcggtagccttgtaggtgtcacagatgcggatgaacctaatctggcaaaagagcttttagacgaggagggcagagatgccatgtccaccttgtccccttgttgctgcctcgccccctcgcttcccacgcacagccatgtcccgtcacccgccatcgcctcgccctctcaccgcccgtgcatagccatggtctatcgccactgcctcgccctctcactattcgcgccacacacaactgatggcctagagtggaggagggtagaagagaggtggagaaagatggagatgagagaagagatgaggagggtggatgaagaagatagaactaccgggttggttttcatgtgtagattggtattttgatccatccaatatatgtataagaacatatataaaatggcattgatacaatttgagagttattgtaatggcaaagttttaaacaggtgaatagtaattgtttttccaatacaacaaatttgtaatagcatgaatcaaatttcaaaaaaaaaaagtaacagccgctgggtggtgacttgtgcaacttatgatccaatgtagcactagttcacactagtgatatacaaggtgtcaaacaaaagaaccttggagaaatgatagaggattctaattcctcgaggatgtccccttgtctatttttctctcaaatcaatgtaaatggttgtaaaagttctaaaaataatttagcaatgtagagtattgcaacatcaatgcaaatggttgtaaaaattctaaaaataattcagcctcaagttgttgattctatcatcgacatgtgtaaagagtttgatctagccctaagttcttagatgagtcttcagcgcactcttctgcttgttgttgttcatttcctaaagctcttgtgccctccctttctttgattggctaggggtctctttgggacaccttagctccgtgggctcctgttgtaagaagaactatgtatttctcttctcctcaattgcaattggcagagcttctgcctttctcctcgaaaaaaaaaagtatagtaacatctaccactacaccaaaaatcatattcaaatttgctctacatattttttttgaggaaaccggcagcgggagctctgctggaatttgattagagatagaaaaacaagtgcaatatagaccagagcaaacgaaaataaaacacaaatcaaggtggcctaaaagccgatctacgaaggtctatttcctgcttgacaatgtatgccacgtccctctccgatctaacagaactattgaaaatcctattattcctttccaaccaaatattccaccatgttttgaggagagctcctcttgttttcagcttttgttcttcggagccttgacgatcgatttcagtccaccaattggatgttccaactgggggttgggcatttcctcctgccaagtttagccatgagcaaacaaagctccacacttgcctgacgaatgggcatccattgaacaagtgatttgtatccttaaaagcacatgtgcaaagacaacatatccagttgcatggccaatgcctcctgagtaagttctgcgtagtgggagttttctgatggagaactagccatccaaaaaacctagattttggttcagccggcgccttccagagcgaggagaaatttatggaagcaaaagatccttcgaattggaaaagatatgcactcttacttgtgtaaatcccagattcattccacttccatgagatatcatcaggaatagtggagagattaacatcctgtatcaagcttcccaatcggactaactcgtgtatttcctccaccgtgatgatttgccggaaagaggcaatccatttattaccaagcagctcaatttggacctttcatattgagaaacgaaaaaggaaaattcacacataatagtaccaacgctattcatatgttagatttgtttttttttatttctcaatgtgttagatttgtttttttttattttttagctagtgtatgtgtaagttgagttttgactttattttctggagtagagtataaaacactttccctggagaaacaactcaaaacatagctcattgtgtgggttgtacatgtcaaatctgttgtcttttgctgacatgaacaacgccaaaggcaataatattcttatccttcctaaatgacctaataatgacaaacaaatctttagccgcctcatgcttttgatccaatttaagctagaaatcagtcagactccaacgtctaaaac

SEQ ID NO: 65347 - DNA, 2014 bp, Oryza sativa
ctttcgccactgtcacgcgcggaatttctatccaaaattccaaacgcttacatgtgtgtaaaccctcgtacaagaatcagccaaggcacacaataacaaattgataatagagtgcaatcattactctaattaataagcgaatataaagttattacagaggtagatagttcctctcaaacaataaaaatccatgcagcggaaaaataagatgaacggcgcagacgactccatcccacaagcagcttgaccagggctacacctaatcctccacaccttcagcatcactgtagaactcttcgtctgatgaatgattgcaaggtgagtatatgacatactcaacaagtcacgcagcaaatatgcaagtgcagggaataacaaagaatggcataatatagtctcatttgcataaatggcatttaataaatactccagaatttataaaatagtaaagtatttaattaaacagtattaatccaacgctatacaacatacccgttgcataggcccaaccattctgaacaaccaatcccggctacacagttctacctccaaaccaggaatataccattccaaaccaggagctaaacaaattattatcatcatcatttaatatggtgagaggtatgaaactaaacattattagacccgcccataaccgcgggcacgactattcgaatagttttactctggccatgtcgcgcccggaaaaattaccttttcccaaacgctagtgtattaatccccgtcccaggaaaagccgaggtacaccactcaaacatgatacaaaaggcacatctttattatatcgataatatttacattattacaaagacacttaaggcctgacaatcaaaaataaacagcagcggactagcgggcctacggctccatcttcacaggcgctcaactggggtataagctaggagtccacttaggacttcttctccaaagcttctcgtactgaaggggagggaagatagagcaagaatgagtacaaccacagtactcagcaagccacaccgggagatgcatgattaatgcaagggggtacaaggggtaataatataggggttaagttttgcagtaaacagcatttaaaagtcacttagttgcccaaagccattttataaagacgatcctagagctacactgttattaatcaaggccgtgaaccctcacgaacctgccttaacccaaggcctacgatgattcagaccgaactgacaacccgacctaggtcccagcttgtcccaagccaacccaggccaaccattccacattatagttgttaagcaaattttaagaagtaaaccactaacttgggtacattgctaggcttgcccataaccgagggcgcggctattcgaatagattatactctgatcagaggtgtaaatctttatccacaagacacgtcttcctcacgtctaacaacgcgccacataccaccacggcatacggacgaaagacgtgacatagttcccaacccatcctagccataaacaagagtaccgacctaaccctggctacggccgggattcccgagacgggcaaccaaggttgagcccctagcagcaggacaccggccctgtgccatgacatctcgactaccgggccgcagctcatgtagccttcatttgtcctagagatgtccatcgggccccgacttcgtccatctccatccgtgtacctttgtttataaccagactgagccacaaactaagccttacccactagacatgtggaagtacggtagtgctttgcaatagaggcctgagcttaatccttatattggccgggtgctacttcccacaactggcatgcacccaaaccccaccggaaaataggttttaggggttttgaaagagaaagagaggtgtatgtccaattccatcataatccaaccattccatagtgtccaaatgatatgagaattcccaaagtctaagttataaaaccacctaatgttgcataattaatcagcgaagaatctacctaaattcatactagtgga

SEQ ID NO: 65348 - DNA, 2972 bp, Oryza sativa
tgtccaccaaaatgccattttcgttccatttggtgaatagaaatgtttttgctcaattttattttttcccagatcaaaatacccctaacgaaggccccacttgtaatactctttgatctctcggtttcccctctccctctctctcaacgacaccgtcgggagcggagcgtggcggtagaggccggcagacggtggcgggcgtggcagagcagggcccgcagaggagtggctcgaccagccgcctcgacgctggggtgccggagtttgcgccgcggatcgccgccccctgctgccgctgccagtaatctgcgcattcgccgcggcgcctcctccgccacaggcggccttcttcacgccgccatcgctgtatcatcgaccgtacgagctcatcatcaaccgcagttgctacgagctcgagccccagctgttcgacttcctcaccggcctcttccggaaacccaccatccccatggggatcttgccgccgaccaacctcgtcaccgacgacgacgagccactgccgaccgctccgaggtcatgcaatggctcaatgcccagcctcgtcggggagcccgtcgactagtggctttgcaacctccgtcgcatctggatccatttctgtctcctgctcctccgtggtggcttgcggtggcttttggtatttcttaacctcatagataaaatccgcaagcgcacggaatataccgatgtagcacttcaccgggagtattcttaggtatcgatttccataggactataaatcaggttcatccaagtacacgaagctacgagtaggcaaaaggatagagaggtttcaccggtgagaaacagtgtctacataaagcttaactttaatcctaacgcgatacttcgggcactggccagctcgttgctgccaaatatcgctctactgcgcacccggacagggaggacttcagtgatattgagggttgtcaccacctctacacccgcctcacacctactatgggatgcggagcaaacaccgaaaattaactacctagataccgcgtctaagcagattaattacttactttaatactagctacacactaaagtaaatcactatatttttagttgattatagtgaacgataatcccgtatgctgattacgcactaactaagaaataattcttaccaagcaaactaaattacttaaaatatatttctattataatcagactaattaacagagcaaaagaaataagaagaggattgttgacaactccgaaactcctccgaattcttctacgctactctctccctaatctagtatagagcctcttataattcagctcaagcttggagtgtgtgtgaatgagggagaggagaggggtatttatagtgtggaggtgacttgagagagtggagatgctaaggaatattctaaatggaatcttcactctctcttgacaagtgtcccttcggatgacggttttcaccggtattaacagccacaaccgtcataggatgaggagtacaactgccacgccgaagttgggctagactgggccagctactggttcagccgaaccctttggttcggtcgaaccctggctagcccatccagcccagccctctctctggtgttctgacatgtgggccccactatatgttccactgaagattggccaagataaatgtatcttattgggtttgtgggctcaaaactccataggtttggatatggaagttatattctcatccttcatgtacatttcatctcaattttggtagcttgtcacctgcatacgaatatacaccaacactcgtggaaattgttagaaataaaccctatcactatgttggatgttttatatttatggtcttatgcaggtattgatggcgttaattttgtacttagcagccgtcaacagtggcggcggctgtcgctcctctgcaagccttgctccgctacgcccgccgccggccgccggccacagcccgcctcccggctactgccgctcccgacggcgtcgtcgaaagagagaggaagagaggaaagagaagggtaagagagtatgacaggtagggcctgcgtcaggggtattttggtctggaaaaaaaacaaaattgagcaaaacatttctattcacaaaaagaacgaaaatggcattttggtgaacctctcttagtttaggatgacattatagtgaatcagtttgaagtgatggcattccagcggaaccactcttttgcgatggtataatcccattttctccttaaccagggaccgaatctgattcgtatccgtaatatcgggtatctcgacccccaagtactaaaacctgtgccatttgacttcctcggtggcttaaagggtggttttgccaacgacaagtagagtatcctaatcttctttgtcatgtggggattagggtagtaatcaatagcatagacgcaatgtctaggctagaggttatctttgtttgttgtgtgctccatggattatagagataggcgacaggtggtgacatccctgtctgtcctttgtaatcctccatgctcggatacattttagagctataggccggagtctccttggcagactaggggtaaaccggtgcccgaagcaatcaatagagttttaccttaacttaattaagttaattaacccataggaattctctccatcccaagcctaccatttagttattgtccttggaagaatcatgttcttagattatacacatacgttccttgtggatacgataccctgaaatactcttgagtgaaggctacaacgttatctgtgcacttgcagattattccatggttgtaataaataccaacaaagatacacttctagcctcgaaaggcctcaataaaggacttgctgtagattgaaaaagcatctagctctactgggttttggctaattgatgacaaatgattaatggattaatacacttattgagtgtataagtagggtattagttcgatgaagagatga

SEQ ID NO: 65349 - DNA, 77375 bp, Oryza sativa
  unsure (1)..(77375): unsure at all n locations
tacacacacacacacacacacacacacacacaatatatatatatatatatatatatatatttgatatgatcgaattgagcgccatgtctgacctgttgctatgtgatggcaagaaggtgcacgtcctgccgcgggagatgctgggcgtggcgacgttctcggtggccgtcttcctcctccggttcctgccgctgtgggtggtggacaggatcctggtcgtcctggcatggctcttcctcggcgacctcgccaagatcggcatcaccaggccatccagggggcccctcgagctcaagaacaccagggggaggacgcccgtgctcgacatcggcgcgctcgccaggatccgctccggcgacatcgaggtcgtgcccgggatcaggaggctcctccgcggcggcgccgagctcgtcgacggccgccgcgtcccggccgacgccgtcatactggccaccggataccaaagcaacgtcccccagtggctcaaggtaaattcgttaattaattattacttaaacttactacttactagtattattaattgcagttacgatagtgggcagcttttgaaactttaacgtaacaatatttaatcggaactgagttttaaaagtgaaaacaattacggaaagaacaccacctaagttccaactcaaagcttaatttattctccaaggacttaatttatgagaggacaaagcaaggtgtattctgccggaaaaggcttctaaaaaaagatggataatgatgcctaacaaagttagggctttctaatgttaatttggcagttagaaagatgttaggtactaaaaagtgtgctccatgttgttgtactttattttaatcacgaaaatcatttcactgattaatttcttaattgcttgtcatgattagggaagtgacttcttcacacaagaggggtacccaagggtgccattcccagatggttggaagggggagtcagggctctactctgttggcttcacaaggagaggcctctctggtgtctcctcagatgctgttaaggttgcacaggacattgccatggcatggaaccaccaaaccgccaccacaagatgattgatttaacttgctaaggaattaaccatgatcagcttgctaactgcaaacaaattgcaattaatcaaatatcttgaggcgcaacatggcactcaactggctaagaactgcatgctacaaactctgttcagagacagacaccaaaatattcagaaaccaagtcagggtccaaaaaaaaactataaaacaggggggagatgaagcttcagagtagatgaagcttcagagttcaggagatggatgccacaacaaaggggaaaaaaaggggtgctatggatgctaggtttaacattgatgaggaggccagattaagatgcatcaagtagagcccaaattttgttgtacccatgggcctttatgtacagaatgttatgtagtggagcttgtgtacatctaatggttggtagggaatctagagttgacattcatatgtacttggttaatgtttacgtaatatggaggtgatgatgatgagacgcaatttcgatttataatatttcttaagtttttttaaaaaaattaataaatagcctttagtaaagttgtctgtctatgctacttggaagatgcttccttactctgccaaaaggagaactacactatgcttcacttatttataattgacaacttgatatcccgtaataatagctgtaccgaataatgaagatttctggttagtcatgtcagcagtctcatttggttatgtctcaagtcttgtcacgaaaaacattccccaatcgatacaacattccaccgagaacgcccccccccccccctctcgcagcagcagctttcatgatctcattgctttcgtgaaccacttgattaagagaagtattaaactgttggtatttaatatgaatacagctcttacagagcatctgtaggatgatccaatggactgattatccagtagacaattctatctttatcctattgcataactccagaactttttgcataactccaaatgttaatcaattaccatcattatctgcgtcctcaataaatgcaagacatacaaagttgattgctgaaagaaatataaacattttttttttacttttggcattatataacattttgatcacaataccagacatatactctacctagtgggatgcaactttaaaggaaaaaaaatcaatcaagttatatacaaatatcagataaagctattcattaaaactttgaaaccttccctgtgtttaaagagataataccttacatccgagttttcactcattccttccatgctcctatgatatgtttgatcccctgcagaccattaagtttcattttttatcttgtatgtgtccagagcttcatcttcttatcccctgcagacagttgagttttcactagcagctggtcgttgtggccagcacaaaagaacaattgccctccaatatttcttcttcctcgccggcttcttaaacttgtcctgtttagagttttgacatattgttaataaagaattaatcttcagttcatatatgtgattgggtatttcctctaaggtcattgccagcttgagttgggaactcttcaaccatggcacacaaaacgaaacgatggtttagtgcatgattaattaagtaatccctccgtcccatacgaaatcaacctagtactggatgtgacacatcctagtactacaaatttagacataactctgtccatattcgttataatagaatgcgtcacattcagtcctaaattagttttttttgagacggagggagtattagctaaaaaatagaaaaatggattaatatgattattaaagtaacttttctatagaaattttttgtaaaaattgtaccgtttagcagtttagcagtttggaaagcgcgtgctagaaaaacaagagaggtgaagttggaaaagtaaactaaagaacacagccttagaatataatcgaatggaaagttatgtacatgtgaggaattttgtcatacatacaagtgactaaagagctatttgtagaagcctataatgttaatttgttgcacatgaattgaaatttacctcgtaattccaaaggtgttgctaaaaaaacatactccctccatcccaaaatatataagaagttttagttggatgtgacacattctagtactacgaatctagataggcagcatgtcccatccaaccaaaactccttatattttgggacagggggagtagatgaaaccttaacataaatctgaagaaaaaaaaaacagtgacaataacattggtgcaaatccttcattatgtgctgtttagattgtacaagtagtccttacacctgcctttatttctgcacaaggcacatcttaatcattatggaggattcctggattgcagttttgactacttcatgccagcagcccattgactcgaaattatagtttcttccttctcataaaggaataaactataccaaaaaaaaaataggtgcagggcctaccagtctgccttcctaagatcagatggtgaagtgcataccaatctagtcaccatttaaggtgttaaaaactttggaggatggaaaagacactatggcatagcgcgtgaatatagtattttaaaattttgttcatagtatggaccccaactactccaccccatgaagattttaattttcctttttcatttgcctcacaaaaactccatctttaatgcaatcaacgtaatgtagtttaagaagtgaggataaatatattggagtttaagaaaataggagacaaacacgttggagtgtgagaaagtaagggctgtttagaaaatagggacttgcccaagcgcctacccaagatcagattcgagggtagataagaacggagcgaggttatccccaaagagagacccttgtagcctttttgggtttatattggtatatgtaagataggtaaaaataaactcttttgagacggaggcataaaacattgtatgcactatataactataagtaactgctgctaaaagaattcagatcacctgccattgatagtgctcatagggaagttcacaagagatttctgggtagcaagcgtaccagaggtgtagaagagcgtggccactggaaggggaatgaatatatttgattttgcagagcatcgataatgccttagctgtatctgtatcgatgtacgtggccttttcaattcggcaactggatacgtcagaagcctctgtcgacttgcacactgcagcacacgattatcatcagccagcccccgtccgctgtcagcaactgcacaaggttcccccatcgactgttaggacaagctatagtatgcccattgtatcgtactttgaaccccaaaaatcaacgtgccacgtgcacgtgtccgtacacgtgacagggacgacgggtgccctccaatatcagccttatagtgcccagcttcattagatgatgaatgatcagcagcattctaattgcctgcttatacttatacacgacaggtgcccacgtagtatgaatgtatgcagccaaagtgggacgtacgtatgtatgtgagtatgtcttgacattatggtgtaggagggggatcagcaggtctggtctgagctgtatcggagaatttcacggtgtaagcttcgggagacacgctcgctcgctctcccatgtggtccaaatcggtgaaagcatcaacctcattcagcagggccgtaactgtcaaatgatgatgcaacatgccaggtgctccaacaggattagtccccaacttcagctttcaaacattccttctcactgatcatcccaaagctggtgcatgcacacacgcacgcggcatgctgtgtcatcttaactgtcatccacacgacgacgaacagcccactcggttaaggtccagcgatggtatagcttactctagtgagattttcgtgttttgggttgaacttgagagtcttgatatacatagccaccatcgcaacattagcttcctgagcaatatgagacctgagttactgccaccatccatggctgataaaggacaggggaatataccaatgacaaacaggattgtaacagatggattgaagagggtgagggaggggggatcacctagatggaggcgcagtagggtggtgccaatcacgtacggacaggcagccaatccgagtatccaacaacgcgcaatcatggcgggggtgctacgggcaccagaacaggatgacagaaaatgaaatgatccttccatcattccctccatcctgttttttccagcctctgtgtcccattccagcgatctcactggccgcgagagcgacgtcccaagagggcgacgcgcccgccccgcccagcccgcggggccacgccagaaggaataaatggggatcccggccccagcagctaccgtcgctgtcccgaaggagagcccaaaggtgccgacgggggcctcgccgtttgccagctctgctagccttgcccatgtgacagccacatgatcccaccctccgacatggcgcccgaggcgcggcgctgcccggccttggccgtgcagtggaatcgcgccgcgcccggagcaactgtgccgccggctggctggcctcggtgctgtggtgccgccggcggtcctccagctggcccggccgccaggatacttacttcttgctcaagtgcgtacttttggatccaacagtggcgcggtggatcccatccacgtgagttcttcatgggcagacggggctcaatagcacaaggtacaacttcatgattggctggttatcagtgctctgtcaggtccacatcacaattacttcgtgagggcaacccacaagacgatcgagaataaaaatgaggttacaatatgggtaatgagcaatgcctgtaagaattgccgtttgatagacggaatgatagatgccaggaactggtggtaaaaggcaagcatgtacctgatgtgaaccatctctgctgttgccttttgtgcgaaattacctcctttgagtagagcaagccagtccaaagaaagggcactgtgtatatgtatccagctttcctgaagcagaaatcaactcagaagtggacaagcctctcaaaacaataatatttggtgtaggtgagctttataatcatattaaatgactcaacaagctataagtatgccgctatctacaagacaagcacgagcagcctacacaaagcatgtttaaaccagaataattaagacatggtaccaaaaaattcagatgaaaggctacagttcctcaagctgttccagtcaatagcatgcttaaattgagattgtgctcttctttgtgcatgtgtgatggcgaggacctaaccaacatggaactgtacggccctaactttgcaaaatcctgactcacaagtcaagatattctgaaaagggccacaagaccaaactttctgtcacctcagaaagtgaattcagtgacggcccaatcagggaaggactgattgatctagatggcaccttgctcatggcattaaccaaagcaaagaatcacttttgacatcagttccaagcaatgcgggagaggcagatgaaatatgacaattatcatgacgcaggtctgacagtttacctcttgatatcacatggccatctgacttcctgtttccactctcacatctgtctgggcatcaaagattactgaaaagttagccaaacaagctggtaagaacaaatattttaatcagaaagaactaaaacatgaaacaatggaacaaatgattaaaaattgaagtagcaaaaacaaggggaaatataaattgtcactccatgatgtcatggaaatatgctacatacattgtttgctctcatcatcaggaacacattaacatagcacaacacttggttcaagccacaagtagaacacagcaacatacacaaatgcagatttcataacaccatcatttatgctttcctcttaccatagcaacaaaagcatgcaaaattaccacaacacctactgcaagttcatgccaataaaatggtggccatcttatctcgtttggatgctaaaataaagctttctactcaagggttataatgccaagaaaagccccgtctaccattctaaatacctttcataacacccatcatagaggttagcatgacaaaacatacgaataaataatgggtcaaattcaatacatgtattacagtattgttcagagcaagtgttagtctagtaccgacctccatctggatacagtatggggaatgattacgtaatgttatgatactgaatggctggttataatttgcccatcatatcttgtataatgatagatgggtgatggcaactgaacagaaaataatgaaattgacatatcaagaaaccggatatgaacaaagtcttgaacaaatgcattactatacaaatatatccagcaatctttacagaaacaacagagatttactgtcaattcatgtcccagcattatcaaccaacattgatcactacaaatgctcctccaatggtaactatttctataagcatcactcaactgcaagaaccatatgaaaatggatcgcaagtaaataccaagcacattcacaaacagtgaaaagataagatgaaaaggctgttattgttcaccaactactgatagcaacctaacaagccaaaacaagaaaacgtattttgaccatgttctaaatataactaagaaagcataattgtgaacaatttcttgagagatacagattatagcgcataacatagaccagaacaataatcacagattaataacagatacaaattaaccagcactgatgaacaagccaaatggcattccatagaccagaataataatcacagaattatgacaacaaagatctgtacatctcagcaaaatgttacaacaatagaccacaagttttaaatgcaagaatcaggacaagttttgcagtagaaatagagaaagcctctggatgtcatacctgctgttgcatcacctatgcaatcaagcttaatgtgtacacagggatttatctgttttgtaccactcaattctgtcacaatttgaaagccacgatcactgtacactgatcatgtaagcgtcgaagcaacttcctcatatgacagagcagggtttctctattcaatgaaccccgattggttttcaatcatggaccgctatgcattatcatttcatcacttcaacacgcggtttgtaggtgtctacaagataagattgccagattgatggagatttcgcggttgataatgacaaggaagttacagaagttgcaagcataaatcaatatgagggtagctagtgaccactcagtaattgaacagatactaccatgaaccagatctcccaatgaggtcagagagctaaagtgctccccattagaatatgttttattatctggtgctagtgttcatttgagtcatacatgcttcatatgttgtttgaagttgaaaaccctacaaacactcaaagaaaattgagaaaaaaaatgaacttgccccagaaatggactgatactcataaactgatcttggtcttggaaaacatcccctaagatataatcaaccctgattattatcattcaaacaaaatgcattaaaatgcatattcattaactgagtgaatagaaaccaaagcacagaatatgatatttccaacaacatctgcataccacaaacccacagcactgcattgtatgtacgatctggacatctcgtgtagcaaaccccatatcaactaagcatggcggtgttatctaattcagtaccaactaattatgtctatagtcccataagcactccaagcatattggattaattcaaatattttataacatgtggaagacaatctagtggccaatggttgttggcattgcccacagtctaaggtctaatggtattgcatctattttgtagtgccaagtatcttatcctcagaatccaacatttaaacttgatcagaatgtcttcatcaataaggcatacttgatatgcaccaaaataaatttcaacaaccagcttggcagtctactggcctggtaggtgaaatgtcatttttccttgtatgttgcataatgccctttacttatatggttgacataaattcctaccatgcatgcattgcaaggagtactagtattctagtctaaaacaagtacccgctccccctccaacatattctcaagtagatattattttaaaatgggtggagttaaactccaaaagaattgctactaacaatacccaataatatatgtaaaaagtattagtgtgaattgcagtctgcacctcctttaaccaatcttttcactttcaaccctgtcttcgatcttttccttcaccttgaagcccatgtgctggttccccaccacagccattgtggaagctaactcgctggcaggtctaccacaagccaccgatgtgctagctggcctcccatggttgggccacctgatctggagccacaatcgatcatcctgtgcctcactgtgcgccagtccagatctagagcagcctggagaaagaccagtcgggcagtgcagccaggggagcctcgcacaatgaggaactgggctgaggctgttgctgccattcattggtgagagaggttagagttagactactatagagccgcttgtccgaagttctctgtttgggtgaatttttagacagctttcaaattacttcaacccttctcagacaaccagacagaaggcccaactcgctgtatttattcttattgtgtgatgaacatttgtcaagtattagtccaaaatactcaagaccacagttcctttaccgagttgttcttgttggtattaatgctcactaggtgtcccttttgctgttggaacacattccttcatgagttcagaaacttgtgagcggctggactgaagagaaaatgagtatgcgggtcaggaggtgctcattaaatcaatggtgcaagcaataccaatatattctatgagttgtttcatgttgtcagtttgtacatgcaagaaaatcatgatcagtaacacactggtggaccagcaatgctgagaagtgaaggatgtgacggcaaaagtggaaaaccattcaaaaccaaagtcaagtgcttgaaatgcaggggtgaagattgcgaacaaatgcacaatccttatgggccagggtacgaggagagctattatgagtgtagagaagcataagatcagaggcttaatcaaaatggtggaggagatcaagtggtaacaaccctttgtcagaatgtggtctatcttgatttcttgagtagatgtaactaagaattcttgaattctaagtttctgtggggaggcccaaagaatacattgcaaccggtgtgggcaaggatgtaggttttgatctagaagaagcaaaagaaactaaggaatctggtaagttatgttgctgaaccaataatggacacctttagacgtcacctatgtcaagatcaatatgcatatgggagttacaatgaagtggaaaagattggcacttcaaatgatcattagagtagatcttgaaaagttttaaagtgagacacaggctcgctagtactctcacttggccaacgctcttgtttctgaagtttggtgctccgtgatgttctctgcatgacatcagagctatgagaagtacacgtgctaagctagtacctggatgtaggcaggcctgcctgtgggagctggtgcttggtttcctctgtaactgcgttgctaaggattatgctccttcatatgatgaatgaaaatgaagcccctgattcacgaaaaaaaagggggtgaaacttcagtcataaaatgtgacattagcagatttgtggccagttttatggagatctaacagtcattatacttctaacagttttatggacatccaaatacaaatagtaatggtcaaggatttgtattggagactgtgtcatcacgtcataaatgacaagtaaaatgaaacagatggattacttttgtatgatgacactatttacacagcatgcagttatgcactgttatatataaaaataacaataaaagatattgtcaaacatatttggttaacaatttaacatgttaccaataagcccaaagcagggctcaaatctcaacaggaacagccaaagaagactgtacttccaatgttgtgttttccacaaccccgtttctaggtttccctgcaattaccttttatataaataggtctacaactgcttctaatatacaaacaaaactccaaatacataaataacagaaagtaattagtctaaccccttccacctaccctctgaagtacgaaacccagtgttgttcctctaagtgatgaaaaaatgattcaaataatccccagcagcgggtttggaggcggcaactaacgtggctatgacatggcgatgattagttcccatgtttcagtgttcactcccatcttcttcctcagttaataccttttcccggtggccagagtgcagctgcactcagtaaccgaattgaagcagcccagtggcaatgagcaaccatgtcagcgccatttgctcgagtcattgcacatcaactaccatactgggaaaaccaccccaggattatttgaatcagttcccatacattagggtgttaaagacccaattttgtagttcaagggatttagtagacagaccatactacgttagttgtatagtagactttttcctaacaaaaagatggaattatgggttacttgtgcatgaggacatcagaagaatggaaattttggacaatttcatcattaaggaacgcaatttgtcgctttagaaagcagactccaatactagagggtataagacaatgagtatacaaaactaaagaagcactgtagctgtatttatatatcaaagcagcctattccaataactgtagtgtctgttcatgtccaatataacaggttccatagcacaaccagctaaacaatgctgctagggttcagggatatgctgagaggaccattaataattcattgcaatcattattacctcattatgttggatttatccaactaaaaccagggatcttcttcaatgccccttgtttaatcttagccctcacatgttcgacaatattccagcttccatcaaaggcatgcagattagatactgagacaagattagatgggttcccttcttccagtctaagaaggtatctgcaggacaaatcttgaatttctttgttattgtgaacaatggaggcatccagaagtgctccccagacactagggcctggctctatactcattgactttataaagtccaaggcctgattaatcatccccgatcgaccaagtaaatcaactatgcaagcagacatctcctcagttggatgaactccataatccttcaccagagagttgtatatctcaaggcccttaaaaaccaaccctgccctagaacaagctgaaagcacacccaagccagttatgctgtctggcttaaccccagaaatatgcatctgatcaaacagggcaactgcttctgcacccttcccatgaaggccatacccctgaatcatcgaacaccacgagatcacatctttgcaccatctaccatcatcaaagatctgccgtgcataccacaagaccccgcatttgacgtacataacaatcaaagcattgttcagggatacttccccagacaatcccatcctgaccgcaaagccatgcacctgtttcccagcagccaaatctgtgagggcctccacagctgagagcacactaatcagcgcaatcctgtttggcagaacagcaccgatcacccacattgcccggaaagcatccacggcatcctcaaacatcccgctctctgtgaaccctccaaccattgcagtccaagaaaccacattcctctgctccatcccatcgaaaacccggcgtgcatgtcctggttggccaaccctgaagtacattgacacgaggctgctcccaacatggaaatcgcctgccccgcacatcccactcttcagagcgaagcaatgaagctccctgccccggagttcggactcgcacgctggcaggatcgacgagaccgtgaaccggtccggcacgcacccgtcctcgaccatgtgccgcacgacgggccagacgtcgacacccgggggcgagtgcgagatgagggtgttgtaggtggaggcggtgcgcgcgggcatttcgtcgaacagcctgcgcgcgaggcctggcgacgcggcgcggaggtagaggaggaggaaggagttggcgaggacggggtcggcgcggaggaggccgaggcggagggagaaggcgtggaggcacccggcggcggcggcggcggcggtgacggaggcggagggagagtgggccggcgggaggagagaggcggcgagggaggagagcgtgaaggcgtcggggcggcggcgcgggaggaggaggcggcggaagaggtggagcgggaggtgggcgtgggaggaggcgagcgcggagaggagggagttgaagaacgggagcgggacggcggctgggtcggcgcggacggcggcgaggcgcgccgccacggccggcgggagaggccgcatgcttcggtttcgggatccaggcggcgccccgccggtgcccggctggacttcccacaaggcaaattagaaaaaggaataagttcaccggaggtccctcaacttaacagcgagattaacatcctttaaccacaaacccaaaatgtgtacctctaaactcaactaaactgtttaaaggaggtcccatggcagtatttttgtccggttttactcacatggtatcctaatcagcaaaagaaattaaaaaaattacgtgacatcctagtcagcaaaaaatacttccatgggaccttctttgaacagtttgactgagtttaggagtacacatttctgatgttgtggttaagttgagggacctccagtgaacttattccttagaaaaatgataacagttgggccggtgggccggtgagggagaaaaaggatgttttaatgcaattttcgcgtagttttacgtgggccggagacacgcaacgcacacggagcgggccatgggcttctatggttgtgatttttttgggaaaagtccattttacacccttgaacttttatgctggttcaaaatatacccccaaactacaaaaccggtataatacaccctcgaactttcaatacggacacttaaccgggagctgctagctggcgcgtgtgcacaagcagcgagcactcctccccgctttagtcttaagtaactatattagttattaacatacttaacactaatgatatcaattaggaaatattctgaagatttttttggagatttttttactaacagattgacaattttttaagttagatttgaaaactttcgatttaagttttaaattttaaagtcaaattttaaaaactttcaacttgagatttgaaaactttcaactcagattcgaaaactttcaactcaagaatcgagattcgaaaactttcaagtcgagattcgaaaaatttcaaatcaagatttgaaaactttcaacttaagatttcaaaactttcaagtcgagatttaaaaactttcaagttcagatttgaaaattttcaactcaaaaattaaaaactttcaaactcaaaacatgctagagataaaaaaaatcagaaaaaagtgaaaagaaaaggaaaaaaggtttaaaaagggttaaaaaaaaggaaaaaaagtggaggagacgcgcgcgccggcgcagcggcactgggccttctgggcccgaaacgcatgccgccggtgcgagcgcgtgtattagcttttccgcacttaacccccctccccccccccccggctgtttttagcgtggtttttgacatgtcggatccaagtcagcccacaaaataatataggccaagtccatattgtctctctctctctctctctttctcctcgccctgttgtgtttctctccctcgtgaccattgacggcggcatggagctgctgcgagggtggcagctacggcagcggtggctatgtggagcggctgcgagggctgcggcgctgctagggttgcggaggcagtcatcggtggaagcctttccacgcagtcgccggcaaggagagcagcgatggcggtggagcttgctgccccgcgcaaaagaggcggatctcgccggagccacacgcgtccccaagccccgtcacctccgccaaactctacatccccaagcagctctagctcactggcaagctcgatttcgtggagaagatagagctcctgaaggcggcaggagaggcggaccttgagcttgggctcgccggcggttcgcacagaagggaaggctagggatgtgcttgagctttgtcgccgcaacaagtcccctgctccaccgccaccgatctcctgctccatgagctcaagaatgccaccgccgcttctctcctgctctgggacgaagaaggatagagagagaaagtgaagaggagatgagggaagaagaagaggtggctccaccgtggttatggactgacataaggtcctaatttttatttttatttgctgactggacttccacattaatgccacgtaggcgaaaaccagctgaaaaaccactcgagggtgtaaagtgaacggtattggaagttggagggtgtgaaatattcggttttagagttttgggtgtattttagacaaaacgaagagttggagggtgtaaaatggacttaccctttttttaattggatccattccattacaacttcggcaaattaaaaaaataccgctactatttatgatatcggttatatgccattggtattttataaaatttgaatcatgccactatatcggacacagttagaccggatttttttcataccatattttttacgtaaaatctaattcgagatccctctcgttttagcgctatcgcgcgacgttggcaaagccgtccgatctccaaccacacgcacacgcgggtcctgcttcagagagagtcacagagaagaaggctacagtttctcccccatgtcatttttttcttcaaacaaagttttatctcaaagtacttatccgatctacaatccgattacaccattgtgttcgttacaattaaatcttcacaacaagatcttacatgattatattacgataaaaaatatttatgtttgtaaattacttttattatatacataagttacttttatcatatatataagttacttttagatttcactaaattacttcttagacatataaaagtaaattcaataaagtctgaaagtaatttacatatattataaaagtaatttaaaacaaaatgtaagtaactttgtcacgacattagaagtaaattcgttgtagggataaaaatatgactagaaattaaatttaatcagcatagatcaacacacataagtttaacaatttttaaaagtaacttgaatgttaattgaaagtaacttttgcatggttcaagttaaaaggagatattagatggagtacaaactagctaccactagctgtgtagtcacgtccaatgagaaaaatatattaattaaagttactttctttttgttataagttacttctataatatatgtaaattacttttaggttttattgaattacttttatatgtctaagaagtaatttagatatattataaaagtaatttattattttttataaaaatataatcatgtgagatcttgttataaagatttaattgctacgaacacaacggtgtaatcggatcgtaagtcggataagtaatttaagagaaaattgtatttaaagtatagatggatagtgtcttttataaatgaaggagtagctgtttaaccagctaccactatcgatcgatatagtcacgaccaaaatacctataacatttagaggctgagaagtggaatccacgtactcaatccttctctagctcgacgaagctgatggcttgttgagagctcgaccaggcccacgtcgggttaggaagggcggaagcttaattaacgagaccgggccgtgcacggcagctcgaggaggacggcggcaggtctccaagtcttgttcgcgccgccgtcaccatcgtcttcgagaaggatggggatggagctcatcgccatctttcgagtcttcgcaggcgccgggcctcctcatgccgctccacgtacgccaagccgcaaccagactcgcctccgctaatggacctgttggcgctgctgctagacccaccaccgccgcgacgaacttgtcacagcctctcccccgcctgatttgcttaagcccaccacgtactggatccgtcgccttcccgctgaccaccaccaccgctgctgcttgcttctccattgatgcaactgctgctactcgattcgcggctgatgttcccgcttgctctaccgccgtctcgctccacccggtcgtcgctgattgcttgtcacttgcttgccgcaaccaccaagataatgagtggatagaagcgaaaaaagtctttacttgaattaaagctagatggcgcccgcgtgccaccagagcgcattttttccgggagtaacaagcataactagttttagacttttagataatgacaataattatccgattacttttttctttttaaggtagtaatacttttctttcttcggtttttttaactaatagagtgaaaagaaatctataaactttcacgtgaaatttaaagctttctaactttcaactcaaaatttgaaactatttttaaaattttcgacttgatatttgaactttcaagttaaatttgaaaactttcaactcgaactttaaaaactttcaactcagatctgagagatttaaaaactttcaaattcatatttgaaaatttttaagtcaagatttaaaaactttcaacataaactatttaaaaacacgtgtgctaaagattaaaaaaataatccaaaaagcgaaaaaagaaaataaagcgaaaagcaaaaaagaaagaaaaaaatgcgaaaaaaagaaagcgaaaaaaacgccgcggggggggaggggctgcaaactggcgcgcgcgcgaattagccgcccccgatagaagtattggggaagaaaagaaatatgacaaggtggatctctcttgtcagtctctaatactaggagcattttggtccgcatgaaatacaggatgtaaaaacccggtctaattgtttccgtgatgtatataatggcatggtttattttttacaaaatactgatagcatctagctggtatcgaaaatattagtgttattttgtcaaaaaaattaaagagaaaaggtagagagtctctacctatattcattgatgtgaaatagttacatatatgtaattggcagaggagagggatgataaattaggaggaggcgaggggaagaagagaacgagaagagaagaaagatatattttgtcaattaggcatagttgtgattgcagggatccaattaaactttttttttcattttagagatcttttctattacctcagtttcacgttataagacgcttcaatctctccatttatcatattcactagtatccatatgaatttaaaggtatatacaaagcacatatattgatcaatgcttgaatagattgaaaacctaaaacatgttatttgaaacagacgaaataattcattgggacctacttgctccgtcccacgaaaaacaaatctagaattggatgtgacattatatccagattcatagtattaggatgtgtcatattcagcctattggttttttatggatggagagagtactccatgtccttataaaaacaaacctacgataggatggatgtgacagtcatatcttgtcgtaggtttatctttttggcaaattttgctacaggacatcacgacttccgggttttagttatagggcaccgtgcgaagtgacttttaggggaaggcattatcaaaagttggatatttgctggtagacatcccgctcattaaaataataatttccggttgaagagaagagagaatcgcgtgaaatgtcaaaaatgcccatgggccacatgttagctctcctatctctcttctctctctatccggtttgggatgatgcaggtttcgatgttgcaggcggtgcgcgacggcgtggtgctcggctcggcattcgtcggagctcatcaaggagcttgcagcggtagcagtgattccaggcggaggaatcggcgccggactttggcagcggcggctcctggcggaggaggaggcattgagggctccggaggaggaaacgttcccaggcggtttcctgaggtcggtggcggttcccgatgaaggaattggcgtcgaacttcggcggcggcggttcccggcggaggagtcggcactaagggctccaaaggcggcaacgttcccaggcggtttccagaggccagcggcacggtggcatcttcatggcgaggaccttgtcctcacactgcgccacccctgtcttcgccgcgcgcgctccgcccgctggtcacgccgccgctcgcggatcgtttggcttgccggagaagagagaaaggagagggagtggaagagaggtaaggaagaagagaagataggaagaggaagaggggcaatttggtcacgctgtgtaaaaatgtgggtcccctctcacctggtcagcacaaaaatactaaattagtggatgcagtgtcccgtggcaaataaccacatttacataggccctgtttagttcgcgaaaagaaaatttttgggtgccacatcggatgttaaccagatgttggatgggattttcggacacaaatgaaaaaactaatttcataactcgcctggaaaccgcaagacgaatcttttaagcttaattaagctgtcattagcatatatgggttactgtagcacttataactaatcatagactaattaggctcaaaagattcgtctcacgatttccatactaattatgcattagtttttgtttttatctatatttaatgtttcatgtatgtgtccaaagattcgatgggttgttttcggggaaaaaaaattagaaactaaaccaggccacattgtcttcctcaaaagtcacttcgtgcggtgtcctacagatataaccacgatgtcgtgatgtcttatagcaaaatttgccattttttcgtggaagggagggaggatatatatggaatttatgttgcttatatggtcgtacttgtactaacatgggatgatgcgttgtactcgacgtgccttgcaatgtggagttaatcatgcatgtcatcaaaagaattcacagtactactctctccgtttatacatttcacgttaactttttcagtgtcaaattcttttaaccaagtttataaaaaagtatacaagtttataaaaagtatagtaacaatttttaacacaaaataaatatattatcattatatttaatgaaactaatttgttgtcgtagatgttgttatttttttaaatttagttaaacctaaaaaattgaatagaaaaaataaaaactacttataatataaaacgaagaaagtagttattattaatcacagttctacatttttattgtaaagttaaaggcaccgtacaaaaatatcatgctaactagcccatcatcctcgtgtacaaccattttgcacacttatcttgctaatctgcaaattaaccaagtcccaagatgcagtttgactggcatgtttgtccaagtacgtacgtcagtccgctaattaatcctggacagcaacctgcggacttggagataagaggaggctgcggcggaaggcactgtactgcggggagccggggcagtagtacaagctgtactcttggcttcgggcaaagccagtgtagtacgtacttcacgtactccgagtcttttcccagcgatggagcagcaaaaagtacgacgccaatcgatgccatcctcctcccgaccccgtggaaaagagtctataatacgtgagcgctttgcctgcgttttggccaggcaaacgcagcctccatcattaatccggtcatcagcaaaggttaattaggcccggagatttttgcagctgagagcggggagggaacgaatcggaatcggcatcgttatcggcatcggcagcggcgatggagacagagagatggaacgcgagggagttcctacaggggcgagctgggaacacacggtgatgaggcggtctggtctttcgtgtgttctcaggtcgcccctgccgggactctctggttgattatgtatatgttgattattttctcttgccaaaaggtctcctaaatggcgcggtgtaggtatgttctcttcctcgattacacaattcggttgattccagttttgctttaaaatgtcattgtcttatcttgtggccactttaacacttgctatatcaagtttaccttttcttttatactgggattaattctttgggaaaatatctactgttttattaatttctttcggaaccaatagtaatgcatgttctcataacgcgcttatgtaaacgcacatatgcacacctctacctatgagtatttacataagattaagtcggtatatatatatattgagattgataaagtcatcatgaacatatcactgttaacgggtacatcgtctaccattaaaacaataattaactacaatacaatcatcagtatcaggtgtagattgaatccagatgaggtagttccaccacaagatacaacctcacttcgtagctattttattaatttcaggtgaaactttgcatatgattttttaaaaagaacggtatgctgagaagagatagacattttactccgttaaatgctttcgtgtaaaagaattgttgtgttctgatgacatttgagacacggcgcttaactggcctactttccactctttgtttcacaatgcgatccctcctgttcgttaactagatttcctttctcgcacttctgttctactactctttcgataccaaaatataatattttttcactttcagtatttatctcaaaatataataatttcttcaccaatattttttcctaaccaatcacaaccactactacaatacctattctcccgtgtgggctaaacgatttttgcgtgcgggtgggcggcccgcacgcacccagtcatctgggaaaatcgcgatcgcccacacggaaaaacaaaaaatcgaaaaaaaaaaagaaaaaaaacctaaccctaatccgctgccgtcgcccccgcggtcgccggtgccggatccgtagtcgcacatcgacacaacagatctcacatcaattccaagagcacatctcacatgttcaacaaatgaactccaagaacgcatcgcacaaatcacaaagagtcacaaataacaaagagagaaggagggggagagatggatccaccggtcgcctacgccatcgcacctcttgccggcggccccacctccacgccggccgttgacgctgctgcacctccaaccggcgccgcacctctagatccggcgcgagccgcctccgtcccaccgcctcccgccaccgaggggcacgggctgcctccctcgtgccgccgctcagccggatccgctgggcccccatgcctcccctccgccggatctgcaaggaaagggaggggaggggccgcgtgccgccagatcggccggccccatgcctcccctccgccggatctgcaaggggagggaggggaggggccaccggggtcgcccgccgccgcctgctgtcaccgcccatcttcccgcccgcagtcaagggagagggagggaggggccgcgcgctgcttgctgtcgccgtcggtcggccgggagaggggaaaagaggagaggagaggagaggatgagtggagtaggagagagggagagagggaggtgggaggagaggagcaggcggagggggagatgagcgaagtgtgcgggcacgtgacggattaaaaggggtgggctattttcgcgtgcgggtgaaaatatgcttattttcgtatgcggttggcttaagccgcccgcacgggataatgcgttttcccgtgggagagacagctcggcaccggtccccctattttcccttgcggttccacttacggaccgcatggcaacataagggggcggcatccaggaaaatctatcatgttgtagtgaaccctccaccattcaatttttccacttacctttatttcttgtccaatcacaatctcatttaattctacatattttcttaataactatattaaccctaaaaattcttatactctccaccaacattctctttttaaccaatcataatcctctaccattcaattttttcacctatctccactgctcattcaatcataatctttctctatttaattctacctactttctaccataaaaaattctacacactttcttaataatcgtgtacacccctaaatatccttatattttaggacagatgtggtaataatttttacttgcatgtcatatccaacacatgtgtgaaaatggactgggaaaaaataaaatagtttggactgtttggtagggcttcagcacctaaatttagagcctgtttgatacggctccatctccagctccacttctcctagagctaaagctcaaaatagttttagctccacctaaaataagagtggagctaggtagagcattctcacaaaatgaaaaagagaggtggacctgggtttaggtggctccacaactctactccagacccaactcctgtagttaaatttaaaaattggagctctaccaaacaagcacttaactctaggaactgggtttaaagtggagttatggagctgcctaaacccaggcccacctttctagtttattttgtaagagaactccagtcggctccactccctttttgggtggagctgaaatcgtttggttggcctccagctccagaaaaggtagagctagagttagagctgtgccaaacaaaccctttatgtaccacatttcattcataatttggttacttcattttagaaggagacaatatgacttattcttgtttatttagagagaagacacactaaatttgaagatactttctgagaaaatttcctatgtacccctaaaagttcacctaacctcttttatactcctgagatttgctcattcccttccatacccctaaatttaagtttggatcccttctataccccttacattagttgaccgttaaattcctatcataaagtctattttgccctttggtatcaagaaaaaataaatttatgaagtatattgatggagtgtataaatttattgtatgctactattatatttatgagtttattttgtgagatattatttaacaaaaataatattttagtttcacctccgcgaaggcaaaacaaaaatattttttatctatgacaacatttatttttagatataataaaaaataatattttttaccattaaaaactgtatatataacatattttgttataatagtacgacatttttgtaagataaatatatttacatgctaaataaataatttttaataactaataaataaattttatttttatgtcatacctaaaaataaattatcataaatattatttatgactttgttacgcaagatattatttatgataatttatttttattgtgcgataaaaaatatttttgctaaataatatctcatagaataaactcataaatataatagtcacatataataaatttatacactccatcaatatactttatgaatttatattttcttgataccaaagggcacttacatagcatataaaaatctaacctatatttttgttcttcttatattttgcaaatttttgttttgttttcaagtttataaatgcaacatgaaggggaaaatgcaatatggaagggtaataatacaagtcacctcagtgggggaaaggcatctccccccaagcttgtttcttgctcatggtccaaggtaggggctgaacccctggtggcgaaagtgggcctgccagtcggcctattgttgctgcatcgtgttgttgaagttggagagctgtgcatcaacattttgttgccactcatgtgtctgcatgacatgttccttgagcgtgtgctggatatctctggcctgcagctcaagattgcatatcctccaagtgagttcacataaataccctcgagaggagacagagcaacgcaatcgggtggagggaggtaggccacttgaactggagaagcgctttgccaagacgaacctccggcctcatgttgaggaccttgtgtccaaccgggggcatccttagttggggctcaatcggcctcatacatctgcactgccggtgaagaggatgacacctcttaaggtgtcactcttgccatgcttcacgtcaccttgcgtggaaatcatttgtacaagattcctctatcaattggagaggaatagtagcactcgacaattatacaaatagaaccccagttaggtaacgtgatttcattcgtatagccgaggaagaaaaatacaagcaaatcatccgggccatgtttgagtgtatggccttgcaccaaatatgcctcattaacatatgaacggggtgtggaaatgtaagaaatttgagcatccgacactaacccaacttcataagctatacgagaaactagagaagtgcactcaattggaccggtagccctcaacctcgcgaaaccaacggtggcgacggcacgactcgatggctagctgcggccgaaggcggtggcggtgggtgtgatagcgcgggcgcaatagaaggcacgggaggaggtggcgagtgaggaaaaggagggggcgcgggagagaatcttataggtccgaggagaggagtttgtggccaggaggtgcccctattttgccgacgacgtgggagaggtggccctatggccgcgcgcacgtgccgccatctcgcaggcacgacacgtatgggaaaggcgagggagtgggcaggcaacgtgggcatggcgcgtgcgtgcggagtgggggcgtggggtggagaggaggaagcggcggcagcagttagagctggggctccactggctggagattgaggaaggggccgacaagtgggccccacctgtcggtgaccatgagcggcaaggaggcgggcgccgactgggccacggcctcggcctgggccagctaggtgggagggcgcttgtgggcgaggcggactaggctgatggcctaagaaaaggaaaaaggagaagggatttgctgggatttaattattaccgagaattgattttaattggttaaaattatttccaagcctctaaaaattccactaaaaatcatgttaatatatttaaacatggggaactcaataaaaatcccaccatgtcattttcgattattaattgcatttattaattagggtttagctctaggttaaattaaattatttcttgaggcaatttattaactgaattaaggctagagaaaggggaaacttcagggtgtgacatgtgtactcatgttttacttagaaatgattgagaggaccaaaaagggagaggatttgcgcgggctggatttggactgaaggacatcacaacttgtgacaactgccacgacttcatacaaactccattttgggcatgtaagtacaaatggatccatcctcatgtccatatctattctggagagtctgcaatcatcattttactacaaagacttttttatgtccacggtgctacgtcaccttatttgggtcgaatatgatgcgtaccaagttgagtccgttagagacacgccttatagttagaggacaaccccaactcattctccacctatatatttcccttagccgccatagatcaactcgggttttgtttagatcaaagtttagtgtcgctattttgccgtgtaatcttgtgatcaattagattgccgttttgctcgttacggaaccccacctttgacactcttgttgatttaatcctacatctttattccgtaaattgagttgcttgtttatcttattgtttctagttctcgattgcttacagaaacaatcactcttgtggttaggctgattatgcatccgctcagattcaagactgtctctagagttagtgtaatgattgctaacgcgcaacgtctctagtcggatcaccaacgtcgttccattcaatcggattatcttctcttcggaaaatctgcacaccctcgcatcatcaacgctgaacttttctgcaagtctaaaaatcaatggtatacggctaaaccggatccctcccaactttgaactatcaatctgaactttccccaagaaaaatatataaatttggtcgctgtgaaataaatttgtaaaaatgattttgtctaattttatacattattttttggtgaaaaattatacagtatatcatttcatccatgcatcatgaatgtacaggtaatcaaaattttatcatgtaggccctgcttgggaacaccgaaaaattttgcacctgtaatggtgccccaactttaccagtgaaataaaaaacaatgcaggacaatctgttttttttttttggggggggggataagctaaaataggaaaaatgaaaagaaaattcaggttcatcccaattagcaacaaagatgttctcggttcgtatgatatcccaggcatcgaaggttttagatcaaaacaacatcaaattagagaaataggaggaatgaaaagaaatttatggtttagccgtgcaaatcatcaaggccagctcttatgaagaccgcaaatcaacaagcccaaactcccttatcttttatgcgttgatcaacatggagagtcgagcctagtgagccgagcccgatgttcacgaaaataagtgtgacctccttagcccacacttatttttcgctggatcgggctgaaaacgggtggaaatttgttgtgttacggcccatcaaggatttaactttactagagaaacatggccatgatttacacccgttttggaccgaatacatgtcttccgagcaggccaatggttatattattaatactcttttacaaatatatagtctgataaaataatgatcatcctttcgagaacggaggcggtagtagttaaaaattgatttgtctctataataacaatacaaacaccaacatagacactaatactcacgcatggacattataaacgcatatacatacatcatattcttatgagcacctttaaacatattttttttcatataaatatggatagttctttttttttcttttccctggtttcaaccccagatagagtttctctgatccttcattttatcttacatctttgctctaccactcatggtagaatacatattggttttgcttccaagaaaaaatggcactgaatctctagcaccggcaacataataaacaaaatacaaaagcaaatctgcactgactggattttatttcatgatccttattacgtcgtcgaaggccccggcatccacaactgttcacagttgttttacacacagcttgactgaaaccagaatattatccactggactgaagtgcactggaatctcaggaatcatttccaggatcccaggcaagcaggcagcgtgcgactgaaactctgaacatgcactccacagtccgctaccaacaaacacaagaaagaagacgcatctgtttcttgctagtgcaaagcttgccatttatacttaattattaataactaaagcagcattattgccagtgcttaaacttggctagctagctatagctctcattgggttcaagttgaccttaatggaagatttaggatagtattaattaatttctccacagtgatccatatgcatgtgtgtttgtttggtgagctaaacaaagtttggtgatggtgatgcacaagaccaaacaaccagctcccctcaattccagcatcgtgctctcatcaaatctttgaacaattaactgaaaaagatctgtagctagcaacatgtccggtctggtcccatcagattcagatcaaccatcacacaacacaacaagatcaggaccctcctaggctcctagctagctagctactacctccctccgagaatataacaacttttggctataaatttgaaaacacagttatccagattcatagttaaaaatgcttatattttgggatggagggagtagctacatgaggtctcttaacttcgggggtgtttagatccaggggtgtaaagtttaatttggcgtgtcacataggatattatatagggtatcacatggggtgttcggtactaataaaaaaactaattacataatatgtcagtaaaccacgagacgaatttattaagcctaattaatccaccattagcaaatgtttactgtagcaccacattatcaaatcgtggagcaattaggcttaaaagattcgtctcgcaaattagtcgcaatctgtgcaattagttatttttttagcctatatttaatacttcatataagtgttcaaacattcgatgtgtcagggtgaaaatttttgggtgggatctaaacagggccttccatataacttactccatttgttccaaattacttattattcaagctttgttttaaatcaaatatttatattctactattagtttttagaaatttgtatagttaagcaacatgtgaactatatatatacatatatacatatatatatacatatatacatatatatatacatatatatatatatatattatgaaagcacttctcacgataaatccataaatgtaaatctaatagaattaatccatataattttttagaaagcgattatcaaatatataaatatttaatttagaataaaaccggaacgacaaataatttgaaatgaagagtggagattgattgtggtatagcaaatagtagcaaccactattcttccagtttggggtagcctgcacatcacatgcactgtagtactatacagtacacagccccacaaaggtagctgcaggatccatgaaaagtaattgtgtttctgaacttgtgataagcattgagtaaactatgattgggcacatgattcatgaatttatacctttgccagcctacaatcaagccctttgccctaggaattatagatagctgcactcaactgaataaagattgttagagcaagtttaatagtatggcccactacttactccaatttatctatagccaatctaatagccaattcatacaatagttgcttgctatactattaatatatggtctcatctgtcatacacacattgcgtcttggagtccgcgctacagctggctacagatttgtagcccgctacttttctctctcatcttttatctcattaaaatatgtttacagttggctaatagtctactattgtacctgctcttaggagtactactactatactatgctgatgtatgtatgtacaaacgagaaagtagctgatgtaactgcagtaccgaattctaatgagtaatgactattgcaggatgaagacaagcagaaacgtccacagtgaaactgtaaagaagtagtagtagatttttaaaaaatgacattttatcaatttttaaaataactgagagtatgttaattatcactgtccctgagtcaaatttctagagtaaagaacacaagcttgtggttatggttaagttaactacgcactaattctatcaccggtaaagacaaacgagggttcaaacccttgaagaaagtgatgcaaaacaaaaacaatggtgctagctagcttcctggtatctttgacttaactgaaatagaatcagagagagagagaggaaagcatgcacctggaatccagtgcaaacatcttaggcaatgaatttaattatgtccaattttgtactaatatatggccttaattatctgatggattaattagacctatgtacctgtcctgtcttgtgtcggcttaatcggctatagcaatgccgtaatcgaaatgttaggctatagcaatgtggcactgtgcattacagtagcaatgttgtaatcacattgccacattactgtgcattactgtgttaatcgaaattgattaacatttcgatgccgtaataaggcaacatttatagcaacaatgtggcactgtgctagaaataccgtaatcgaaatgttaggctcgatcgagctcgacaattaagtcaattgatcagacactgtccagagaccaaaggacatgtctaactgttaacttttttttataattagctatagcatatgataaatacttaggttttgacttgtgaggcctaatccaaatactaatcgatcctaacgttgtgagacaatgttttcaaagatcaaggcagtgagtgtaacatgagacaacccaaatgtgggatgctcgtcaacaatgttataatgaaattgtgagctcattacactagaaatagttggtgtacataggttaattatttactgcttttgcaatgagcagtaaccatctatagtactttgaaattactgctttgccatctttactactttgaaattactgctttatcattggaaaagtagtatagaaaatcattatgttgctactttaaaagaatatagtgacgatgacgacagggtatctgtcaccttaacctacttttattgtaattttgtggattgccccttcaatttttttatattataaattaaccaaatctaaatggatagttaaattaaggtgaatatatattccgtttagcataaagatgcgtaatacatttcattttaaaaagtatcataacatatttttaatccgtagttatgctacggagattccgctagtagtttaaaattgaatatcatgcataaacatggatcattcgaggctggaggtagtagcaaataattcaaaatactatacccacaacctttgctttactagatcattttagaaaattcaatggctttattattgaaatcaaccgatcgaagcagccaagccaagcaggaaagatgaggcaagatagacccaaagtacaatccaatccgggagtttgcttcccaaatggattaggtccaaattaaaagacaaacaacaacgcgggcggcgcgtcgtgatacgcgctgcatcctccctcctaatccggattatcggggtggggtggatatttgattaagggatgtgggccccacaccaccgtgccaccggaggggtggggccctgcagaattccacggtggtcgtcggccgtcgctgtcgcgctcgatcagcctcagcgctgaaccccagacgccgaccacggacacggccggagggggagggagagggagaggcgccgcgtgccgtgtgtgcgccgcaacgccagttttgtgcccagtagttgttgtgttttggtacgtagacgccgcgtcaaaccgcgtctcaactactccagtagtactccacgggggaggtggtgtgttttgcccagtgggttgtggtgttttggcagcaggcaacgcgccccaaaatcatagaaccaaacaaaaactcaaatattagggaaggacctattatcaaataattagaaggggtgaggctttgaacccaggccgtctagtccaccaccttatggagctagccagaaaacccctgagcatttctcccaaaatcatagaaccaacaactaatatatcgctgctaataagtttgtttggtttggacaaacaacatatgtagggggagattaattaatactgtatatcaaacccgccgctaattaggataaagacaaacacacttatgcactttttgttaacacagggatttctccccctcgtgatgggcttccccgaagggccgaaggaagccttagtaattcccctcgttttaatcgtggaggaggtaaattggactgaagcaagagttcgtgcaacatttagacttttttccatacaagtatattattgtccaaagaaatacaactcgaatacacataattctaatcaatttccaaacatttcaggctagggttgaaatcggatcgggtctgataggatcatggtatttccacatcctattctatattttcctttgaattcaaaactaggaacggcggataacatatcattcatttcatatcatatccaatacttttccccataattgaatttggaaacagatatctattaatttctctaatttatagatactaaatccgggaaatcagttaaagtgttaaaaagatgggagtagctatacttatttttcaaaaaaaaagtaaaatattttttacgatgtaaattacctacacttacattgtaagaatgttgtaaacttcaaaacttacaatgtaattgtctatggactatgcccgactacgctatttttagagtatggagatcttgaatatcaaaatatacgtgagattgtatcaagaagacaagggacaaggttttatactggttcgagttcttaagatgagtaacaaccttactttagtttatatgtattgctggggagatgtgccacatggattacaaggaaggggaaagagatgactaatctaatccgctgactagaacccgccaagaacggtccagctagatctaatcgacgactagggtttcaacttcatccggattgtatcttgatgtggcttaggctatggctgtaattcgatgcaccccccctccatggaggaccatgtattaataacaatgagtaccttcttctccaagtaaaaccctgagactttgggctaacacgagccgaagaaaccttgtctttccttagtaggactctgacaccttctatctcagatagacaatttcctttcagactcgtataaactccgcatctaaggatatcttcccgtatactattaggtacgtgatatttttgtatatcacaaatccgtatatatgatgtatgtatataggaggtatgtcttatctataaccctgacagtaattacattgtaagttttgatatttacattatatttcttctaatccacatatataaagagaattaggattaaaagaaatttatcatctacttaaaagaggagatagaagatacatacgagagatggagtgatcacatatggaaaaaagttattcaaataaagtgaaaaaaatatgacggcataaaattagcaatcctgtaaaaaaatacatcaataaaagaaataagcaatattacttattagcacataagttggacagaggcaacgatttgtagagcagctagacatttttctgcaggagtataatgacatctacaatgtaggagtaaataactactaccaagtcatagatttactaacaggctgtaagcactttatagtaggttctatctatttttaaacatgtttggagattcttttaggtgagttctaccttattacccactatagacatgtgtacatttttttctatctagttttgcaacaagtattaagctaagttttaccatcgaaagatacacaactgaaatatacatgacaataaaaacataaacataacgtaaggatataggaaaatgtgggacaaagtaacgcatggccttctttaaatctgaaaaatggtcggtttaataattaaataaatacatttggaccatacagacacgatctgatagatgaggtacaactacaacatctagctttgcctacagggctactacaacaatcacattgtgacataatgaaataaagtactttccatgaacagttgctgataacagtcacgtgacaaaaaaaaatgctactctattaccaatgatctcagtagcagtactttgtgtgcaaggtgacaaaatgatgatatgggggatggcacaaggaaaaagggaattagatcctagttcatactacccatgtcctcttaaaattatgtaattgcagaagtagccctgctaaaaatacaacttcaaatttgtgctggttagaccaaatctaaaatctttgacacctcttaaatctacactctgagcatgaactaataggaaagcaatgcgctaatatgaggacgaaggcacaaatttggtgaaaattttagtaacccctactcaaatgaccgtaaaattttaaagtctagatcgtttttgtttggaaggaaaatcgataaacaaggaacagttgaagtcatcttctttagccttagtcactttattatcttcccaataagattgagtttaatctcaatttttttatacgtctgtaaaatagcacctcccatatttaccatatttttagtaaatttttataacttctactttgggaaaggctttccacaacttcagtaatttgatggtttcacttgatacttccccttatttgaggttagcatgattagttttttttcttttacactcgataatttggtggttttttaaagttatatgccagatttaattcatgtttgacattgctaaccgcattttcccagttctgcttatataggtcataattcactatgttagccatgtcaaccccattacacatgcacttctcatcccaaaccaaaagcaatctatgataggttgaaaaaaatactttcaagctactgatatagagtgttaactaggataatcctataatcaccacttaaaaccctaatctacttggtgtttctctctctctctctctttttggttttttttagtttttatttgaattgtatataaccatacttgttgggattgatctacttaccctgaagtacaaaaactagtaaacccaaaagaatgaaaacatgttcaaataagccctaaagactagagcagttataagtagttttggccatgtgaactatgacaaggacattaacatatgggaatggattcagataaatatcttttacataagttatatggatttttaaaagcacataaatgttagtaacatgtaattcatgggctcactaggtagagaaggatgaaagttggtttgagtaaaatatcctaatgtgtcggccacttaagaaacaccacacgacacgtcattgtcgatgtggacaaaaatacctgcaaaaccactccatgagactatttggaccggttttcatactttatggtagaatactcaatttttatatgggttaagtagattaaccacttcggagggttatatagaccttttcgtttatatttattgttagaggttcgaagagtaaaagggagtaaaaggaggaaagatcttttccattgtttattggcagaggatccataggtaaaaaggaggataccatgactaataagtcaataactgaatatatactgtctgccacttgtttcaacctggacatccttgcattccctaagctttttcaagggcatggctgcatttgcaccgtagagttaggtggtgtttggttggagggactaaactgggctaaactttagtccttctcacaaaaacataagtccctatgctcacaaaagcataagtccctatgggagaagagacttatgcaatagggacttatgcttttgtgagaaggactaaagtttagtctctagttcccaaacacccccttaatattctttgggcaacaaaacaacagaatatatcaaactcatgatatcatgttactgcatcatcatttgactttaactaaccaaaattgagaagaagaaaaaaataatgaggggctgacttatggggaccacactctgaatcaaggccatgtgactatgacattgagatccctctcaatggattgatccctcaaacatacatgcatggtgcccagcccagatctaaagcattaatcatccatccatttcctcttgttcctttacccctagaaaaaaaataacttgaataaaaagaaaatattattatttctatttatattaagaaacaagtagtattatatctctcttcaaaaaagaattttatttctttaatgaattgagcagttgggaaactgcaggagggctagctagctgagatgaaaaaaaaaaaaaactctggccaccggtccagtgtcccctatcagggagttcatgaaatttttgaatgttgcataatttgtggtccaaaaggctttatagccttttttgtggggtcttagaattatgccggtatgatccataccataatattcactttctgtttctgcctttttctctcccttcttttttaacttcaaggtagtaggagtagcctgttgtctttggtatgtgatagcataatgttcttttttttttaaaaaaaagaaaagttcagaaactgtaacaaaaatagaaaccatgcatttcaaactggtcacagagttctaaaaaaattggcaatagagcataactttgtcattatcggcggtttgtttgactagtagtcgtttattttgcggtataagtttactgtttcatcagaagaactacaggctatatgagttcggcagggcaagtttctaacttctactatatcacgcgcacacttcctaaactatcaaacaatacgtttttttatataaaaattataaaaaatacttttaaaaaaaatcatattaattcattttcatggttttagctaatacaatacttaattgatcatgtactaataagtcgttccgctttacatgcgcacgagagaatttccaacccttaccagtaaacacaggctaagtgtgcattcggcagtgaattccaagcttatactccctattttccatgcgcatattttgcaaagaaaaaagtccaaatacctcccaagttcatctagcaccttaaactttagaatcagacatccaatcccctaaactttgaaatactatccatattatattacctcataatatagttttggatgatggttttgcaacaactttgaataattaatataacatatttggatatcatcggttgtaagtcatcaatttatacttttacagtgatacctagttcgtatttgtttgcaagtgagagctaacaaggggtaaaaaattaagtgaagattttaaatatttatgtcaaatttgtatgtcacgtgatcatattcatccaagttatatataaattagataaaaaccattgtgtaaaaaccattttagagggttttataaatgatattataagtttagggggttgaatgtcatgttttgaaatttataaagggtgccagacatatttacattcaaagttaagagggagtttggacttttttctttcccgaattactaaacaatatgtttttttaattttttttatagaaaagatactttaaaaaactatattaattcatttttaagggtttttaagcttcatatttattaatcatgcactgattcgttgctttttttttcttgggaaaggttcccaacttgcatattagattgaagcctaaggcctagtttagatctaaagtttttctttgaacttccaacttttctatcacatcaaaacttttctacacacataaacttcaaacttttccatcacatcgttataatttcaatcaaatttctaattttagcgtgaactaaacacacccaaagctagttctccattgcatctcaatccatgcattcaatctcatgcatatcagcaacaattattatgctatactcccttcgtccctaaataaaagagattttagttgaatgtgatgtattctatatccagatttattttactatgatgtgtcacgtctagctaaaatcacatatatttaaggatggatggagtagtatactaggaaggtgcactaaaaaaatattattaaaggagacatttacgtctcttttttccagcttctagtgtgctgaattggcgttttgggctacgcagttggtgaaccgtttgtcttttaagccacaagtttacaatgacagtcaaggctccaatagtaaaatcagacaaaaaaaacttgtagctgtagaatagctgtagaatgacagatggttttgaacaaaaattttcctcatgcatttcgttttggacgtgacaaactgaagtcgatttttggtaaagtcacgggagtggaaattcgcgtgacaccttttatagtagttgatcaattatttttgaaaaaaaaaaactaaacgcacgcactcgtataaacatgtgcatatatattctaattagcgcacatgcacacacaccttatatgattatctttgaaaactgaattaacgaaatcaccataaatgtctcgttgtcaaagctacatcttatctggaaagagtttcttgcactttcacttgactcccacgcttgagaaattgcgaatgaaacaatccaaaggtaattaatgaatccaaattaatcgctctgaccagttgcaaatacagtcataaaatagaatagaggcagcaaatgcgaacgaatcctttccattcgaaactcaaaaaactgttcaaatccagccccaaaattgattgaagtttgcgaacggtggaagaagagagcaaaaacaacggaggggggaatcaagacggagtggagccaaaaaaaaaaaagttcttcccctttgctttgctcgtgctctgctcacatttgtttctctctcctcctcggttgcaagctgcttctgccttctgctgggctgctgctgctgtcccaatctcttttctctctctagattccaaatactttccccctattcctgggcaaccccatcatgagatgagagaggaggaggaggagggtggtctactctagcctggctctagagagagaagaggtccatcctagttgttgtactagtagcaatagcacaactctagagagagaggcaacaaggggagaagaagaagaagaagccaagaagaggcaaggaggaggaggaagcaaggagcaagaaaggtaggaaggattggggaggcatttcttggattcttggcttgcggggggtagcattgcgcctcaattctttgcttgcgctgctgttgcagatcagcggggaggtggggggaggaggaggaggcgtttcttggattgattcgccggaggaggagggatggccggtgtggacgcggcgaggtacgcgcacagcgaggcgcaccacgcggtggcgacgagggaccacgcggcgctgcggcgggtgctggacgcgctgccgagggcgcggaggccggaggagatccggacggaggccgactccgtggcggaggaggcgcgcgcggaggcggcgtcggcggtcatcgaccggcgcgacgtccccgggcgggagacgccgctccacctcgccgtccgcctgggcgacgcggcggcggcggagatgctgatggcggcgggcgcggactggagcctgcaaaacgagcaagggtggagcgcgctccaggaggccatctgcgcccgcgaggaggcgctcgcccgcgtcatcgtccgccactaccagccgctcgcctgggccaagtggtgccgccgcctcccccgcgtcgtcgccgccatgcgccgcatgcgcgacttctacatggagatcaccttccacttcgagagctccgtcatccccttcatctcccgcatcgccccctccgacacctaccgggtctggaagcgcggcgccaacctccgcgccgacatgaccctcgccggcttcgacggcttcaagatccagcgctccgaccagaccatactcttcctcggcgagggctccgacgacggcaaggtgcccccgggctccctctgcatgatcaaccacaaggacaaggaggtgatgaacgccctggaaggctctggcgcgcccgcctccgaggccgaggtgcagcaggaggtcaccgccatgtcgcagaccaacatcttccgccccggaatagacgtcacgcaggccgtgctgctcccgcagctcacatggcggcgccaggagaggaccgagtcggttgggccatggaaggccaaggtgtatgacatgcaccatgtgatggtcagtgtcaaatcaaggagggtccccggcgcgatgacggacgaggaattcttctcggcttgcaacgagaacgataccgagagcgagggcttcgacgatgttttgactgaagaggagaagaagcagttggaagccgcgcttaagatggactctcctgatggtgctggtggtgaaggccagtccgacacgtttgttggtcctcgacatagctgtgttgagccgagggagagagagataccaattgaggatttgagcatctccggaaatggggatagtaaacatgataagaaaggttggtttggtcattggggaaagagggttcagagtagcaagctagaggggacgaagaagatggcacctccaaggagttcgctctgtgtagatgagaaggtgagcgatatccttattgaatctccatcgaatgtacaaactaggccaggaaggcattcggtagatgtagtaagaggggatgagagcagaaggggcaaggaaagggattatcggagacctgctgcttcgtcggagtgtggacataggcgcaaagaaggtagcaaagaaagcgagtacaagaaaggtctaaggcctgttctctggctttctcctaacttccctcttcggactgaggagctcttgccactgcttgatattcttgcgaacaaggtgaaggcgatccgtcgcttgagagatctccttacaacaaaactgccaccaggaacttttccagtcaaggtattagcttaacttataattgcacgtatatgtttgttatgcatttactgtgccgcaattctttctgccccaactagtgtcaagtttattcttgcttgtcagagctacagtattttgttagtgttcggctacaacgtgcaagttttactatgttcatttctggttatttgtacaattttgaactccttgcgctgttgagcgtgcatgttactgaactattagagcaccatctactagtaatcaatgagtccatataaatgtgtacttgtgtgcctttatcattgttagttatagagcttttttagattctcgttctttttaataatgtataatttgaggtccttgtttgcactttgcacttggtggtacgtcaagacatggataataagttgataaacaaataataattatttggtattgaatagatgctatttctacatcatatatgacatatagctactcaactagtaaataaatgaactccaagaaaaggcgctatgtatttattacaagaggagccttatgcttgaatatcttgagtggccctgtaatattaaatcctcgagagttcttattccttttccacttgtctcctgtttcattcattataaaaggacgatatagaccttatgcattttggattagcatgagcctgataaccatctaaaaataacttttatagtagatttgtaatagagtttctccctctggtcataaatattcgtgttggacatacctttggtaaagctttttaaacattgtatcaatgtcttttaaaatgtttacattggatgcaagaaaatcatatatgtgtagattcatcttagagtacttacataatatctaaaatgttttgtttcatgagtacataacataacaatagaaaataatggtccaattgtattttaaagaccatgtaattgtccaaaattatatgtatttctgaacaaagggattatttgttaggtagcaactagcaaggtagatttgcccccgatatcagaatttatatggtatatatgttgtatctttgatatactttcatttacagtattaactatgatgcgccatttctccttttcctctgggagatctagtccttgttctgcacttataagactggaagttgtctcaaactctgattgcctcttgaatttaatggacagatgcaaaatcttataaaaccaaacatgtcatattgaatgtacatatgaatacctgaaacaaaattcaataatattggttatcctgtatttttcttggattggcactttaagtctggtagctgtaactattctcagttgagttgctatggtgacatccgatacattacaaaatcaagatatttctcccttttgatcccatttccatactgttttaaaagtagttgtgggtgatggtgtagtctacacccattccccactcataaagatattttgtaattagttacacctagacatgtttgtggtttcgtatcatgtttgtaattagctgcattctttgcacatgtgtgtatcagtgtaggtactaaggtaggttgctgattgtatacatttttaggtttgaggataattatatttagcattttgaactgtcatatttggtgtctattgactattgcaatgcctggcaacatgtgagttcgtttgtaaggttgatgtgctaactagtaagtattatatattttgctcagaatttgtatctgcattgcttatttgaccaatgttgcagtgcctggcatgatgctagttactactagtttgtaaggttgacatgctaacttgtaactattatatattttgatctgaatttgtatctacattgcttatttgatcaaatgtcttctccaagataaattgagattaacaccatatttgcatgctgtagattcatagctcatacgatatattgtagcttcatttcctagcaaaagagtgctagatatcaacttcatcgatgcattgtattgaaagcagcacatccatcaaagaatataatagactttccgatatgccgccccgcaagcaaggagtgccgcgcacgagcggagcgaaaactaagcaaggggaattccgtcattccatggaaagcatgcgaaatcctttgattgtttatagagctcagttattttagacgtgatactctatttaatgaagaggtctagagtatatggagctaattattcaaatttagttactgagatatacttttgtgatgtctataattcaagtggtttgtttatgggatttggcttagatatttttatgcactagctttgacctgtaatggcgtctgtttctctggattcagatagcaaatgtatgacatagctgtgcgcttataaatgacatatgatacttttgcatttgctctgtcaatagtggtgtgtttccatgtcattgctatcttggtatcttcaaaatggcatatccggcagagggcattaacagaattatggcaatccgtccatttgattttgttggaagtccatttgattttgttggaaggaaccagggcgtcaattatgtagggaggtcaataggtgttgtgggaatgggctgaggtgtaagaaacggataactggaactggagagaatatattcaaaacttactattaaaagaaagataccagtgctatctatgttctatttacagaatacaatacggtatattatctgatattgttgctaccgacacttatacagtgatactttcagctcagatgataacagtcagtaggtaaacagttttgaaaagagcagtgtgtgtgcagagttgttaaagcattgataatactatcctatttgccatatatgccttctggtattgcttgaacagaaatttttacattatagctgttagtctgttgaaataattttgctggattctgtaacatgatgaattggtgatgtattaacactttattactctcaggttgccatcccagttgtacccacaatcagggtacttgtgacattcacaaagtttgaagagctacagccattagaggagttcaccacaccgccatccagccctgacaatagcaagagcccagtggcgcagtcttcctcaagttcttggattcaatggatcaaggctccttaccatcagaacttctcaacagctccaggccccagcagccgtgtagaggacatccaggacccatttgtcatccctgctgattatgtgtggacgacaccagaagagaagaaaaagaagacacaagaaaacaagagtaagtcgaagaaaggccgaaatgcggcggcatagatagatagcgctggtggtggtttgagacaatgtcgtggatgacactgaaatcattgaaagggcaatacttggtgtgatgataccttctgatctaacaggaaggatgagtgggagatttgaagatttcgacgagctgcaggtgactgatgtcgaatgtcaagaaacaaccgcttgtctagtttcgatgtgatgaaaagatttgttcgcaacattctttcgtttaacccaaatcatttcaatcccatttattattgcatcgacctgcaggtagttttttttgaccgaggtgtctgttgataatgctggtgtcgcggtgttctaaagttattgcctgtttttttgcatcttcaccgtgccaacatccaaatgcatagtactatatttctgtatgttggggtggcacaaattttgtgacatgaaggtgcacacttaacttaagtagatcattgtatggtagattaattttctgtctttgctgggtgcagggatcaatattcatggttgaatttgtctttagtgtcttatctggtctgctattctgaacttcgtattggttaagcttgggcatatcaggcaaattttaaaatttatatttctgatgattgcttattactacggtttaattgttcgtctcagtttcaattatttgtataatcaatccttaagcagtcaagaacatgtactacataacattgctgcacaaatttgtgtggtttggtcctggtgctaggcaggttcaccaaactgtttcggatcaggttatcgcaaccccacggtaaggtggttatcatagtaaccatgtgattaccgtgaaaaccgtatggttaccgtgaagtttactatggtttccgtgaagtttagggcccctttgatttgtaggaaaaatgtaggaattttggaggatttcaatcctacgaaaaaaaaatcctatgaaggcctttgaaagaaatgattgaatcctattaaatcctttaaaattcctatggaatggtaatcctatgcatattttggaggaaagttagcaagaggtctaacctcttggaacatttcttccgagtctatctctctcatctgatttctgtatttttcctgtggtctaatcaaatggtcattcctgtattttcctgtgttttgcaatcctctgttttactgttttttcattcctacgattcaaaggggcctttattgtggctttaaaaaccgagaatttcaaaccttggtgctaggtggggtgcctaccacatttgcaacaaaaaaaaaagatgctggatattattttgttcctcatggatattcttttgctcgtcaggagaacactgatgtacttgcccacgttcttatcaatgtacagtactaggtttcgtttcctcctaataattgcatcattagtactatattttgcaatgtactagtacgttacagtagttgagttttcttttgttgcagccgccagagagatgtgtcatgtatgatggagttgtgcgacctctacaggtaacgaacgaaatgaaatgataatgggaacagtgcgggtgtttcagctcatttcagttatggtaggttggtagctcagctaatccataatcaagaagtgtattggttataaacacggaataattaactatttgcttaaaattggtgctaaattatttgtcactaaacccatatgtcatatacacatgagggcccacatgtcagacatatgagggcccatatgtcatagataagcacatcttaaaagtgacatggagttaaatgtccctttaaacactccacaaaacacatatgtagaccgagcagagtactgcaaaagcgtctgtaaagcgagtcgtcgtcatcctctctcctaacgcacagcacactttttgcaaggaaaaaaaagtactgaagaaaaacaaaaagaaaatattctttttgaaaactgaaaacgtttagttcaagaaaaagaatttctctactacttagaagcaagtcgtcatcgagcaagaaaaaatattactgtaggaaaaaataaaaatggttagttcaagaaaaggatttgttggagaaaaacagaaaaaagaggatagttaaaaaagaatcatctgcttttaggataatcataaatgaaattgctatatatcattcgaatgaaatttggggatgaaaccttacagattttggaccattggatctatactaagattcgtgcatcggcttcttctcctccaactccggcgggctccccatcttctctggcgccggcgacacccaaactccgacagggaccatacaggttagggtttggttggggggagggggggtgtcagggtagaagggggttggggagggggaagagagaggtttactcgagacttagagagatggccgtgagcggcggaggaccagcggtgggcggtggacttgggcaggtgatgcgcatttgatgattaaaattcatttttttgtgtgatatgagcttttaaagagaacctattaatgtaggtcgctcaaatagtctaaacatttcaaaagtttgataaaatattatcctaacataaaacatttgattggaggaaaaaaatcaaatagcacgtcaattgcttgctaggtaaaagaagaatcataaattttcgagcacaagggaattaagcagcattagattttaagagcgcaattgtcggtaatagagatagagaagagaagtagagaaaagttttttgaggttttttttataaaagtttcttggaaactagaaaaaacatgttaaatataatggataaagtttccatataatttgactagttcacatggattcactcagagcaaaccaacaaagttaacatgtgggtcacatactcacatatgggccttgttgtggctgtaactttcgcatgcaagtaacggattacaaccctcttaccaggaagagagagctaaggaataattttttttacgggaaagaaaccaatgttctttttttcaactctggcagtttttttttttttttttacccatgggcctgcagggcttgaaggtttggtagccgaaaccatctgagagctaattaaattccaaaaattcaaagcaaaccaattttagtaccgttgtgccttctatataaagctgcttggcaaaaaataaaaaatcataggccggctacatatacagacacacgcgaagccgagtcgcagatggacttggcaatgtcccaaattgaataagcggaagtcttgcgtatattttaactagatatagactatagatatagatatctattcgtagtttgtactactagttttgtttttgttatattttggaatggagggagcagttcgcaagaaaaggctaaagtttcttgctggcctttgtatttattttgctgggaacaatgtgaacactttgaagtgatagactgcttgcaggagttatctgtaaaaggccagaaataaataaatctataggaggtaaatatatttgataataagcatatttgaattttggggattctttgtaaattcagaaaatacaaatgtgtttttattatttcaagcaatcaaaagaaactgtataaattaaatagaaactgttaactttacaattatttggatccagaaactactacataacatcctatcctatcttagtgtaagttataactcactagatcctaaagcttaacatacaacgatgctatattatcatccactaacaattattacatcttaagcatcacataagtatgttatattatctattattctattctataattattaatttttattttagtgctttaaaatgcaagcatgttaaatcatcatcccacataattcacatgtttcaacatatctctcaatcattttttattatcctaggtatatagttcatcctcacttacttaatgttatttcactcttctctcattaagccatatcacatcaattggttttagttattagatgattaacccattaatctatggttcaaattatctccctcctttctctcattaagccatatcatctcaattatttttagctcttaaataattaatcaatgattcaaattatctcttcttttcttctctcataaaaccacgtcacctttacttttacatttgaatatcattccatatactctctaaattatcataaatcatatcaacttatgtaaatttatgttgtctaactattttactaaaatccctcgataacgcgcaaggtttcacctagttatatcaaagccaaacctagttatatccgaggctgttagctgatatgttcatggctgcttactatacttctagcaaagctaaatattgtattaatgaatttttctaactagtgattggcattcacagagcttaccatgtttcagtgtcgttaaactctgcccaagaccttacgaaaacagtctttccgacggcatagaacagatttacccatgtaaatatgtaatttgccactcaacgaaatgctcgaaatttcacaacctaccttttcttttaaactaaaaggaagaacaatcgggaaagaaggccaaaaacatcggtctcagagcaatcaactggaaatatgaagggcacacctggagaagaaaaaaaaacaagctattgatggtttgcctacgaggcaaacatcttaggatttttagaccaggatacctgggttcatgcagcaacagaatcttaaaagcacaggtaattagtaactgcttcctctgtttcacaatgtaagactttctagcattacccacattcatatagatgctaatgaatctagacattattatatacatagattcattagcatctatatgaatgttagcaatgctagaaagtcttatattataaaacagagggagtagcattgctgatgaaatctctacaatgaccacctcaacaggttgcacttgtagataccagggtgacattgacaccagtagcccgacagttgaatatatgaatagctagcaaaaccatcagtacggcatatatatgtcctggacagaatgcctctccaggactagcctctgtaagagctccaaatctatgagctaccctaccattcaagacatggccaaccagcatttacagacagaagtgggacacattttgaagtcatgtaatgtacagatatatgtacatatggagttctcgtagcaattgaagggaaaaaaaaagaaaaacagaggtcaagtatgaaactcggtgcttgctgcgcaaaacaagcttcctacaaaagcaagcatcaagcttcaagggtgagagggaatcagccacggggcactgcagctaccatgcaaaaatatacaacggacggttgatgcctagtggatgacaatgagctgtgactttgccttcctcatgggaaggcttgaaacatcatcccatatgcaagcttctgttattcgcctgaaataagaaataacaggttcattcatatttgaaaaaggaaaggaattattacgggcaatgatgagttaaaaaaaaggagtgtaactattatttacaggaaatgaaagcaatgcactagtttgacaaaaatgcataatgatgttgttggaaaaatgtaaagctaacataaaaaaaaatactagcaaagtagaaacagctgattgaatttgaacatgtaaaatacaataaccacctcagatatgctgtagaccaaaatgctttggtaaaaacaaataggatgctgatctgcaaaacaatatggtacagcatggcagtaatttaaaacgcacgcagaaaaagtcatgtcataacaaatcactactatttagacaaagagagagtgtcgtctaccgtcccaacagcaaatccaaaccactattacacagtaggtgactagttgacaagtcgaccatagagcacaactagagggacacgactcaacttgggactgcttgagagcaaactgggtcttgtttgggaggccaagttcataggaaaggggaaaaagaggagagttattttcctcttccatatatagccagccaccagagctagagccagattagaggaagcagcaagaatttcacacctcctttgctcatgtgttccctcttttccctgatctcctttataaaacactaatcaactcatcgactagtaatgactggtccacaggttggtagaaggatgcatcaacttgactttagtagtttacaacttaacaacaatgatcaacacgcagaattgtttttatttcttaaaccttttacatataataatttaatattagaccctattaaaattttatttccaaatctgaatcttttggccatgccaagaatactggcgttgccaaataaccctggcatgatggaacgtgacacactgaaagactgtgctacgtcatagccttgccatgccaacatccttggcgtgacaaccttgctctgaattgccgtgccctgcggcatgacggagatttgcatgcatgctgatcatgccctggtttggatgcgagcaggctttgcatgcctattggaggtaatggccccctagcgtgccatacatgtatgacactttaattaattagcttgagttgccagctagctaacaaataatgttgattgatcgtttaaaagtatttttgaagtgatgtcattatattacaggagggggtcacaacatattgcactctgaattatttcaaagtcgcaagccactcagtgaagggccctttgatttgtaggataggaaaaatacatgaatagaaaaaacacaaaaattaaaatagtatgtttcttaaatcctacatcaataaaaaaacacaggaaaaaataataagagtcctttgaaagtgccataggaaaaacaaagcatgcagtatgagtccggtccctacatgctctgctatatcagtggttactcataactatttgtttattttgtttgaaattatagatgtaatttagccatacatgcatttgtgtaaaagtgatatatatgatgtactctctccgtcccataaaaaacatcccgtactagatttaatttttatgggatggagtaacttttatgacaattatcttcatatattactgtacatgaatatctagaaaatatgcaaagagtggtgatcaatggtatgcacctactagctaacacaggcaaagcatgcagctacctacgacatggtctgacacgcatgcaagcactagcagccatttatgccacaccaaggagcacggcattgcagcgcttccttgccgcgccagggacgttggcatggcaaggctatgacatggcatggtctgacacgcatgcatgaggggatgagagtggatggtttgatcttcaacttcaaggttgatcatgctgtttgatttcacagatgggatannnnnnnnnnnnnnnntgggatacatattccaggaatattctatattgattctgtacaattccatgtgagaaaaaaaatgttgaaccatgctgtgggtcatgcgtgtcaaacagtatcctacttgtcatcttacaaaccaaacatcgtatggtaccatcctgaaccatccgacacaaccaagcaaagaaaatttgtaccatactgtgtaaccaaccaaacatctactccctccgtcccaaaatagctagctaccttggttaaggaagtaggtggaattaaatggggatggttgtgattggttgggatgagtaagtaggtggagaaattaaatgagatggttgtgattggttgagatgactggtaggtgtaagtagctacattttgggcgcgacttcagttgacaaaagtgaacaagatagcgctaacacctgatgagaacttttgttttaacagaacttgaatgctaaaggtagctatattttgagatggagggacaacttgtatcacagtccattctagaccatttcatccatcatgcattttcctatcccatccaccctcctccctcaaccaaacacaccatcaaaatacatgagagtattttcaataaactccatccaagtgatgccaagataggcttctataggcatgctaagtacaatcacatatgaagataatggtggaccagacattcacatttacaatcagtgccatgagcccataaaacataggacaagcagatacatgtgtgcatccttctcatggtgtgccatgaaacaagcttccaaatagttatggccgcaaaactatggttttactgcctatacatggagatcaaacacattttgttctatttttaggtagttttgggagatggcacaaggccatgtttatttctaaatcatggcattgcctaatcttaataatatttgtttcttttattaggtcactgaacccaatttactgtgaacatatgtgtcccatagtagcatcatggataacattaccatcaaacccacaaaacaaatccacatattggccagagaggatgacttgagggcacaagaagttgttggcagtagaagacacaatgaagcaaggcagcaacgatgagttgcttaggaggcttggtctgtcaggcccattattactgaatgaagggagataagaaaagagttccattaggtccatcagcacagcatgtagtgcaagacgagtggtagaagcaaccagtaaatgtagtaaaagtcagatatactaccaaagactagtgtcaactctcaagtcggtagaggggcaacttgactcaactttactacttaacaaccataaagctcgttggggaattatatgggcacgtattaccatatatgggctagattgacctccagattccagaaacgatgcaaaaaaatgtaacaatatataattgatattctaacataagccaggctgaagaacaatatccccagaaatcatcatgataattggtataagatatttaatttcaaactaaattttgaaaccactagttttttttttttgaacagcacatatcagcagctgaccaccaatagtacgataaaatccaaatatttctgactgaaagaaatgaagactagtaaatcaaagataacatttatggtacatatgtatggagattgttgcctatttatagagggcaaggaacgcatgcacccaggagcactacttcacaaggctgcactttaaccaattcattacttcattcaatcttttcaagtaccacaaccaatttatgaatcatgatcccagcattgaaaaatgcaatgaagttgaataagcaagagataaacaaaatactaattaagtaggaagtaatacaggtcaatcaaaaggaggtacagaaaatgcaaattgaagcaattcacacacaagtaatgtagacttgttataaaggcatattataagtactgagttcgaaacataatcctagaaatctcaaaataaaaagatcatggaaggactgggagagttaccatcagagaaacttgttgtcagcaatcacctcaaaaatctccatgagaaggattatgaaagcatcaaaacaaaggaagataaactgagtattgccttctagtagacagcctgactacatggttaactttcccacccattcatcaatcattccatagtcaatgcttagctccctcaatggtggaatgttctccatggcaaagatcatgaggtgaggataagctgcgttgtaatggtcaaacagcacaaactggacaaacacatttggactgcaactatggctgaaataacaagccacattccttgcccttgacacatcaattgaaaatttcaagtcaggaacagctggattgtttggtgccacatactctggatagacatcagagacatcaccccaatctaaccaccttggagggaacctgcttggccgcaccaagcaatcaccattcgcagccataatctctgactgttgatgagtgagcactatcccactaaactcacagatgaaggttccagccttaatgagatccaaagaccgaacaccccacccagtctcccttgaccggaatacctcaagccgattcctaagccccttctgactaaccctgttggggcaactaggtgggcaccggcaatatggcccacactcatataccagtggtttgccccgtaaaagagcaccgagcttgtcatatgcaaactcaccgccattcctctgtgcacagtaacatccaattgagcaattctcagtgcactcacacccgccaccaccctcagcaaacttcccttggactgcagaggacggaaatattggccgcgccagatactcaaataaaagtgggtcacgatcatcatcaacatcattgtacagtgcaaccggcatgatctctcgacccatggaaatatcaaagcccaaataccctgttggccggaaagtcagggcattgaccttaagctgttcggctagtcgaaaatttacagagcccatcgactcctgcccctcgatgcgcagcattttgtacttgtaaacaccgaagccagacttcccacggtcaagccagtagtcaacaaccttatagaggccatcatagaagtataccttgccgacggggctgcgcttggacttgacagcacggatcacgcggatctcaataccataggccatgctacgctcgagggcaaggttgccaccctcaagcttctgatcaacacaatgcttgtggaggttggggtcacgaccaccatgtcctgtgtacacaagtacatcgccgcgatcgtcatcgtcttcatacccaccggacacgatgatagatgtggctatgggctcccctgaggaagactgcccagccgtgacaaagtcgatcccagcctgcacctggccgtgtagccctagcacgcaaagctccatgcggaagaagaaggcgtccccaaccgagatccccgggatcggccccacgattcggcggtcgcggttgagccacaggtctcggtcccccatcagcgccgcggcacgcaggtcggcgcggacgcggcggcggtcgacggcgccgaacccggggacgcccgtgaggccgagcacctccgcgcgctcgtcgtccgcagcaggatcccgcggagagactcgaacgtgatgcgcgcccggcgcaccaggtcccggaagtagatctggtcctgcacgctcagcgaggacacccgcaccagctccgacgaccgcggccgccgcttcttcgcgccggaccccgacccgggctgcgccaccgcccccgcggaggcctccggcgccgccgccggcacgattacgccggccgcccccgccgacgacaggtatagcgtcgcgagccggtagtactccgccaggagcgtctcctcctcggggttcggcggcagcgactgcagcggcgtcatcaccgccgccgccgagaggtcgggcgtcgccggcaccggagttgccaccgtcgccccttgcacctcgagtgncggtggtgggggcgccggcggaggtgaagacgccggtnccgctgccgccagcggcagaggccctcgctccggtgaagccggctccgacttgggctccctcttgaggaacggcaggaagttgaggtcgatggagtccgacgacgccgccggcgacgacggcgccgaagacgatggcgatgtgtccatctccattgcccccttcccccctctctcacacacaaaaacaaaatacaaaaaaaaaaaaaacaaaaccacccactcctccgcccccttctcccgcaccaaactccctcctccccgcaaaatcccaccggtttacgaggcggcggcggcgacggcggcgaggtggggggcgatggcgaatcggttgaatcggcgatgaggcggaggcgagggagggaggaagcgaagggaaggggtgggaagtgcgaaatctccgaaatggagcgccctttttcccgggcttcaccgaaaagtaaaaaaataagtgaaaaaatcgaatccatagaggattaaactttaaggcccgtgcacccatcacctcgtgctctcgacagtcactgacaaacaggtccagacgacaacccggtgggtttctcgagaaaaagagtgaagtaaatgctcaactgcacctccctgagaggtgcagggttaattatggaatatcgcttcgattagacggcgatatatctttataatatttatttatatgttattattttgagacagggacgtgtggattttaaacgattaatttatttgaattgacgtgacattgatttttattagttaaatatagagttattacaaaatcaacttattaataaatatttgtagactatgaaaaaacggagaatgacggtcatattatttttcttataattcgtttccctaacttttgtgaaatattcttaatgcaaatggtccatatgcatgtagaaaaaaataaacggttaatctactttttttcatgtagcgtggtatcgtcgattacatctaatgctttattccataggattatttggtttatcttattttagtagcacacgaatcgccactgacacatgattaattaagttttacgaagtagcttttataaaatattagaaaatagatttattttatttttaaagaaacttatatataacttttttaaaatactgtttagtaatttaaaatgcatgttcacgataaatgataaaatagccgagcaaataatctgtgtagaacttagccagaaccgtaaatataccatttcgttgatagaattagctgagatctgctactcaacacgacatggtgattcttagggggaaaatttggccttagaaagtttcaaagcaacaagagaacaaacaaaacgcatttagggggggtgtttagatggggctaaaaatttttaaatccatgtcacatcgaatgtttggacgctaatttggagtattaaatatagactaataaaaaaactaatttcataaataagagctaatatgcagacgaattttttaagcctaattaatccataattataaaaagtttactgtaacatcacattgtcgaatcatggcgtaattagactcaaaagattcgtctcgcgaattagtcaaggatatggaatgggttttgtaattagtgtatgtttaatacttcaaattagtgtccgaacatccgatgtgacaggtacttggaataagtccctgtttcccaaaaggtcttttgctaggtgtgcacatcctcctgtttgttggctattagagcaacccgagtctttgtgtccttctgaggctgtgtccgttggtggggttgggatccatctgctatgcacggaaaaccaagcggtctattagcacgtgattaattaagtattaattttttttcaaaaagggtcaatatgatttttttaagcaactttcgtatagaaattttttgcaaaaaacgcacaatttagcagtttgaaaaacgtacgcatggaaaacgagagtagggagttgggaactgctgcaaacgaacacaaccttaaattgtttgtcacataagggatgaaaactttcggtcccatcgtttggcttattcgtggaataagcctaacaacatatttataaacaaaaagtaatttgtgaataaaacttttatacacgtgtttttagcgatctaaaatcaaaggctaaaaaataaacttcgataaaaaaaaacctcaaaatcagcttcaaatttattcgttgaaaatttaaattttggctgataagcataagcataattgaaaagatgaggccctttgaggcatcaaattacaagttgtggccacacaagggatgtacttcctattgagctgttttttagctataacatggcaacaagctctaatggtttggtcatttgttactttccattctaaaatataatgatttttagatgcatatcttgttttaaaatataaggattttcatcacttcacactactacttatcacatcaatcactttccattcaaacttctttccataccaccctcccaccctaactctttcttgtttttttaagggacaccaaagtctttttccctcttccttaatccctatttaaaaaagctagaaacataatattttataacagagggtgtggttgtaaccaggatgtaggtattgtaacctaagggcatcctctatgtgtatatatcgataagcaataatgatgaggtcctgtgcaggaagcactaattatgacaaacttcacaatggttaggaattaaggaaatattgcttcatttgaaatctttcaccccaagaatgaactacctccctctcctttgtgtaatagttttattcttcttttgtcttaatgtccaagccataagcttatggtgaactttagcatcaaatggcttattgccaactttcacaatatataaggctattagctacctttatgtctcttactatgttcacattgtgaatgtcctaagtcgttagatccacattattacataggctctatattgacttttcctggttaaaattgctctattatctctgtttaccttaattgtcttccttattgctagtcatccccttggcggccccatcgccctaccaccattaccactcctcttctgtattagcttgtaaagaacgccactaaaagctcaatgttgagacttaggggaaataggagctccagttcatcaaatcgacttaggctgagtttaaaagagaagttagccattagtatataattaattgaaacaataattatagttattattaaaaacttgagtttattttttaaaaaagaaacttatatattttacttgcaaaaacacgtcgtttgggaagcatgctcacagtaaatgatagagtagcaatatccaatctcatttcaaaattagccttattaggggaggggtgattatcagatctgcctcatagtaggttgttagcagccctagaagaaaagggagagaatagttaattgtcacctatatgtcaatgacataaggaccctcatgtgcctatgacacgtgggtccaatgataaatagttaatcgtcacatccaaaagtggtaaatagttaaatatcttgagagaattgggcaatcttcaatatatcatatattctttttactagagggagtacctatgtgagctagagaaaaagtggttagaagtaggtggcttattaaatgacactgatgataagagaaagttttatataagggttagttgtggcatctaattttgtctatgtaaaataagagatgatatgtacaatacatcacatttacactatctctagcatactaatcccaatgattttattttatttgtttgtctaatccactcttcttttatctatttttttcttgtagtttgtgtggtggttgcccttgcatgaggagtgttgctcatcttctcttttcttacttctgtcatccaccttatcatttaattctgtatggttacatggccatgagatgttgagattgttgagatgcacttagtggtacagtgacaaggggtgtggtttcaaccttgaggtcttgtgttaaatcctcaacttcttaaaatggagggacgtatttccgtccaaatttctcttttttttaaccattagatctagattgccgattaatgcctagcagcagaaccaaacaaagcaacatgtatcccaataaaagtgaccttgacatccaaatgactgttcgtggcaaactggtgagctacatgagtgttgatcccgatggtacaaccaagcaacgtaattcacgagagtagttgttctaggtttattcacatagtttccaacattatattttgaccattatttttataatatattcaacaactatagaactgaatgttctatttggttcatgaatatattataagaaataatggtaaaaaaattcaagggtaaggatggataggaaatggaaattcatatttgctagatgggggcaatccaacctttttctatggatgtagtgattagatttcttgtttggttggagggatacaatttgaatgtgataaaccaaaatttagtggaatccgcttgccatatattttttccatcaaaatataatcataggagatcttgttttaaacatttcattgcaataaatacaacattataattagataacaaattggataaatggtttaggagaaaaaatcatttaaaccttactaaccaaaattgaacacatcacaaccaatcagaatatgacacgtcgctaggaacaaaatatggatggctccatttggctagatccaccatccattaatatccttagtggtcccattcttgtgtgcccatcaaccaaacacataaaaaaaaatatagcagacatcttccatacaagctaagcatccagatacattttaaaaacacacaaaaatgcttatattttggaaaggaggaatagaaagaaagggtttataaaaataattaatgtggacactgcaattgggaggaaagataattaatgtaaaaaagaagtatggctctcttgggacaaagaatttatggaggaattttgtaggattgaagtctaataaaaatgtccttatttgatcttttgtaatgaaggattaaagtttttataatcctatcacattccgttggtatggtttaatgatggagatttaagagggaagttaatatgagatccaacctcatagaaactttcctttgactttttccttttatccatttgccctacagcttatccaaacggttatttcaatagctctttttgtgtttcataatcctttgtttgctttatatttgtatgcacaccaaatcacacatttttcctattcactagtcatgtgtttcttgataaaaataaatataatttctagacctgttattatttttctagttcatgaaaagttcgacaaaatatgaagatatcaaaaataaaaaaaagaatagcctaagcatataaaattgaagtaaaaagaacttgaattccacaaatcatatatgtgaaaaaagacaaatttgtaatgccattcctatctatccccttcatgatctcgttgtgaacttcaacaatttggttctacagatttaggacatgtttggggagcgtttggccctatattttccaaaatttaaagctctctagatagtccataatttcactcaaattctaaaaagatgtagttatagaatccagaaaatgaataagaatccagaagctgattttcccagcttctccatgttttcgcaagctagattcccactaactccttagaacgtaaagctccccaaacatattcttacttcgcatgcctatgaccatccattgtgccactgtactgatgttgcgaagagaacatcaacattaattgatgagcattgctcttagaatggtgggatgacggccatatggagttttttgtgaagctgcaagaaatgcagtagcagcgactgcattgaggttgagggtatttttagagataatactgttttgttggaaaattacaaatgcttggatttaattgtgaaaatagatgcttgtcaaactgacaaactttgatatggggtctatcgatttgttgctgtttttttaacaagaccaaagcatgggaaaccccttcagttagaaattttatttaaaatcgaaaaaaactacatagcttaaagcaacaaagttacaatatatctctttacaagattaagtctaaaagcaaataggtggtggatgtcctttttgaaaaaaaaaaggctccaagaatgaattgaaggcactatttgctgaaagattaactcaattctctgtttccaaatgttccaagctacataaaggactttttcaacaaatggcaactttggtaaacatttgcaacctgatgaagcattgtcctaaaccagaagtcagaagatgtgttccaattaatccgaagcctctctcaacattctatgctaaaaggacgttcaaagaacagatgcatacaggtctttcaggtgcacacttctttctatctagcatgtctatggtgtttaggcggtcaataagcaataagcaataaccaataaaaaaattaattttcatagtacatttactcttccaaatccatttcaaatattttggcggttttcttcccgtaaatttgttgttgttcgatagcaccctatcaaacagtgtacgcgcaactggtagagccaatcgaacggtggaggttcaattgggcccacacctagcagccgcaagccctatcgaactggctgttcaataggcccccgaacaatgggcattcgactggttgctttaaaaccctccccaccacttcaattggagtcattttttagagggatggagaaccaccgagcggcaccggaggggggggggtgttctaccaccatgatagagagagccgccgtcacggtcgcctggagaggaggtcggcgtggtcgggaggaggcgacgtctacgactgtgcaggcgagagcaatgacggtaagcgtgcaatacacataataaataagtgtgtactctatttgtaccacaagatagggcctgcgaatttgccaagtgcttcaacctattgaagctcacaccatcagttcactaacattgaactccacagagtgataactcaagtgaagtttgccctctttccctccgcaaggtcccttttatagtcagttggtgggtaggttgtacaatagcgcacctcgccatgcatacctttgcaagcgggagatgacaacaaactttcgacacatcaccactaagagcaagttttatagaagaggtaattgtcacccctaattttatctatgtaagttaagaggtaatatgtacaatatatcacctctacactagctctagcacaatactcttaatatttttattttatttatttatccaatccattatttcttttccctattttttcttagagtttgtgtggaggttaccacttcatgagggatggcttctactatctctctctcctttcttctcttctccacctcaccatatgtccatattagctaagtgatatcttggggttagtgcttagggacttacagtacttgctctaacacaacacgtgaataaagctgagatgagatgcaacaatacgtttatttcaccttttcacgtgtgaatacaaattcacttacataggaaagccaattttggccgtgtgcattcaccttagaatgcataggccgttgcccattatctaaaataaaaggtaagctaattttcagcacactaataacaaggtataccaggaaaactgtgcaccacacccatctccttcacggtgtgaacctagtccatgcatcagtgcgctgtattgttcaccgaatccaattaatcgagtacaaatggattaatataaaattttaaatttgctaaccgaacaaaacatttttgagtttaaatctattttaaacaatattccaaaagctagtcaaatggtggcagtttgattggcttgggcattaggcttatcgaacattggtcgttcgactgtttgactgggctcgttgaacaatcaaagttcgatattgtcgtggctccccgcagatctatcgttcgtccttcatacgacatgccccgtgtcgaactttctcagttcaacggacatttattttcataattaaatccaactactttgcaattttccaataaaataacattatttttaaaaatattcttgacgatatgcggcagttccgtacgatcgggattaggatacttttctagggaacttttgtttgcatactgtgctggatgcctagaaattagtaagaaattaagagacgagacaaataggagtaaggaaggctcagtccctacacgaatggtctatacgatggggcaatccaactctttgccagtatattttttcattaaaatatgattatatgatatcttattttaaacattaattacaaaaggcaacattataatcggatcacaaattaaatgaatgatttagaaggaaaaaaaatcattccaagctcattaacaaaaattgaatccatcgtaaccaatcaagatataacatgttgtcataagaaaaatatagatggtttcattcaactgattggctcaggaccaccatccagcatattaggggaatattccctggtggtcccattcttattttttcgtcaaccaaacataaattatataattatatagtggtcatcttccaagcagacttgtgtagtaaaccaaacacacttaaaaattaattgtttcaatgaaaattagatgagaaccatgatggaaatgattgtgttgtatgtacaaacggaaatgattatgttgtatcacaattcatataatagaaactttacattctcacaatattaaattgaagcagtgctttacattgctgccgaaaataaagattaaatggaaactaattggttagaaggaatctacgggtaaaagatccaattcttaatcagagccatatactaaacaatggtaaggattaggtgtttagttcgttgcaccaattcaatattcgtgtaagtaggacgatccaccatcaaatttcaaacatattattgtatcactgcaacaattatgattatatagaccaatcctataatgagttttactcccatccggcagcctgtaccgaccggtaatctggccgtccaccttgaaaggatacaattgggaaacagaaaagaggcggaacgattccggagtcacgccgccgctttcctccctcactacgctctttctttcctctctccccgcatcggttctttctcatctattcctccatccgagcgcagcaacggagtagttgcgccgcatccacgcctccgccggtgccgattttttccccatccatctgctgtccgcggcagcaaagccaccggcgcgctccgtcaccaacaacgccgccgcattcacgagcgaagatgtcgtggtattctgtgtcccctatcccccccccctcgacggctcaagcaagtacctaatctcccccgctgccattggcacagcctaagcccccattacggctcaaaaactactccactatatggtctagttattttgtaatgaacaattcaatctgccatgtttcttgtaatgaatttataagaaaagcacaagcttttgctggagactttaatctttgaatggaaaattttaagctcatctgtcgtctgtttttttatgctgtttacagggcatgatctatcgttgaatggagcttttgacttaatttttgtctgctatgaacagagcatggtatatatgtcgtattgagagccattaatattttgtctgctgtttttgctcgatctcctgtaaaatacatgtcattatgtggagtgattagcagcacaacaatggttacaaacaagtgttttcaatgaacagcaatccagctagagatgtaaaagttgaggaatcactggagtagagtgctagacacaggggcaataattactgaaaaaaagtataatttacatgattctgaaagactaaaacaaatatagagtaattcagagtttcagacagtgggagaggttaggtgctctcccaaacagaatagacagttaaaacaaacatagagtaattcagagtttcagatagtgggagagactaaaataaacagaattctgcaaattttcagccaaacagaacgaactagaacttagcaagaatctaaaactgaaggataagttagacaacccatctgaagaagctgtaatttagagtttcagatagtgggagatagataaacaggagaaatgcccaggggtcttccggctagctccacaaggtggtgggctagacgacctgggttcaaagcctcacccctcctaattatttgatattaggtccttccctaatattctagtttttgggagatagataaacagaattcacatggattggttgctaagacatcaacatgctgagtgatccccatccattaattctggtaattgacatgtacaaaaatcaacaatggcaagcatagtacatattatcaaatagcttcatgagaaggaacacagctacaactactgttcctatgaactactttctaatgggaaaattagaaccatgccattataattttgcaaaatttgagatatgccatcctgacccacatgtcattgactcatgtgggtcctacatgtctttgagataccgatggcatgtctcaaactttggaaaattataatggcatggttccaatttacccatttctaatgtcatcagtctcttttttctgcttggacaacttcttcattttctctcttctgccttcgttttctcaacataatagttgagtgcttgagctgtgggcagtgctacagaataaccagaggttgaagaaggatgcccaccacgaaccacccgctgccgaaccaccacgcacgccacgaaccacccgttgtcgacgccatcgccgccgccacctcatggacacgggcccaagcaccagacactgccgccaacaccacctcaccaccgcagcccacggaccagccaccacctcctcgtcgcctcccatggaccacctactcgccacctcccacgctgctgccgccgccgccgcctcccacgaatcagctgtcgccaccgccgcctacggatcagccgccgccaccacctcccaaggaccacctcgccgccgcctctgagcgttgctcccgtccagcaccaccgccacctctcacggatcagagctgaatcgagatggatccctacgcgaaaagacaacattaccattccacccctctaactattccggtaccacctcatgggcaaatatgtacctggaggtaccgcataatttccaccattcgatcgagctaaataaatagctgagatttggtaccgggctggtaccgtggtacctgcaggatgggagcaagctggtgcgggctgcggctgggaacggcaccggcaccgctcggcaagcaaccaagcagggagagagcagcgtttagcacttgctgcacttcagcgtttacttgtattcccaaaataaaaaatactttattactttaagtattcttcaatgcatactcttttatttatacttatttgcaaatggacaatagattacgatcaatggttgctgccatgcttaacataggcttattgacgtaatattttgccgtacgataccgtgcaattgagattgtttatttccttattcttgttgggttttcactctcgcgctagtccatatgagccacaccttgtttttttccgtcctccgccactggccttaattatcatgtatttcaattaatgtgaatatgtggtgggatatattttttacactagctagtacggtagcacccctcaatttaaattctgaattcgccactgtgtacactgtagttgcaatgcatatacacaagtacgcaagtgaatccttagaaatctgagccaaaccaaagcggtagttatcctcaccacccaaacttaatctaatcatgtttgttttttcattttaaatggaaggagggcgccaacatatacattagttagatgtatatatgtgctagcgcgtatacacacgctagagaagcagtgatacagtgaacaaaaaattaaacttttttgagtgatacagtgggtcaaaaccacacttgcatggccaaattaaacttttgagttttgtggttagtagtagtaactaatgaataaaaaaatgtacttgtacacaaacaatggtcttttctttcgtacgatgtgtgaacaaatcacgcacagccagagaagatcatggagttctaggtgatgtgtctttttacataggttggatcttctgcagtactgttggtgtcctactactactcgtgtagtaatgttgtacataacacatgtagtaatgtcgtagagaatcccaattgcttttacacatttttcctataaacatttttaagagaaataaatattccctccgtttcaggttataagatgttttgactttgatcaaagacgaactgcttcaaatttgaccaagtttatagaaaaaaatagtaatattttcaaccaaagataaatttattataaaaaattatataattattaatttaataaatctaatttggtaatgtaaatattaatatatttgcctataaacttagtcaaacttaaaacagtttgactttaaccaaagtcaaaacatcttataacttaaaacggagatagtaacaacttcatctgcacaattctgaaggaatggaaaagaaattgtgtacctagaatggtagcttctctcatcatccaaacatgaacttttggtcacgatattttttaatataaaaatataaaaatatgtaatcattgtacgcataaattatacatatattatacggagtgtgtgtctataaacccttgggatctagctatgataaagactcatcatgtgagcatttacaacgctctagtgtggaccactaatccacaacgccacgtaagagtacattgtgtgcgaaggagatgtgtctcttctaacacagaaagaaatcctccatcaatttaaaatataagaatttctatgatttaaaatttatacacaatataaccatttctataacattaattccaacacacaaaaatctatacattttcagccgatgagatgcatgggaagagaatctaaccaatttaaaattcaaaatttgaccacttaaatgactaaagagggaatctatactttgcttatagactagtggttcaaacttcaaagtttcaaacccagccagagttaaaaaaaaaagaagaagaatggaactagatcaattctgaaattaggcctgctcttctcaattcgtatcaaagtttttttataactaagagagcaacgctctcctatttctattagtagaaatgaaaacattcttaaaagagaacttttacggtacattctactgcaagtatatactattagtatataatagggtagatttgatatttgttaaaaatctgaaaagggttgtttagtcatttaaaatagagattgttttggtttttttaatcacgaatagtgataaactttcccgtggtttttttctgttgtggatatcgtcatccgcgtgtagcgcttcttttcgtttcatctggcgtccccgacgacggaagctcctggcgcacctcgctcccgccccggctcagcgcctccatcccgataattccttcggcgccgagagaagccgatcttccacgcgcccggcgtcttccgcgtccccggcaccttgtctccagccctagcctgttctcccccttatccgacctcccacagcttctgccctccccaaaccacggcggcgagggttaatggttttggagtctaaacatggtttatatcatctaaagttcgaaatgatgctaatggttttggagtctgaacattcttctttcacggccttctctggaagactggaacatgagagttgaatggatagtagtcacataaactgttcatacattagttatattggcatataaccatgctaactacacattagttatgctaattatgccgccctgccgctgccacctgctgccgccgggctgcctttgccgctgcgagctgccgcagctgcacgccttcttcccggcgcccttctgcagctccacctgcccgccgcctcccgcagaccgggcgccgcttatgtcgttgaactccgagttgaggatggtgtcgaactcaacggcgaagaggtggttggtcacgttaacattgccatgccatcaaagctgagattcgcgctggtgaaccccttgaagacgaactgctcgtggccgccgccttcagcagcccgccggcgccgcctcccgcagacccgacgatttggggattttcggaagaactaggttttgggtgaggaaagggggagggaaatcgaatcgattcccgatggcagcgacgccgattctggttgtcgacggcagcgcggcgcagcatactcgcaaaggcagtcagcgaagacggcagtcgcccacgcgtggcttcgagaaaaattcgcggccagatctgactaagtgagaaacacgaatttacaaaattaccccacacaaatagataaaaaagacaaatatacccccattcaatttatactgcagaataattgggaaaaagatcagatgaatttacaccgttagatcaaatatattggtagtatatacttcaagtagaatgtatcctaaaagtcctctcttacaaagtgattcatcataaactaaaagtatagatagctacttcctcccccctcaccaggtaccatcgcaccatggttgggggtgagaagccaagcaagttcagtgtcctcccctaaaagacatatcaccgctacctctcccgatttcatcacagcttacaagagcagaaggagctaacagaagcccatcgaaacaaagcgttcacatatggcgctcattactccaaactaaatattcagacaactgcacgatcacgattcctccagtttttagatccccaaccagacatttgtcttccatgacccttgtaatcttgctgtcctgaggctccatccatgataggcgccatagacctcaacggctaacccgctttaacagtctgatccctttctgtagacttcttgcctcgccctccttatctgtaaaatatcctcgatgttctattattgtactccctctgtctcaaaaaaactcaattttaggtttccgtgtccaacaattgaccgttcgtcttatgtgaaatttttttatgattagtatttttattattgttagatgataaaacatgaacaatactttatgcatgagttatctttttaatttttttcatatttttttcaaataagacggacggtagacacggaaacccaggaattgagtttttttggacggagtgagtacatgccaatgccttatattatttttgtgctcgacttgagtgtcagaaatattaaaaaccattgacaaatcaaacatcaaccacgatccaaaatattaaaacccgttgacgaagcaaacatcaaccgcgacccaagccattatctcacctaacaatttgcatttcttttagataatacctaacaatttgcatacgttggcacttacgacaaccaacaaaacacaccttattaattgaagaaaccaaacacaacattatttatatcaattgaggggtacacccggttggcagctcaagagtacagctaaacattatgcaggaatgtgcagagacagaaggtatacagttgtaccttatcaaaaatcatcaggtgttctcgtggatctccttctccatctgctggttgtttgttgtctcacaacattaaaaagcatcatcattcctcggtggtgatctatcaagattcccagaagcagggcataaaccgtccgttaaaaaaaacaacttaagaatatgtttagattcataatcagaaattctttctttttttttaaggagggaatatatccgtattctgtcagatatcattaggtgttcttgtcatctcttggatcttttccatttgctggtgtttgttgtctcacataaggtttttcgaatgtccatttgtcaagattactggagcagtctacactgaagaagcctcattacttcatgatcattctccagcatctatcttagagggagaaattcgtccagcatgcaaggagaggatgctggcagaactcttaaatttggcacagctctagctcccaactccaacttacctagagctggaactgtgccaaatggtatagattctctattttttggagcggagttggcagagctattccacaaatttgtactacggaggtggagctgggtttttgctgctccacagctccaaaccaccctaaaagatccactaccctttaattttttaacgtatttacacaaaaataccactgaagtaccccttcacaccttctctcctcctgttctctctcctcccatcctcctatcaccaccagtgagatttggtacgattcagcgacgaacgacggcaggctggctggcggcggtgacgcgagagctgttggcggcgcgtgggctagctgacggcgtgccggctgggcagcggcgcgcgtactggtggcggtggcccggtggctggcaccggcgcgcggcttgggtgatgggtggcgggcggcagtggcgcagactgggtggtgacggcgccggcaggcagcagcggcggcgcgcgagctggccggtggaggtgccggcagcgaacgtcggcggtggcggcgtgcgggctggaggcgccgacggcggtggacacgggcggtgggcggcagcggcgcgggctgggtggtggcctgggcgacgcccaccaactgtttgacaaaatgactataagggacgtggtggtgtggagctaacaagtctagccaaacattcacacacacctcagctcctataggagctactccttctactccctccgtttcagaatataagaagttttcgaattggacatggttattaagaaagtaggtagaagtgagtggtggaggattgtgattggatgagtagtggaggtaggtggaaaaagtgaatggtggagggttgtgattggttgagaagagaacgttggtggaaaagttgttatattttgggacaaatcctaagggctaaaagttgttatattttgggacggagggagtagctcccattggagttggagtttggagttgtgccaaacggggcctacatgtaaaaccttatattcaaattcattatattttaaccgtaaaaaaacaaaattctgacaaatttaatttgtcagatttttcacttttttgctacggctaaaatataatgaatttgaatatgagactttttagatatgtgcaatactattaggagtaaatatccaatttttttgtagatttgtttgtgatatttgctagttagcgtgcacgagaagctttatgtatataggatatatcttcttacttaaatatggattactgacacgctaataagtttttgtgagtttttttttttgttgaattgagataaagcatcgcaatagaaatctgcaaactacataggactagtatactacaagcgggacatttaactatttaccacttttaagatgtgtaaattaaagatttaccactcgttgtctataacatgtgggtcctcatgtgtctataacacgtggatcctttgacaaatcctttatcaccattcgtaaaagtggcaagtagttaattattccacaagcatcatgggccacatggccggtgttggtggtggtggcagacactactgccttaagaatgtgttcggcagtacgtgttcccaactcctctccttcgtgtttcgcgcgtacattttttaaactactaaattgtacgttttttaaaaaaaattatatacaaaagttgcttaaaaattatattggtctacttttaaaaaaactaatactttattaatcacgcgctaatgtatcacttcgtttccgtgcgcaggagaagtagtatagatagtgaatggaacggcaaaaaaaaaacttctagaaagatctttcgatgatataaatctgaagtctaaacccttcaacttacactggtcaaaccatttttcttgaaaacctgctgccaaaccattttttttcccaaaaagagaggccaacaaaaggttagtgcgaaaatgtttatcatgattacttggccaacttcgtaaaaccaatcatttggcaccacacctcaagtaaaaatgaatattagcacatgttttaaacatgagttattaacatgcggatctagatttaaggtcccgttcgtttctccaacaatatttggatgaagatgaagattttcatggcacgtttttcaaactgctaaacggtgtgtttcgtacgaaaactttctatatgaaagttgtactaaaatatcagattaatccattttttaagtttataataattaaaactcaattaatcacacgttattaccaccccattttacgtgaaacacttaatttttatatttatctttatcttcaagagattcaaacaccaccttataacttccatacaattaatgtggttgctaagttggaatcatattccttgaattctttgtggttgcatgaaatccaattacagctctcccaccttttttttcgacttttaagaatgattgactgcgcgctccttgaattattatactaactaggaaggtagcccgcgcattcgggcatgcgttttatacattatgtttgagatagttataagagcgaaatatcaaccgtaaaacatctaccatgatttcttcgtaaattgttttcatcgacattaattgcttttttaattttctaacctattagctttatattataggagtataatatttacctgatatttataagcaattatttataatcttcttcatcatttgaaatcatttgaaaagaaggtagacttattttctttagaaaacatgtcaacgaaaagtaagtgtaaggtaaaactaaggtatttttcttttttgttcaattgcatatgtattatcatggtttattcgatgatgaattgggagagacatgaagctccactaaatatatgggtttatatagcctaatatgattgatgtagtttgagagttagtcaatctatgaacatttcatgtagagtgggtaaaaggttccacgcaagctaacttgcatacgataacgataaaatataattgtacaataatatttttgaaatatgacataccatgaatacacacttgtatttccttttataagatagttctaaaggttagaaataatggttctaccggtttaaaagatataggagtactccaagaatgtagcttaaaaattatggttgttttaatatctaatattattgcgaagtgaacgtagctcaaccggttaggttccttgtgatggaacttgcccgagttcagacttcacaaattcttttagtggtagacaacgtacccgtcgatagcgagacgtacgtggtgacttcgtcaatctcaaaatatatcaggctagtctcttgaaagtactcaaaggggtatttgcatgtgtgcgttcacagaagtgattgtgcgcgttgtgagcgccagcgtttgtattttgtttaaaaaaaatatcaaacattatttattgtttctcttttatttaatagataacacaatagggaggggacgacattgttgtgtacatgtgagggtgatgcggtggagattatatttttctaactttttaaataatttaagtgagagccaatgacgaggtgtttcatttttttctaagaatttctaaggtttttcctttttataggacgtgacacacggtgacttaagattttttctaaaaaaaatagatttaatagttaaaaataatggatacatcaaattaaattgatttttctgataatttaattacaagatctaatctattggtttattatagatctagattacatgaatatatatacttccgtatattatgtagtattatattttatcttttttatattatacaaaatcctattgttagaccgtagttttttccacggatactaagtacactttttttttgctttattttatcgtagatagatgtctattttttttcttccagctaacagtaggtagctttatatgttttttttaaaatggagtagctatatttatagcgccatatttttcaccaaaaaatagtcaaaaaaaaagtcggtatgtatttacattgtaattccctaaattacatatgtaattttagtgtatttataatataagtctcaaaattacatatgtaaatcttaaatttatatactaattatatatataagtggggtgtaactacggtgtaaattcgtataaatatataaataattattaattttacgacggaggtgaagtgctaatgagtctagagcttaattaggtgcatttggttctttcgcataagctgtaagatggggtgcagcctgcaaatgcttgaaacgaatcttaccggacgatctcacggttaaaacatccgactgtacacaaatttagcaataccgttttttaattgtaccaacgtagggacatttatttttctttccttttcccagccaccggttgcatatgtttttttaaggaaaaactatcacattttttaataatagatctaatctaatggtctaaataaacgggtccaccaatttaagtacatccgactgtacacaaatttagcaataccgttttttaattgtaccaacgtagggacatttatttttctttccttttcccagccaccggttgcatatgtttttttaaggaaaaactatcacattttttaataatagatctaatctaatggtctaaataaacgggtccaccaatttaagtgaaaatcgacgatgagattagatagtgccacgtggcggcctaggagcgtttgtaggagtcccacgtggtggcttgagagcgtttgtaggaagttttatagacttttagtataataatagatagatagatagatagatagatagatagataatagaagatagatagataatagatagatagatagatagatagaaatagataatagatagatagatagatagatatttggttcggctctaactccacccgataataaggatataggagctaaagtcttaataaacatgcccttatttgcccaatcactaagcggatgatgactaacgtgttccacttgttgaacatgatcccgcatgatcccatcctttaacaagtatgaagggaatattgtcgtagatttgcgagatgtgaatatttcctcggcgtgggaacacaagagatttgataatttaacactcctta

SEQ ID NO: 65350 - DNA, 670 bp, Oryza sativa
caaatatgacatcggcttagagataaatgatatgtcatcggcaattagccgatcggctatcatttatggatttaacgatggtttctttttctttatttttgttggttgcaggatcaaatcaactggcacgctcacgaacctaaaggcaagattttttggacctgcactgaagttaagcagatcttccaggcctcgtgttttcgcatcaacagctaggccaaacaccgacggactgatcgaggccataggaagtcacaagctgtcgagggtcaatctctgttgacgaagatcaagatcaagatggaatgccgaggattaagaggatgtgatccgttgatgaatatcaagccaaaagtcatagtggcattgatcaaggctaaggtatagttgatttggaactaatgtgcttagaattgtaggtgaatagtcccggtggtaaaatgccattgacgttggcaacccgcaaggtgaagcaagatgatgacgtgatggcatccctagtggtatagcttttctatttgcatttgagtatatgaatgccgtactattaagatagatgcaacgttgatgtgtttgtttttgtctcagtgctcaaagtaacctatgcaagtgctatcttgagggaaacctaagccttaacctaacttatgactggttttagagcttgttt

SEQ ID NO: 65351 - DNA, 3215 bp, Oryza sativa
tggtaaattgatttcgctgtgaagtgtttttcaggagcgcctatttaccccctctaagcgacatgaatgtcctttcagttctaggtttgcactacgtatacgtgattgcattacatatttctcactcaagtgcaacctgccctacaatttacgtcagcatcagatattagcaccaaacgcatcaagcactttgaagtatatatatgctgccacacaaaacaatcacaagttacaacaagtcaacaacacaatacagaatgaaactagctcatttatttatgtttttccacaaaatatatgtgttgtaccagttattactgcttaggtggcttgaagtatgcataagccgcaaagaagctctgcatcatggtgagtgcgagcaggatcactgctgcggcaagggacgtggccacccatgggttgctgaagtagttgcgcaccagggcggcgcgccaccgcggccacctggaccgccggtaccgattcacctcaccgatcacgccggcgaggtagttacggtcggcagccaggtgggcctcgctgcagagccggctgaagaaccccgtggggtcccggtcgcggttcatgtggttcaccagcacgccgctgaggtgcagcagcctcatgtcctccggcgaggtgacgaggcagtccatgaagacggcgtaggcggtgacgtggccgcgcgtgtaggggtaggtctgctcgaaggcgatgaggttgcggaagagcggctcgctgtagtcgtacagctgcagctccgggatctccaggacgccgccgtggccggcgaacctgacgtcgaggaagctcgtcgcatccttcctgggccggaacgtgacgccggcctcctccagctccctggcgcatggtatccactgcgggagctcagacggcggcaccaagtgctcgctagggtcgtcgtccggcgccgcggcggcgtccggtggtggtgggaagccgacggagaggtagaagaggtgcaggaggtggtgcacatgcacatcgcggcaggagatgggcgaggagtagagcttgcgtggtcggagggagccgaatagccgcagggcaccagcgacgaggacgtcgctggtgtcgtcggcgtccgtccggagctgatggaacagcttctggacgacacagaacgggatctggttctccagaagcagcaggtcgcacgtgacgaacgaccacacccagcacctcccaaacagcacggcccggtcctcgtcgtcatcttgcccgccggtgccggaacgagaactagaggaggaagctttagctcctgattgttcttcactggcaatgcgcgcgaacttgagcaggcggcggaggatgaagcacccgtccagcagcatgatgcccaggactacatgtctctggccgacgtcgagcgcctccgcgtcaaaattgtaggacgccaggatacgtggcaggaagccgttgatggcgctcaggcaccggcgcagaagctccggtgtccgggttggctcttggagaaggtggtgcctcccgatgaggctaccgacgcagcgccatttgtacagttcgaggaccctgtagtcctcctcgcggctctgctgccttggatagcttagcaagccgatctggacggcaactgggaggtagctatagctgttaccctcctcgtccctccttttcatctcaccagggactctgtagatggttggcagccgctgctccggctgattgggcccgccatatttctcaaccaccagccttttcaaatcctgctccatactcttcacgaatccctccgatacaatattgctgcctggatttttgacatattggccattttagaaaagcttattttataagtagattatcattaaatcaacataatagtataggatttatcggttcgaatccaactgtgtcacgatggtttagatgaaaaaaaagaaacaacaacaggatatctgcaactaggtgacagaggagaggaggctgatacgtggaaccggcggataaattaaaaatttaggcggataaattaaaatgaaaatttaagagagtggtatctagatatgtgcatatttagattgggttatttgaaggctaagttccctattcgatagactaagttcctacttaaaaaaagctgtatatatccggttggatataaaggccgggtaaaaaaagtaccctcctctgaaaaaagatgtgcatattcttccaccgatatcgatcctcggcgcaggtcaggtctctaatcccctcatctcttcgtcctcagtttgttgcagccttgccggactggcgagcaactcgctaatccgtccacactaataatctctcccgtacctgatacctcgctttgcctggccacgcgcgccgtgcctcgtcctggcagctctcctctcgttcgacgccgtgtcgcgccattcctcgtcgctttcctcagcacgtcgccgattgccaggatggaggccgatgtggaacagccatagcgcaggaaaaaggccgacgagccgcgacgcctctggcggcgttcggattgagaaggtcaggaggagggtctgcagtggtggatttaacctaaaaattattttcatagattcatgagatatgagagctgaaggctctctagtttgtttagcccacgctgtcatagttatggataccacatacttaatagtacactactacaaaaataatttttctgtacgatgactcatcatttttccatgcggaccataactagtggcgtctgtaaaaatcgagggccattttcccatactgcttaagtggcccgtagggcctcttaagagggccgcatgcaaaaatgagctcatttttttcatacggctcacttaagcgcccgcatggaaaaatcgatttttctatacgggccatttaagaagccatatgcgaaaataaaatttgaaaaatttgaaaactagtgtatctcactcatatgaactccaaattgaatgtttttttcctaaatgtttctaaaatcatgctctatcatgttattgtgttcttactggtattattttggctattttttcttgtgactttgttttatcaattaaaaatttaaatttcaaaagttcaaataatattttgaagtagtaaatgattttatctgaaaaaatcatcaataacaaagttgtataactcatcaaaatctataacttctattttggttattttttcatccgagaaagtgatttgttagattgttc

SEQ ID NO: 65352 - DNA, 11171 bp, Oryza sativa
tccccgctggtcgacgacgacgggccgagcgcgctccgcaaggcgcagtcggagcgcttcgtcggcagcaagacggcatcgtccatggtgcagttcgatgtcgtcttgtagccgacgctgctctagctagtctctgcacgacacactacttacgctgtactatatagtactgttcatgtcacacctgtaaattaaattagcacgaagtaaaaattagtatcaaaatcagtcgctgatttagttgttatggaaagtagctgcaggcttgagggtcttcaagcagtgcaaacaatgggggattattgagacattgtttgttgtggtttgaacaattggatacaggaatacaggtgtggaattttgggagaggttcaaaattctgggtggaaaatttctgatttcttttatgtcggtcaagaagattttcgggacaactgtaatttgccaagtttccatgcgtgaatgatatatctgcaaaatattattgccttcatatatatgaatactatccatgacatgtataaaaacaataaattataatatatgtaattagtactaggagcttcccaagacaacacgaaattttggaatatgttgttaggtttaaaaatttagcttgaaattttcattcaaaagttttggaatttggttatcctcttctgcacctaccacccagccccccaaaaaatggtagtctagggtgcatgatgtgaaaatatgaaggcgatggagatagagacggcacaggccaaatggttccacaaaatgtgcgcgcgccgacgctccatgttgtggcagggttttgaaaatagaagcaagtagctaagcttagtagttggggaggttgctttctagtttgacatcaccagtgaggtgtgcatttgtttttgtgattcctacgtaatgtgagatactacctccatcacaaaatgtttgacgccgttgactttttaaaaatgtttgaccgttcgtcttattaaaaaaattaagtaattgttaattctttttctattatttgatttattgttaaatatacttttatgtatacatatagttttacacatatcacaaaaatttttgaataaaatgaacggtcaaatatatttaaaaaagtcaatagtgtcaaacatttagagaaggagggagtactatgcaggcagttaggggttgtggtgtttgtgctaatcttgttttatctggcgactcctccggtaatcgtcatcgccatgtttgaattcggatcacgtaactaattaaacatgtgaatgatttcatgggaaaatgatctcattgaaggatcgggatccagaccggccttgtgccggattacatttttatgaatggttccgctaaaactgtcgccacttttccggaatatataaatctcagtgatattttttgaccgtacttgcttagtataggtaggaaatgttgtgcccataatcatgtttttcatgatgaactttaagcttctctctctctctctctctctctctttatctctcttgttttttttcgtttctcttatgtgctaatttgtaccataatacattttgttcttaagtaggtcatcaatcatttagagtcttagttctcatacattgagttttacaacaaaaaattgcattgttaaatttgaaattcacaggggcggtggccgcaacgtcaccaagctcatggcggaagcattgagggcgacaatggggaaggtaggagctaaaggtgatatataggggtgtggggaggacggtggaggtggaggtggaggtggagacgcattagaggaggaggtgggagatagactgaggtcatcggagttggagtcggagggggttaggagatggatggatggccaacgattggagatctggagaactggggctcaaccggcagtgggtggaggagaggaggaggacctgctgttgcacggcacccttaaggccaccatcctcggtggaccacctcttcaacccaacccgcgccactagtggtgccccctaggatcttccgcaatgtcagttgattgcatccatgggagattccattttcttcaagcttaaaattgaattagttttcttaacagtagactttgacaagggggtgacatggctatactcgatgatcaccctcggccaggcatgactgggggcaaatgtgggtcatcaacaacaaggtggtgaacccacggtggtacgtacgaggagttccacatctactcagcccacttcgctaccaacatcgtattctccgtcaatgctgcacagcccatcggtgccacgctcatcgcctgcacctacctccccattgagctcctgtccagccaggacattgagcgccatcccgacatcctcgatgctagcaggaagaggatctcatatgggtcgacaatacatgtccagctacagttccacgtctgaccttctcctcattgacatagatgctagggcaatggctggacgtcgatcgaaggggagaagataggagaaagaggggcagaggaggaagaagggaaatttcaatgacaagtgagtcccattttttttgtaattgtagcatgtaacgtgagtgtgacgtcagccaaaaccgccatctataaccaccgagagactcaatttgcactggttttagaagatgaggttgcgttatatctggtttgtgtggttgagggatataattgaaactcgacccctatttgatggacctaaagtggatttttccattttaaaggaataagttcactttaaatcccttaatttatcaccaagtttgaaattcgtctctaaactataatgccaggtataacacacccttaatgtgcgaaactggtgtactcgaggtcccatagtaatatattgcccgggttgatgtagcggctgagttagtgtgggacccacatgctagggcaatttagtctggattaaaaaataaaaattagtggactccacatgtcagtgacacatcctctccttctctctatttctctccctttttcttggtggggttggtgggaacagggtgtcggtggcgtgggagcaggcactgtatgtggcacgcgagggcatagggagtgggcagcggcatggaggatgaagtcggcatcggtgatgaaggtcgtcatcacctagggagcccttggccatcgtgtgcgcttgcacctgcctcccctcctagacagccctcctagcgacgacgaggtcgagaacccagccgtagtgctccatgggagggtccaaccccgctaccaagcgggtggtgagtaggtggaggacctcccgcaggtcgccttcccttaagaatgacaacatctgccactggagtgtgtttggggatcgaatcgtctaagcagctagaatccgccctcatcaccgaggagttgcgatagaagatcagcagcaagggtgccgttgttccgagaagatggacatgtcacgagataaggccatcatgggggccctctacgtcgagatctcgcctgcccctccgcaccagccctcgcgactcatggatggtgtaggcactagacaacaggcatcgacgtcgatggccgagtccaccgaggccatccccaacctcgtatgtgccacctgtggcaagtcctgccgctcccagaccatgagatccccttgcccgccccccccccatccatggttcccaccagtagcagccgctcaatccactgccaccccttttccatgacaaggtgtgcccgtgcaggaccaagcctcgctcgcacggcctcacccgaccaccgccaccgcacaaatcgaagctggaccaacttcggttgctttccaccgaccatgaacaccaccttccagggaacacctccgcctcatcagtgctgccaccactaccgcagttgcttgctggctcatcaacactgccctccatagtcgccgcttacatcactagatcgcgatttcgctcctttcttcaggtccctcgggcagaacagcggcggtgcctgcgcggaaagggagagagaggaggagggagagaaacagggaatgagaggggggtgatgacgtgggccccactacaatttcttttaaccgaacactcactgacatgtgggtcccatgaattttttctgacttgaagtaccaagtcaacgccacgtcagtcaaaaaacagtccaaaataccttaggaccttatttgcactggttttgagagttgagggacgcgccatatttggtattacgattcactaacgaattttagactccacaacaataaggggcctaatgtgaacttattcctattttaaaacttgctgcaactttcaatcccgtcgaaaagaaaaagcccacagaaccacgcgctcgttagcctcctcgttccgacggcccatgtgatgcacatatggcccatattgcctgggaaggtgacactatcacagcggcgaggcccactaaactcgagctcagcctctctcgctcgtcacctctcttctctctccgcatctcccgtctcgctcacgccgccggtcgccgccggcagcctcaatctccgctggcccttcgtcggctgaaggatcaaggattcaaggccctgaggtggtatggcgagccaggagaagcccacgccgcctcagcatccgcctccgcccccaccggcgccggaggtcgcgcctcgtgtgcgcgggttcggacgggcccaccgggcgacggcggaggtggttaccctaacccgccggacgcggcgatccccgacgccgcgacgctgcgggagcagtggctgttcgcggtgcggcagtacagcaggtggtactcccacgcctggggcaccgccatcctcgccggcgccgccttcttcggactcggctggctcgtcaagggctccaaccccctcccgtcccgcgctgagccccacgcctccaacgccaaggaggagggcttaccggtgagaaccccctctgattcttgccttttcagagttatttatttctttgcttgaaaataatggcgagttcgagttcttgatccgctggttgatattcccatattggaatggaatggggtgttggatagcaagactatatatgattctgctgagttagtttcgatatgattggactggtaaagacaaaaattggtggttttttgtgtttaagatgagtaatgagttctagggaagagtggggttgctactttctgcatacttgcaaattgacaaaaggatgctgtgaaacgcatgggtgtcgtgaaaaaatattggcgacactagtactttatgcagctcatgaccatttaggtttgcaatgtcaactccttaaatctggttgttagcttccaaaagttccatattggaaatgccaacattgaatttggagaactatctgacaagagggatgagctatagaaacattgacctttttatataatgttgaatagtagaacatgaacaagtccagtcctcttgtataaagttgctaccagttgcttcagattcctttagtttatagtagaacaagttaagaactttgttctgttaagtttcgacttaaatttatcagcattgattaaatttttgcttacaatggtaattggtccgtcacacataactagagaactgttttttgtaactttggcaatccatcgcttccaaatagctttgtttaaacatttttggtatttagtgaacaagtgagcatcttaattctacatagttgttttaagcgttatggtttcgtgcaatgttttagaataaggtctacaaggccgcatacaaggaacgggtgccccaaccttgtaccgcttaagccgcataagcggctgattgtaccacataagtgtccaatcatgccacataagcgctacaaggtgggggtgaccgcatgaaactgcatactgctttttaaaatattgggtattgtgtgaaacccttttttagataagttttatagacaaaataccactaagctataagaaacactgatttgatttgtttgtacagttagcaagagcaaacaatacttggaaacatcctacatgtgcatataactaaagccgaaaacatcaccaaaattagatttgaattgttgattgcttttcatcaaaccaattgaaagactagcaattttgctataaaattttgaagatcgattatccgatccatgcatgttttatattttataaactcatttaatgaacagttctgtatatcagacattcatatggtatagttattgtactttctgtgtcattgtattgtttacctcagtctgcaatagatatgtatgaataatgatatgtgttatttgtaggttgaaatcgtacatgacaaaatatgtacaaatgccactacttttcattcaacttaaaacacaaagtcatttttggtgttcctcttgtttatggaagtttcttttgagcagaaagtccttgcaggcgagccctccccgcgtgtgagccgcagccgccgagcttgtggagctccatctcgctcgctactgccgccatccacctgagggtgagaaagagagggtaaagaggaaggagacacgtgggcctaaaatttatttttgttgttttactccactgacatgtgggtcccatttaaggcttggtgccacgtggatgaagaccaagtcaacctgccacgtgggataaaaccgctcgaggagtcgatttgcaatggttttgtaagttggggatgggttatacctggttttgcaatcgagggatgtgattcaaccagggacatgagctgagggaagcaaaatagacttattcattgatattacacaacgaaccaagaaactatgcatgcaatacagggtacattatcttagtacatcacatgaatgatttccaacagatagagtgactggggagatatgtgatggctacgatgttcactgatcatctttgaggtgagaagggagcattttatcttcggccaatctttcgagttgaagggcgggacggctgggatggatgctgacggagtgcaacaatgccgcctccgcctccttgacgtcttcttctttggctaagtggcagagcacaaaaacctttactgtgcgaagagaactcgggaggtgctccaagccaatgtcaaaagcaattttcctgtccttgaagaagtgcacgtccaagctgaagtgaagtaattccaggtatggcatgactgagacaggtgttgtgacggcagcactagcagcaggaggtggtacaaaccggatggaggtcgtggccatcgtgcagaatctcaacttgcggaacaacagggtgtcatgaatcccaattcttataattgcattccccatcgcaaatagatcgagtctgcggagcattcgcagcctgccaaggatttccatgtccgcctgtcgcaaaacctgcaacgacagggacaggttgctgaggtttggcagaagtgacggattaatccacggcggcaggctggtgaaggtcaaacacctcaggcacaggaactggaggcattgaggagtgacgaatccttgctcccacggcacacactgccccaccgctgcccaacggtcaaaggcgtgcattttctgtatcttgggcagacttcctagagactcgataatgtccgttgcgggggcaccctcgaactgagtacagagcaccctcagatcctcgagcttgcccagctccttcacaaactgccctgcagctgcagcatcaggccacatccacaactcttgcagggacgtcaggttcccgatccaatccggcacccttgttttaatatcggcttgtaggcacagcaactgtgtcaacttgcccacgctcgacggcacttgctctatgccagtcccccacagatccagcgtctctaggaacctcagacgtcccgctattccatttgggagctcagaaagaggtgtgtacgtcagtgcaaggtatcgtaggtgaagtaaactgccaatatgctccaggccgtgaaggtcctgcaatgattcacaattttgcagtgccagtacacgcacagcttcaaatttcgccggtgttggcagaacatctatgtatgacaaaccattggcactaaatgaccggattgtcacttgtgactgtgccgttcccaggttcaccactgggggtaatccattcttgctgcttaggatggctatccttcgaccatagccctggtgagatgtgttgtattgttctatacccaatacggtgacaaagttttcactgcttgacaatgaccggatcagaccgagcaccatgtcatgaacacgacagcctagtatgtagtcttcattctctgcctctattggcatgatcatacgtcgttttacaagctcgttgaagtaaccctctcacacctcatataagtctcttccttcttccttacagacaaaaccttcacctatccacctccatatcaatgtttgtttaccaattaaataatcctctggaaatgcgctcaagtacaataagcatgttcttagatgataaggcaaatgatagaaactaagagacaatatcttcatagtattatccacatgccggttgtcttttgcgccaagagcaattgaccgatacaactcagaccagtcctcccttggtttactctccaacaaactagacgttgtaacaatggccaatggtaccccttcacatttcctcaaaatttcatcacaaacctcttccaaatcataatcatcatcggggcattggtcttcaccacttaatattcttctatgcaataaccttctcgagtcaacatcagaaaggtgttttatttcataaacatgaccgacttcctcagcaatttcagaaatacgagtagttatgatcactctacttccacaactactgtctcccaggacttttgcaatcatgtcccaagcatcgaatttccaaatgtcatcaataacaatgatgtacctatcaagaaaacagtgcaagagtttagcaatgtataaatacacgttttgctcctataaatacaagaaacgtgccaataacgggaaaatggaaacaaacaaactggtttcatctctgaaccctgatcaacaaatgcatcatcataacgtatacacgagtgatttcatgagcaatactataatgttgtaaatatgtacaatgttatgatgatgcttagttttttttactatagttaaattaagtatctgttctatcagaccttaaatacaattttgtagtacatgcttttgtcaccacttatattagtttgagagacaaagtggaatttttttatgatgattgttgaaagtagtttgcccttcaggacaacccaaaaatcagattgcctatccattcatagatcaacaagccaacatttaaaatatacggagtagttcaataccactccacctcaaaatataaggtctacaaggtttttacacagtccctaatgtaaaagtttgggcgttaatttcttacatgatatattatcaacaactaccagattaacatcatacgaaagtacttcaaagtacaaatctattgatgtcaaatatcgtgaaactaaagaacatatatattgagagtaatttttactagtcaaaagttgaaaatgccgacttctcttaaacaatgattccttataatttggcacatactaggtcgtacatgcttttgtcaccatttattagtttgagatataattaaagagttatgtttgttgatgatcgaattagttttccttcagttattgagaaacccctaccaataacctccaagcttgcgaatagagtacttaattaccagctaataaaagttaacgaaatggaatacaaaaacattttgccgcaatttctatagtaaaaactaaagagaaaagaagtttatacaacaaaaacattatctagaggtgatgtttaaatctcctttaaaatcaagatttatataccaagtaaaacaaaattcaggatttctacagagcagagacactttttagaggaatttcaaaaatttcctagaatacatttacccaaagcacatgctcttctatttattcctatagaggcatcattttggcactctaaaatttgctcgtgcttgatttatagtaccatggtatgaaagtataatatgcgagggtaattagaataagaatcatgagcgcacctcttgttttcaaggaagtcgtagacctcgttcatgagtaaccttacatccttttttgtgctatggatattgtcgaacttttccttgtcaagatcatttagaacgtccatgaagaccctcttcaagtcttgattctggccaactggcacaaatgccgagcattggaatttccccttaacactgtcgtacactgctctggagagagtggttttgcccattcccccggatccaacaatggaaacttttatcatcttccccaagggcaagttgtcaccctccagggaaaggatctttatgatgtcattccttgtgccatcaataccaacaagctttgccgcatctgtattcgataacaggatgcgaggatcatgggtggacaattgtgtggcagctaggttagcctgaagatcagaggctatgtatctttcacgcgccttggacacctcctctagtttggtgttgatgtcttggacgacgccagatatctgatggcgaaccttgatcttggtgaacaagccgcacatcatgtgcacaagccgttcgaggcaaccggggttggcaggcacactgccatctacacgcaccagaaaggcgtcgatgacgtcctccatgtcatacgacagctcccggactttgcttgcccaaatcctgacctgctcatcaagcaggtcgggatgcatgctgccaaccttgcgaagggcagcatgcatgtcctcgagctcactcttgagaaaattgattttctccctaacgcccgtttgcagcttgtactcctctttgagcagctcggtcagtttggggacaaggctccccatcgcctcagccaccagcgccatggctcgctcaacttgctctaggtgtgcgtatcagtagtgtatggtacgctcggtgggatggcctgctgcctgcagtgggggagtagaggtatatacatttttcttgcatttaaaccctagctggcctgggaacgaacgctgcgtgcacctcgatgaaggtcggaagctgtgtcatcgatccgttacttgcgggtggggcacgtgcaccaaccggccagctgctctcagctcatcacgaattcatcgatatgcatgtcagaaag

SEQ ID NO: 65353 - DNA, 992 bp, Oryza sativa
agcataaaagagcaaaatcaccaaaacagcacataaacaatcatgaatagtacatttggatatttttaacatgtagatctcaattttagaaaaaattagagacttaaaccaactaaatccgagttaagatgaattagttatgaatttttaaagattaaatcggattaaatcatttatttagattttaattgaactatgacgcaataaagaattatttttgaaaaggaaaaaatgatttattgcgtcagcaggctcgggttaacggtggaccgggtgcacggggacggtgtacggaacgaacggccgagatctaatctagacaaaacgaacggccgagatcgatctaatccaccacgggtctacggatgacacggcgctgacgtcagcgatgacgtcatcaccggcggcggctcggcaactcacgctcgccggcgaacgatggcgcggcggcgcaaacggagggcacctacacgtagagggcgacgcggcgaactcactgagggcttggacgacggcggacggcaacggacagcgacggcgacgaggtcgaagctgcggaggcgttcgggtcgacgacgacggcggtgctccggcgatcctcggtggaaacggagggtaggacgaggacggcgacgacttggcgaacccaacagtggccttcccgagcgacgacgacgaccagagcggcggcggcgcacggctggactcgcggcggcgacagcggcgcacgggttgtcgtggaggcggcgctacaagcggcggcgagctgaggcgagggtggcgacgaaaagaggaggtcccgagtgtccttatataggggctaggagcggcgatgtaggcccacggcggccaacaacggcgatggaaggtctagggttaggaggaaaaaacgaatccgaatcgagctcgaatccaacgatttcaaacgaaattagccgaagattccaaaagagaaaaggaagaggggatcccgaggatcatttcccctctat

SEQ ID NO: 65354 - DNA, 1892 bp, Oryza sativa
gtcagaaagtcagatcatcacgatccagctgctcatcagcttcctttcttttcttgacgtactaaaaaaacgaaaccaagtcttaaacaaatatcatcgtgatccagctgcttagcttcctttctttcttttcagaaaccaagtcttaactaaaggaagtcagatcatcacgatccaagtgttcagattccttattaattttcttgactgaaaatcacaagttatgtttttccttttcttcttgactaaaactctgaagtcttttggttaataaattgttgccgttaatcctacaataaattaggtttggttactcgtgttcgatcctacacaatattattgcaagtttttagtttattaagccttcagagtttgtaggatcaacgacaataatttatttacacaatattaacgaacacaagtaaccaagcctactatacaagcgtgaatggtagattacgtccgcggaagtcaaattatcgaactttgagagataaaaacataccataacctcaaaaactaatggaatagtatggtggtctatccaacctactagggttagtttgaccaaggcctggcctatctgactgcaagtcctctcacggtctagccatctgcgtggaaatagcaagacagtacttctataaaaacatgatttctccaataccaaccgttggatcgtgctttaatcttcataaaaaaatagacaaaccaaggaacaactccaccaaacagattttcaaacaaataaacagtttcagtgtttctaataaacagtttaagagaaaacaccctgaaagtcagttgtgttagaatttcagtaaatcttaactaaacctaaaacttaagcaaattcgaatctagcaagagccaatcaataaaaccttctaggtctgatcaatgaattattaaaatggttttagatgcgttaacttgaacaaaattgcagcaaaacaaacaatcacaagtgaatatcaaaaccgaacaataacgtgaaacttacaaaactggaagagatcgtcaatgccttaatgattgtatatgatctttaatgcttaagtatttgttcacagggtgcagccacaacaccctcataagtttctcacaaaaccgtaattcaaatgctctcgactcagtaatctctcaaatttaacttaccctcaagacatagcctccctatctatttatacaaaaacttctgactcaaagtaaaactcctagttaggactcaaacactcaatttccaaactttttacagtttaccaattgtcactctttatttctctatcaaacacgcagccacagccagcaacagaaatcccggctctggatcggacacctctggacgatcgacacatgtccctagcatcttgtttctatttcacatgattagttgctaacgtttcaaaagatttgaaattttagcaccattgagaacatgttggttttcatcatctcactagaattagtggttcggatcatgttcgtggttttcatcacctctgaacgatctttatttggtttgttcatcgtgttgtcatgttaaaatgtttgcttcttcacatgcttctgatacttctgtgatgaagaatacaacaataggtttgttgacggaaaacacggcggcctgggagatctgcttagctcctgtataggtccaaggctgtggggatccctgttggtatttcttaacgacattactagaaatataattttcagcaatggcgcagaaatacttctggtatattatgtttacagagtttatgcgcaagcgcacggatataccattgtagcatttcacccgagagtattccaagggtatcgtatttattttatcccgtgggaagatcatgtagagagaactcaactaataattaaggggatccactagt

SEQ ID NO: 65355 - DNA, 4595 bp, Oryza sativa
agtctttttcttcgttttgcgtgttagtttgtcgtttccgtcgttgcgaaggttcgtgagtgcgccggaagtattcaataagattaattgaagaccgattattgcaaggcaagtcacacagaccctaaacacaatcctttgagcatgttgatcctatatttaaattctctatttatttcaactgtgcatttattttcgaatgtcaccgggtggtgtgaacctattcctttgttatggccaatttgcattgattactttattccttgataccttgggttattataacttgactagttgagctttatatattggttcagctagatattagatatgattgcttagccatgcttagaaacattagcacactattgggataacttatgactcattgtttaatgatggtttaatcgtagctcacgatggttaatcgtgttatgataattaattgataactaaaacttgacaatggtgggttgtgagcacatggttttgaaggtcgtgctcatgacaattaaggaccggttcacgagctactgttgtgaaacattaaccgtaccaaccacaagccagcatgggcaacggctttaccttctgtatagcatgattcattgcggggcaccagactgagaagcggcgagaagtccgtgggggtcgctggggagtccatgcctctggttatatttatagagggggtgattatgatccaggaatggtgcactgtggtgagttgtgttgtgcaaagggtattgtcacagcctctattcgggtactttccagtatcgcgacgcatggtagacatgatgaggaggctgtgtcttgtgggtacagtggtacacctctggccagagtaaaactattcgaatagccgtgcccgcggttatgggcgggttgagcaatgtttttcgtgattagtctcacacctctcacaataattatggatgttatatctggtaataatttgcttagctcctggtttggagttagatctgtacagccgggtatggttgttcaggatggttgggcctgtgcagcatgggtgtgctgttcagtgttgattaaaatttctgattaattactccactgttttactcctcttaaatgttttgctaaatgctgcttttgcaaatgagcctatattatgccatcctttggtatccttgtgcacttgcatatttgctgtgtggcttgttgagtatgtcatatgctcattcttgcaataatcaatcaaacctcagttgaagaaaaaggatccagaaggagaagacgtttggcttataccccagttgagctgcctgtgggagtggagccggaccttcgctagaccgtaattccgctgcagttttcttttcttttgaaagtatgtaacactattattgatgattctgtatattaaattgtcagtttgtgtacctcggctgattcctggacgaggattttatgcacaaataagttcggaaattactagtgaatttctgggcgtgacaatttccccctctttattgcgcgcgggggcggcgggatgcggcggaatccgcggcggcggcagcgctagggcacgggcgaggcggcgggcgcggcgcgaggtaggggatgacgggtgggccctacccgtcagcgagggtggcgggcgggcccgcccgtcagcggcacgcgcgcggggaggaggccgattgggccgcgggggagaggagagagagggagggaggtggcccgagccggcccaagaggggaaggggggaaaagactttttagggtttttctttttataaactcattttaactttgtttatttcttaataattattatttgtgctctgaaaattccactaaaatttgagggctctttttagaccaaggagaatttaacaaaaattctccgggccacatttgaatttttcttgtacgtattttagtgtttgccaatttcttttcgaattttaattaattctattattccttttagaaaatgatttttatttcgggatgaatttatcaggacgtgacaaatccaccccccttacaagaatctcgtccccgagattcgaggaggctagcatgaagataggttgggcggtcttctcttcttgtttgacttcttccgtcgcgtcttctaaacgaacttgcctagcaaaacttctccactctggactgcttggctcgacctcctgttgcggatggaatcttctcttcacctgacttatccttggttgcaccttgagctgacttcgactggggtgcggtacttgaagacggggtttcagttcgaggacttctcataattcatacccttggtgtcaatctcatacaagttaccaatttcacgttgtgcgtcgataccaacttgtcattactaggataccatgcttgtcatcatgagaataccatgcttggcgtttccttccagcttaccaccaaatgctttagactatcatatcccgcttaccaaggataccatgattgacaacttgccactaactgtctcatattagcttttctggtctctgggtgctagatacttctgctattcactgcaagggtcgataactttgcctttgaattatgcttcccaagagaaccaacttatcccacttgacatgctttgacgtcttcccaaatggctttattgctggatttgttattgtctaatcattatcctgccaaatctgaggcttcgttgttagatgtgcttttaatctgacctctatagattatcttcgaacatatcacttgattcataactgggaatagctctcacgaacaagcaactcggattcactttctttacattcagtttacttcccattatatcttcaggttgtcctcagttagcattcaacgtattcctttatacctttaaccttgatgtgttctttcccattggatcatctcccaagacatggcattgcctggtaaccggtgcttgcacttttcactccgtgtagcatctgataccgagttgaagatttcactctttgccttcatagaaacacttttacccaggtcatcttgcttacttaatgacaaggtgactgttgcggggcaattacaatcaggggtcttccttgagcgatgcagagcatgtttctgtttatcaatcacctttcggcctacttctttcatgctagagaacatctttgccaatctcttttatcaatcttctttcggcttatctctaacaggtggtattctttaatgtggattgcggacgcttctggggacgatgaggtcctttggcttgctgcctttcagagaaaccttgaagtagttcgtcaaaagctagactgacgattgttgcctttgatccgaagaagacacatctgaaactcttagtccaaacaaatgtctctttggttgatcacttgattttcttcgccatcaacaggttggttattaactcgagattagtatatgattcctctgaaatgagaccctaggtctcctttatcagtaagcaattatacacataatcacatatccgcatcttccaaaagaatcctaatagaacttgtctgtattacacatttctcccttattacatgaatacaaggcactaccttaaacaaaaagggaagatgcttaacatcggtacattgtttctactatgggttatgattaactcgaggcctcacaggtatggcgtttgctccagtgaccacaaggcgagtgacttgtcttcttcttgcataatggccggagtgatggcgtaggttacgcttcggctgtggacaatctctagagaaatgacctggttctttgcagttgtaacaaatcaacgtcttctttgttgagctgtccatctggggacgatcattttgacttggagttggaattggtggttgaaatccttgctaacattggcatcagtggtaccatagttgctatcaccattggagtctttctcagtgtcaaaattgctaaggttgtcattctggattccaacattgatactatcgttgacatcttggtgaatgctactgacattgcacgctttattcgagtggtcgctaatgaggcaagaaccatggttgttggtggtatcatcatcattagtattgctagtgttgttgtctgcattgcgtccatcttcttggggcaggaactcttgatgcacaacagaagatccggtgatctgaagtggctcagtgcgctgtctttggttaccacatggaaatactgggatgttgacaatcctcctcttgcagttcgtcatccgattatgctcactttcgagttgcatggctttgtccacaagtttctcaaaatcttagtaatcctctagaaggagttgcactgcaagctcatcttttaacccctggagaaacttctcttgtttgtcttcatctgtttccacatcttctggtgcatagtgagccaaacgatagaactcgtgcaggtactttgtgacggtcaaatctccttgcttcagatagcgaaactctcattttcttaatgtgatcattcctgcgggaacatgtgatctcctgaatacagatgaaaactcgttccaggtgatggtatgtccttctggccgtgatgcttcgtagctatcccaccactctgaagccggtccaaccagctgaggagttgcgaagcca

SEQ ID NO: 65356 - DNA, 3809 bp, Oryza sativa
  unsure (1)..(3809): unsure at all n locations
agcctcttgtgtttaataattatggaggcgctttactacctcataaaagaatggctatatattataagtgtctcctcncntactaanaaaanaaaagttancctggatnactattcgcatacacccaagncgacnctagaggaaccccttagctccagtgaacacttggcgattggcatgtctgcttcttgtaaattggcgaaaatgtggaggccgattttttttccttggttagggacagtccctggagtaatgtcgtggttctttgcagttgtaacaaaccataacttttttacactcgagttctccaccttgtacttgatttcttggctgttgttgaacgtgctgatgaagcctagagggggggttaataggctgtccctgaaaacttaaaaacaaatcgcagcgttaaaattcaaacagacccggaacatcgtggtaaggaactccggaacttccggcctgccaggcccaaaacttccggtgttcttaggacaggaacttccgggttacaaaacaaggatgaaattcatatttcgaatcaggagactaagccaatcttcacaagatgatgcacaggtattctaagtagaagatagatcacagaaacattccaaaaaacatcacagaaagaaacaagagcaattcttttcctgaagttcaaatctgcgatcctactctccgttgaggagctccaaagagctgggtctcgattaacccctttgcctgacttgtgcaaaaactccagaggaaatccacagccttcaactacaaacacccctaggcaagtttctagaattgagtgaccaccaagatccaactcaaactacttctagaaattcgccacaagtatacgttgctctacttggaaaacctctagaatctcagcacaagaacttaattaacttacctcgttcccttttggaggagaggagatccttcacaaacttacccgggacatccacaatatgcaacggattctcgcgggcgacacctaaccatctaggagatcatctccaagagtaataagcaccgagatgacagcccacaagatattccaagtgctcacccaagatcctagtcttcacacatctccaaatcttcttctcttcctctcaatctctctttctcataagaattaggctctagattgagtggagaaggcaagaaacacttgggagaggctagcaacagctctaggttcaaaaagtgaaagtggaatggccaatgaacaagctggaaacgagctgtatatgtgacgtcatctagccgttactcacaaatttgaactgaaaactagacaggaagttccggacctagaagacaggaacttccggataatacttaggaaaatttctttcatcatactggaacttccggacctggaaacaggaagttccggacttgcatttttggaccaatggagcatttgcaaaaatgactcctagggaaacttgacacttggttcacactaagagcacttgagatatctcagagcatcacctagaaccccacttaatagtacggtttttcctaaaaactcgattgcaaaaaataaactatcctatgcacttctcgagttccggtccgctttgattttatacttttggggggtctccaagcatccatcttccacaccttgaactaatgcacctaaaagatactcaatgaactcattagtcccttaaccacatttgtcattaatcaccaaaacccactagggggattaatgcactttcagttgtgctggaacatccaaaggtacaacgcggatactggcctctatcttgtcaactggtggctggggctgaaattgagcattgacaccttgtggtagtgcactcattggagtgggagctattgcatcttgggctatacgactgcttcaggacgcatggatgacaattcgctgaggagcaagcttctgattgaggggagttgcatggactgatgtgctggcaaatatgtttctcggtttcgggcacatgtcggcgaaatgacccacttcttgacaattgaagcaacatatatctttccagacttggcattttcttttcccattttgattcctctgtcttggcactggagttaggctgaaactgtagtcttgtcgaggatttgggttgccttgatgcttctctccattgtaactggcgggttggttggccatcttcttcgtcagcagaaaactgaattgacaatcttttggtacatgattagttccttcacacaagaaacaagtgatcctgctcgttggacactcgtcgggtggatggtcttcctcacaaggaacgcaagtggtgacacatgagctggcaaagtgaccgatttctccacaacgagagcatgccttatgttcctttttattctgattgaaaccttggagagacttctcatcttcatcccgtgaggagacttgatctgaatcttcgctatcagacactctacctccattagccaaaagatgttctgtcaactgtggtgcacctcggaagaaatttcttctctgacgttttgtcattcctggtggaggccattctgtgccggtaatggtcatcttacggacctcatcttcggttcgcattggtgcttttcttttctgctgaggacggttccttgcatagtgcccttgttcaacacagataaaacaaatgattcttgcttcttttgagtccacaagtggcatggcacgatgggcctgttgggatgctggcggagcgctgacttgtggtgtgagtgcttggactgcctccaactgcacttgaggttgcatctgactcgggttcagaattggcgtctgatgctgctgtagtatctctataagcaatttgttctggttaatcaggtgttggaccactgccatacaactggtgtctggtgcttcattcactcgggagcttgaggtacccacgtcctgatttctgaccatactgccttttttattgtcagccatctgttactaggtttggagagggagagagggaaaacaaaaggggagagacagattagaaactaaggataggaccttaacagatctattttttttctgttatgatgtatgttaggtttattctgcaagttgattaagcaaacaatctagcatggttacatcacaccccactgatgcaaaccacgcgctacacacacaagcaaggaaacacacgactaacgactctaccctagagggtggcttaggttctgcaacaggttctccaagatcttcacccctgcttcacagctggcttcattgcttccttcgcttcgctagcggatccaacagtcttctggagcttcggcaaacgattgacgatctcttcttcttcacaaagctgaccatctagtactagttgaaattcgaagaaggaagaaggaagtaaaccttttgcaaatagcattagggaaaggaggaaaaaggaactttcgcaaatagtttcatttataaaatatgtccttacgttttatccagttggcttatcctacagtcgagatatctctgataccagcttgtcgcgcccggaaaaataccttttccataacactagtgtattaatccccgtcccaggaaaagcacatcaggcctgacaaacatgatataaaagacacatctttattatatcgataatatttacattattacaaaggcacttcaggcctgacaaacaaaaataaatagcagcggactagtgggcctatggatccatcttcacaggcgctcaactagggtataagccagggctccacctaagacttcttctccaaaggggtaccgagctcgaattcgccctataatagtgcgtttctcacccacg

SEQ ID NO: 65357 - DNA, 4108 bp, Oryza sativa
ataatcagaccattcaatgactaatttaatatttaaataattgctaaaatgctatttgtattattaaaattaggagttgagctccgaaaaatccgagaaaattccagagagtataattaatcatggagaatttaataaaaattaaatccagccatgctttatatttaaaaaattttatttcccacatttaacttcacttgtaaattaattaatatttaatataaattctaagaataatttattaaataatttataaatcctgaaacgaaattcaggatgtgacacactggtgacagtgtcagtgcagtttagctctcggccaatcgtgttcagcatcaacgcacgaagcacgtcgaaatcgacttacactttgttcgcgagaggtcgccctttgtgatgttcgagtgttacatgttcccaccacttaccgctcccgcctgcgatttgacgccgccctcaggacccactgccaggtcgccgtcccctgtctcctcgccgtcgctccgtcctcaagatcggtgggagagcagcagacatgggggatctcgctcggtctcatcggcgcggggaagctcaccagcacgcagagcagagaagcttgccaatggggggagttgcaggtgtggaggtcctcgtcggtgggggtgtagtacgtgattcctgtgagaggtgagtagttgaacacaaaactcatcatgcagtccttgtcgctcttccacagagtacaacgtacgtggggtgctcgcgaacttccatgtccatctccacacctgtaatgccgagatcatgtgttctggagagtgcatatgaattctggattttagatccacacaacgacttgtacgtgtgccaagtcatggcgatcgttagtaatatgaaggtgtgtattcatcgaactattatgcatatgatctttaggtgataaaatattgattgaattgtctaccgttatctttcagaatccatactccagaaatcttacatatacacatatttgttgcatcaaacctaagctttcttttcatacatccctgaacaattcaacttcacaactgctctcgacataatctcattcagaatggtttttttttctcaaattagttggacatagcaaaatattgcttttcaagactgtaacacaaccaactagcagggatattcataaattttccccttctgttgggtgtttttttatagacatatataatgaaggcgtatataacaaagggagaagctgtttgagggtcttaaggacaatagctcaattgactaggaaattgatgtacaaatctctaccttgttttttgatttatagtttctttggtttcaaaaagtaaagtagctcatgacatgagaactttactagcagagaaatgggcttatatattattggaaagataaatttctccatcgatacttgctgccttgattgtgttgcgtgtgccagccctgtaggtggcaaatcattggagaatcagatgcagcttttagatgggcaaagtaaggccatggtcggtctgattaatctgtacagctttcaggcataggctcttgagataaaaaggtatcaaatttcaacttcttgatactcagtactcaagacatctgttaggagtagagctcagagaaaccctatttttagatcctgtaatcagtggcagagcttcgtggaggataaactgggttatggctcctccagcttcatgcaaatacactatattgagtatgttcatcttcatagacattgattaccatctttaacaggttagtttatgtagaaatcctacattatatttcatgttaatggccacttcttgttagtctatgaagctccgccattgtctgtaatgttgtttctgttaatggaaataggggtaatcttcaaaaaaagtctcatcttcgcactttcacattttttttgaaaaaaaaatatttctaaaataaattttttttaaaaaaaagaaatcctacattatatttcattgtataatatgctgatttagtgattttgagtagaatttcagggagtcaatgcaaaaacttgcatagtttggtcaacgccaccatcatgaagagttgcccaggcaagaagaactctggcaagctcatcatcacatgattcataattcgcactcaaaacatagaagttcaagacttcaggttattgtctcatctctacatctgattatcaaattagtttttttttcccatttttctatattttataaattccactacaaatgatcaatgaataacctcaggatttgacttctttttcaactgatctcttttttttttagcaaaacactgtagaggaagccccacagtaaacaatatattaaaaattaaaaaaaatatttacaacaagttcaaccaatgaatgaggactggtctctcaattacatttaactaggtgataccctgcgtgttgctgtgggatttgtaagaagtgatcatgatattttaagtgctgacaaatgctcaagcattacacaacaaagtaatcaattaggggtaggaacggtgcaaacaactctgaagaagggcaatataaatgttttgtacaaatatatacctgtagtctggtacgaataacgggagttcttcattgaaaaaagcagatctcagctcagcggtagtgcatttgtatatctagaagtagctatcaacttgtcaagtgtgaatgtgtgatttcctgaacatcttaatttcccacaattaatgaatctctaacaaaaaaaactgttgtatatttacctgttgtgcatttacctggttaagtggtgtgctgcttctgaactccttttaagtaccgttcaaaccctaatctagctaccaactggagtgattacttgattagtgaaggagcattgcggggttcataaaagtgtgagcagatagttacaaaccatggaggcaatggatattgtgtaattagcagatcatattcaagcctgaaattaaaaacatgtacaattgaggtccaacataagaatgtgacttagcctatgattgtacactgaaatgtcacttagcctatgattggacactttctcattagctgaacatgtagctgaatattaggcatcagagtttgtatgtgggtaaacaacaactaaagaatacatcataattgatgacatgatccaagaaagtcaccctgtagggtggtaataacagtacttaatgaaaataggcaaaacattatcaaaatgtagaagtgtgatgaaatagtaaagttcatttgcaaaacgtagaagtgttttgtatggttagtaaaagtcccatgtaaattggtagcaagatattcacttagaaaaattgatattgcaagatagacaatattaaatgcaggttagtgggacacatttatagaatagcagaatatgcctgatgctgtacgctgctgagaattgcgttcatttattctttgattaaaagtgcttggtatgattgccactggcataatattagaagtgcttgatatgattgccactggcataatatggtatagtccgataataagaattaaacagagaataacgtattgcagttctgaaaatttgataaatcacctttgcattagaaaaaaaatatctcatcaaagaaaataaaactgaaaactgaaggtgaaatttagaggcaagtactataaaatccacaggaaagtaggaatgcatgcaagatgtagcatgaaggacctaactgtacatcggacaaaggatgaacagtgcaaagcctatacagcggaagaactaattgggaaatagtggagcttgaacgaaaccaatgaaccaaatctgctgacgctctgcacgtataaacatgatttagctcaaacaataccaaaccgatgcaataagctgatcaatggggcttagataaaagtagaagaaaagaacttgagaaaaaggaaacatgaagataaacatctcaagtcatacccaaacactgtgagaagacatctacggccaggaaccggatgcaggtcgaagaaatcgatatatgagaaaactcaagtgtgttgatggaattgataattgatttaattgccacagttgatgccttgcagttacctgaatttggggagataaccaaaggttttaga

SEQ ID NO: 65358 - DNA, 2390 bp, Oryza sativa
cactatagaatactcaagcttgacaaaggagggatcacaagtaaacatggaacacgcgaggaaataggtagtcccataatcccatgtactcctaattagcaaaacgtgcaattttagttgcaaagagtaaaacatttgtaaattagcaaggagggctaccggtttgaggaagaactggggagtgaagctcattagctgcaaacttgagggggatcaatcaataaaacatcacgcaccaacagaaaagagaaggtgagaatttcccccatactaccaccacaaccacatcctctagtaaattaaacttaaaacaatccatcaccactgtgtagtttttccctagcaccttagttcagcttttaatagaaaagaaggagcggtagcaggctagcagcagataaaatggaggaggaaagaataggagcacttacctaggggatgattgctcggtgaagtcgagctccatggggcgctggtcatggcgtctgggtctagagctccatgcgtgaccctattctagccatgggggggtccacttcttggagctgtgggttggagagcatagagagaaggattaagaggggaggtcttgctggtagcctgggcattgaggtcgccgagagcaacatggtggtagcagcagcagtactagagtagtagagtgaggatttgagggaaaagatatccactgctaatggcaaatggaggaaggaagaaggggattagctagctgatgcttttacctgcaggagtgataagaggggagagacggggagaggtttctgcaggtgagagaatagagaagaaaggaaaatgtggactgattgctagatgtacattagtaggctacacagaacaccaacctgagcatagtgacccaattctgtagtccaagtatagtttgataaattatctagcacatcacaactggagtttcggtacaataaaaaggttacaaatttgtaagcacatttgtatttgtaaattattgtatttctattagtatagtttaattaaatctcgacgcatttgacggaatacaacaagggaactagaggcggagtctggtcagttgggagcgccagctatttttgatttgaactacgagaattcaggcaagcgaacctttgatcttgatgatttgaattattttgcataaaccttattttgcttcatgaaactgtcaccttgcataaaatagatttaccaaactataagtcggatatataaggatgatgatagatactgggaggggcagttgatggagaaactgatcaccttcggaccttccaacacttattagggtgtccacagatggggattgactggaaacgggaccctttacatatggctataatataaggactaaaatcactctcacatgcatatgtgtgctgtataaaaatcatgtcaaccatatccttgttgcaaggcgagcaacgctttgtatcttatcaagttcttacactccgcatggtgtgtaatgatagatagtgctaagatgggagaccctataaaccccatagaacattagtacttggatgggagatgatataaaccccatcaagatagtagcacgtggtggagtggagtgtaatgtgctgaaataagagaagagcatctagctatctattagtccattaaattttctataaacgcttctaaaccgccacgtggcgctcctacaaatgttcttatatcgccacgtggcaggtggacccaatattttataaatcattaaattatactaattttcaccactacatcttatctccaagaatgaaaatctgtacacgctccactttccgttcgcatatttatcacgtaatatatttgaaaagaaaaacagaacgtgcacatatatgtacatactctccctccctccctgtctgaccctcttcccttccgtctcttctcctaatttctacctctaacaaccatacattataaaaattaattatacattaaacttcctacaaacgcttttaaaccgccacgtagcgctcctacaaacgctcctatatcgccacgtggtaggtggacctaatattttataaaccattaaattatactaattttcaccattacatcttatctccaagaaagaaaatatgtacacgctccactttctgttcgcatattcatcacgtaatatatttgaaaagaaaaatagaacgtgcacatatatgtacgtactctccctccctccctgtctgaccctcttcccttccgtctcttctctctcctaatttctacctctaacaaccatacattataaaaattaattatatattaaacttcctacaaacgcttttaaaccgccacgtagcgctcctacaaacgctcctatatcgccacgtggtaggtggacctaatattttataaaccat

SEQ ID NO: 65359 - DNA, 749 bp, Oryza sativa
atctgttgccatgcaatgtggagcattgtatgcctggatctatcgacaactatacatgagacaatgtggatataggagtacgatgtgagatttccgagatatccagtgtaaatacatggtgaaatgtttaactaggtcggaaacatgtaaaccacagaatataagttctcaaaaagagttttatttgaaaaaaagaactcaatgatagctatatgaaattagatgggcatacaaaattcaagataaaactcaactttgtttgtgagatattaagtttacaaatagcaaagaaaaaaacacaaataaagaatactctttttttcctcactgtttatcaatttcatatgtcctgaaattttatatggttgtctaatataaccttcctgtatgtgagatattttagaaatttatgcgatagttttcccatgtttaatatccactgcatgtttttcccatatatcaatgtgcaactacacattacccattgaaagttttcgcatgtattgcctttccggttagaagcagacaatacacaatttcaaggatgtggtacacggcccttgggttctgcttaataacaattgcacctgagacaagttaacggtattccattatacaaagagaataatgctcttatgccacaaagttggatgcgaaaactctcattttgaacaaaagtttgaagcctttactaaaatgccacaaaattgagtaccaattcattcttttaccacaatacagtgagaaat

SEQ ID NO: 65360 - DNA, 622 bp, Oryza sativa
atttttgtcctatccccacccttcttctctgtgtccagcaaggacagacctagctctgtccggccaaagtttgagccagacctggcagccagcccactcctgcacgtccgacgccccactcctgcatgtccaacgcgcacgccatctccgtgcacctgagctcggcatgagctatgacaccctagctccagtagccagcttcaaccttagcattacctccgcctctggccgccagcagcacaacaatatgcgtcctgccctcagcaactggctctgtgcagcccacctactccgcgcacggctttcctcctgaaagccagttccacgcgccctgctcccggccgcagtggcggacctaggtcctaggcctgggtgtaaaagcccatagagagacatacatttttaagatataattttctgttgggccaaacacagtgggcaccagcccgtgcggccaagctccattcacaaactcatagaagagagaaagagggtgcagaagaagggaaaattgcacatttggtgggttaaaatggtaaagtgtggcagataaacgagtatacaactgaactttgtggcatttttacaaagccaacaaatcatgtggcaaataagagtatgg

SEQ ID NO: 65361 - DNA, 5070 bp, Oryza sativa
attatggttgtgaaggccaacttttggctgaaaccccgtccttcacaaaatcaaacaagggaaccggctcccgtgccccacattgccaaaggtgcaggcggtggtgaacaccatcccgccggggaactccctgattttcatcaaactcaacatccggtgttcactcgctccaataacccacttgattgtcgcgcccggaaaaataccttttccagaacgctagtgtattaatccccgtcccaggaaaagctggggtacaccacacaaacatgatataaaagacacatctttattatatcgataatatttacattattacaaaggcacttcaggcctatggctccatcttcacaggcgctcaactggggtataagccatggctccacctaaacttcttctccaaagctttactgaagggggtgaaagatagagcaagaatgagtacaaccacagtactcagcaagtcacaccgggagatgcatgattaatgcaagggagtacaaagggtgataatataggggttaagttttgcaataaacagcatttaagagtcacttagttgcccaaagctattttataaagacaatcctagagctacacagtattattaatcaaggccctgaacccacacgaacctggcttaacccaaggcctatgatgattcagaccaaactggcaacccgacctaggtcccagctcgtcccaagccaacctaggccaaccattccacattttagttgttaagcaagttttaagaattaaaccactaacttgggtacattgctaggcttgcccataaccgagggcgcggctattcgaatagattatactctgatcagaggtgtacatctttacccacaagacacatctttactctgcattccacggccgtggaacccgtggtaaaggatgtgacataacccctttacccatcctagccgtgacaaaagcaccgacccaacctcgcctacggccggaatcccgagacaggtaggtaagattgagcccctagcagcaggacaccggccctgtgccatgacatcttgaataccgagccgcagcccgtgtagccttcatttgccctagagatgtccatcgagccccgacttcgtccatctccatccgtgtactcttgcaaggactagactgagcaccgagttaagccttacccattagacatgtggttagtacggtagtgctttgcaacagaggcccgaagaccggtccttatagtggctgaggtgctactagcagaaccatgcacctcgagcccagcctaaaaccattttgggagttttgaatagagggggggaggtgtgtgttcaattccaccacaagccaaccattccacagtgtccaaatgatatgagaactcccaaagtctaaagttataaaaccacctagtgttgcctaattaatcagcgaagcatctacctaaattcatactagtggaaccgttaatagagtacccactagttggggttttgtttatcctagggtgaacaaggtaataataacaatagcaataataataaggtcataacaaaggtaaataggcatggctaaataaaacagtgataatgcgggaatttatgtaaagcggtaatgcaataatttaaatcaaaataattttataaactgggattcaatatgctaaagggtgatgcaacttgccttgctcagagagaacggccttccaaaccttcgacgacgaccgcgaaccacactttgggaacctccggaacgacagaagctacgcgaagcacacaagcaaagctacaagcctataaagaagcaataataaaacataaaaagaaagcacagggttctttaggttataacaaacattaggagacttgaacaggtcgattcggagctcgtatgaccaagatatggtcatccgaagtttaatgctgtcacgtggagatttacgaattattgtaattaggctttgcaactataaaacatgtgtaagcgctagcctggaaaagacaggaaggctgcgccgttgacatgcggaccccacatgtcaatctaagggaccacggtggaccgggtacacagagacggtccacgggtcgaaggaagcagaccccgtgtgtcaaccgaggcgagtggccgacaaacggactccaccagacaccacgcgggctgcacacgtggaaaccacgcggctaccgagcgggcacacaaacacggtcaccacacgcacccacgaacactactgacaccggtacacgggtaccggggttgacaaccgcacaacgggcacggggcaacaccgaaaggacgaggacggggcagcgagaggaggcaccgttaccaccacccgaaaaggcgcggcacgacgacgacgaacgggcgcggcggagacggctcggggacgacagaggcaaacgacttcggcggcgatccttggacgaaggcgagacgcggccggcacgaggcttgacgacgcggagccgaggacgaagacgacaatagggctgcagcggctcgcttgacgaaccacaggcggcgaacgcgatcggcttgacggagggacgaacgccacgacgaccgggtacgatgggaggatgacgaccggaaccggtgaggaggcgatgagggcagccggcagcagctgcacggatgcgaggacggcgcggaacacgtcgctgtgatgacgacgatggttgcggcgcagcaagacgacgagcggggcgaccgacgggacatcgacgacgaggacgaacggagacgacgacgatggactgcagaggggtttgaatgaagggaaggcgatcccgaggacgatgtcgccggctcgccgctgcgatgccggaggttgtggtggcgcggccgccagcgcacgggtgaaggaagggccgaccgggaaaattccgtcgaggcggatggagaggccggcgctgcacggcggtgttccggcgaaattctgtaacatacccaaattctagaccttaaaaatttcctatcaaaatagttggaagctaacttttccatttttgagagctaaaaatttccatttttaacctaggtgtggtcaatctaacttgaacctaagtaaaatttgagaacaaattaaaactttttcatttataacctaggacataaatgcaaacacgagtaaaagcatgcatacttgcataaaacatgttttgacttgagtccttcatgtgcatttgaatatttgatttgcatttcataataggtctgatgaatattaactaagatctagataaacaactaaaccattatggcctagtgctagctagaggaagttaaaatagaaaccatacaccttaaaatatatcaacatggctaatgtcaagcctcacaaaactaatttggacatccatctgaagacatgtcatgaacatgaaagtgaacaaataaattatatcatatagggtatattctatcttaatcatctctaagcattctcttaatttaatactaaagtaaacttatgcataaataagtaaggagcttatgacatgtgtaaggtaaactgtaattctatcatatcaatatcacctcaggttaatgagagtccaaatataacttttataaacatttacatgcatttaggaaagggaaacacatataagacataagtcttgcgaattatctaaaataattcgtgcaagataaaatcatgggaaaattcctgtaggctctactcaactcatacaactcactgtaattttggtataatttaataactaaatttggtacctcaaataaatcagtcaaactaataaaaactagattaaccgtagttcttaatcggctaaaaccatactttatctaaaagtgcatttaactgcataaaagtgtataagtaaaataatttattcaaatactaggtcatttatcatgaataaaaataatttttccagaatttatcttctctgtttaaattactaaagtgggagagagaaataatcctgaaaatcattcaaaacttttgttcacccacgtttctgcccaaccctctcaccctagcttagtttgccacgacctggacccacttggcagccactctggctcgtcctcaccttgtgcaaatcttccagccgaccagagacagccgagagagagagagagattggcgccggctgtgtacgacgcgtggccacaatgtgtcgacgccatcaaactcctattctagccttctcctcctcccagctgcatctccacacatcattctccacctctaagccgaagaaaccgagggaggaggctctcaacttctccgtcgccctcatccttgctgccggccgcgaagaagacgactatcgtacttgtaaataagccagggtaatccccatctctttcgcgttccatactcttctcaccatgccgatgatttatccttttaatttcatcctctatcgtgcagcggatcgacgggaacgccgtcgtgcccacggcactccggagcgcgctccaagcgccaacgcagccgacatcgtcgtcgttccgaccattgtagaccaaacaaagccgagccgtcgcgccaacgtcttctccttgaagtcttcctcaaaaaccctcaaaaatcctaggcaatggcgcagcaagtgcggagatcggctaccgtcttcttcacctccggtcgccgtcgccattgtcgattccgccacctccggtgagccattgaccgattcttcgcgtatacaccatccctgggacctcactaaccccatgaaaacacatggatgtcaattcgatgagtggatcgagccgttgccgtctccccggagctctacaccgtcgccggaccatcttcttcaccgctgccgctgtccagactttcccgcgcctcgttcaaggttcggtgagcacacttgagcccataggattgcattcatgcatttcattcacttagaatcgagcaccaactcaacatgcagtagcagcctaagcacagccgccgctcggactcgccgccggcgttactccgatgtccactgaccgagaaaagtagaggaatggaatcacaatagcatgatcgtcattttgtcttttggtcgcaccctcaaccgagccaccgtttgccgctgg

SEQ ID NO: 65362 - DNA, 11289 bp, Oryza sativa
ccaccagtgactactgatctagaaatagtggtatatactactgatccagaaaaaagtgaaatatagtaccgatatagaaaaaaaaagtatatactaccaatagccaatgtatggtggtacatagtatgatctagaaaaagctgtatgaagtgctatgcaaattttaaacgtgcccattcctcggcagtgtgcatgcatgcaaaaatttgaaaaaatagaacacctacggatggacatgaagaaatttgaaaaaataatattatttatttctttttaatctaactattcattatcaactaatggatatccaacaaggaagagggagtacatacacatacacctaggtatacagaagagtaaatgattccatacacctaggagtacgtactccactagtggagaaatcatctttgcccggtcgaacaaaaaccacaatagtctcggatgcagtaaaaaccaggactaaagatggtttttagtcccggtttataagtagaacgggactacgtgatctttagtcctggatggtgttaccaaccgatctttagtcccggttcacatgctatcaggtgttgtcaggcctaatcccggttcgtaacaccacccgggactaaagatcacgtgatctttagggccggttggtgttacgaaccgggattaaagatcaaacacactatataatccctattatttatcatcttttctcgtccactcttttctcatccacacccactcctctctccctccatctctaatcttatctcttcccttcctccttatctcttttccttcttatcccttcccaactccccttcccaactcgatccagtgtgcgcagcaggaggcggtgggcggcccggcgcggccgccgtcgtggaggggcggcgtggagggccgcgtggcggcggccggggaggaggggaggtagtagccggctcagccggccggcggctttgcttcgttttttttctttttttttcaaataatttgtgatccatgtgtagtttgagatgaagaatctgtggttcattgtatggattgagatgtatattttttttttgaatcttatggtatggatctgagatgtacatgatttgtgtatgatttatatatttgggatgtttctttgatttggggtttgacttgggttgtataatctgtagtgtatatgattgatttttgtacttgggatggtatgcatcccacctaatttgggagaaaataaattagagattaaatagtaagtaaatgaaaaaaaaaactattgcccactcccatctttagtccggttggtaaatcgatctttagtcccagatatttgaaccgggactaaagattagggatctttagccccgaattcgtagtcccggtttgaaaaccgggactatagggggttatgaaccgggactaaaaacgatttcttgactagtgctcccgctcccatctaccgtccatcatagccaccccgaagaagcccgttaccggattcacagaacggacccgttttcatttttaacaagaaaaaaaacataatcttaattaacccgcggtaatcggaaaaccggatagataaatcccttttcccagctcattagatcgataaatcagttatcagtggagacctcgatcttcggaggggttggcatcgttgccgacaagggcagcatatctacatcattgatttggcgtcaacgacgagtcggaagcgacggcgtgatccatcggcctggtgtcttctgccctaccggcgtcggaggaccacggaatggcattggctggctccgctcgacagaacgagaataggtctaggtattggcgatgcgctgatctactccttttctccagttcgtttttctttccgttgtttctcgcttattaagcggagatcagaacgggttataggtcagctgctagagtgccgcaaggattaaaacgcacagagatcacggtggccaggtattttgtctaatccaattgatcgtctcgatctcgatgagatccggtaagcacctttgttagttaatttcaccattagttgtgatttgttttcatatatgtctagtcaaggcagccgtggcggcctatcgctactaccagatctccaggatggtggtgtgtactgttcttagtttatatatgaaattctgaatcacagatccacactcagatgagtatacactatttcttattcttcttccttttaatctctgtacgtacacgtagataaaaattaatcctagagttcagaatgaaaaatactgtgatttggatgagaaaaaatgtcatcaacagatggtagattaattgtcctttgcatgcgtgaatgttgttccaggatagtggtttgtgatggatttctttagttccttgaaatttgaatgaataagcccctaatctttttgttgcttgcaggtggtgtccggccgcgccggccgtctgcagaacatgtcgactcaacgccacaatccaacggcaccagcggagagaatatacacgcaaggggaaggatccttgtttgacaaactgtgatttggatgtacattattacttttcaatctgcgattcagcatgttcaatttgtgttcttgatcatgttttctcgtctgtgaggctagttcttttggaactacatatatctttgagaatatactaaaacttttggatcataatacgtgcatgcagcacgaacactgagttctgcgacagggtaaaagcaagtaataaaaatagcatatatactgctactatcttaaaaaatagcatatactgctactgctaaaaatggtatatactgcaattatcttaacaaaagtataaacctgcaccttaaaaaggtatatgttactaccaccttaaaaagaagtatatatgtatattgctaccacctaggaaacagtatatatactagtcttaactgaagcacagtacttaaactactttggtgaagcacagtactaagtaaaaaaaagaagtatatactattaaaaaaaataagtatatactgtcataaaaaacacgtatgtgggatatttatctgtatatatttctctacatcaaaatgaagtatatggcagctgcctataaactgctgcctactacaaataaaaaaaaacagtatataccgttgcttactaaaaacaaaaacagtatatactttcatgcagaaatggcagcatatacatagctaggaaatatactgcacgaaaaaagagtataaactgttacctactactaataataaaaaacagtttactaaaaacagtatataccctatatgggctcttctggccccagcttcctccaggagacttccatgtgggcccctaaatcagtgacatacattctaggcccatttgtgattgttaaattggacttttgggccttctcatgcaattgcagatcaccagcagactttcgactgattgattgatatatttccacatccttctcttcatttatgagtgcttctcctgcatacatgttagtagcatagcatatagtggaagtaattattttatttgggaattatgcattgcaaccataggtagtcttcatatattggataatattgacggtcgaaactggtcgacaacgaccgcttgttcttgtacataagcgaggttgacaccggcctcaacatcatcgacgtcttcgccaagctaatcctacagaagttcaccgacacgatgaacaggagggagctactcctccagagcgacaagaaggcagttgcggaggccttctggcggggcatcatggatggaagggtcgatgacatggtccccacggaaacgatgaggactccgtggcgtagtggcagccttttacctcacacgcaggggtacacacatgaggagcagcagcatgattgcgcagctttggccgtggagccctcgcggcggagcggtgtagcagtgaggacggggcagcggggcacacgtgcgtggtctatgaccttacgcacaacagggggcgcgtgagaactgagaggagcgtcggaagaagaccggaagaagggagaaacacaagcacaaaactattgttttatgtggtttctctctcatcaattgggttgatattatattggcagggccagaaagttttacaatatagaacggagggaataaaaaaaattgatagatggaaaataaattggtaaaaattagtagatgggaaaaaagtagcactaagttgataggttgggtataaaatatcgtcgcggatcacaaaatatatatcttacatttgggacaaatttaaagggcaaaatcatttatattgtgggacggagagagtagttatatagctgaattttgcttctggcctgtggtgcagttgcttccaaaataataattctctccgtctaacaatatatttggagctttttttctggatattaacaatgagtatgtgaataaagagttagtattgaatgagatgagtagttatgtgagaaaattaaacgagcagtagtagttgtgattggttaagataaatagattgttgtagatattcgtatattatattaaataaattttaaactatatatcattatatttctagacctaatgattaaccaaggaaaaatgcaaggatttgacaaaaatatagaagccaatgctaggcgcctaagtgaatggatatgaaacaaaaagcgagcaggctgtctatatatgggcaattagttgcattaatatagtagtttataattgcaagcatggcactacatcacaacaccaaaaagacatgccgtgatgctagaacagccattgaataaattagaaagaaaggttgtggttaattagttaacgaccaatcgagcctactagtataaattgtacctcgttgttatgaagtaattcatcctgtagtaacgaaacaagcagagagagagagagagagagagagggagagagataaataatatacagaaatgagcaggtcgagctcgagcatggccaccgtcctcgtggtgttgatggtcgtcagcgccggcggcttatccccaccatgtgcggccgctgcgaaggaggagaagccagtggtggtgctgccacctgcggcggcgccaggggaggcgccctccgcggacgcggcagcgttcgtccgctcctgctgcgacaccgccctgcaggccgaccgcgacggctccagcttctgctatgaccatctcctcccctacgctgccttcttcgagggcaaccaggtgaaggtcgccgaggtggccgccaccatcctaagcaccaacctctgggtctacgcatgctctctagctacctactaagtggaagtacattattttatttattatacttgttgttaattcccatgatcgattagtggtgttgtccacgatttttggtaacattgtttttctcaattttctatttcatatattcccaactctcaattctacattatatatcattttttcattcaacttcatacatacaattcctcagttctttcttatatataggccttacgctaaatttcttttggatacacaccaccgtcgattatatcgtgcatacttttgtatttcaattaattaattgtgatacttgcttcccacacattgatcgcatgcacgccacatttgtaacattgttatcaaatttcggaaataaatttatctatcgtgtgaattatttcagcttgcatgaatctttctttttattttaagcaacctttttctggtcaaaacaaactacacaaaaagatgacaaccaaaatatgttgatatattattaggagtatcctgattcacaccaatgctaaaacaaaaacataaaattacaatagaaaaatgtaagtaaacatcaaggctagagctaggcatttaatgctaaaaataaatgtcaatgtgtagctgtgtgaaccaaaatagaaaagagaaaacagatagttagttattgatcgtccttgttcctgtagagaaacttgtggagagtatgcgtaccgggtaccgacacggcctccatattcgactagagataggagtgggccggatccatctattatgtactagagtgggctgtctggcttgttttctactttgtaaccctgccccccaacctatataaggcgggcaatgagcccctacaagggcatcagcacggataaccacaatcagatcatcagatcaatatccacctggcggatacaaatccccaaacaggtgtagggttttacctctcatcgagagggcctgaacctgtctaaattcttgtcttcacatccatccacttttatgtctcgtgcgatactctttttcatattgccgaattccagtttaaacagttggcgcgacaggtaggggaagcgtcgaattatccatcaagaagtgcaatggaaacaacttcaggaatcaaaggcattgtttttgctcgagggcaatctcaatgagatcgatgattctaatctctgacgtcgattggtttgtcgtttcaatctatatgaaatcttttttgacctgaaatactgccagggctttgccgagcagtgtaattttatataactcaaaaaatatttacaaagttacagtcgaaggagttaaataaaactataaagcttgcaaccaatcaaaaacaatttgctttaagggatccttcattctgcacatatacagaagaacttctttcacaatctatataatattattagcttgatttataatcatggattgatctgtcgtacgatgtcttctttgcatgcatgtacgggtggctgatgaggtccatgggccgccgaaccagcacgtctgcccgggagggaaagtgaagtcggtgatgcccgaaacgaatcccatcgcactagtcggcgaaaaacatggcgcaacccctacctgacgcgccaactgtcaaaacaagattccggcaatactaaaaggggtagcaatcaagctggaaaagtggataggttaggacgtaggaggcaaaggtttatacagccagggaattattccaccgagtgtattattgatctgatgatctaggagaaaagttatgcccctaggtacacttagacccgaccttatatagggagaggagccaagattacaatgtacagcccatatggcttacgtactaggctaacgaatatgtattacaactgtagctaactggcactactggatatttccttgacatacaagttaacataattcccgagtcatttcctaaacatattctatctatacaagctattacctataaccagtcggatatacgtgccatgtgggtatgtggtacccaactacccataatctccactctgtgtgtaagatgcatcccttcatttgtaggagtcaagtcactatctttcttcttgtgatttcttctagcagtctttgtcacatccttattttcgtattaggatttataaattatttaataaattattattaaaatttatattaaatgtacattaataaacaagtgaagttaaatgtgggaaataaaatttcctaaatataaagcaaggatggattaaatttttattaaattctacatggttaattatactctctgaaattttctcggattttttagagctcaattactaattttaataatacaaagaacattttaggaattatttaaatattaaattagtcattaaatgatcttatcttaagtttgttaaatactctaagtgtccaagcagttgcgagatttttcttgaacatatttcagtatttgaagtatttttaacaattcaaatatcatttcagtgattaatttagttggaaaagtaattaaaatactttccaaagctcaggtcttaatatggcccatctctctccttcagcccagccgatccagcagcctctttctctctgtcgaagtctgctttgggcctgtttgggggagctttagattctgagaagcagctgtttggtagccagcttctgagaatgtggaaaagctctgaaacccagcttctccagcttttggcttcttagttcattttttagaatctataactacagattctcagaagctgtggactgtttgaggcagcttctaacagaagcagcttttgggaaaagctgcagctgggagaagctcccataaaccgggcatttgcttccctctttaatcaggccttggaagatgaagcccagctgaaagtctatacgttttccctccagctacagtgtcgtcttccagctccagatagagcccgtgcagctgccgagacgctgccgtttcctccgcctgattcgctcgattctctcagccgtttcttgaattggttctcttccgtttccctagactttatcccttttaattcgacacggaatcgagctcggattgagtttatctctgcaaaaacaaaccctaattttccttcaacgaatccatccgttcccgagccgatctctctttcccactcctataaataaagtcccctccctctcctctttcggccgccacctctccctatctctgccgtcgcttgtagcgctgccgccgcgttcgcctactcagtctaccgccgaccgccgctccagccgcatctcgccgtcgccctggccgtcctcggtcttagctgcttcctccctcggctccgcaaggtcaagagcaagcccggcagccatcttcccgaagctgaaacccattggaatcccctcatcgacgtgaagccgatctactccacctccggtcgagccctgtcgatgactccgtggtggtcggttttcgccgtcgtcttcctcagcatcgcagcgccaagctgaagcccggccatcggttttccttcgccgaagattgccaaaatgtcgccgtcgtcttctcttgtccccaaagcagttgttgcttctatggtggatgctagttgttgagctggaagtagtgggttcctaacaatctggtatcagagccagcctggtttcccccatctagctcttggtctagttgagaaagttctcatcaagtagggtgccatggcaatagaagacaaattggacttgctgttgaggcggatagaggagtacgagctgaggcgagaggaggctgatcggagaactagagctgatatacggtctctcatagatgtggttgaagcatgcacaccggaagttgggaagaaggcaaaagacttgccagcgtcaattaagaaagagcagtcaaaggtgacgcccaccacatgtttgacgaaatgctctagtcccgacatcgagcccaaactcacactggttgcgatggtcaaatgtgccgccactgccatggcctccatgaagttggtagctgataatggtgcaaccagcaccaccaaaattcccaccactgactattccaaggagacgcacgccaagtgttcgatgttgggcttcgatgtcaagtgggacgccaacaaagccgacatcgcgttcctgaccaagacggttgtacttgagaccgttccagcatccattgcatcattgagcgccttctcaccaaggatgatcgccgacatcaagcattacacattgatgcccaccaggtattcagcgaaatgttctgggtctaacaactctcaagttgtgtcttatttgtccttcttaagcaccccagtgttagtggaatcagttgaaggacatttgttagttccatggcaactgctgttgcaacactttgaggttgatccatggccacccataacatcaagggatcaagagttgatcatattggagtcacagttaatgtcatggctggcattcaactgcagctgttgtaaagtacatatactgccaccttggccccctccaaccgaagcgaaatggtttcaactctttgtgggcaagcaattttcattggtaaactcgctgaacattatacatgtcatgtttgggccactagagtgggatccaggtgatggaaaggtccaccttcgcaaaatattaatatggatggatgattggttcccacaacattattttcattggaggtaaattttgtggagcaataagctgaaattcaatgttggagtgaaaagtgagttgtcctttttgatcaaccttatagcagccactagcaaggaaggtatctatgctgctggtgaacctgaatatttacttttggggctatcttttgttgaaatggaaagaaagggcaactgctacttaagttggagtcacttacttcttgcaagagtgatggttgtggagctgagcagtactgggcaatttggttctgtgaacttttccttcaaaggaaaacatgttgacaagctcagactatttgtcatgccaccttggctgccattagtttgtttgctggaagttagagaagggaaatgttgcactactgattctgctgcaagtataattccttggaatgagcaaaagaaaatgatgattactgaaacttgcacttgctttgagcaaaaaatgcagaagttttgggatctgactttccaggtcagtttgacatcacttgatagcaaggaaagcaatctagttatttgtgatcctaaatcattatctgtttggttatcatctgttgatcttcaggggatgttgctcaactactaccaaactagagtggagaaatggaatatgagaataatttgcatggtgatatcagaatctgagtcatgtttggaatcaaattacattggtttgaatgttgaaggagatttgctatatgtgattgctgatgaaaaaggccgcaaaagggtgaaagaaatggaagaagatgctaattcaattcatgatgagaagtatacttttgggttagttcctatagtggtgttgatcaagcgaggttgtcactgtttgcagcatatcaaattgttgggaatcaatgttggcaagcgattcgtaacagtgctattgtcatgcatcacccaggtgtactttacatggagtaagcagttattcaagctaaagctacttgctctattcttcttcaatgatggttcattgtctaacaccaaatatttggaggaaccatgggatccgagaggtgtattccatcggcttttggacaagccaaatttcaagaagaggggattgtcaggatcccgggtgggccgcacacgggctggtcagcccatcgccatgaggcccaagcaaacggaagggagcagcatataagcagcagcatcgacaacaccagggggcatcgaaagatcatttggacttggcagagcagaacctcccggcggcggaggcgacttgggtggccggtgggcaccctcgtcgatctctctcccctacctctcctccgatctccagccttccctctcccctcggttctagaagtttccagcacttgtattccatagcttcttcttctcttg

SEQ ID NO: 65363 - DNA, 2722 bp, Oryza sativa
gtgctgcagtgatgcagtgtgctggacatgcctgatgcatggacctctttttttcccctctttttacagtgggatggatggggaggaggcattgtggagttttgattgtgtttgaatttgatagctttgggatgaaaaaaaaagaagaagtgttcttgttagatttttattttgaaagattataattggatgcatacggctgtataggcatgtagtagtatgcgtttgttctcttggttgttaatactacttatgttttttaatatttcatgtccttaattttttatgattcgtttgattattcatcttattaaaaggttttgtgcaaatatataaaaatatagtgaagatttaataataactcaagtcataagaaactaaattgtaataaacatatgaattttataataagttgattggtcaaatgtattactataaaacaacaacgaagttagatattaaaaatggagagagtataacctcggacattagaacatcaaagagaatcggtaattcgtgtatgatcttgcacatttctccattaccattctgaaaaataaaaatctttaaatccaacttctcaattggtttcgtcatcacaggatattcaattaaaaaaaattcaacaatttactttttttcacactagaatttcccacaatttttgcatcgtttttgtgttgattaatcggcatatgattcccaatttaaagatgctttgttctgatacataggtcatgttcttttttccaataagagttgaatgaaaattaagattttcgtggcacgcttttcgaactactaagcggtgcgtttagtgctaaaactttttatatgaaagttgctctaaaatatcagattagatttattttttaagttttataataattaaaactcaatcaaatcatatgttaataccatctcattttacgtaaaaaacttaatcttcatcttcaaaagaaaagagcaccaccacagtggtagcatggctttactaggaagctgtctagtacattaccatattcattactgaacaagtttgcatttatgcagttcacgatctgatttttactcctttcatttttcaactctccttttacaaaaccgctttcaatatttatcaatgctctctattattagtttacatttaaccaccgataaattttaaaaggttaaagcaatgatgaacgaaagctatgcagcataataacttttataaataaaatggccaaactttcaaatatatactaccagttaaagcgaattcaactaaaagctactaacttcataaattattaagtgaagtgttactgcagattaaacttggatgaattaatattttcataaatgcacttaacaaaatagcttaaaatataaacacaaggtctacgcaatgtggtagaagatttttttctagaaaatgtatttttcaaagcattgagcaaataatatgctttaaagtttggtgaataatttgaaaggaataaggctgagttattttgagcactttgggttagctactcccttgtattttgtgagaatatttcccgaagtgttaaatggtatgtgttttgcaaaactttctatatacaaattaatattctgaaaaatcaaataagtttattttaaagtttataataattaatacttaattaatcatgtcctaaaaagttttcttgttttacgtgcggttgtttagcactgctcgaacgaacggtgactaggccctgttagaggataattaattggtaatcagcttctgataatagttaagttttataacttcttttagtttttactaaattctataactcaaaatcaaatctgaatgagaatctaatttatttaaggggattttaggacaacttacagtgcccagaaactccccaacacggggcctaagcccagataaattaacaaagccagtgccccagtataccaccctcaagtttttttcttttttttttaaaaaaaaggcccctactgtggacatgcgccacgcggatcgatccgtggaaaatgccggttcgatcgcccaactctgcctgctgccaaatacgcgcccgcgcgccgcttgatcaaccgatcgatcgagactgatctccaggtgagaaacctgcgagaccgatcgatatgatcgaccgaccacgcccgcgtccaccgctcgtccatcgaacccaacccctcgcgctcgccgtcgcgcgtgcgtgcatgcacctacatcaacaccaccctccgcgcgctgccacggctgtggctggctcgcgctgcgtgttccgtgtgcgcacaagtgcaacgcacctgggctagctgggcgcacccaccacttataactaacggaaagaaagaaacagagaaagaagagagatgaaacgggaaaaagaaaaataaaatgcgatacgacatgcaacggcctgctgctgctgggtgtggtggtgtgggtggtgaggtcgtccagtcctgtccaggtgcatgcactattgcgcccctttttccttcctcccccagcttctttcgcccttatcaaatccacagcttcgtcttaattagacccctgttaatttaaaaagcttaagaggcagcttgtcagtcattagcttctgagaatccagcttaagaacccgcatgtgacttctagtttattttcttttttaataattttttagtttattttttaagtccgtagttactccatccatccctaaatataatggattaatga

SEQ ID NO: 65364 - DNA, 3875 bp, Oryza sativa
gaagcagttgtttcatagagtaaaaaaaatgcattcgttatttttcttccattttcttgtactatcagctagggttgtgtttagttcagcgcaaagtttagattttggttaaaattagagatgatgtgacagaaaaattatgtgtgtatgataggttgatgtgatggaaaagtactgaagtttaatccaaatttgaatctaaacataacctaggttgatctactacgcggtttcgtggtggcctcttgtgggggtttgattaatgactcggtgaacagaactactaataatcgagagtactgaaacttacacgtgggcccatttcagaccagtgtttgtgcgtggggcccactgtcagtggctctacgcggtcgtccctcttgttgaacgagctccggagtccaaactaccagtccaccatggaaaggtcgagctgacgtcgtgtgaattgttctttttttttccctttcaagaattatgatttgtttgaccaacgagttgactgggagaatttttattttttttataggtgagttgggttgtatacgtagaatttgagtaaaggtaggtagctcgaactgtttttctatgttttgatgctattataaacatggattttaattgtacggtttggagtttttacctgtcaatctatatattgctcttttaattctccccccccccctcctaactcctaagtggctttgtttggttaagtgaggtttaaatataaactcataaattgaagcatttctcacatatttatgcccatctcacattacacagatattaagaaatcaggtaaaattaaataaaagaatattgtgattggtcgagaaaatgaagaggtgaagaatttgaatggcaaaatattataattgattaaaaagggaatatgagtggagaaattgttacactttggagtataggacaaattttgaatggtataacattattatattttaggacgtagggagtaggtgattaattaatacatcgccaatctgtatgtaatggccaagcttagaaagcttaatcgataaaaatttcaagattatgctaccaagtatattagaagaagaagaagaagaagaagaagaagaagaagaaagtgaaagaacaataattttgtccaaaagaagtgtactccgtattctctatagaggagggaggtaaggtacatatcaaaatgagatgtattcatcggcagacggcacgcctatagttgctcctattctacctttcaatcttctcccaacaccaaaatagggtgtatttgaaaaagacatatgatttatttttagaaaaagaagataccaacgttattactatttcgtataatggactataccttattgatactactgctttcaataaaaagtttacactgtttagtgataggcatgattagctttaattatttccccagaaatcgacattgcagaaactaggtcagcttattgaataaagatcacttataagatgattattcttccagcagaaatttatttacatgtcaaaatttttatcatagtcaattatcataatcctagattatatatatacttgcaaactcatatgcttgtatgtcacatatcatttaacaatagatattccgatcaaattatcacaaaattatagatttaacgtgtaatttctcacataactatagatttaatatagagtgtcacaaaaataaaaatcaagtagcaaatttatcacataactctaagtttagtgccaatttaatcacaaaactacaattatcatagctccaatatgatggcaatgctatggatttaaactcaatagttttatgataacttcaatataaatagtagtttcgtgatattcggttttgtgataattttaacgttaaatatgtagttttatgacacataaattaaataagtatttttatgatagtttgatcaaaatattaatagttttgtgaaatttactcttaacaatattatatatgctattcaatagcaattgctgaccatacaaaaacataacacttaatttgcagtaaagaaattctctgattaattatacacagctgctaaattctctcctcacttcaatccaccgtgcaatacagctgtttttcaattcgcaacgacccccatcgctgaagatgaaagacaggtacgcatgtactattcttctactacaaatggagcttattgcagctttgtgggacagccaaacggtcagccccggcccggtggttgatctgaagatccattgcatttgcacctgacgcgctcacaacaatttgacaatttgaacctgatagtgcatgtctcaccaaactatatagtactatcaattttacatgcatgttcatcactgaattggagaaacatgcaatgaagagagatcgacatgacatatactagtacatactattccatatgcaactctagatctgaactcaacttgtgaaattgtggcctaaatagtctgtacttcagcagcacacaacactgttgaaactctctgagcttcgatctaggacaggcaaaattaattgaattagcagactggacacaccaatcaatcatcctatccaagtacatgcatcgtcgtcgtcgtcgtcgtcatcgtcatcaaccattgcagttgcagctagagagctgaatatatacacaagttgcagctctttccatgctctatcattcatcaagttgggtttaacttttaattctttctcttcacccttcttgcactggaccaagacctttattctttttcttgcattggggagctgaatccatcgatagattcgtgagagaaaggtaggagtagtaccatgatgcatgaccgaccaagggtccatccatccatccatctcgatctatactgtctactagtcttaaacaaatgaaatgtgtgagctgtttctcgacctgatcagtcgttcttgcaacttttgcaagttgcagcaataaaataacactggattgttgcttagatcacgcaaaatgcagtacaagaattcctaggaaatgaatgaattgctggctaggagtagcaatccagagtcttcttcatcatcgtcttggactgcactttctcggcctccatttgggtagttcatgtggccaggtgagctgaaccttgaatgcatgcttgtgcaatttgccgattgttttagctaaggcgtagtacgagggacggagggtgagatgacctaaagtcctgaagaccagaacgatgaaagaggaaatatgtcggttgctaattcatgcaaattattaatgcttgattaacttttcaatcaaacgcaattaatggttaattgattaattagtcccccacctacatcacttggcctgttttatatagtttgccttatggtgtcgtgtgttggtaatctgtggatcagcagatgccacggtgatctagataggaaaattagttcacagtacttcactcacatctgcatcttgagctatctatatattcatcctagctgcgacttgtgttaagtttatcatataatcgttgtttgattgctctctggttggcttctttttaatttgcagtagctagctatgcacataagaaagctagccatgcatgtatatatgaagaaattactgctattaagtaggagatcaagatttaaagttcatatatattagacaaacaaaaacacttctttttcctaaaaaaattagattaatagttctccacacagacgtggtaatagtcgtctttcaaaagtttatagcttaaaccacaatccctgtttctttttttttaacaagttctcctagcttgtttagcagccggttttctgaatctaatcccatcttgacgccttgacgtgtactagtagaattctagctcggacaccggcggca

SEQ ID NO: 65365 - DNA, 1591 bp, Oryza sativa
agctttttagcagacctgccccttggcttccctatgcccattcttggatccatctgcaagtctttggtcaccttgtcctacagcaacctatagctttgtcttctgtatgggcgggcatcttaagtgatacacctgggaaaaaccatctctattccaactccttttatattctccactcccatctctctctttctcccactcctacctaccctggccactccccctctctcccccactcctcactccggccacctcctctccctacctcccgcaacagggcatcttaagtgatacacctggaaaaaaccatctctattccaactccttttatattctccactcccatctctctctttctcccactcctacctaccctggccactccccctctctcccccactcctcactccggccacctcctctccctacctcccgcaacaacaggtgtggtcgacggcggtgcccccctccgctctcccttgcgcggagttgatggcgtgctcgagtgggaggtagcgggcgcggcagatggcattgtggtggcaggcacgggctccggcgacaggtgcagatggcggcggcggcgcagatccggcctccacgcgcgcagatccactaccgtcgacgacgacggtggtggccgactagggttaggattagggtcaggttttgatttttagattaatatttgtgattttccattttcacatgagaatggcttaaatgcccgcatgcgggtgagccatatggaaaaattgctatttcacggaccatttcggacagacggctggtcgaaccgcaattgattttgacagtttgaaaaaaatccctttttagtagtgcatgcttaaagtactttaactaataaaataacttacaacaaaataaattattattacgtaaatttttgaataaaacgaataataaacatataaaaagggtcgatggcatcatctatttaaaaaacgaatgtaaaaaacgaatgtagtatatataatctgacacacgaacagcccaagacagatatatacccaatagattcaacgagataattattatcagtgggtgtggttcgagaaatgacactaataaattttctttgtgccgcaatctttaatgcgttaacagtccgagaaaaaaaatgtacgagacgaatagcatatatatacttcctccgtccgtacatagtataagggattttgagtttttttttattgtttcatcactagtcttatttaaaaaatttgtacaaatataaaaaacgaaaagttatgcttaaattactttagataataaagtaagtaaaaaaataaataataattctaaaactttttaaataagacgagtgattaaatagtataaaaaacataaaatattttatattatgagacggagaaagtatatgacaaggtaccacgctatcgctacctactatatatacccagcatgaaaatgtcgtgagtctctctctctctctattggaatctttctactactggtagataaacaagtctttaatacgctggccttctactgatcaagaacaaatgaatcagaatctgacaaggttgccagaaataaaaataagcag

SEQ ID NO: 65366 - DNA, 1360 bp, Oryza sativa
gattacgaaacgtgaacgaacgtgcacgaaacgcttacgaacgtgaatgcacttgtactaaaagtgtgagaatgaacgcgtttatactaatacgatttactggtaatacatatatgattatatatgtaacttggcccgtttagactaatacattttcctggtaatgttgcagagaagacgtcgtcgtcgtccctcaagccgaagtggtagctagccatcgaaggaattcgcgcaggcaagtgatgtaaagaagtgattgttagatatttaatattagattgttagacttagcatatatgattattacaattttaatataagattgttatcgatttaatataagattagtagcgatttaatataagattgttatacttagcatatatgactattacaattttaatataagattattagagattaaatataagattgttagatatttaatataagattgttagacttagcatatatatgtatgattattacaattttaatatgagattagtagccatttaatataagattattagacttagcatatatgactattacaattttaatataagattattagagattaaatataagattgttagagatttaatataagattgttagatttagcatatatatatatatgattattacaattttaatatgagattagtagccatttaatataagattattagacttagcatatatatatatatatatatatatatatatatatatatatatatatatatatatgattattacaattttaatataagattagtagcgatttaatataagattgttatacttagcatacatatattattattacaattttaatataagattattatagattaaatataagtttgttagagatttaatataagattgttagacttagcatatatatatgattattacaattttaatatgagattagtagccatttaatataagattattagagatttaatataagattagcagagttttaatattacggtacgcaaatacatcctatatacctaacaaatattttttgtatgcacagatggctgatcgcgatgaggaacagatactatacgatacaatcgtagagggaagcagccagtactggaacgaaggagaggggaacgaggatccaaaccagtacttgaacgaggaggggaacgtggagagggatgcggaggggaacgaggaggggaacgatgaggaggaggctagtggaagtcatccctctgctggacagaagagggcacgcggacaacgaggtgccgcgaagaagatagagggtcagcacatcataactgaggatggacaaagacggccgacctagtgccccgacaggggcagc

SEQ ID NO: 65367 - DNA, 3992 bp, Oryza sativa
taattcagtcttcccactaccaatcagagaactgatgacactagttatggaagtacctttttgtgaccttttaaagtcaacaagaagaacctttaaccactaatttaattgctatataccggaaagttacgaagtgtaatatactaatatgattttttgtcttatcaagaacttactctttacatttttgtataaccatgctagacattcaaaacaataacttcggtgaaaacaaatatggtttgattgcatgcattcttgatagtgattatttgctggctggatggagtactatcagttacagtctacagcaaaggtcccatgtaaattagctatgttctttgttcaggtaggggcatgtgctttctattcttttgcatgtccccatataatgcataattatagacatgcatcttcattatgattttattcaagtgtattccttaattcctgcttacgtgattcaagagctgtactgttgcatcagctctctaagaagcattcgcatcatcctttccgtaaattgccaggccttcctattgcagcagtgtttcatccaagtcaaaagatgttctttgtggccactaagaaatttgttcaggtttatgatctccagaaggcacagttagtcaagaagttggagtcaggtgttcgtgagatttcctccatctcgatacatcctggtggtaagttatatgttagctgtatgttaattaactaactgctagatatttggggcaagagttgcttcacattgcattgtcctaagcaataaatcacttgtttatatcagtattattgcattactattgagttgattggtgcagtgatgatcttttataattctttcatttaggtgataatgttatcgtgggcagcaaagatggtaaattgtgttggttcgatactgatctatccacgcgaccatacaagacattaaagtatgattcttatcttatctttaaacatcttttcttttaggaaatctatagattttttttaaaaaaatgttttctgtgatgtcttacaaaggtaagcatcatgccaagcgaatttgctctttgctcagaaggaatgctgtcaattctgtttgaggttcatgcaaaagctgatttatttcctactaaaaagaagctgaaattcaatgttgtttccattacttttatcattacttattgtcctatcattgtttgctgagtttttttttctgctaacttaacattgatgttgtgtatttcaaagtgttgttatgtatcaaatacttgaatatggacagcatgggtcacatgtttttgctgtgtggtgccattctttccaggaaaatattccgggatgaaaacaagttctctgcagtcttaaaaaatttcacactaattataaatttatcataattttgagtatttattaaatttgaaatgtaaaaggttaaaagcaatgaaacattgatgccttctcttaattctaaacctagcgtaaataagcatagcctatgccctatgcatttccaaacatggtgcataaggttctgctccaatgaattatgctttgatttggattaaaagggatagctctgactagattttaataattctaaggattctctgagaggagagctactagttagtgctcaggaatgtcttcccttgttccatcttactcatttacaccttacataatccatattttttcagaaagattttccagttagtcaaaggattggctattattgtttgtcatccaactatgactcttctctttttcatggttcagatcacctttttttttttactgggagatcgcattattatgccctatgatcttttgaactccgatatttctattttgtgctgttgtaactcgtttgcttaatttcaggaaccactcgaaggatatcactaatgttacttttcaccggaaatatcctctttttgcctcatcctcagaggattgtacggcctatgtattccatggaatggtctattcagatcttaaccaaaacccacttattgtaccattggaaattcttcgtggtcattcaagttcagatggaagaggtacatatatatctagtgtcttttttaatttgcatcctctaacatgtcctttttcctgtacacatttctttacatacatgtattattagctttttgttgataaaatgtactaaccacatatattcctaaataattaagtcaatactgagttgagttgatcgagtaatcttagaactgtgtggatgcattgctgcaaattgaagataaatattttatttgttctctcctttttgccttttgggaagaagtttcttcttgttgtttcttctaattattagtgatatctttactgcattagtttaaaattctttgaaggatgccaataatgtttaactcatttgcttgctttattgttgcacttcaaaattcttcaagtaattttgggcacaatatctaatcatcagttgtgcctttgttggtgtgcaggagttctggattgcaaattccacccaagacagccttggttgttcactgctggtgctgactctgtcgttaggctttattgcgactaaaggtgctttcgaaaaaaaaaacaatagatggttttacaaggcaatgcaatatgtctggtctttctacgggctcgtatacgatgatggatggtgtatcatgccaaacacttaactggagccagggcacgtgttgagccatctgtgctgcctaaattttggttcaaattatttgtaccctattgttattttagttctgtagtaacagtgagacatgcagagtgttccagaatcgtggcaaaggtaggtgtgtactaggataaacagataaggaacaccgagctaatctatgctattccaaaagaggttttgtgctgtcacaagcttttgtggtctctgaagctgaactgaactaaaaaagtagtgatattggaagcttgagttcgacccaacttaggtgagttatagtgttcttcagtttgctaatggttttttatgtgttctacatgctctgtaaccgagcctgcagagagccttgtggaatgctcattgtctcattgtaacaatatgatgatctcaggattagtgtctgcgtacgcttctagctcggccatttacttcttctagaaccttctacattcttctcttcgcactgcaaattctaagcgagtgaaatggtcggtcagcacataagtagggttcgtagaatgatggaaatttatgtgcatgtacaatttggccgtagaagaaagaatacaacggttataagcaagggattatcaagtccacgaggaagaagcagaggcaggcaaattacatagtattatacggattataaagaagaaaccaccaccattacactaatacacacaaagctcgatcaagcagcttaattaatttcttccacatgtacgacatgcatcctctcctcactccgtgatcaatttaagatgattctttgcagctccagctcgacgacgatccatccgaattaaaatcatttgacctcctggatctcgtccagggcgtagttgttggtcgacacgccggcgtagttcaccttggcgaaccgaaccaccaccgggtagcgagtgttgggatcctgcatccagtcaattcaattcaaccattaattgattattattcattgcttaaaagtatttcttccttttgattatcgattggagtactaggagaattgaactgattcatgtgaaggctatgagatttgtacgtacctgatcaacggtgacgacggagccagtgccgttgtaccagtaggactccctcctcaggatcttcacctgcatccatccatgaacacattgcgtgattagttaaacgttaatacaatctaaacaacgcaattaaggaagctaatatcattagctaagcaaccaacgctcaccttggtgcctctcttggggccaatgggaggcggcttggcggcggcggctccttggtcgccacggccgcctcggcctccgcc

SEQ ID NO: 65368 - DNA, 2308 bp, Oryza sativa
gaacccccgggacaggcaggcaggactgagcccctagcagcaggacaccggccctgtgccacgacatctcgactaccgggccgcagctcgtgtagccttcatttgccctggagatgtccatcgacccccgacttcgtccatctccatccgtgtacttttgtttataaccagactgagccacaaagtaagccttacccactagacatgtggaagtacggtagtgctttgcaacagaggcccgaagaccggtccttatatggccgaggtgctactatcaaaaccatgcaccccgagcccagcctaaaaccattttggggattttgaatagagggggcggtgtgaatccaattccacaatactccaacaattccaaagtgtccaggtgatatgaatatcccaaagtctagagttgtaaaaccgcctaatgttacctaattaagtagcgaagcatctcactccctatcacccaaacaaactcagcctaagaagttttaggttatctctaagttaaacttttcatttttaactaactttatacaaaaatatagtagcatcgataataccaagttaatattattaaattcatcgtaaatatatttccttagtatatttcttttgtgttgtaaatgctactaacttttctacaaataaacatgattaaatttaaaaagtttgtattaggataaaccctaaatgacttatctctactaactgaatttgattgctcaatattcgattattcttttacctttgaaagaagaggcattgtcctcgtccccactattgtagtccccacataaaaaaactacccgaaaaaaccagcccatccaaaaaaaacaacccaccaaaacacaagatataaaagacagaaccctataaaacatgtgcatgacactagtaatataaacacggtggagtagtagttaccatggagggccctacataaataaaaaaacagatcaaacatgattcacgcaccacgaatgattaactaatccacatcaaaataactatttcctccggattgataatacttgtcgtttagataagggcacggtcttcaaaaaaataactttgatcattattttttattataatatgtataaaattgttaacaaatatatgattttatgaaagtactttttaaaactaatctatacatatagtcaccatatttgaaagataaatattttaaaaataattcataatcaatgattctaaagtttgatctaacccttctctaaaatgacaagtattatcagttcgttgggagtaaatccttatctaatgtgcaaccaaaatcaccattggctagatatttaggcccctccgaaacagagcaaaatcataggaattccagagaatttcatatcataggaattccagagaatttcatatgagaatggatcctttcgaaacaaaatgattattttctacctattcctttaaaaatcctatggaatggatcattctagaacatttttgaggaaattacgcatgaggtcttacctctggtgtttcttcttcatgtgtatagaattattgtgtttgtcatgtgagcattcaaacaacaattttaaacctttcagtgtttcgaaacactataggaatctaaaaagtgtggcattctactcctcattttttttctattcacgtgttttctcaatcctccgtttcaaagtatcgttacttttttgctagcacatgaactcgatcttggttgcactactgcagaacacctggttgcaaacttggcatacatgccggtttcgcaactgacaccaatgatgctaagtcattggtgccgttgtagaactggcacctttgtgctctccccatttcattggtgccgttgtagaactggcacctttgtgctctccccatttcaaagaaaaaaggagaagctggctccaaccatcggctcggcttgatgaggagatgctttggagccgccccttcaagcaacccctaatcccatccttcacaaatcacaaatcaacaaacaattctcattcccatccatcacagatcaacaacaaaaatcctcaccccatctttcacatatcacagatcaacaacaacacaagatcaagaactacacaagcaagatgaactcactctccccggtcccactgtcgttgccaatttgtgtcaccgacggaggagcgatgtggaggtcatcggtggggtccctctctgcgccgaggtctccaccagggttcctctccgcaccgaggttgccggcgttcgatccagtggcacgacgggcggcgacgctagatgcagtgatgggcggtggatatggatg

SEQ ID NO: 65369 - DNA, 5122 bp, Oryza sativa
gggcgcgcccgaaagtggccacccccgcacaaccgacgggaagccgcgcacccgcgccccgatggtcccgccggcgaccaccggcgcggcggaacggcgccccaaaaaagggaaggaagggggaaacgaatcggcggtccacagctcaccccggggtggccgcgaacaacggaaccgccaccggaaccgaagaaagccgccgcccgcttccggttaacggggacggcggcggttcggccgttggccggccaaaccgaagggttgaccaagttggccaagtttcggccaaaccgaaggaagcggcccccaaaccggaaaaggttcggggcgacgacggcggccagccggaagttggcggttaccgccgaaaaaaaaaaccaccaccgcgagttgtattcggcgaaaaaaaaaaaaccgcgagtgcgaaaccgttgaaggaagccacgggaggtgtttatataggtttggaattaaaaaaggccgcccggataaggggaaaacgggcgcggaagatccggccgccattgatgcgccggcgaggtttagggggaaagattccgaacgaatccgagggagagagggagggaaaaatggggggaaagagggagggaatcacggggaatatttccccctcttgattgcacgcgggcggacgggagcggcgggatttgcggcggcgcggccgctaggcgcgggcgaggcggcgggagcggcgggaggaaggggatgacgggtgggccccacccgtcagcgagggtggcgggcgggcccgcccgtcagcggcgcgcacgcgggaagaggccgatgggccgcggggagaggagagggagggggagggagatgggccgagccggcccaagagggagagggagggaaaggggactttttagagtttttctttttataaaatcattttaactttgtttatttcttaataattattatttgtgctctgaaaattccactaaaatttatttacgcattttaggcttttaggaaatatacaaaaatctcccaagccttatttgacttttaactttgcaccttttaattgttggaggctttcacatggattttaattattcttggcataatttagaggatgtattttagagtcgttttgggacgtgattatagggagatctgtctatataagtggcaaatatacataaaactttagtaaaggagtatgcatattaggtaagatcgactgaaaccccgatactacccttattaacaatcaagaaacaggctagagatcatggttctaaacacgacttagtaggtcgaatatactgatgcggcactaagtatgaaaagaaacatgatatctaaacaatcaagccattgactaaattttcagggtggtagatgtctaagctaatctaatctagcaacacgatttagccgataccggcaggacccctaaagcgagaagcaaccgatagagctaaattgatatgctaagactaaattaatagagacatatgataacgatggtcacgataaaaaggactaaaatatctaaaaatgacatattagcccacgatagcacaagccatcgagacgggttgcttcttgtgaagcaaactcgtcgaaaagtaaaagagaaaagggtggtgatgcgccaaagttgtattggattatctcccgtattacaatgctatggggttcatatttataccccgaatacaaacttagtccattatggacacgactcgaacctttctaaagataaaatacaaacaagaccatatacggtggtctcttaccaaatctctaacaaactgacataactatcctaattaatagatacaattgccttacatgagctctatctctgattggcaatgccggttatcctgatctaggcccatgccgagcccaagttatatcgtaccggccaagccaagcctttgtccaatttttagctgatgcttagtccgtcttggagataaacttgataccacaccaaatccgcttcggtttccttcttcctttttgaatctgatgcaaaattccattgttaacactaagataactgataaccagcagctacaatagatagattagaacatttaaaacgttatactaatccaccgatgcaaactactgtgacaagtcatacctctcatcggaagatcgaagaagatgccccaactcgaaacaagaactcattgagaaaattgaaaacaaaaagtttggcgatgcactgagagtatattgaactgttgttgttcttcatacaagaccctgggcatatatttatactcgtagtacaaaacttgttcatatcggacatgattcaaacttcacaaaataaacacaccagcccattgtggatgctaatatagatttctaaaacacaaaaaggaaagcttactcttatcctaattaatagatgcaattgcttctttggactctatccttgtatggcaataattctgaatcctcaatccgaactcatcatgaactcgaaatcgtatgtatcgactaatcaaatccaactctatatcgactgatacagactccagcagatgcattgtttcattttggaaaccaaactaactccttcaaatccgcttcggatccatccttatgtccacgtatcttaccaaattttgttgttaacatctatgctttgtggattctggctagaacagtcactggttgatgtgtacctgtacaggtagatcacgcatgtgcatgttgttgatgtagaatcgcgccgccacaacttgagcatgttatgtgcaacccacggaatcacccggagacgtgccgctgtagggtgtgggtagaggctgccgaacacacacccaggagggaccctgttagggtgaatgcgctctggtttgtgctagactcggcaggccagctaggatgtcctttaacaccgtagagacgagaggcggcgagcaattaggggatttggggagaatttacttgggattggaagcaaggagggagatgtagaatatagagggtttggataactaaattgagtttgacgattgagtggttattgtttcaatcgaacttgtcccccttatatttatattaggggtggacttacttcccatggtctttcccacgtccaattaggcttagaaatcaactaggactcgagaaatccctattgttggcggctgttaaatacacatttttataccgccagcatttgcataaaactcatataataaaacatccaatatagtggtaggtgttaattctaacatattccacgagtgttggtgtttaattgatgcaggtcctaaaccaccgaagttgggagaaaaatcagtctaaagtgaagaaggaacatatccatacaagggaggggctttacactttactaaaataccagagaatcagcccaaaactcacagtaatggataaagcagaacaggaggagtccacaggccaaaattgagggccagatgggccagcccagaaccctgatctccaccgttgatcctggggtttggcagggacgctcctgatttgatcctaatggcggttggagggcacttcggacaattctcgttccacaaccgtcattaactgcctatttaaggagtttcactcattcgcttcttcacacacttccaagcttgagctgaattataagaggctctgttgtactattttgtatactagaattaggaagagagtagagtagaagaaatcggaggaatttcggagatgtcggtaatcctctcatgtttattttattctgttaattactctattttcaatagaaatatctttctgagtaatttagatttacttgtgagtacttgtgagaattacctcttataagaattattgatcacaaacatatattgatctcgccacaattccgtcatcaccagccacgccaagcaccaacccgtgatgtgtttgtgcttctaacggtggctgctataacaatactgccatttttcatttaagcaggttgtccatagaagtcaaatttgagaacttcatctcttcagtcctttggctcacatagcaaaactctgagttatcgtatacatgatttgttagtaagtcagagtagcatatacgtaattgtagtgcaagaaacataacctaaattacccatgcataacttgagaccacctttttttttattcaaacaagtatggcggtcagattccatttccttcattgtggttctttggcttgccttagtcctgacctgcaatcgataacattgtgcaatacatctaaatgagaaaaaaaagattcatgcatggggttgaaatgaatgaaaatcaatgttgctgtccaccctgaagatgctattgccatttttccaaaacattgcattgacgaaataatgaccgaacaaatgaaaattcagatggaagcagtgctctgcacgtattgcacatgcaaattcaataatgcacacatgaaaatttagataagagcaggaaatggagatgcttaaagcatcacaaaaacaaaactctagcagcaggcctacctatgcatgatccttatccatatttcatatccacaaaaaaaaactactactattttgtagtcataatactgctaaaaatagcatgttcaacgagaccatatatatgtacgtagtgagcagttcagaaacacaatccaatccatctcctttttcaacaagaaacatatcgtcagaagttcagaaaaaaaatcaatcgatgtgctcctttgaacaacaaaattttggaaatgttgctatccaatcgagttatttgagttttcatctatccaaaacttcagattcaggacatgcagtaaaaatttcagaaactacaagcatatgtgccaatcatgtggctgactgatctagtgatgttctgtaaaagctgctggctaatcaactaaggccattcacagagcgccctgcaattttggtgttcctcccatgccaactagacaaagaactttataggctacatactccacaatgcatgtagcatcttttttatttttttatctccctctctctcctcttctcctttcccctgttctccctctcctctcctccttcccatcggcagagcgtggcggcgagggcggcgccggcaccggggcgacgagggcggtgcacggcgacgaccccccaccc

SEQ ID NO: 65370 - DNA, 10159 bp, Oryza sativa
gggggggagagatgggccgggccggcccaagagagggaagggggactttttagggttttttgttttttataaaacctttttaactttgtttatttcttaacacttattatttgagctctgaaaattccactaaaatttatttacgtattttaggcttttaggaaatatacaaaaatcctctaagtattatttgacttttaactttgcacattttaattgttggaggctttcacacggattttaattattctaggcataatttagaggatatattttagggtcgttttgggacgtgacaccaatctttcattctctttcttaagagcttgcatagcatcaacattagtagcataagagttcaaatcaatattgtaacacctagcacaaccattgctagtagatgggttggaagaattagaaaccacatttggttgagaagtgctattccaaagagtgtcaaattgaacttcaagatctttatgacttttgtctaaactagcaaatttctcttgaagagtttcattgacatccctacggctagctagagaaccattagccaaattaagctcattagctagttgttcatttttagcacattctttagctaggctctcctctaaggcaaggtttcttttcttctcaagaataagtaattcttcttgcctttcgagagattgttctttactatccaaagctctcattaacatagccaaatgttgcatagcgggtttgctaaagctcttaagcacatcatctaattcattatcactttccgcatcactagaatcaacatcaagagagatgtgagaggacttttgagtcatcaccttgcggccttgggccatgaaacaagagtagtggtaggagtcgtcgtcgtcatcactccagttgttgaagagacgctccttgattgaagaggatgacttgaaggcgacagtagcaacaccaccttctccttcaaccttgtcttgaggcttgggcttgggcttgacctcgagatcttcttcatctccggagtaccacacctccgccatgtgtgcctccgccacatgagcatgctccggcttcttcttgcctcccttagccttagcttcatttgacttgggacaatcggcaatgaagtggccatgttcaccacaattgaagcaagctctctttgattgcctctttcccttgtcatcatccttcctccctttgccatagccactcttgcgaagaaagtgcttgaatctcttgacaataaaagccatctcttcatcttcactttcttcacaacatgactcttcttcttgttttgccttcaaagcaacttcttgatttttgatcatggcggcattcttcaccatttgcctcacttcacgagcttcctcttcttgcatctcatgagacacaattcttccaagaatgtcacttggggtgagactcttcaattctttcctttcccgtatcattgatacaagagtaggatttcttggaccaaatgcacggagaagtctcttgaccacaaagtgatttgtcatgtcctcactcccaagtcctttaatcttgttgacaaggatcatcatcctatcatacatctcttgtggtgtctccatgtcatccatcacaaatcttccaagccttccttccaataattcaatcttggcctcacgaacggcgggtgatccctcatgagccaattgcaaagtatcccatatctccttggcctcctcaagcccatcaaccttgttgaactcctccagactcaaggcggagagaattgcattggaagcttgagcattgcggtggatgagttgttcttgctccgaagtgagctccatgttatcatggggtacatcaacatctgtacaaacaactttccaaatacttggatgcaaagagattagatgcaacttcatcttgtgcttccaagcggcattatgtgtcccatcaaattgaggagcatgcccagaaggcacggagacaaagttgtgagggggaatggtaagtttgctgtaatcaaaaggtatagtagctcccttgggtgatggagttcccttgctgctcgctccatcttcatttccattttccccgttctttccccctaagtccgacattgtggatcactcaaagcagtgaagcttgaatcaagagcaccttgctctaataccaattgaacgtgctgatgaagcctagaggggggtgaataggctgtccctgaaaacttaaaaacaaatcgcagcggtaaaattcaaacagacccggaacttcctggtaaggaactccagaacttctggcctgccaggcccggaactaccggtgttcttaggacaggaacttccgggttacagaacaaggatgaaattcaaatttcgaatcaggagactaagccaatcttcacaagatgatgcacaggtattctaagtaggagatagatcacagaaacatccacagaaacatcacagaaagagacaagagcatttttttcctgatgttcggatcttgcgatcctactctccgttgaggagctccaaagagctgggtctcgattaacccctttgcctgacttgtgcaaaaactccagaggaaatccacagccttcaactacaaacacccctaggcaagtttctagaattgagtgaccaccaagatccaactcaaactacttctagaaattcgccacaagtatacgttgctctacttggaaaacctctagaatctcagcacaagaacttaattaacttacctcgttcccttttggaggagaggagatccttcacaaacttacccgggacatccacaatatgcaacggattctcgcgggcgacacctaaccatctaggagatcatctccaagagtaataagcaccgagatgacagcccacaagatattccaagtgctcacccaagatcctagtcttcacacatctccaaatcttcttctcttcctctcaatctctctttctcataagaattaggctctagattgagtggagaaggcaagaaacacttgggagaggctagcaacagctctaggttcaaaaagtgaaagtggaatggccaatgaacaagctggaaacgagctgtatatgtgacgtcatctagccgttactcacaaatttgaactgaaaactagacaggaagttccggacctagaagacaggaacttccggataatacttaggaaaatttctttcatcatactggaacttccggacctggaaacaggaagttccggacttgcatttttggaccaatggagcatttgcaaaaatgactcctagggaaacttgacacttggttcacactaagagcacttgagatatctcagagcatcacctagaaccccacttaatagtacggtttttcctaaaaactcgattgcaaaaaataaactatcctatgcacttctcgagttccggtccgctttgattttatacttttggggggtctccaagcatccatcttccacaccttgaactaatgcacctaaaagatactcaatgaactcattagtcccttaaccacatttgtcattaatcaccaaaacccactagggggattaatgcactttcagttgtgctggaacatccaaaggtacaacgcggatactggcctctatcttgtcaactggtggctggggctgaaattgagcattgacaccttgtggtagtgcactcattggagtgggagctattgcatcttgggctatacgactgcttcaggacgcatggatgacaattcgctgaggagcaagcttctgattgaggggagttgcatggactgatgtgctggcaaatatgtttctcggtttcgggcacatgtcggcgaaatgacccacttcttgacaattgaagcaacatatatctttccagacttggcattttcttttcccattttgattcctctgtcttggcactggagttaggctgaaactgtagtcttgtcgaggatttgggttgccttgatgcttctctccattgtaactggcgggttggttggccatcttcttcgtcagcagaaaactgaattgacaatcttttggtacatgattagttccttcacacaagaaacaagtgatcctgctcgttggacactcgtcgggtggatggtcttcctcacaaggaacgcaagtggtgacacatgagctggcaaagtgaccgatttctccacaacgagagcatgccttatgttcctttttattctgattgaaaccttggagagacttctcatcttcatcccgtgaggagacttgatctgaatcttcgctatcagacactctacctccattagccaaaagatgttctgtcaactgtggtgcacctcggaagaaatttcttctctgacgttttgtcattcctggtggaggccattctgtgccggtaatggtcatcttacggacctcatcttcggttcgcattggtgcttttcttttctgctgaggacggttccttgcatagtgcccttgttcaacacagataaaacaaatgattcttgcttcttttgagtccacaagtggcatggcacgatgggcctgttgggatgctggcggagcgctgacttgtggtgtgagtgcttggactgcctccaactgcacttgaggttgcatctgactcgggttcagaattggcgtctgatgctgctgtagtatctctataagcaatttgttctggttaatcaggtgttggaccactgccatacaactggtgtctggtgcttcattcactcgggagcttgaggtacccacgtcctgatttctgaccatactgccttttttattgtcagccatctgttactaggtttggagagggagagagggaaaacaaaaggggagagacagattagaaactaaggataggaccttaacagatctattttttttctgttatgatgtatgttaggtttattctgcaagttgattaagcaaacaatctagcatggttacatcacaccccactgatgcaaaccacgcgctacacacacaagcaaggaaacacacgactaacgactctaccctagagggtggcttaggttctgcaacaggttctccaagatcttcacccctgcttcacagctggcttcattgcttccttcgcttcgctagcggatccaacagtcttctggagcttcggcaaacgattgacgatctcttcttcttcacaaagctgaccatctagtactagttgaaattcgaagaaggaagaaggaagtaaaccttttgcaaatagcattagggaaaggaggaaaaaggaactttcgcaaatagtttcatttataaaatatgtccttacgttttatccagttggcttatcctacagtcgagatatctctgataccagcttgtcgcgcccggaaaaataccttttccataacactagtgtattaatccccgtcccaggaaaagcacatcaggcctgacaaacatgatataaaagacacatctttattatatcgataatatttacattattacaaaggcacttcaggcctgacaaacaaaaataaatagcagcggactagtgggcctatggctccatcttcacaggcgctcaactagggtataagccagggctccacctaagacttcttctccaaagcttctcttactgaagggggggaaagatagagcaagaatgagtacaaccacagtactcagcaagtcacaccgggatatgcatgattaatgcaagggagtacaaagggtaataatataggggttaagttttgcagtaaacagcatttaagagtcacttagttgcccaaagctattttataaagacaatcctagagctacacagtattattaatcaaggccctgaacccacacgaacctggcttaacccaaggcctatgatgattcagaccaaactggcaacccgacctaggtcccagctcgtcccaagccaacctaggccaaccattccacattttagttgttaagcaagttttaagaattaaaccactaacttgggtacattgctaggcttgcccataaccgagggcgcggctattcgaatagattatactctgatcagaggtgtacatctttacccacaagacacatctttactctgcattccacggccgtggaacccgtggtaaaggatgtgacataacccctttacccatcctagccgtgacaaaagcaccgacccaacctcgcctacggccggaatcccgagacaggtaggtaagattgagcccctagcagcaggacaccggccctgtgccatgacatcttgaataccgagccgcagcccgtgtagccttcatttgccctagagatgtccatcgagccccgacttcgtccatctccatccgtgtactcttgcaaggactagactgagcaccgagttaagccttacccattagacatgtggttagtacggtagtgctttgcaacagaggcccgaagaccggtccttatagtggctgaggtgctactagcagaaccatgcacctcgagcccagcctaaaaccattttgggagttttgaatagagggggggaggtgtgtgttcaattccaccacaagccaaccattccacagtgtccaaatgatatgagaactcccaaagtctaaagttataaaaccacctagtgttgcctaattaatcagcgaagcatctacctaaattcatactagtggaaccgttaatagagtacccactagttggggttttgtttatcctagggtgaacaaggtaataataacaatagcaataataataaggtcataacaaaggtaaataggcatggctaaataaaacagtgataatgcgggaatttatgtaaagcggtaatgcaataatttaaatcaaaataattttataaactgggattcaatatgctaaagggtgatgcaacttgccttgctcagagagaacggccttccaaaccttcgacgacgaccgcgaaccacactttgggaacctccggaacgacagaagctacgcgaagcacacaagcaaagctacaagcctataaagaagcaataataaaacataaaaagaaagcacagggttctttaggttataacaaacattaggagacttgaacaggtcgattcggagctcgtatgaccaagatatggtcatccgaagtttaatgctgtcacgtggagatttacgaattattgtaattaggctttgcaactataaaacatgtgtaagcgctagcctggaaaagacaggaaggctgcgccgttgacatgcggaccccacatgtcaatctaagggaccacggtggaccgggtacacagagacggtccacgggtcgaaggaagcagaccccgtgtgtcaaccgaggcgagtggccgacaaacggactccaccagacaccacgcgggctgcacacgtggaaaccacgcggctaccgagcgggcacacaaacacggtcaccacacgcacccacgaacactactgacaccggtacacgggtaccggggttgacaaccgcacaacgggcacggggcaacaccgaaaggacgaggacggggcagcgagaggaggcaccgttaccaccacccgaaaaggcgcggcacgacgacgacgaacgggcgcggcggagacggctcggggacgacagaggcaaacgacttcggcggcgatccttggacgaaggcgagacgcggccggcacgaggcttgacgacgcggagccgaggacgaagacgacaatagggctgcagcggctcgcttgacgaaccacaggcggcgaacgcgatcggcttgacggagggacgaacgccacgacgaccgggtacgatgggaggatgacgaccggaaccggtgaggaggcgatgagggcagccggcagcagctgcacggatgcgaggacggcgcggaacacgtcgctgtgatgacgacgatggttgcggcgcagcaagacgacgagccgggcgaccgacgggacatcgacgacgaggacgaacggagacgacgacgatggactgcagaggggtttggatggaggggaggcgatgccgaggacgatgtcgccggctcgccgctgcgatgccggaggttgtggtggcgcggccgacagcgcacgggtgaaggaagggccgaccggggaaattccggcgaggcggatggagaggccggcgctgcacggcggtgttccggcgaaattctgtaacatacccaaattctagaccttaaaaatttcctatcaaaatagttggaagctaacttttccatttttgagagctaaaaatttccatttttaacctaggtgtggtcaatctaacttgaacctaagtaaaatttgagaacaaattaaaactttttcatttataacctaggacataaatgcaaacacgagtaaaagcatgcatacttgcataaaacatgttttgacttgagtccttcatgtgcatttgaatatttgatttgcatttcataataggtctgatgaatattaactaagatctagataaacaactaaaccattatggcctagtgctagctagaggaagttaaaatagaaaccatacaccttaaaatatatcaacatggctaatgtcaagcctcacaaaactaatttggacatccatctgaagacatgtcatgaacatgaaagtgaacaaataaattatatcatatagggtatattctatcttaatcatctctaagcattctcttaatttaatactaaagtaaacttatgcataaataagtaaggagcttatgacatgtgtaaggtaaactgtaattctatcatatcaatatcacctcaggttaatgagagtccaaatataacttttataaacatttacatgcatttaggaaagggaaacacatataagacataagtcttgcgaattatctaaaataattcgtgcaagataaaatcatgggaaaattcctgtaggctctactcaactcatacaactcactgtaattttggtataatttaataactaaatttggtacctcaaataaatcagtcaaactaataaaaactagattaaccgtagttcttaatcggctaaaaccatactttatctaaaagtgcatttaactgcataaaagtgtataagtaaaataatttattcaaatactaggtcatttatcatgaataaaaataatttttccagaatttatcttctctgtttaaattactaaagtgggagagagaaataatcctgaaaatcattcaaaacttttgttcacccacgtttctgcccaaccctctcaccctagcttagtttgccacgacctggacccacttggcagccactctggctcgtcctcaccttgtgcaaatcttccagccgaccagagacagccgagagagagagagagattggcgccggctgtgtacgacgcgtggccacaatgtgtcgacgccatcaaactcctattctagccttctcctcctcccagctgcatctccacacatcattctccacctctaagccgaagaaaccgagggaggaggctctcaacttctccgtcgccctcatccttgctgccggccgcgaagaagacgactatcgtacttgtaaataagccagggtaatccccatctctttcgcgttccatactcttctcaccatgccgatgatttatccttttaatttcatcctctatcgtgcagcggatcgacgggaacgccgtcgtgcccacggcactccggagcgcgctccaagcgccgccgcagccgacatcgtcgtcgttccgaccattgtagaccaaacaaagccgagccgtcgcgccaacgtcttctccttgaagtcttcctcaaaaaccctcaaaaatcctaggcaatggcgcagcaagtgcggagatcggctaccgtcttcttcacctccggtcgccgtcgccattgtcgattccgcctcctccggtgagccattgtccgattcttcgcgtatacaccatccctgggacctcactaaccccatgaaaacacatggatgtcaattcgatgagtggatcgagccgttgccgtctccccgggctctacaccgtcgccggaccatcttcttcaccgctgccgctgtccagactttcccgcgcctcgttcaaggttcggtgagcacacttgagcccataggattgcattcatgcatttcattcacttagaatcgagcaccaactcaacatgcagtagcagcctaagcacagccgccgctcggactcgccgccggcgttactccgatgtccactgaccgag

SEQ ID NO: 65371 - DNA, 886 bp, Oryza sativa
atttgtccagtgtactagaatttgtccagtggagactttacaaaattttccatatgcttgatagactcattaaagcttaatcattatgcccacactttggttgcatttaatatttatgcatttatagtcttatgttttgaccagcaaaggtgaccaaaaagtaaggaagtgaaagcggagcagtggaggccaccatcccttctctgcaacacatcaacttggcatggcagattcaatgcttagcacggttccttcatggctccccgtagggtaagtgacttaactttccgtcgttcataattttgacgtagttgtatgcgtggagatcattttggttgatagatacatacattgatagatacatactattgtgttcatccacaggatggaccccttaactacatatttgttggaaatcaaactagccggggatcgaaaaaatgctagggtggaatatgattggtttattttcagtaaagtgatagactcaaatgcgatgtgctacaaagactttattgatgatattgcgaagtcatatccatgggggccaaatgaaactgtcacagttggctacgtggatatggttcataaaattactcatcatgtcacaactgaccaggatatgcttgcaatgtttgaaaagtttgttgatatcaaggtgattccaatgattattcgcatacatggtattaatgaaagtattgatgagttagaccacactcttgttaaagcaagcgcatgtgatcccgatactccttctttggcaaccccatctcaagtggatttcagccaacctagcagcagcactcttccttctcatgtcattgtgccatcagacacatacttagtaaacccattttctatggctgaacatgttggtgttgat

SEQ ID NO: 65372 - DNA, 2288 bp, Oryza sativa
ctaattacacaattttttaagtgttctgtagcaaattttgcaaaaaaaaaggaatatttcaatgtgcatatgtccctctcttgacattgcagtcgtgtcgtgtgtacgtagaaatagaaatagttgctcctagttgatatcggattgtgttcaccctgatttctgattcttattctgagatcgaatcggatttgctttgatctccgatttccttcctacatgttgtgcagattgctatacatgtgtgtatatatacaaaggcatagcacctggccgatcggttgaggtgtgctgcaacctgcaaaccggagggagacaaagaacatggcgattacggaggaggatgtgccggcggcgaagaagatgaagacgacgacagaggatgatcatgaggaggtgttgctggcgtatcccccgcgcaagaaggaggatgggaagaagatgaagaaggtggtgaagaggctggggaaggaggaggtggagaggctgctgtcggtgacggtgaccgtgccgaccctcagcaaggaggcgatggaggaggacgatgaggaggatgtgcgggagagggagatgctgctccgagccgcatgcgcaaggaccaggtcctcatccgctcccagttcgaggccaagggctacgtcgacgtcctggacgaggtctccgacgacgacgacgacatggagatggagccgttgtaacataacctcacctgtaatctgaaatatactggaataaaacacataccgaccggcaatttcttttgattacggatttattttttaagtagttaagatcttgattaactagacccgtcacatcagcgtcacctctaaaacctacagcatcgagcttcacaatgcaggttggaaacatctgaatatctgccagtctcttgcccttgagcttcacaatgcaagtatgtatcccccggaaaaaaaaatatggagtatgtacggtagcacagttgttggaatataaagctgtgatcattgtttcctagaactgtcgcttcaagcattgttgtcattccttttgcctccgtccagatttgtttctgacagtgtacgtatccattactcagataagagcctgatgtggtgcagcaagcaatggtatttgctatgccttctgaatgttaatacatcccgtgttttttaactgatgcttccaacaacgggagtggattctaatcgctcgaggggatatcccctcgtatacttttttcttctaaatttgatgcaaatagttgtgaaaaagtctgaaaaaaattgacaatatagagtataatggtacctgctagctagtacaccaaaattcaagttcaaattcgatctacacatcgagaaaaaaaaaacaaatttagatataaatagtgcgctagtattcatatgctgattttttcttttttatatctcgacgtgtgagttgggtttggacttaagatttcgtggagttgtatatatgtggtgtatgaatattatcaaatttttccaaatttttcataaccgtttagatggtttttatgcaaacgagggaacccttgagagattaaaatatagtttccctccttgggacatttgttattccgtcttcctctgtccagatgtgttactgagcgagcatccagaattacatgagaacctgatgtgatgaagcgagcaaattgttggtatttggcgtgccgtctgaacatgttcttgttctcttgttaattgatgcaaccattggcacatgggttaatgggccaacccaaaaaaaaaattactagctttgcagagccagccgattgatctgtcaatctgtatgacaggattaattgagatggaatcgtattcgctgttgtctcctatttcctttgtgtacaagttgtgcaatctacggtgtatataatccgattcaggaggtgtgcggctaatataatccgatacgatttcgtattcacgacccaagaatttgtatataatcggatcgaggtgtgtacatctgatatgtgttgaagatcccagactggctagcaatctgacccagaggaagacgaagaacatggcgatgacggaggaggatgtgccggcggcgaagaagatgaagacgacgacagaggatgatcatgaggaggtgttgctggcgtatcggtcgcgcaaagaggatgggaagaagaggaagaaggtggtgaggaggctggggaaggaggaggtggagaggctgctgtcgttgaagctggccgtgccgaccctcagcgaggaggtggtgatgcctatgcctgacgacgccgaggatgatgtgtggca

SEQ ID NO: 65373 - DNA, 723 bp, Oryza sativa
tgtatttagtagatcaatgaatgatttgatctaaaagaagtataactgtgtaccaattagcacactctccatttttttttctgctgatctatgcattatgtttatggaactaaataattaatagaaattttagcacaactctcaaaccccaaatttttgaacaacgggattttattataagctataaaatctctggcagaggtaagatggagaactgtgattacataccgtcaaataaaagagtttacactatcaaactatatggggagagtttttttttttaccgcccatcaaaactttggtacctcgcaggagcagacaagtggccagcatcgtatcaagaatttgttcgcaggcagggctagctagagattacggtgtcgatgcgggcacgcgaggacgagaagattgaaaggcatcgatatacaagtgctcatttgtgcgagggagagggcttgagttcgtttccaatcgtgcccccatcaattcgactgttcaatggcttctggtaccttgaggtactatctgttggaccatagcaaaccttgtatagggaacatctcatattaagaatttattaacacacacaacacaagtgcatatttcacaacgccaagaaggataatggaggcatagccacacttgtgtagttatcattcaatcttattccttccaggacgacaatggcggtgtctcggagtccctctaggtggtgaggaagct

SEQ ID NO: 65374 - DNA, 25490 bp, Oryza sativa
cggaccaccaccatcctcctcccgaccctgttcgccgcgaagctcacgcggctggccccgccgccgccgctgccgccgttcccgccggccagcaggaacctcgaggtggccgacgccacgttaatggtgctcgccatcgccgccgccgccgccgccgcgctcgtgtggatttcgaattccaagtgaagtgggagcaggtggtggaggtggaggaggagagtgaggcgtaaaatggcgcggggagattatctgcagcggaggctggcgcgggttggatttcggccagtggggaggcgccgcgtggcgcaccttatccgccggtgcggatgatgtggataacctggcggccatgggatggattcgctgccataagtggagatcgcgagtactagcattttcttttgatttgcgatataatttgacttggcgcagatcaagtgagtcgcgtgcttgcgtgacatgtgtacttttggcaactcatccgaacatgggagatattttccggcctgtctagggagcgtaaaattctgaaaagcaatttgttagtagccggtctatgagaatcttgaaaagttgggtttttcggtttctgaattctaatttattttctggattttacaactacagcttcttagaatttggaccaaaagctagactatttgggggagcttctgattctgggagaagttacagtagctagaagctcctccaataggccctaagattataagaagcagtcgattgatagttagcttcttcgttctagaaaagctaggtttttcggcttttggcttctacttcgttttctggattgtacatctactatttctcataatctaaaccaaaagctaaactgattggggaccttttgattctgggagaagctgcagaagttagaagctccccaaacatacccatttgtttggtggaaggtgagggtcattgacaaagttcatattacgcagtacacatatggttgttacaggtatggagaaaaacaaagtgtatatggacagataacaatgtttgtatcatattcgtcttttagtttattttatgaaagtaaatatgaatagctcgtttaaaagtaaatacgaattatcttgtatttttgaaaatgatccgacacgaatatagaaacgaaaataggcttctaaactcacgagagtatcgttaatttgtaaaatagaatggatgaggcatttgccatcaactaaaatccacaaatagccccaatagtgtatacaaacctgccatatgcatataaacctcaattaaagaaatgttagtatatgctagctttaagcaattttatttcacaattgcacaagctggaataacttacaaccgtgtatttaaattttaagttattatgatgtgtgtcacataaccacagatttacaagtgataatacttatgatttttttgataatagaatatggggttttttgaaatttactcttaaaatcaagaacatcatgcttccttctttccacgacgataaaccaacaattttatttcagcaaacaatgtagagcaaaaccaatattttctctgaatacttcgtaatttataggactatacttatggaaactcttttttcttcaaaggagatcgctaccggaaacttgattagatcccattggcgaaaagtttctgaacatttactcccatttattacgtatcatttaaatagttataaaaaacttttagaagacttacatggtagatcaatttgttatatatcatttcaaaaacatgcaagttcaaatttaacatacatttattaaaaactaataaatatgaatgtgaataatacaagtactagttactccctccgcccccaaaatataagaacctaggatcggatgggacatttcctagcactacgaatctggacaagctgcatgctgcctgtagcggtggtgacttgatcttcattccaagtgacattgacgtggcgtttatatggtattagaattaaaaaatattgtgacccatttgtagttcacacaatttttgtgagcccacatgtgaccctctttcttctccttcttcctcatccctccctctctcttatctcttgctttctctccccctttgtaaggatgtcgccatgtgtaaggacgtcgccttttcaagcagtcggatgtatcggcggtgtccacgctctaggtgaagatagcgcgccctcgactcgcgtggggtggaagcggggtgggttggcaccgacgatggcactggaggccacagagggaggtgggccattgagctggggtggatcgattgccgccgccggccacaggaaggaaaggaaagtagagctacaacatcaggggagagtggcgccgacttctgcctcacggctgcctccgacgacgccattgccccgtgccgcaggagctccatcccggacgatgacgacattgagctcatcggcgctcctcctcacatcctcctcggtgcagctgcggagctcaccagtgctcctcctccagccaccgtccatgggtccgctcatcctccggcctcgtcggtgccgacgatgacaatggaggaggcgcaagctcgaaggggagagaaagagagagatatgggagagggaaggaggaaggaaaggaaagacgatgacatatgggcctcacatttttttgtatgaactacaaatgggttccacatatttttttaattataataccacataaactaacaagatcaggtcaacaccgccacgtagatgccacgtcagcgaaaccgccctccaaaactaacaaggaagtgaaattgcaccggctttagtagtcagggggtcgagacatcaggtattatggtttagtgatacgaatcagattcagttactagtcgagggagtcaaagtgaacttattccaccttagtatccctctagaaagcggatacgtgggcctcttagcttatgggcccacatgtaaggctgtaaatagcccgatcaatcggccacgtccgcttcttctctctccctagcacgcaaccgagtcgagactagacaaggggagcagccgccgcgatccaagtcctcctccgccgccgccgacgccgccatggatccgaagctggtggaggtgacgcagctcttctcccgcttcaaggcagccttcgccaggaacgacttcgacacctgcgtagacctgctgtcgcagctcaaggtcgatcccccgtggatctcgtccgctcctgctgcgttgaaatattcgattctttttatcgctatttcgtccaagtttgttcttgtttcgtcggtgtagggattgatctgctgtcacgatgggatgtgtgtgtgtgtgtgtttttttttttgcataggttcgattgcttctggattcgattctagctagggtttcttgcccgggaaggcggatctattcctagtttacaaacgaattcgacggatttctttagatccgagtttgtagtaaacacatgacctcctcgtctggcctcagttagggtttttaatttttaatttttatttttatttactgtggagaataaagaaatactgggattttactaggttttagattattatcgaagtccaattctgatttggcactacagggaggtgtaaattttgtgaatttcatgtgttgacatgtggtacccctccttgtgcaggtccgcctcaccaagttccccagccttcctccatcatttcagcagacaccgaatgcagtggaagagctgaaaattgcgagtaagattaattggatgtttgcttttatattaatttctgcctaaaatgtgctacacttgttacatttgattgattctgtacatggttagttactcttgaacttctcatttgcacacaattatagatcagtgtatttcattgttaaacttacatctgaatatctgatgctgaaatttggtggctgtatttcattagcatgttttccacatgctttttgtggtcaatatctttcctatcttgattcctcttaggaaattgtgtatgcttatgttttatcgactcatgattatgatctagctattcagcaatagacatttgaggaagtattttagccagttaatttttatgtaacattgcagttatccatgacagaacacatctctatctctatctcttatcttctctactatattataaaaattgaagatgtttttgccagtactttggtatgccatttgtgtatgagtcggttttcaagttcgttcacttttggaaatacatatcagtatttgagtcgtttattaagttcgtttgcttttggaaatacagaggagtcgtataagatatctctttaaaagaactcgcatgctaacttgaggtgatcggactctaattgcaactcatgattttaagcgaattcccacagtgaatttcactttaattaaactgtataacaataataagattaaaatagccttcacctgtctagtactaagataaatgtgtaatctttcaggggacatctatgagcatgcagttgttctgagtgtgaaaattgaagaccaagatgcatttgaaagggacttttgtcaactcaaaccttattacatggatacatggttagttcctgtctacacttcacatcagttctgttaccgtatattcaattgtaggctgtcattttgatgcacgtaattttcttttatctaccattagtttttagaaactaaaaataagaagtaatcaaggataatttgttttcctttggcacgagttgcgactgatttgagcctgtactggtcaagtttaggctaccgtgggttatattaccgctaaagtgtagtatgttggtttttttatgaaatatcttttgattgagcaagtattaatctatattatgtaccagcatggtgaacattttgtatgcctctaaaacgtggtcatatctaactttggatgtaaaatttgatgaacacttgcatgataaataattcaagggcttgttgtaatggttgttttatgtttttttttctgtcatgtgattctaaatcattctgttttatgaagcggcataattccaccatcaccacaggagtatccaatcttgggtcttaatcttctaaggctgttagttcagaacagaattgcagagttccacactgagctggaacttctgccggtcacagcacttgaaaatccttgcatcaagcatgcggtggagcttgagcagtcatttatggagggtgcttacaaccgagtgttgagcgctcgccaggctgtgccccacgaaacatatgtgtacttcatggatcttcttgccaaaacagtcaggtcagtataattatattactgtattactggtgcttctcatttgatgtattgatttaaaatttgtgcagcccataatcccttatttgaatgcttgttctgcacatgcagagatgaactggctggttgcagtgagaagggttatgattatatgtcaatagctgaagcaagacaagtgctgatgttcagctctgacaaagaattgcaccagtacatcgcagaggtaattgctcttcctcccctctatttatgtgcctctcgtcaatttacatgatataaaccctgtatttaatgtggtgttacaggagcaccctgaatgggaggtaaaggatggttccgtcttcttccagaaggcgaaggagacccagccctgcaaggagataccatctttgcaggttatcaaccaaacgctcagctatgctagagagctggagcggattgtatgatttgttaatgaatatcatttgagatcatttgggacggcatgttcatgctatgtacacatcaggtgtcacggttgagatgcgcatgttgcagctttgaacgtttgagatgcccatgttaccttatgatactttttttaaaaatttcatttaatgggctggatctgtgtctgatgtttggctgcccagtaactctgatcgtgttttgatatgtcagttcgtgatcaatttactttgctgaatagctgtcctgaaaatgttcagtattagtcgtgaattgcaactgcaaactgttgggcttatgatgatgaaatgagatcgtacttattttgatgatcattgtcagtgtactctgatggaggctcatagtgacacctcggaacaatgttgggacagaaaatgtggtgagcgtttaatttgttgaaattccaaaaattacttttgatcatatgatagccgaagtgctccattgcatgatcaaaagtccaaattgaaccccaattattatggtattgattgacggtgttttttctttgtcacgtaaccaacccggaaaaaattttctccggggtgcctcctcaaacccctatatgtgatgtccctcttcagatttgatgccgcagcccgtcgttctgctgccggcgcaaccaacgcccatcgacctgcaaacaccacttacgatggcgaatttgggtggctgggacgaccacacatgcaacaatcaaatggattagaaatgccatccaagtttcagatttcttcaccggtcctagtcatgccatcgtcaacgaagtcatcttaggtcactcaccggagttattattgcaccctgacaatctcgatcttggttggataatcctttacagagaggctttacagagaggctaaaagggtcaagttcaatcgaacaccaattatcacgagcaaatcagcgagtggaaataagactcttaattgtgttaatagaaagtagagagtatcttttgccgtggactagatttactccctttatattcggttgtggtaggaggacgctaatgaaactgggagatcgctagttagcgcgcgctccggcggcgcacattttgtcccagaaggccaagtgccgctgcaccggcgcgcgcacgcctcctccaccttttttttttcgtttttttgccttttttttccttttctttcctactttctttctggttttttttaatctttagcatgttttgagtttgaaagtttataatttttgagttgaaaattttcaaatctgaacctgaaagttttcaaatctcgagttgaaagtttttaaatcttgatttgaaagtttttgaatctggagttgaaagttttcaaatctcgatttgaaaaatttcaaaattttcaaatcttgatttgaaagttttctaatctcgagttgaaagttttcaaatcttaaattgaaagttttcattttttttaaatctggacttgaaagttttcgaatctcgattctcgagttgaaagtttttgaatctgagttgaaagttttcaaatctcaagttgaaagtttttaaaatttaactttaaaatttaaaacttaaatcgaaagttttcaaatctaacctaaaaaaatttcaatctgttagtaaaaaaaatctcttaaaaaatctccagaatcttttccctagttactatcattagtgttaagtatattaactaatatagtagttaagactaaagggggagggggggggagtgctagcagtcccatgaaactgagggtctgtttggtacagctccaactcctaaaatttagctctagtagttagttctggagtggagtcgtggagctgcctaaacacagctccacaactctagttcattttgtgagagagctccacccagctccacttccagttttggtggagctgaaactgtttggctgagctccagctccaggaggggtggagctggagctggagctgtgccaaataggccctcctacattttgaggaaccaaaactccaaaagtggactgctaccttttttccttcggaataagtccatcttacctccctcatctcttgcacttggatgaataacatccctcaaccggaaaaccgggtataatacctccttcttctctaaaaaccagagcaaatcacctccctcggcggtttcggaggcggttttgtcctacgtggcacttacgtggcgatggcccctccattgactagctgagtcagcttatagaccccacctgtcagcaaccccctatcccatcttcttcctcacgcggacgacactagcggcacgccggcacgaggctgcttcatcccgaaacagagagagaggagctggacctcagcacgtcgcgcttcgtcgtctgccgcaccggcaccgtcccctccgggcacgactcgtcgtcgttcgtccacgccatcgggaacacgacctcctcctccgccgcctccccatgcgccgccgccgcaccaccaaccttgggcctctcctctggctccggctcaacttgcacgcgcacacagctgtcacaaacacgatcaataaacgtcgccggagatagaaatgatcactgcaaattgaaacaaaaatgaatgagcttcgggtggtcgaacgccggttgcaggtgcagcggcacgcagtcgatgacatcaccgtcggggctctgaatgcaaccatgcacaacacgacatccaaccacctcgagtctttggtacgatggcgaccggtgctccgacgtcgtctgccaccgccgccgctccctaccgccgccgccactgctccggccaaggtggagagagaggccgtgggagagagagaagggagagagagagggaggaggaagaaggaaaggagagtttgcactgacatgtgggtcccaccacgctgagtcagctcgtcaacgggtcaacgacgccatgtcggacgaaaccgccagccaaaccactaagggaggtgatttgctctggttttcagagaagaaggaggcgttatacccggttttccagttgagggatgttattcacgcaaacgcaagagatgagggaggtaaaatggacttattccttttcctccccttcccttctctggcccaagtcaagctggcctaggtcagcccaagccaacccagggcagcccggcccacttgtgccccaactctatccattccactcgagcttctcctctcaaggtcgccccgccaccgcactacacttctctcctgctcttccaccgcctctccccggccggagctgggaaggggaggcggaaccctagctccgccgcccacgaaccaactccgaaattcgccgcgtccgatcctcctcctccgaaattgaaggtaggaatggattccccattcccgcgcccccctttcccctctcctccccaacctcacggcccgccggaattcgccggccgccgttctcggccgccccagctcaagccgccactacctacctctactcagtgctcgatcttcctcgctggaacccgccggagcgccgccgcctctcacgccaccgccggaatcggcgtcccctcgccggtcctgctcccccttcgctgctggccaccggcggccttgaaccgctgacgacccctgtaaaccgaagaaaaacgaagcagtctcttccttttgaaataaaaatacaatttctctggttcctctggttcagtgaccaactgaccattcgaaaatctgccacctgttcccaactcattgaattattatcccgagtccatccgcacaagtttcgtctcaatccgagcatccattaacacaacccccaaattttgattcttagggttcgctgaccgttaaagctacagaaattttcaaatttcaccatctaacctcttttgatcctaaacggcaccttccgaggttttagtgtttatttggattttatttgcttagctctttaattgtgtatcgatagattacgccatcggttcaggagaagggtcagagtttgctgttgatgcatacgccatcgctgctgcaggaggagacgtttggtacgactacgctgagcccaaaggcaagtcatctccctttatcataatttgaagccaattgtgcttgccttgaagtacgttttagggtgccttgaagcatacttaaaacctttcaaaatggcaatgaccagttatctcatattgctatatacagccatgccttgttgttgaacctggtatatccttggtaacccttgtacaacataacatgtgatgtttacagtttagttatatcacttcatgtgttcagatggaaatgttatggttcttttaaagtttataaggataaacccacttatactaatattaagtggcatagtttacgcccatacgtttgaccgagtaattagacttgaatgaacacatttccagtggattgaaatcctatactagaatttcttctctaaaaatgtttggagtggcgtctctccctccaaatctcgttttttgaaatcctgcactaggaccccacaacccgctcgctcttgaagtgaaccatatatcggcttgagattgtgctgaggctcttttgtgtatgccttatggtccttacagtgtattggacctattgcatcttttagctcgtcaaggtggtacattaacttcaactgagagtatcggagtaggtcccctacccatggcattgggtctcccgcacggtacgcgttgggggcgtgaccccgtacacgacggagatgttcacggtggccttcttgaacacgacccacccttcagcacgtggctgatgcccttgccgctgcccagccgtgtctaggcgtcctcctggaattgcaccctgctccacatgcctaccgctgctggcctccttgaccacctccagcgccgtgcacacctccacctgcgcgtgccggatcgtgcgctcgaatcgcgcctgcaccaacgcggccttctcctctcccagcaggaatgtcagcggtaccctacggcctgcgtgatgcaagagagaaagagagacagatttaaaccagctcagccaatcccctcccgccacatgctccatgacttattctcttctatctacagctcgctgtgaccgggagctccgagttggccactagcaatggcattgtcggtgagtttggagctctcgcactcgcctccgctgtggcaccttccctccctctgccatcaccgcccaggtataccggatccaagaaaatcgtggacagtaaagcaacccaagaggatctgcagccgcaggtatcagccacaatccaaccccaaagtttcttccttccatttcttcagatgcaaacaattttctcgtcaactggcgaacattcagtgtcaaaactgaagagctgcagagattcagtggccggaacaaccacggaggaggacgagggagcccttgaggcgcggcacggtgagtccgcgcctccctgtgcccgaccacatccctctccctccttacgccggcacgaatcgcctccctgatgttgaccccaatcgacagctgcatgactgcgagagcattgctcgtatgagagccgcctgcgagctcaccgctcgagttcttgagtacgcagggacactagtcaaggtaacccttaaacatatatgatccatatatatgtacagttcttcatcttctgcccaattttcatttgaaaaattgctttgaaaaatatgcaacaatcgaacatgcgtgtaatcatatatcttattaatgtgtcagccattggcgacgactgatgagattgacagagcagttcatcagatgatcatcgacgctggcgcctacccttctcccctaggctacggtggttttccgaagagcgtctgcacgtcggtgaacgagtgcatctgccatggaatccctgactcacgggtgctacaggtcgagagggattcatgagcccttctgcttcttacattcatatatattttagttctgtttggtactgatgcttggtttcaattactgatcattcttcttgcagaatggagacatcattaatatcgatgttactgtctacttgaatgtatgtgattcctttttcattcttctgtcctcttttccttgtcagtcatcaccattcaattcgattgaaatcatctgcattatctaaaaaaaaaattcaacattcaatttgttactcatggtgtgctgctcttgtgccattaattgacctggttattgacacatttgcagtgtaaaattaagtgacatgtagtgtgtttacctagggataccacggtgacacctcaaggacatacctatgtggagaagttgatgaatctactatgcaacttgtaaaggtgtaaatgaccttgctgatctctgctgattgtttcatgatacgataatgtttcatcctgtatctgaagaaacttatatattgttctgtaactaacatgctgaggggaatatcagcctgcaaacacggtgctagttttaagacaattggtcagagaataaggtgttaatctctcttacccataaatttcatgatgtctttcagatgaatcaagtactaatcagcatcgatctgaaagcactgaaaaaaggaacacaaaaattgatcaggatgctgtttttcccagtaataagcaaacattttcctctaaaatttactgagaaattttgtttcatgtacttatatatgtagtatattatctatcatacattttttctggtgcactgaaactcaaataagctgaacagtaagtggaaaaacatataatgctgaatttcaaatgccatgaatcataaatgcacttatcctgtcagtgatagtccagcttctacaaataatttcatgatttctgatttcagtgagtacgtggacgagtacgggtacagcatcgatccctttgtcggacatggaattgggaaaatattccactcggaaccgatcatttggcatacctgtaagtagccaataaccatatatatgtcatgtagtctaatttcagtatggttaatttcttacagacgacaacacactccctaactaattgatttaacatagatgattatgagccaggctacatggttgcaggccagacattcacaattggtaggtaggtacatacatacatacatgatcttgtgttttggttaatggctgggctgcatgcaatgcagagcctactctgtccatgggaggcacccagtgcacactgtgggacgacgggtggacggctgtcacggtggacagcagcctcaccgcgcagttcgagcacaccatcttggtcaccggcgacggcgcggagatcctcaccatgcacccgcggtgagatgacgagaaattctacgcaactagcaccacttgcatatcgtgctggtctaaaagcatccttttctcagttttcatctttcacaaaacaaaggcaactcatgatctgtacagcattttcaaatagtagcaaaatgcccatactttgttacgggattaaaaacaaaatcttactgtatgctctagaatagtacttcccgttcaataattatgggattattaatgtgactgactggggattagtagaatcttttcagaatcatttagagactatactgctacaataattgagacaacaagaactcttaatcatcaatgcaccaaaatatttttttatacccttctttccttttctccatcctcatacaacaaaatttcctttaacaaatgttaagagtcgactctgagctgttgtcatgtatagcaaccatgtttttctttcctcttctctctctcttccaaattagcaaatttacttgcatggcaataaagagagagatattacacacggttgtacatgcactcataggcccaactgcccttttaaagaaacgaaaaacccatattctcacacgcagaaggcggaagccccaaatggccggacgggagcacttataactgacatgtggcactcacttaccagcgccaccggtttgttttaagattggtatagatcctaatttcaaagagtgattaatcatatcataaccggagggatcgagtactgacctttgaagacattagagccgaaaagaggggtcaatttacaaaaaaaaaaagaaaagaaaatattaaaatctccccctttgacgagctagatgagcaagaactaggcccaaactctcgacattccaaaagttaacctttgagcccttacctaaacctcgggaaacggaggaagaaaaaaaaattaatcttcggaaatccctttccaagaaaaaaaaatcagtcttcggaaatccctttccagttcgagaatgatcttttttaagattatggaagcacctcaagcttttcctatcgaaagagaccacttgccccgtgtagttcccatgaggcgatcgaggaaaattttctcaaagacatggtgaggggatcaactaccatcgtgagcatgagcggttaagagatatggagctttcttccaaagcaattcgaattaactccccatccttaactattcaatgtctcatgaaagaggccatggtgaatgttcactataatcccattgttggtgctaacatcatatccacagcctttgcattaactagcttaggggacagactgttagcacccatagacaaaaccttccgaagttcctcaggtcttatgatagaaggttatgggattctatgtggagggccattaaggcacaagaatgtcaaagccctcctagacttccacgtgttcaaaatccctgactttgatcttttaatcgtccattccacataaaagcttcttctagatgtgcccagaagggaggactggcggtctttgaaaactccaaaaatgagttgatcccacaacgagccgtcacgggatggaggatgtgcattgacgttggtatttcttaacgacattactagaaatataattcccagcaatggcgttgaaatattcatgatatattttacggttacaaatataatccgcaagtgcacggatataatgttgtagtattttacccggaagtattccaaggtatcgtatttatttaattccaatgagagatatgataagagaatactatgctaataatttatatcacttgtataaatcagagtctatacaggagttaggcaatatttatgggtagatcagaaaaatgttgacacaaaagaagtaaccatattattctcattaaaataaagtctaagctaaatggagaaagaataatagaagaatcattcatgtacttctagtatatagtcattttaatatacacttgctaatatacaacaatgcagccaataccccctaactatgccctcctactgtttcgagaaaccacccctgattgtcagtttcttacccgtcatggccatccaaccgataatgaatatgggggagtacccacaccaggaaattgtcttagtactatatacccacgtagaggaatacccgtactgagctatcaccatcagcggcccaccactactgttatgtggcatataataccaattaatgatatataataaactaagcactatgcttacattactaaatactacactatatcgttgcagcagacatagagcaatcatcaaaataaacattaaatccacaccattgcatatctctggtaggttagctacattattatattgcgacaagtctaacataaagtcggtacttagataatataaatgaagtaaagaactaaagctatataaagaagaatatttcattgataatataagtcttacaaaagaaagaagagctactagaaccatacccgaaatctcctgaagacttgaggaactagaaaactattttgtttatactccagtagtactagaacaaagtaaataaactagagagagagagagctcttgattcttcttcttcttcggtgtgtgatggagtggagtgaactgacctccataaatagactgccaatgacggttgtggcagttggaattgtcggaaaaaaacccacaaccgtcattggggagcaatcatggacgttcacatggaaggccgggatgagatgccgcagctagggttcggtcgaacccctggtccagccgaacttgggccggcccctctagcctccaattttggccgaggactttcttgttgggccttgttcttcatggtatggtagtgagcttatttgcatgtgttaaattggatttgtaagatcatccatccataagtctgccactcggcggtcatcgattgatcgttcagttattttccgctgattctcctccgtttatgtagagatctttgtattcaaataaaattccaagtacaaatggaaatagattatttctaataaaatacgcattgcaagcataactagttctcttttattccggttatattgacggtcgaaattggtctataacgactgccaacaaactccccaaacttgaacctttgctcgtcccaagtaaaagatttacaaaaacaaacttagttgttaattaggagttgctaccatgctgtatatctcaaaggtattggtacaaagtatgagtactctctctctcgttaagcgagttagcacggtggcttacccatgcgcctaatacccgtgggacacatgcttctccttgtctttagtggttgagagatagaatagttagtagagcactaatcaaaagttttcaagtagagcactaatcaaaagttttcaaagttgcaaataaaagccaagttcctcaaatgattctctcgattactcaaaagtgtataacttgccattgatgtgcattcggatttcttcggctcccacattgatgcatgcgtctgtcatgctcaggaacgaccgcccaaggataagtgtggtgtccttgtcggtgtccatatccagcaccacaaaatccataggaatgaagcaaccccggattctcaccggaatgtcttcagcaatccccgtcagatagcggaccatagaatcggtcaattgcagcatcataggggtaggcaagagcgttgtatagttcagctagtcaaaaactactttgggcatgacactgacgcttgctccaaggtcgcatagggcatggtcgaagtgttgtgtcccaattgtatagttgatggtgggacaccccggatctttcttctttttaggaagtcggttgagtatagccgcgctacactcttctgttagtttgacgatctccgtggtgggctgcggccttttgttgctaatgttatcacggaggtagagagcataggttggaacctgcatcgcatccagtaataggatattgatgtacattttctggattacctcgatgaaacggagattctcccgagaagggcactggtcttacttatcacggaggaatgcatttgagcacctctcccaagtgtctatggcacccctcttggagtagaaccactgttttcccctcccaagtagggagaacagaaacaggcggagcctgatggcgtcctgggtcacacctgcatccaacggtattcagctagcctaaacaccatgtttatgctagtaaataatatcactaactctcccgggactctcaccctttcggatgaacaagttggagctagagcaacttataaaggtcattggaccgttaccgtagcatggatcgactagcctaggatgaagcagatatacaaagtatatactactcatagaacatatactaaacaaaggaatacatatgctatgagcataaataaataaagaagatagttccattaatataactatagtcttacaagaagagtaaagtactaaagacatactggaaactccgagaaggctgtaagaccaaaactcctctagactttattcctactaaactatggacaacacaatagggaagagggaattgctccttgaggtgtgtgttacaagtgagggactgagctccttttataggtggcttatgacagttgtatgtcggataaacacccacaatcgccattgggacttgggagccaaccaggaagctacacgtggagggctaggatgaggggtggcagaggcggttcggccgaacccttgggtggcagaggcggttcggccaaaccaagggttcagccgaacccttggcaccgcctttctccactgcctttcaccagcagatgacaggtggggcccctatgacagttcctggtgttttggccccattttaggtcggtttggctcgacttgtgggcccctcaatccgtgtgcttgcacgtgattcaccagaagtgtgtttccttgtatgttggtcccatttctccttcacttggatgtataattcctgcatccatgttatttctccaatcctaatgcaactacattatttattattggtatatttgtacaaaatgctaattttctctttattagttgtgctagttggcggtcgaaatcgatactgaacgttgcgcaattctattatcaactaattaggcatacttcttgtatgtgcactagtgatgcttacgtgcgactttcatcgtgttcgggtagaatcattgagagtttccatagtatttggtgtaaattcggtgcaccgaatagcctccgagtcatattctcaatgaatcatagtaaaaaaaaaacccattcttgctctatgagaggtgggtgtgcatcataatctttcaaaccacttctttcgtgtagtcaacagagtgtcaacgcactcgttcatctagtgtactcattcatgaaagtaacatagagacaccaatgagagactgaagatgcttgatcaatctcatcaagctaataaatagagtgtacttgagttgatggtgctcaaagcttcttgcaccgtcgacttcggttgcatatgtcagggatattctagattcgatgaacttcttgttcgtgatgccagtcatctttcgttattaaaaaatacacgcaaattacatttaggtaaaatgcacaaatgttgcaatataatggtacacaaaatttccgcaaataattccaatatattctatgcaattctatacattttacagcaaagatatcaattaagggtaataaaagcattacaaataaccactaatcataaatgcaataaataaaattcataattataaatatcaacaacaaaagttcctgaaatgcaaaatcgggatcaaaattcaaaaatccaggggctcttttatgcgagaatatgattttttagtggttttgcaaattccgaataccgttcaaacaaatatcccaatgcaaagggttatttgtgtatttttaaaaaatttcagggtttaaaacatgaaatttccaattcagacaaacatgcgatttcccaaaagatgagggtttatttgcaaaatcacaagattcaatcattttctttttcttttttccctttgttttctttccttttttcttttctcctcccccctcccccgatggtgctcctgagtcctgacaaatgtggcgggcggggaggctggcgcgactcgcacgatgggtgttgcatggcggcgtggaggccgagacacgggacgggcgactgggcgacggcgacacgcatcacggcgcgcgtgctgccgctggcgcggtggcctcggcgggcgcagtggctccggctccagctcagccagcggcactcggccgggcggcggctcggcgcgagcatggccggcggtgaccatatttccgtgcggcggcagcgcgggtcacagcggccccatcacggcctcgatggcgcggccggtgtcgccttctcctttttttattttttttctttttcttcgatttcttctttctaatggcgcatgtgatgtcaggcggtgtggccgccggcgcccggctctatgggcaagacgcggcgtggccgaccggcggtgtaagcagcaacggcagtggccgacatcgcctccccggtctccgcttccttttttttcgttggttcctcctctttcctttcctcttcttctttccttctaccttcccgataatggagtggaggcggcgtagccgtgcaacgacgctgtctagcggaggaggacggagacagtgcaactgtgcaaggttgacgcggccaaggtagcatgctagtgtgggcaattgcattcaatttcttagcatggagtgatgcagtaataactatttttattgacattaaggccaaatcactttgctatatcttaaactacatacatacggaatatgtccattaatataattcatatggataaaaactaaccatcaacacccatgacagtgtccttgtcatatctggagtttccgcaagcacatgtagatatttggagttttagctacgctttaggtcccctttgaaacatgggataaaaaacgcatgaatggaagtaacatgttttttcaatcctatagaatataaaaacacataaaacataaggagaagtttgtttgatgcagcacagtaaagattgaaccaaaggaatgtttccaataggctttatctcttacttatttttttatgaaattgacgataggatacaatcttaaagaaaacttcctatcttctttccataaataagagaaatcctttgccaatcctcataattattaagcttgcctaactgtcgaaattaattactcatcttcattccaacttttttttccagtgaggaagaacctaaatctttacattgcgcatatttcaggactatcatgttaagctcacatcgctggaaaatattttacaaggagtcatctatccaatagtgcctggatcaaccaggagttaccaggagtgatgtcgtacgcctggccatcatcggcccacctatcagtccccgccacgtggctccaccccccctcgaatggctctaggcaaatcacccagctggtatgcacgttgtgacagcatattctagtctggtttcccaaaccgccgaggctggggttaccgcgccccggcggtatgcatggttactgcggtaaccgtgaaaaactgtatgaaatcgtgcaaaattcatcaaaaatttaaattatttttaaatttatttgaatttaaggaggttaccgtggtatttacattaccgtaccccgtagtaagctcgataaccacggtaaccgcgcggctaccggccatacggtgatccctggtctctctcctttttttactcacccccgaaaattcacacccacccccaccaatcctagagcagtagggccccttccaggtgggaccgacgcgcgccacgtcagcgtagcgggtggcaattggcaaagcctccgaaacagagattcccctactaccagaatcaccacggtttccactccaccagcgacacttgacacgcacgcgccacacgccgccgctctctgtctctgtctcggtctcggtctccgcctcccgcgccgcggccacgccatggccgctgccggcagggacccgccggcgacgccatcctccagtgagtgaactccggttccccccttcgccctctccctctcccttcctcctcgctctcgtctggtggcaaagtccccggaaggggcgggttcgttttttttctttcttcgtattatgtgtttgattgagaggatatcctgagatggattgggatcatcccatcttttacatgtgtttggtttaaagactagcaagattccaacagagaatattcgggacaacctcatccagaaatctggcggacggcgccatcccacctccgcacgcgcggtgactagggttagcgcgagcaggggcgagttggcggcgggagtgcgctagccggcggcggccgcgtcgtcgcccatcctcccgcgaacccagccggcggcaaccctcggcggtcgctgctcaccctcggcttttgtctggttgggcctttcctcggtgataatgttggctcgcctccgttggtcgaaatctccggtgattttattttatttttggatcgtgatattatgcattaagcacctgtacatgtacacctcgatttgagtagaacaaaggtttgtagtattgtgcttggaaatgctcctcggaaacaaaccattcatgacatttgaggggagaagtgcttgttctactcctacctcatttgtttgtatgtttgagtgaactaggttctggattggagcttctttgctttgttttggagtaatacctgcataatgtttctagaacgctggtagcggtggggggcacattcgtcatgtcgtgatttgagattctcatggcgtacaagggaggtgtttgttgatggcactttgggaagtgggcgtttgtcgatggtacatataaagaagagtagatttcacaaaactcttttagtttattatgccaaaccatggtgatgtatgattaatgacatctatatactctaaactattcttccctgctaatttcaattaatactaattttcttgtcgtgttgagccacatcatcctgaatcattatggttattggatagttgttctgtgtctgagatttgcaaccagatcagaccagccgctccattcacatatcgagctcttatgtgttacttgccttatgtgcttgttgatgttgtttcagtattgctcactattatattatagaacatcctaaataacattcttaaattaagagttgtgcattaagctcaccattctacttggcatttgcacagtttcattgttttgcagacttaggggctattcaagcatcatttggtttccttcccaaccaaaacctgttctttcatggacctaatctgttgttttgtcttattctaacttgataccccaaaccacaaccaacatctcctctgatttaatcaatctgctgtctttgtaggaatgtattactgcaggcaaaggaaggcttcttctgaggtcaatgccaatgtgtttgtgcctgggggtcagaatggtatttcatttcctgcatcaaatagggctcatgattggggatatggcggtgttcgcgaagaatgggaagctagttatgctcgcaaactccagttgatcaattttctttcttcactgcatcaacgcactgcaaattctttgataaccactagaatggatgctaacatggacactcctttggagcaaaaacaaaaggacagctcagcaataatagttcttgattccgatgatgaggacgaagcagaaagatgtgaacagctcgcatctgagaacaataaacaacaggcaccatctggacccactagtccttgcacaacatggattgtatccagtgcgaaagaccaagtaaatggaaccttgcatgttgatggagtccaaagcactcaaattgttccatatggtcaaaatgcacctttaataaatcagtcccctttgcaaaccagctggcaaccatctatccaatatgaaagggttatattgcagagaagacctgaggagcaacgcgttcaagatcttgtggtatgtatctttcacttgaaatttttcaatggactatccacttctacatattggtacttttactccttccacatacctgcactgataaaccaatttattgcatcatgtcttgtgattgtactttgataaatctgaagagcgttatgatatttcttgtctggaatgtgagaatagaaatgtttggtgtttgttgaatctatactcttttgaagcttaaatatctcatatttgaactttaactcttgttgctcactgtaggcagcaagccatgcagagaagatagcagaaacacaagttttccttactctgcctactcttcctaatgagagaaaacgaaggaaatcagaaccgaccaccctggtagatggagatggtggaactaacctagggaaaggaaaaaggaaaaatcatcaaaatcaagcagcagttgattcaatcttggatttgcaacaaactgttgttcctttgcaacaaaatgatgttccttcacaaagctacaggactatgatagaagaggagaaacctgtaaaagaaagtgatggtctcgaggatctttggaaagatttttcattggctgctgaatgtacaaaggtacaagatgtaatcacagatgttcttttttacttttattctgcagccttataatactgttggttctttttccagctgacctctaattgtactcggaaatacatgctgtaatctttattttttgtttcaagattgaataccactgtccacaaagtaagtttcatggcaaagtgtattttataagataagctagagtttgaaaaggcgttcatttgtcatttaaatcagttaaatgcgtattttgacaaagttttgaagcatttcagttgattatttctatctgatttgtgtctttttccaataatgatcaaagtaatattctttgtccagcttgatacaaatgaagacatgtccaatgaaaaagatgtggatgatgaaaacgagatggatgacgattgcaatcatgacattcggattcatgaagatctaggccatgtatgccgtatttgtggcatgattgttagaaaggctgaaacaataattgattatcagtggaaaaaggtacataccatgttttggacatatgatacttcaaagttctcaaacctgtgatgtctatgattctgttatgggaatgggccaggcccatgcaacagtttaggcatgataaattaggaataagtcatatgaatataggagattatctagttaggaaagatatgaggtttattagaaagttagagatagagattggattggtttatataatactagagactagttccttatgtgtctagtatgtcctccctatatgtaaagggaccccatgtactctagtatcaatcaatcaatgaatctaaagttagccctaagcctcagagcctcttttagctcagcagggagaagccctgcctctgctattatagggcgagtgccctatcccccggtcctgggacccttacctaaccaatccataacagactctagttttactttgaggaaattaatataagcagacaatcaactttgggaattgttttcttcataaagaaactgcaagttgattatttacatgaaacccctcatgtcccatacagtgtccacttttaaagccccaagagttagatctggttatacttgaccctacacaccagccgtatccacttgccgtgttcatgtcaaaaaccattttcctcacctcctatgcaaatgctattaatattaaggcacagtaccttgaaggactttaggcagtggaagggcatcacgatcaagagaaatttgtggagtcatgctgaatgaaaattactgatatatggtttttgtaatgcttgttagattcactatgaatatctagggattctggtttcttttgtagaaaaacctgctatgggggatcttctctttactgaaatacttcctaaaatgggagagtgttttcattaccaactatattgatattgataccgctttggagtatatagtaatagtcgttttgcaaatcatatggatttctttagtggcttgtacctgagctaagctgggagcctgggcagtatccagagcatgggtcctgtagcaaagatggaatgcttgcatcagttttctaacgtttgttggattttcctacgtggataagaaagttaacttcatgcttacattatatcaggcttcaaggacaagaacaaattactatgaatcacgttcaaaggatgctgatgatattgatactggtgctgttaaagtttctgaagatttcattgtctctgatattgccattcatccaagacatgcgaagcaaatgagaccacatcagttggaaggattcagcttcctggtcaagaatctagttggagacaaacctggaggttgtattctagctcatgctcctggttcagggaagacatttatgctcataagtttcattc

SEQ ID NO: 65375 - DNA, 4260 bp, Oryza sativa
aaagaaaggaaaaggcaaaagagaaaagaaaagaaaagaaagagggagagaaaggaaaggaaaaatttagggggaaatttaaaatatttaaaaatattagaatttaatcataggcttaatgaaaatatagctagataaattcttgctatttaaatacctaaaatactagcatttaattataggatcaattatttaagaactaaacaattagatgaattcttatagattattatagattatttttagtaaactctataagagattaattcgcggtagtgatctagatgtaattaaggactagataattagataaagtcttaggacatgactttaaatcacaaaatttcttaagaaacacaaatattttaggtagaagaataattccacttcgcgaataaagtagcctatatagaattcacctcccgcgctcgtttctcaattcggtcattatttggattttgtttgaattctaatcgaattcaaattgttcttacgcacgtaactatagagaccgagggagccgcggatccggatgaagaccaagacccacaagacctagagcaaggcaagtcatcactattccttgaacatgttgatcccaattgcaaaattgttttgtttacaaataaaattgcatgcaatgatgaacatcctacttgtgattatgccatgccttgattattgtttacccttaaatccttgtaaccatgatttacgtaaaagtccctagtcaactatgataaatgcttagaaatgctactctagatttatgcatactcatatttatcaaatgctatatgcttgggcaattatctttgggaaggtaattgagatgcggcatgtggagacatgagcgccacattgccatgatattgatgacatgatttgtgaaaggaaaatgaaactaaacaaatgatttcgactggggcggatggaggatttgggtggtatccggaaaaaggctagtgccatccctggtcaattaaggaccgagccatgaagttaagcatgaaacgaccctcgtacaaccgcacttctcgtatgggtatagacctagcggaatagatagctgagcggaggcattatccatgcatagtggtttcttgatgtgtgaggcaggggctctacggtggggcagccattggtagaaccgcgaggcgggtgtctacagtggtgtcgccatcggtaggactgccatgagagaatttaaacataattataacttaatgtatgtgtgagtctttctttcccgggtgcgccagaactcctctcactgctagaaaccgtgtacgcctagagtgcaagaggatgtaaagttcatggagcgggtactgccaatgcgaggttatcaaaaagctttgtcgtgatgcgtctcatgtgttgggacgaggctcatgtgttgggcagtcacggagtgcgggtaaagtgtacatccactgcaatgtgagtaaaccaaatctattcgaatagccgtgctcgcggttattgagcaccgggacatgtattacacttggctagtctctaagttattaacttgtgtgggatgggtagttgcatgatgaatttatatgctgttggagccacttcctgagaagggggaaagtgggcgtcctcagaaaaccataacgattcaatggcgggaagctatccttgggatcacaatggatggtggacagaaccgtcattgtttgaatacaaacactggtactaaaatttgatcagtcaatgctaggtctgaggcttgtgaaaagaattacaaaactggctttacgcaaaagagccatagccatcctttgaaatacccctttcatatgcattgttgctgtggtggcttgctgagtacggttggtactcacccttgcaattataaaattaatcagaagcgggaaatgaagcttcggaggatccctatgcctactaccaggagggagatgaagacgatggcgctcagtaggtcttagtacggtcgttgcctgtggcaatggcatgccgctgcctaaattctgctgccttatctatttctgcttttggatgtattccggaccgctcggtccgatgatttaagacaatgtctaaggtcttatggtgtaataattagcactagactctcgtgtatgtgcatttggtatttcagttatgaactcgtgtgtaccagactacttgatccagggaaatggtactgtttacatgaatgattcctgttataaaaacgggggtctacacattcatcctgcaatggtcagcccatcaggcaatcatagcagctgcgcctcaatggggcaggtcggatcacagagcatggacgccatgcaaacccagggcgaaaccacctgccccgttgatgagatcacgcagcggacaccatgtgagctgcatattcccttcaagaacttatcaatcaaggtatgctcgtagtttgatgatttttgacttgtacattccgcaagttgctgcttaggttgattactaatagataacctctcatcacgtgaaggtggcgtcgggaatggccatcccaacggacccttccgggacttaccactgcaggccgattccagcaggatactcgagggtcgaagttgagctggtggaagccgcgtacgaggacctcgagttgaactacccaggaggagacggtgagacgcatctacgagacacaagccacgccatcatactatggcgcaagcggtacatcatccttcctgggtgacaagcggcgtctcgtgcaccatctcctccggctccgccatctcctcctgcaccatctcttccggttcctccgccacgtcctcctgaaccatctcatccggctcctccgccacctcctgctgcaccatttcctccgactcctccgcctcctccgcctccaccatgtcggcttgcacctcccaagacaaggtctcgccaagctccaccgcctgcccacacaagggcaacgaagaaggcgaaagttgacgccaccaaaaacaaggagccaccgtacgattgcagtcaagaggagcttgatgcttatgtggcaggagaggtgaagaggcaactcaagcctcggagtcctgaaaagaagatacctattgacccgagcgtgaagaacttcttcaagggaatgtccacaacaaacaaggaggcgttacagatatcggactatgaccgaacacttcagagagcctatcacaagaagtccaaaccagtccctcagcttggagaacaaccaaaccaagaggtcgagccattggtgaccggtgaagattttggcataacagaattcattgcagacaccggtctaactgtggatcagttggttcgaggcgcaccaatcccgaaggcggaagtggcatacaagtttgaactcggtaaaccgcttgtcaaacctgaacagctgcagtccctaccgacacagatgtacaaattccatgaacggtacatggaaatgagcgccaagggtagagagatgttcggagcgaggatcagaaaccccgacttcttgcaaggagaagatgttctctggatccatttcaaggatctcttcgatctgtaccagttggacgccctcgacgtctctcttctgagcgcatggattttgtgagtatctttgagttcgatttgtttcgttcaataattagctcctggcatatatgtaagcaataatactttcctttcatcgttgtagaatggagattcgaagggcccgacggcggagggtctacgatactgggttcatcgaccctcggaaaatcaacaccgaaatgatcgacaagtacgagaaagacacagaggacaatctcgtccatctcctaacgcagcagcatttcaagacgtacatactactgccgtacaacagagagtgagtttttattgtcgttcgaacaaatttcgttcccatacatatagcatgtacattttcgatcatatatatatatctcatctcacgcatattccagattccactgggtcctgttattcttcgacttggacgcatgcagagtcactgtgtacgactcaatgaataaagaggagaagatttttgacaaggtcttcaaactaatagacaggtaatataatgccatctattccaaagtcgcggggaatctattgctattatgttgatctcaggtaataattaatcatagcttgcaactgcatatgtagggcttgggatcggttccgttaattggtccgcgggacttggaaataaaaacttggacggaggtttcattttccagtgaatacatgcatgatccaaaattatattgaattaatctc

SEQ ID NO: 65376 - DNA, 900 bp, Oryza sativa
attctgataggggtctgaataggagtcctacgggccttgaaggcccgagtcatggatcctatatattcgtgaggggtgtgactggggaggtattgaatcacgtgagaaaccctagccgctactctccttcccgagaaaaaccctagccgcgcgcgggtgctagcgcatctgcgcgtggcgttccgtctctgtacagtagaggcgccgctgcattgcggtgctgatcggcgtggtactacggcgaggagaatgcacgggaaggagaaggtcgacctggtgcgatcgacaacttcctctacatcgacgcgcgctacatcgcgagggttcctttgccttcttagcgctttcttccgctgcgcaacacgtcgagtggtaatgatctatgatctaatacttgcatggttcctagtttacgtggtagaaaattttgatttatgctatcgtagccttcgcgtatcctaacagtggtatcagagccgccttgtataatttatgatttagatcattgcatatagttgatatgcgggcgtagtagatgagatctattttgtagtagatgagtacttagatgatcggaacataagatggaccgataggcacatgggttgatgagatcaatcagtatatgtgttggtgacttcactagaatgtctggtactcaccacggccgagcatgattgtgttcatcggatagtccgatgtccactggaaccgcacgcattgagaaaaacgagacaatgagattgactcagtttcggcacaatttgattacaccgttaaggttttcatatggcgaatcatagatgagatctgtgtaccccgtgaccttttcaggatatgacatggtaggatagattccctcaaaaattaagtgtaatttatgctcttacgataattgca

SEQ ID NO: 65377 - DNA, 7158 bp, Oryza sativa
atatatatatatatatatatatatatatgtatatatatatatataaccaaccatgcagcaaacagggccatgcaaaaaaaaaatggtgcaccgatctttagtcccggttggtaatataaaccgggactaaagatggatctttagtcccagttatttcacccgggactaaagatagctatctttagtcctaaattcgtagtcctggttggataaccgggactaaagggggttaccaaccgggactacagacggtttctccaccagtggatcgtcgtccttgaggccctggcgatcgtcgtccttggcgcaactcaagtcaaagacttcgcccctaatcaattaatcattgcactagaaaagagataagggacgaaattgaggactggtaaaggatttttggaggacactcagtttctttttgatttttttaggtcctttgattcatagaaaaagataaaagtttttgtataggattatattcctatggtcaattttataggaaaaataagtaagagattagatctcttcaaaactttcatttggttcatttttttcctttcgtgcagtcaaaggacatttcctcctgtttcctgtgttttcacttcatgtcggattgaataagcagttacttcaatttttacggttttttctatatccatatttttcctttcctgtggttcgaaggggctctaagactttgatttatctctagttcttcatcacaaaatgtagaggggaaaaaaagacttttgaccttagtttcttgacgtgctacttctacgagaacctaaaacacacacaggatatacaaataattactccatctaatcattgttttttttaaaaaaaaagagaagaactttgcagtatttcattgatagtgaagatagagcaacatcaacatgatcagaaaggataaatcaccgtgtccgaaaaaagatcaagaataaacaccaacccaacacacaacacctcacaaagaccggaatatccctctagtaagtattcccaatgtcatatatctatgacaagtggaggtaatatttgataatattttttaattacacgagtatatgtgggaacacacatggaaacaaacaaaaatgcagaattattttgtaccaacatttttcattttgcccctgagggattttttccatcttggctttttaccactaaggtgaaaattagtcatggtttagcctcacatttgcatttgccctttggcaaaataaatagacatagtgaatgtttatattagagtgtcatatatatgctattttttatggataagacttctgatactaatttaacagcaagcgattttcgtccaatccagatcctcagtattgcagactcaatgtggggctgaatgtggggctgagggtctgtaaggcccatatgtcagtgagcacatgcagtactgcaggagccgcatccattttcatcaccttgactcttaagacgtcaaaagcaactctacaaacaaatttaatgagctttaagatgcatttgtgaaatggggagcctaaagagtctacaactcgtccataactttagccagtaggaacagtacaactgaatggtatttctttaattttgtcttccttttctgatattaattttatcggaatatattcagggccatatagtctttgaatagtcatgtttttttatttaccaatcactttttaatatcgagattaatatcaaacattcacatatactcttttttgggtgaaacaaatagtatttaattagagctccctttaaaacatagaaataggaaaaaaaaacataggaaccaagtgacatagattttaaattcctacaggaagataaaccatatgaaagtactttaaggtcccgttcgtttctccaactcatgagttggatgaaaaagaagatttatgtgacacatttttcaaactgctaaacaatacgtttcgtacaaaaactttctatatgaaagttgttctaaaatatcagattaatccatttttcaagtttgtaataattaaaacacaattaatcacgcgttattaccaccttgttttacgtgaaatacttaatcattatcttcatcttcatcttcatgagattcaaacaccatctaaatattggtgtttgattggaacacataagaaacataggattgcaagagacaaaagattgaaaacatgaactaggacctcttggccttgtttctctgaaatcaccatataattgtccatttcatataaatttcaaagaaagtgataggatttaatcctttgtttcaaaggctctcataggaattattttataggattaagaatcctccacttcaaagcggccttcaaattgcactttgatgaatctctaccaatgttaaaaaaatctaacggcctagagaagcacaaagcatatctagatgaattgtggaatgcagaaaaaaaaactatccctagagaattattacagtgtttgtagaatgaataattatgaattacaaaattatagtttggttaaaaacaagaaaactactgagaagcacaaccttaaaaacaaaaatctccatctaaggttgatcagaggatgcataactattgtttgtaccaacatcttacaagttgtatgttgtagttatctttctcaagccataaaaatataatcttcgaaacaagtaagtaaggaagccgtgaagacgattccaggtggtggcaatagtaaaaagaatataggcatatgagaaacacaatcatatgatgctgaaggttcaatatcacattaaaaaactacatatttaacaaaactacagatttgaagtgttgtatcacaaaactacatatttaacaacaaatttatcatggaactacaaatttaaggtagagtttcacaaaactacatatttaatactatctctgttttttaatagatgacgccgttgactgtttgtcacacgttttaccattcgtcttattaaaaaaattacataattataatttattttattgtgagttgttttatcactcaaagtactttaagcatgatttatatatcttatacatttgcataaatttttgaataagacgaataatccaacatgtgtttaaaagtcaacaatgtcatttattaaaatacggagggggtattaaagttatcacaaaacttcatattgtaaagtttcaatcactagcactgtcgttctgttggacattgtagttttgtaattaaattgggactgaaactatagtattgggataaatttgctacttaatctactgttttgtgaaactttatcttaaagttgtagttctatgataattttttttttgttaaatctatagttttgtgatacaccactttaaagttttgtaaaattttctcatatcacaaattaagaagacaatttgaactagtgatatggttcacaccagtttttcacgaaccatttctggttcactttgtttgtgcactgtcgatggttatgacccctacaattatttctatttattctaaaatgtttcaaatttcagaatacggcgagaagcatccttgatatggcatggaattgtaggggtatgactttattcatcgggttatatatatacaaatataagtatggttttagcatatcaataaattcgtaactcagagatatcgctaatctcgacatggcgatcaacgtgttaagacgacgcacttgcagtttgtgagtgtgtatacatgttgagtcgtaatcgaaatcgaaaagaaaaaggaaagaaaacaattgacgcttactgtcatcacagccattactgaagtaccgatcatgctttctactcattcggagagatcacaaacttttatcgcatcaatcatcatcaaccgatcgagctaatcaccatcaagttaaaaagcgagaggacaataggaggcatcaacaccacaataacaacacaaaagaattaaaaagcgacctctcaaacatgagcaaaatctttttctgtccccttctttttcaggtcatgcaaaagtaaataaatagaatacttcttccgcattagtttaaacttgtatctttttttaagcgcagtaattataggcatacaaatttcttcaccataatataatcatctaaaaccaatttatggcaaaaggaaaaagctagaattaaccgtgccaattattagagaacgcaggtggaagccttaaataggcaagcagtcaggcatttagcagcgcgctgcgcgcagcagtgaagccatagcccaaagccacaagctaaaaattcgtagttgtttttttaataacatcactattaaatatgtattttacgatacggtattaaatatatagttttatgtatttttatgatacggtattaaatatatagttttatgataaatttaatgttaaatatataattttgcgatatatcattttcaatctatagtttctgatagtttaaatggagttcactaaaatttattaaaaaccatgagtaaattttataaaactacatatattttaaattttaaatttgtagattttaaattttaaaagtatactgtaaaatttattataaaccatgagtaaattttataaaactacaaacctacatatttaataacaaatttcgcaaaacaatagaattaaaataaagtataacaaaattcccttgtggtgaaaccagtctatccgggtttaagttttagacttaacatgggtgctcgtatttacagctaattatttttttagtggtaagtgatgtactcatcgacagcaagatgtctatggacttcatcaatctcaagatatactggtccagtcctccgaagatgcttatagaggtagggtatgtgtgtatgtgtttatagacgtgagtgtgtgtgcgttatgggcacctggatttatactacgcttctcaaaaaaataaattataacaaaattgcagatttagtaacaaaattattataaaactacaacattttataatttggagataaaattagtgctaagagtttcaactttgaaatctgtagttttgtaatagcacataattctatgatactccgcattaaatgttttgtgaaaaaaataatcttaattttatgatatgacgttttattctgtactatctccgtcccataataattgtatttctaagatttacatgtgtcacaaaataattatcataatagagtactaattgtctcataatcacttctcatttaaatttatttctattttacccttaattgtccttctattcttacctatacaccatttaatgaggggtatcgtaatctcaaatcttaatatatgctaatcaaaaccatatatcgaaaccatttattatgttaaatgtcgattactccctctggttctataataattgatgttttagataagattgaagtcaaacttttataactttgactatccataactttaaaagtatttagtttaaaaaacaagaacaacatatataaaagtatttagtttaaaagaacaagaataacatatatagatttgtctttcaaaacactaaacattcatttatttattacatatattataatagaaaaataaggtcaaatatatgttttttagatcgtgtgattatcaaaatattaattaaaataaaatcggagggagtattatagaacggagggggtggaagcccataaataggcaagcagtcaaccagatggtcggtattcaggcagcgaagcccccccaaagccgagctcgcgcgcggcggcgtcgtcgtcttcctcctcttccccccgagttggattcgtggccgcgcggcggatgggaggggaggagggaatggcggcggggaggaagaagcgggtggggaggtacgaggttgggcggaccatcgggcaggggacgttcgccaaggtcaagttcgccgtggacgccgacaccggcgccgccgtcgccatgaaggtgctcgacaaggacaccatcctcaaccaccgcatgctccaccaggtaattcccccgcttctcctttcccgctaccctccacatccgcccccgccagtgcacgagtccaaatcaaactcctcgcactcccccctttgctttgatccgggcgattctttttacacttttttttatttgggtgctctccgctgctgctttgctgtttgccaaatggtgagcagccgcgcatcgacgagggcggatggagaatttccgaatatacctcgacagcaatgcgcaccactggttaattcgtgcgagttgcgcgcagctcttgccgtttgatgattaagaataaggaattaactggagagccttaaatttcttgttctcccaaaggggaaaataccttttttttaaaaaaaaaaaagaaaagaaagaaaaacttaattcgagcggtttgtttggtgtttcatctcgtttgggctgacagaagctcagttgcagaattgaaatggttgggtgttgaaagtgattttaccaaaatttggtctgttgtagcttaattcgatttgcggtgtttgcagaaatgctacaaatagttggttcatatggttatccaacgacatcttttgaggatgcatcttgttgcaaagtgctcaagttctctaattatagtggtgtaaatcttttcctaagcttcctgatttgctagttgctatggaacttggtttctctccaattgtgtttgcaattgcaagtatatatttggtttgtttaatataactgttctataatcctaagcctactgctatgccatgaagcttggtttctctccaattgtgtttgcaattgcaagtatatatttggtttgtttaatataactgttctacaatcctaagcctactgctttgccatgaagcttagtttctccccaattgtgtttgcaatttcatgtgtataaatttggtttgtttagtttaactgttctgcaaatcaatgatgaccaccagttttacctgattttgctgtgagcacccatttcagatttccagtttatgcgagatgtactttctttgtgttgtttatgcaatatcgctaatcatgataacaaaaaaaaggactaaaccattctaattcggcattagattacgaactcacttctcatgttacttgacagatcaaaagggagatatcaataatgaagattgtaagacaccccaatatagttagactaaacgaggtatgctaaat

SEQ ID NO: 65378 - DNA, 771 bp, Oryza sativa
taaaagggataaagtctagggaacggaagagaaccaattcaagaaacggctgagagaatcgagcgaatcgggcggaggaaacggcagcgtctcggcagctgcacgggctctatctggagctggaagacgacactgtagctggagggaaaaagtatagactttcagctgggcttcatattccaaggcctgattaaagagggaagcaaatgcccggtttacgggagcttctcccagctgcagcttttcccaaaagctgcttctgttagaagctgcctcaaactgtccatagcttctgagaatctgtagttacagattctgaaaaatgaactaagaagccaaaagctggagaagatgggtttcagagcttttccacattctcagaagctggctaccaaacagctgcttctcagaatctaaagctcccccaaatagccccaaagcagacttcgacagagagaaagaggctgctggatcggctgggctgaaggggagagatgggccagattaagacctgagctttcgaaaggattttaattacttttccaactaaattaatcactgaaatgatatttgaattgttaaaaatacttcaaatactgaaatatgttcaagaaaaatctcgcaactacttggacacttagagtatttaacaaacttaagataagatcatttaatgactaatttaatatttaaataattcctaaaatgttctttgtattattaaaattagtaattgagctctaaaaaatccgagaaaatttcagagagtat

SEQ ID NO: 65379 - DNA, 1030 bp, Oryza sativa
gattccacgtcgtatctgctcccggcgaaagtggaggtagttgtggcccgtcccatcaaaaggtgactcggacgacaacgatacaaatctccgtccatttatgaaaaggtgggggaagtccccacaaaaaagagggaaatggtgcatgtggtatccccttaagatataaaaggaggaccttgcccacttagatgggaggtttttttggactggacttttccagattaggaacccagaacaagggagaggctggctcatactttgtagctccttcacacacgaatccaccaaaacacaggagtagggtattacgcttctcagcggcccgaacctgtatacatcgccggcgtcttgtgtgcttcctgtctcgcgaaccttccacagattgggagcttagagtctcacccagggtccccggccgaaccggcaaaggggggccagcgcggtctcccgatgaggagccccacgctccgtcagatctagattcatagtactagaatgtgccacatgctcatggtaccagggagggagtattgttatactagtactgtactaactagaaaactgaatgaaaaagtatgcaactatgcatgcattagtcatcagtgtgtgaattgaccattgttggtagtcttagtacagtcaatggctactgaactgcgattgatcatgctactactccttagtgtattagcttgtctagctagccaattaaaccggctgctatactgtagtacactgttattgttaaagcctgcaactttcttaaataaaaggctgaacagaagcagagagcaagcccatttactcgtgcttgctgtgttgttagtgatggcatttgtaggtgatgcagactgtacaatcacgagcagtattgttcaatgaatgaacacacagcagtatgtaggcagagtatgtgtacttggtgcatttgtagttgatgactgatgaacagagacagttctggcctggtatgcgagcgaatcgtgaagatattcattgctgtcgttgagctcaggtgataggggga

SEQ ID NO: 65380 - DNA, 3503 bp, Oryza sativa
gctttgaaggaacctttatgtggtatgctctctagtcataagttaaccatctctaagattcgggtccaaggttatgacggagcttctaatatgagaggggaatttaatggtgtgcaaaaattgattcgggatgaaaatccttatgctttttatgtccattgttttgcccatcaattacaactagtagttgttgctgtttcaacttctattccagccattgcagatttattttaactatatgcctttaatagtcaacactgtgggtgcatcttgtatgcgaaaggatgccttgcttgcaaagcatcacgatgtattgttagaaaaggtggagaatggtgagattaccactgggaggggcctgaaccaagaaagtagcctagctaggcctagaatactagatggggttcacatcttaaaactttgcttcatattctggtaatgtgggaggctatcatagatgtgcttgagattgttaagaaagattcaaccaaaccaacatttaatggtggagcatttggtttgatgggtaaaatgcaaagctttgattttgtattcatcatgcatttgatgataggcatgttgagcattacagatgacttgtcacgtgctttgcaaagaaaggaccaagatattgttgaggcaatgagtttgctcatagatgtgaaagagctcttgcaggacatgagggagaatggatggaagccactattgaatagggtgatttcattctgtaataaacatgagattaaagtgccaaaaatggacaaggaagttaatgaaagagggacatctacacgtcgaaggcacaatgtaacaaataagcattactatcatgttgagatctatcttgcagccatcgatgccattttggttgaaatgaaccatcactttagtgaagttagttcagagttattagtatgcatgtcatctcttaatccacggaattccttctccaactttgatgtggataagcttgtgaggcttgctgaaatttatgctgaagattttttggtttgtgatcttatgctactacggactcaacttggaaattttattagcaaggttaggagaaataaagaatttcttggatgtaaagatcttgcaaaggttgttgaattaatggttcagactggaaagaataaaacttatcacttggtgtatagactcattgagttatcattgatacttccggtggcaatggcttcagttgagatggtcttttcagctatgtctcttataaagatagatttgcgaaacaaaatgggggatgaatggctcaatgactcgatgatttgctacactgaggagcagatttttataaatattagtgatgaaaaaaaatcatccaacactttgaagagatgaaaaagcgccgtatgctagtgcctcaacagaaattagtggaatgctccatgcctccattctctccccaagtctctaaattatttgaattcgaaataagtccttttcgattaatcgttaatttgcctttttttattagtctagatagctactcatgaagaataataagtggttggcatagatacatcatctattggacattggtttggtatggacaaaattccctcctaatcattaatttggatgtatgtctactttgaactatacatgtagccgatttatatgtgagatgtttcaatttatgctggcttagtttgttcagcccccactacttttttttcctggatccgcccctgtgagcaatctactataaaatatggtagtttgaaaaataatatatatttttagaaagtatatatagaacttttttttaatacaatatatacaattggtcacaaatatcgtgtttatagcatcgcaaaaacatgctaaatataatttaattttaataataaatgattaaccttttgttatctttacctaaaagataaactttgttgtgaataaaactgtacacaatgaactcacatagtctcatatatcaaaatctacacttccaacggtatacttgagaaatttctatgttcctttgattcctaagggcaaaatggacctttcacgtatcaattaaacagtcaactgatgaaaaagacatacaagcgatcaaatcaaaactcataggtatagaagaaagtgagaaaaatcaaagacattggctaaaattttatgagcgtacaatgaattttctccaaaacaagaggctaaaactatacaatacatatttatgactaaattgcatagggctactacaacttgtacaccatgaaagctgcatttccttaaatcccaataaaaacacgaaagtttacagggaaactcgtaacaatccacattggcatgcaactcatctcagagaaaaaaaaagaaaaaataacagcatatttcagaacatgagctagctaataaagttggaggtaggacgcaagtaccatgactgaatttttctaatccatgttaaatctatactttctacaaagttataaagttataaagttatagttcactaagtctaatgctcaatatgcaaccgtgtcttatcatcacccaatagcaaccattatatatttaacctcatacaagcatacaacatcatctacaattagtttatttaattctataaatcaacatgcaagcatatccttttttgtttgtttcatgttaactactggtaaaccttaatgttttattatttgttcccttaatgttttattattttttcctttttactcttagcttgattatcgaaaaaaatatattaagaattgcttattaatttccacagcaaaaagcggagaatcacctaattaagggttaataataaggggtcaagctttgtgggccatggctgtcaggaagccatagctgtataggccgcatgatattcctaatgggctggctgactggctcccatactggacttcaactgaggtccacctaccaacctgctcgtcaacagatcgatgaccctgctaaccttgcgacgcccgttgctggggcgagcagtttcaaccggtcagtctttttatatatatcttataaattgaaatcctaacgaactttcaaaggtactttaaaacacaggattgaaaaaaaaaacagagcaataaaaagaaaaccacaagatttttgtttgtgacataatttggctagcgactagttctatttggtcaggccaaattatttggatcatctattatattcaagctaataaatagcgttcgtatagcctgcaatagcggctgctataaggggtggcaattccacccacggggccgggtaccctgcaggacccgcccctacgggggcagggacgggtgacatttctaccccacgggtctgttggggccagggccccgcattttgcgggtgaggggatggggcacaagttccacccgcgggtaacccgtggggccccgagggtaatataatatacttgatatgtagcccattacaagaatgcagacccaaaaagcccatgggaatcagcatatataagaaggaaaaaaccaaaccctacccca

SEQ ID NO: 65381 - DNA, 5305 bp, Oryza sativa
tcttattggcaaccgctgtgaagtttacactgatcataagagcctgaagtacatcttcacccagcccgacttaaatctccggcaacgaagatggctggagttgattaaagattatgacatggggatacactatcatccaggcaaagcaaatgtggtagcagatgctttgagcagaaaaagctattgcaatgccttatgcaccgaaggcatgtgtgacaaattgcagcaagatcttgagcacctaaatttgggcatcgtggaacacgggtacgttgctgccctagaggcacggcctacgctcgtggatcaagtcagagcagctcaggtaaatgatcctgaaatagctgagctaaaaaagaatatgagggtcggaaaagcccgagagttccatgaagatgagcatggcacaatctggttgggagaaagattgtgtgtgcctgacgacaaagaactgaaggatctcatactcacagaagctcatcaaacccagtattcaattcatcccggcagtactaaaatgtaccaagacctcaaagagaaattctggtgggctagcatgagaagagaaatagccgaattcgtcgcactctgcgatgtttgtcagcgagtcaaagcagaacatcagaggcccgcaggactgctacaaccccttcagatcccggaatggaaatgggaagaaatcggaatggatttcataacaggtttgcccagaacatcgtcagggcacgattcaatctgggtggtcgtggatcgactcaccaaagttgctcattttattccagtacacactacctatactgggaaaaggttggcagagctttatctttcaagaatcatgtgtttgcatggggtacctaagaagattgtatctgatcaaggaagtcaattcacttcaaagttttggcagaaactgcaagaagaattggggactcgtttgaatttcagcacggcttatcatccacaaacagatggtcagaccgagcgagtaaatcaaatcttggaagatatgttgagagcttgtgcacttgactttggtggagcctgggataaaagtctaccgtatgcggaattctcttacaacaacagctatcagtccagtttgcaaatggcaccgtttgaagcattgtacggacgaaagtgccgcacaccacttttctgggatcaaacaggtgagcgccaactgtttgggacagaagtgttaaccgaagcagaggagaaagtcaggaccgtcagggaaagactgcgaatcgcccagtctcggcaaaagagttatgctgataaccgccgaagagagcttactttcgaagcaggggattatgtgtaccttcgtgtcactccgcttcggggagtacaccgcttccaaaccaaaggcaaattggcaccacgctttgtgggaccatacaggatcttggaacgcagaggtgaagtcgcttaccagcttgagctcccatctaatatggttggaatccacgatgtgtttcatgtatctcaattgaagaagtgtttgagggtacctgaggaacaagctagctcagagcacattgacatccaggaagatctgacttatgtggagatgccgatttgtatcctcgagactagtgagagaaggaccagaaacaaggcgatcaagttttgcaaagttcagtggagccaccactcggaagaagaagccacctgggaaagagaagatgaattgaaggccgctcatccgcacctcttcgccaactcttccgaatctcggggtcgagattccgtttaaggggggtaggtttgtcacgccctgaagtacccctcccttgctctaaattcataaaataaatcgttcgaagaaattgtttaatttaacctagagagaaaccctaaattaataaatgcaaataataatcggaatcggcatgtggaatttttcttgggttctacatgtcaaaatacgctaacaggatttttagtggaattttcagagcattggaaataattttaaccaattaaaataagcaaagtgcaatattaaatcgctgggaaaatcctttttcctttttatccttcctttttccccctcttttcctcctttgggccgccggcccatctctcccgccccctcccgaagtccaggtcgcctccccctcactccctcgggcgctgacaggtggggcccacctgtcagcaccttccccaacctccagccggagggacggcctccctcctccctaccgccccgcgctccctgccgccccgggccacgtcgcccactcccccgcgcgcccgcactccccgcgcccacgccccactcccgctcaccccgcgcccgcgagatggccgggattcaaatttgaatcccgcctctctctctctcctcctccacctcctccactactccggcgaaattgcgccattcccggccacgactcgccgcctcccctcctatttaagcacgcccgcaccttcctctctctttttcctttctcggccgagccctcccgagccctccatcactcccgcaccgctacacccgccgccgccgccttttccactcctccggtcgccgctcgccgccgctggagccgccgccgagccaatctgccgccgccattagcttcgccgccgccaaagctaccccggccgccgcatccccatccaatcccgccgtcgggacccgcttctccccgcgcgccggtgagtaccaccatggccgccgccttcgaccggcgaatccgctcgccgtagaccacccctctccctctaatcctttccattttgttccctaggaggccccggagatcgttcgcccgtcgccgtcatcctcccgtcgctcgtcgtcgtcgttcgccgtcgtctccactcgcgccggccaacctcggtgaaaaactccccctcctccctctttccctctctcccgtgtgcgtcgccgtcctccgcgcgcgcaccgtcgtcttcggccgccgacgccgcttttcgcgccgtctgccgtcgccgtccgcgccgccggttgccgtcgccggtgaccgcgcgtgccgccgtcgctcgccatgcttggcctgccggctttgaagccaagccgagccaccagcggcgcccctcccgccttgtgccactgccagtggggcccacgtgccggcgcccctccctctctctcttgagccgccgctcggtggggcccgcttgccagccgcccctctctctccttgagtcactgacccgcgggtcccgcatgtcggcgccgccccaccccttgctgacgtcagccctggggcaatattgcgcaataaatcgattaagggtttttcttttatagtaaaaacacagagaatcttctaaaaatcataactaattcatccgagctccgattaagtccattcaagtctcagtaaattcataaaaatgtgtagaatccattaaaaatggttttgcttcctgtttcagtagtcttatagcatgttttgcttgtgtgctttgtttgtcgcgtagatttcggccgtttcgtcgattcgtggtttctcgaagacgttgctgtggttccatcagtgcgagagcaaggcaagtcatacattgcaattgatcatattgtacctaatttacaaatgtcccgcatttctattaaatattgcattgttttacaatatcatgtgggatgggtcctattactcagctatatgttgtttcccttatgccattgataacttgggtattaaaatgactagatgttggtttaggagatgcttagccatgcttagttcaactagtgcacaaaaggggaccacattaaagcatagacttgattattggcaatagctttggattagtgccaccgcaatggtgttggctaattaaaatacactacatggtgggctgtgggtgcatggttttgctagacgtgcccatggcgattaaggaccggttcgcgggatgccctggaagaatttatcgtacttaccacaagctagcgtgggcaacggctgggcttgtagtgtagcttttctctagccgacgtacccaggcgagggtgggcgtgatggagttgggtcggccggggtgtccggttgatcggctgccggattcaccgcggcacgaaaggggggctgcccgttgcctgctggggacgggggcgaaccctaaggtgtggtgcgatcggttagagagggttatgcgaagggtcctgtcacggcctctttccggtatgtcgtggtggcatgtcggcgcacgggaacgtgtcgtggggctgtgtcttgtgggtacagttgtacacttctgatcagagtaaaactattcgaatagccgtgcccgcggttatgggcggtcgaccagattcaccgtgattagtttcaccctagttagcttttggaactggttagttcaggtggtggtttgggcctgttgcaacgtggtgtaacgttggacagtgattggttaatatggattaattactacaactgttttactgctttcaactactgctttgaaatgccggctttatgcaaaagaacctttagcctcccttggatatatcttgcatcatacctcctcttccggtgtgacttgctgagtacagtgggtagtactcagtcttgctctcttttcccccacaccagagttgaagtccttcccagttgaagatgtctcgaagaggttggtttcgtcgctgccgtcaaggattgcctgtggaatggagtcgcccgctgcaggagtcaagtcttcaggcttagctcgcttttatctttttccgctgcatttgtaatcttttatatttttgtaagacgtggatctgtatgtcaacaattgtcgtttgtgtaccctggctggtcctggacaggggtttaatgcacattcagcttagaaattctggttcgtgaatttctgggcgtgacaatagctgagttccggcttagctatgctgcattgttaaagggaatatactacatagagtatactagctagaatagactaggatgttgtatactagaagtacatgagtgagacatttctattctatttccacttattcatatttaggataaggaggagttagcggaatccttggctgtgtgtcactctacccttaagcttaacttacccctgcatagaccttaatgtatacaggtaatacataaactattagcatagtactcttttatcatatatttccttgggataaaataaatacgatatcttcgaatactcccgggtgaaatgctacaatggtatatccgtgcgtttgcggatcatatttgtaaccataatataccaggattatttctaatgctattgctgggaattatatttccagtagtgttactaagaaataccaaca

SEQ ID NO: 65382 - DNA, 2599 bp, Oryza sativa
aatcaaacgttcataaaccaaagtaagcaaggctcgaatttagatgtcatatgtgccattgttgtattcttttcttaagggttcaaatttggaaacacgtacgttcaatgcatatgcgttgtttcgattttagttcaaattgcaggggaacaaaatgtgtgccaactgtcttcttggttgattatgttatgccactcttttcttggttgtgcatgaacaactaagcaattacttaaatcaaactatatgtgtcatgcttttgttgttatgtaattaatgagcaaatatattattttaattattcaattccaagcatcaaacctataaatgtccattcttaattcaaaatccagactcataaataatgatggaagacactattactttaacgagtagaatgcactgctctatgtagaaaccttaggtgtaatcaataaatcactaaacaatactaacacattgttttttttacacacaactaaactcccaattcatgttgaatagtccactaactttgtgtagaaaagtctaaaaatatagggaaataacaaaagtcaaatcccacatgaaagtaacgcacagagcaataaaactaaaacttgggtcaagcattgaagaatgagccaaaaaaaaggggaaaccgcccactttccctcttcccaaagccaagcgaaccatgctatttaatccactacactatttgtgagccttttacaactgtgctcccactccgctccactccactagttttttccattccctgtgtccccttttcagatctccctttccctctccaagaaaagaaaccatcaaagaatacgcaacgagataggggggagtggctactatcaatctccatgggcgcctatgaggccaccaaggtggtttttgcccggttgcaagcgcttgagcccaatcttgctccaaacatcattggcatgctcctcaccaaggataacaatgagatggacatgattcatctcgcatgtggccctgacaacctcctccaatctatcattgccaaggtgcgcaccgacctcaccaacaagccttcccctcctatggcctcctggggcttcccgtccgatataggtgaggaggcatctttctccattgacaaggtggggtgtgatggaggtgaagagttctcctctaaggagtatgattggaagttaccaatcggtggcaatcaccatcggagctttttgtcaagcaccgtcaacacccctgggtggaagccatgtctatactaccaaaggttccatcttcaaccctataatatcacatttcttagatccacacactaatctctattgtaccagcggaatgaccacccatcttggtagcgacgacatgcaagagtactcttctcgaccacctcagatagaccaaagtgacctaaccaacaactgcagtgcacgacagatctacttgaccttcccgcctgattccattttcagcaaagaggatgtctgcaactactttaggtatcacatgttccaccatagtgcccctattgatgtgtcttgtttcaatattggagcatttcataatttaatgaatgcaatctgttttggcttgtttgtgttgtgtggggacaaccagcatgtatgggatggtgcaagatgtgcgtatcccataccaggagaagcgcatgtttggttttgtcaccttcgcctaccaaaagacagtgaagctaattcttgccaagggcaacccacattacatctgtgatgcacgtgttcttgtcaagccatacaaggagaaggacaaggtccccaacaagttcaggcatgttaatcattgcctaattccactttgtatttttgcacatatattaccttttgtgagtacttctattgtttttcttaaaaattgcataaagtctattgattttattaaaattgcagaaagtttcagcaaagtgactctcctagctacatgaatcacaatagattgctttattctagggtgccctttgacctgcgacgacaccaaataggtgagcagtgatatctatgtggtgcttgtgttttgatctcttttttttaacaatttacaaggagtgttacattgtgttagggccgagaattttgtatagggacatggctagtcatgaggcatcttttaggatgaagcaagatgaacaacaacatgcgaccgagctgcaacgtcgttgcttaatgaggcttccgcttctcaatcttcaggattggggccatcatctcagctctcccatgggttcacatgtgcttctaggacaagttgataacaaatataatattaatgagaatgacaatcccattcatttggaggatgtcacattttgaggtctagttcttggtcgttgtaatgtcttgtctattaattatgttttttcggaaagtttattaattatgttgtactaaggttgtgacttcttgttttatttatagacaataagctgaagaatgagtttgctatgagggaaattgcctctactgcaatctccacagaagccaagcgcacggtcatctctacggaagaggggaagagagaatatggtcccaaggcagcaacacctaatgatgcttgtggattcctggaaaggtaagatgat

SEQ ID NO: 65383 - DNA, 1801 bp, Oryza sativa
aaaaaacggaaggaaaaaaccgaagaaataccgaaaagatacaaagaaaaccgaaaaaaatcccacgcgcggcgcggcttctgccgccctcctcatccgcgcggacgtcggcgaattagcaatttcgggtatttttgctagtaattaataataggtatactatatatatataatctcctagggcttagggttttaccttaatttccttctccaactcgatcgatatatatatatatacacaccctaagccccggcctgcaacaaactacaccgatcgaccaggcgggcagcgagagatgatgcgcccctccggcctcctcatcagcggcggctccgtagtcgtgcggccggcaaccatggctgcgcgcgccccctcgcggcttccgtccgtcgtcgtccacctcccgaggtgcaccgccacaggagggccgccgcactgcaggctgacagcggaggcatcgtccgtcctccccaacatgtccgtagcgtccccatgggtcaacgatgacgacctcaccgaggtgatcgatcgatctcatcttcgatcatgatctcttaattctttccttcgatcatgcaatacaaatacaatatagaaaatccatattgattattctctaaattaatttgttgtttaatttcttttgctgccgatcgattactcgattaaattagttaggcacctgctgatccatcttgctaacttcataacttaaactaaaattgttgcattttgttttcgatgttccgttgaaacaactaatatttctatttattattagtttaatagtatatccttcatcccaatttgatcatcccctaaataaaaggtgcaaagacaaggacaataaaattttcatgtttttaaattaattatcaccaatcaaggtgctccatatatccagtggatattgcatcacactttaaatgttgcatggaattgcactaacagtcgtagcatgcatatggcttcatgcatgcattccattcagcgatgcccaattaccctttgcataataaataaataaagagacacttattattatatgataattattttaggaagacctcaaaatcgttaggtgatgatcaaattgggatggagagaatatctttagatctaatttatttatttgcttgtgtgatatattttcattattaaaaaaaatctgatttactcatatagagtcgtatcaattgtatgatatctatcgaatattatttattaattactccctacgtccctaaatatttgacgtcgttgacttttttaaatatgtttgaccgtttgtcttattcaaaaaatttaagtaattattaattattttcctatcatttgattcattgttaaatatacttttatgtatacatatagtcttattacatatttcacaaaaatttttaaataagacgaatggtcaaacatattttaaaaagtcaactgcgtcaaatattttgggacggagggagtagttaattatgagcataatatttacgtttttggcagatttccatctacgaggtaattgcgtggtctgcagaagaagccatggaactcatcaagcagactccacctccaccacctcctcctcctcctcctccctctcctccggcgacgcacgacgtgggccagccacctcctcctccctcccttgcagcgccgccgccggcgcagcacgacatgggcaagctactccgcatgtacgcgcggctgctccgccgcctggagtcgcaggccatcgacatgtacgccggcagcaggaggctggtggagtaccacgtcatggcgtggggcgcctac

SEQ ID NO: 65384 - DNA, 3140 bp, Oryza sativa
acgccatcgccgtgcctctacgtcgtctgtggctatgtgtctagtggtgggtttatcaatgcagggcccctccgggaacgggggctgattttgccccgcatgtatactcggggcctggggcggaagaatagttcccgggtcgggggcggggccgttccagcccaacccgcacccgacccgccccgttgccatccgtagctgctatagcggtagtggaccaagtagcggactgaagatagtatgttgtaacttagcgcccgctatagcagcctgttatagtccttcgcgatcgctataacagcccactattgactttgttggactgttataatgcttgaatgttgttcttcatatatggattgtagaactttacattgtgtatcttatatttatcttatacatctatatgttatttcatattttttatgttatgaaatataggagtagttaacaatgtcttataaattgtaatttttacataaaacttgatgttaatattgatatataatctaaatttatggttatttttctatatttgctattggaacttagcgcccacaatagcggccgctatccgtaatccgctacacaagtactaatctactaacaacccgctgctaacaacctgctatacactatttattaccttgattatattcggtaagttgttttcttaaaagctgggtaaacacatacgtgcagcgatttgtgattgtatgtaggaaccgtgtgagtaacctgctggactgctggaggataatctgttagactgctagagcgtggtgaaatgtgatgatagaatgcagaggaggcagattaaatggagccatcagccattgagagatttgatttagtggagatgacggacgcgtagccaagatggatgctttgtagatgcatatattgatagttgcatgaagattttgagatcaattttatttcctttaatttcggttaaatttggctatcatttttgtgggaccgacttgatttcctaaagactaaggcaaccggtatatatactggtgatggccgattggaaaagaactcctgaacaacttatcaattactatttcttattcttttctttctagttattctctatttttttttatagctgagttctactaaccttataatttggttaatttttgccattttacgttgaaaaacagtcgtacttctcaacaaaacaaaagcgaggaggttatcctttgcaagtttgcatggaaactggacgttcgtcgtcacataaatacgatatttatcttcttcgctagtagtttgtttgtaaattagtcatgtgattctatgaaattgaattaattttgaaatcggctctgatctatcgattttgatgactccattgattataccgtaaatcgttaagtgatcatgtgttggtcatgaaaaagcgtcaataattttaatagaaatgtaagtataaaataaaggattaagaaaagaagaatagtcatttaaatagacaaaaaaacacacatatagattggataagaaagatggactcaaagggagatttctaagaggatgaagatcttactaagttttctcctaacttctattggatcgtccatttcatatgaatttgctttgtatgattcaattatttgcttcaaaggcttttctatgaatttttcttaaaatattggaatgcttgaagtttcttatatttttcaatgaatcaaagtgggcctatgaaaaaactggatattttggtggtagggtttgggggtgaggggaatccgatgacattgatatcaaacatatatatcatttaattgcgtcataggatttgaagctgagaagtctatgtctacttaaaagagagttgttctccacccatctcttccccacttcctcctaaaaatgcttctcccatacaaaccgatttgtcaaaaaaaaacacgatcatggaataaaaaaccaatcaacccacactgtccaaatcattccactaaattgaataaagaaatcgtggcaatatacgggcctataactagtcttaggaaaaaaacatggtttgttcgtttggtacactgactagttaacataattaacacagtccattattaaaagaaaaatgagtaaattttacaaaacttcaaatacattaacaaaactatcgcaaaactgcatatttaaatgatgcatcaatttaaccctaaatttatcatagaactacatagttaaggtgggttatcgcaaaactgaaggtttagttacaaagttatcacaaaagtacagttttagtgtcaatttaatcataaaacttggatgtttataactcaaccataacattagtactaaggatttaaacccaaagtccaaagtctatagttttgtgataattatattactgtattaaggaaaaagtacgaattaccccactgaactatggtggtcgaccgaattactctctaaacttgaaaaccagacattcctcactctgaactgtcaataccggactaattacccctctcgactgaatctagagtggttttatcttacgtggtgtacatgtggcaatccagtcagcattttatttttttaaaaatagtgggacccacttgtcataccttatcttcccctctccctcttccttttcatctctctcgggctcagagtgtgcacggcgagcagcggcgcgctggggctgggcggtcgacgctctggggctagcgatgggcggcgctctctatctctctctctcggctcaggcaggcggccagcgatgagtcctcctcgggagggcgcggcgagcggcgcgcgtggcgcggagggcatggtgggcagtgccgaggagggcatgggaggtggtgcgctacggcgacgaggtcgccgcccatccacgtcggcccatcgaccgtcgtcgccgtcaatcggagccacacagccgcgccaacgatttcccttccccggccgtcgcgcccgccgctcaagacgccacctgattcttctggctttgctgctgctcctgtaaaactaccccgtcacaccggtagcaagcagcacacatctgtacaacttgtacatgcatgtacaccgttcgtcgattcaatttctctcagaattcttccgtgacattgccacgtgagattgcgtcatggccgcgagtagtg

SEQ ID NO: 65385 - DNA, 2279 bp, Oryza sativa
tcatgttagatggatctccctccgcttgagcccaacggctcaagggggccttgacccgcgccctgatcgggggtgcccaacccaatagctggtgggcccccgtcacactgtgccatataaaaggggtggaggccgaggcggcacatggtacgaggtttgtcaccaccgccactctaccgcacaaaccctaaccgatcgagagggggcgtagccagtgacgagaaacgtcgccgccgtccacgtcaagcccgcgaccgacaacgacgatggccggcgcttcttcatcctccgacacctcaacttgtcgattcctctaaacccttctcccttatgttctattgttcaaacacccaaatagagccaacccgactagatctaacctaggttatcctagagcaaagtctaacaatggtattagagcaacctagccaattagatcggttcggggaaagaaatccaaagaaagaaaagcacaagatccgcacggatcaaaagaaccgaaaaccctaaccctaattcttacctcatcgtcgttcgtcgtcgacgccagcaacggaggggggaggggcacagggcaccgtcgaggagcccctccacggtcgtgcacgcgcgtgccggcgagggggcccgcggcggcgccgccatctccgttgtcgccgttctctctctcacttcacgcgggtggagggcgagagacggtggggggagaagagaagagaagagaaaagcacgccggccatggcgcggcggcgcgaaggttgccggcgacgacgacgccgctctgtgtggtcgtgcgagagagaagagaagagaggctagctagggttcggccggccggcggctggggtcgaagttttgtccctccgatctcggcgcccggccgtccgacctaaaccctagccgatcggacggccggcggcggccgggccgaatatggcccaagagggcgcgcgcgggaggcggctttccaggtccaagcccaggttgcggccttggggaaggggaggggggcgcgccggcaaaagttcaaattaggtccctcgggggccgaaaatgatgaaaagaggacaatagcaattttttttattttgtcaatttttcatgcaaatttcaatagaattttgaatagatttttgcatgttttacctctgtttaaatttgaaccaacgggagaacttttacagagaataaataacatacttttgctactgttcatatgaattttatatagtttttccactgcaaatagatgaaattgatgaaaattagtgtttctaaaattaaatttcgaaccaacgggagaatttaattttaggaacattaattatgtgctatgatgttgtaattttctgaccaacgttgataattgcaatgttatagttatggctatgtgtgatgtctaattctgcccaacggtgatgtaggcttaatgcatactactttaatgttaattttgttctcatagtacatgattatttcaggtggctactccttgatgggttgcattaaagatattccgaccctgaaaggagataactacgcagaatagaaaagaaaaactcgaccttgcttttatcttgggagaggtggactgggtgttgactatcccatgtcctatagaacctgctgcacttgtcagaggtgaaaatgagtcagatgctgactgggaaaagagacagagggacaatgctcttctcatcatgtcgtatgacattgaacataagaaatggttcttagccaacaagaaatgtttggctgtggtaaagaacacgattgagccaaccatattgggctcaatcccagagtgtgacgctgtctcagagtacctcaaaagaataaagagtcagtttactggctcttcaaagacttatgctacatagctgataaagcagcttgtgacagagaggtaccatggaggtggtgttagagaccacattcttaggatgagcaatatggcttccaagttgaagccaatggatttgggcttaacagatgacttcttggtccatttggttatggcctcattgccaaagcagtttgacaattttattgtcaactacaacataagtccagagaaatggaactttgaaaagctcatcgctaattgtgtgcaagaggaggagagaatcaaagagtcaaatggtggttcaattaactatgttaaagataacaagaaaaagaaccacaagtctcccacctcaaaagctaaatagtctcagcatctgcctcagcaacaacagttcactgttgagaaagatcagtgtctcccctgcaagaag

SEQ ID NO: 65386 - DNA, 8631 bp, Oryza sativa
ctgtgggtgcatggttttgctggtcgcacccatggcagttaaggaccggttcgcgggatgccctggaagaacttatcgtacttaccacaagccagcgtgggcaacggctgggcttgtagcgtagcttttctctagccgacgcatccaggcaagggtgggcgtgatggagtttggatgggtcctgcgacggcctatgcggcttccggattcacctaggcacgagaggggactgctcgctgccttgcgaggagtgggggtgaaacctgaggtgtggtgtgcttggttagagggggttatgcgaatggtcctgtcacggcctctttccggtatgtcgtggtggcatgtcggcgcacggaaacgtgtcgtggggctgtgtcttgtgggtacagttgtacacctctgatcagagtaaaactattcgaatagccgtgaccgcggttatgggcggtcgaccagattcaccgtgattagtctcaccctagtgtaatcttttgaatttggatagtttaggtggatggttgggcctgttgcaacgtgggatagcgttggacagtggatagttaatactaattaattattacaactgtttaatctttcaacttctgtttataaatgctcgctttatgcaaatgaaccactttagctcttctttgatgattccctgcatcatgcctctattccggtatgacttgctgagtacagtgggtagtactcagtcttgctctatttttcccaaccctagagtacgagtatgtgtcagatgaaggtttctccgaggagtaagcttagtccgtgccgtcgaggatgcctgtggagtggtgttcccgctgtagttctagtcaaggcttagctcctgttgtctctctttctttccgctgcatttatgtaagacttttatgatgtttgtaagacgtggatctgaatgtcgacattgtcgtttgtgtaccccggccggtcctggacggggatttcaatgcacattctgcttggaattctattcgggaaattctgggcgtgacagccggtgtgagcccgggtgcacccggtccaccgtggaccgtgaggctgccgcgtgggccctactcccgtggacccggtccgcgcgccccctcccctcggctgacacaataaacccttttaaaattaaaatttaaatgaagaaattcgcaaatattcatttaaagagcatataaactttaaatgaccataagttggccatttgaactcggaattggaccgttcaagtctctaatttttccttaagaagtcaagaacccatttttgtgctttgttccagcttgttatatggagtttattagagtaaaagccttttcttttccgttggtcgtgtagacgctgcagcttcggaagatccgctcttcgtggaagttgaagccgacgtttgggaaagcgagcaaggcaagtcacatcatccttgaacatattgaatcctagtttataaaattattttgatttaacttattgcattatcgctttatttaaattcccgcgttatcattgttttatctagccatgcttatgtacctttgttatgaccttattattgttattgttattatttccttgttcaccctagaataaacaaaaccccaactagtggacactctactcatggtaccactagtataattttagttagatgcttcgctggttaattaggtaacattaggtggtttacaactctagactttgggaatactcttatcacctggacactatggaattgttggactattgtggaattggattcacacctcctcctctattcaaaatcctcaaaatggttttaggctgggctcggggtgcatggttttgatagtagcacctcggccatataaggaccggtcttcgggcctatgttgcaaagcactaccgtacttccacatgtctagtgggtaaggcttagtttgtggctcagtctggttataaaaaaaagtacacggatggagatggacgaagtcggggggtcgatggacatctctagggcaaatgaaggctacacgagctgcggcccggtagtcgagatgtcatggcacagggccggtgtcctgctgctaggggctcagtcctgcctacctgtcccggaggttccggccgtaggtggggttgggtcggtactcttatctatggctaggatgggttggaaactatgtcacgtcttccgtccatataccatggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccggttcggtctgaatcatcgtaggccttgggttaaggcaggttcgtgtgggttcacggccttgataaataatattgcatagttctagaatcgtgtttacaaaatagctttgagcaactaagtgtcttttaatgctgtttgctgcaaaccctaaccctttatattataacccccttgtactcccttgcatttattatgcacttgtgggtgtgtcttgttgagtacggtggttgtactcagtcttgctcaatttttcccaaacctagaagaggagcccctggaagatgaaggctttggtgtctagctcgcgcctgccgtcaagcgcctgtggtcgtcaccctagtcttccgctgtttcccgtttgtctttgtgtgtgctgggtcttcgccgcccatgtaataaattaactatttacgcttccgcttgttaaactctgaactatatcaacttttggtgtaccttgcctcctgggacaaggaataatgcacgcacgtaaggaacgcccgttgggttatttttggtcgtgacaatagttatgtcaaaccagattggtatcggctgggctatctaaactactaaccaattatagtatgatatatttatatagattgattcgtctatataagcatgtactagagtattagctagtacattatcttccttgctctatttgctctaaatattgttctatcagctactttcatagtattgtcttaaacttctttattaaattttgatggacagtattacagccaataaggcatgtttagagtttaatattcactaatttacctagtctatagctaatttggtataactatatcggctgagaccaccaacgatatgctaccggcccatcggccgatcggctatcggttaactaattctgctttttgtctttcttgctgattgcaggattaactcagctagcatgcccttaacacactcgaggctagccttggacctgcactggagttaagcagatctcccaggccgcattgtttttacatcaacacttagttaatctaacccgatgactcgatttacttgcatcggccaagccttttgtatggttttgctagtatcggctaaatcgtttagtcagtttagattagctaagatatccaccaccctaaaaatcaataaaaagcttgattgtttagattttatgcttccttccatacttagtgctgcatcaattgagtttgacctactaagtcgtgtttagaatcatagcaactaaccttgattgcaaataggggaagaatcagggtttcagctgatcttaactgatatgattgcctttctttgtttaatatcttcaatctagtttttcatgttatatctgccctttatataagtatatcactctatttaaatatatcaagcttgtattcaattttggccagattatcatatttgggattgatgcttgtttggtatatttacttagaatgatattcttatataaggttgtatcagagcaatagccaatattgtatctttattaacctaaactctatatcatctgctaagatattattgacgaaaaatccgtgatcggccgatagtgccggaactgtgttggcgcgaactaagccgacgaacacagcggcttgggagatctgcttagctccagtgcaggtcaaaaatattgatgagatgtgggcgtgccagtcattttgatcctacaactgacaagatatgtaaacaatagatcaaatagccgatcgactaacaagccgatggagcaattctagtcgataccgataccagccgatgtcgatagggttttgagcaatcagctctatgtacaattaatgtagattctaacactcgagtaaataatgatatatagataatcggctgataataatatatttaagcaacaatataatctaatagaaaccaatcggctaataatgatcaagtgttgatccaaaggttaaagcatacatcggctggaggtctgatgtcaataaatccaaacgattagataaacagtaaaacctttgctgcaatcggctaaatccaacttgtatgtaatccttataagccgatgcaacatccagataactcatcatctgaaaccccgatgaaacccttattagcaatcaaaaagcaggatagaaattatggttctaaacacgactagggctgatgcagtgcaaggtatgaaaataaacataatatctagacaaccaagcttttcactattttttagggtggtggataccttagttaatctaatctagcatgataatttagtcgataccagcataaaccctaaaacgaatctcaaccgatatgatcaaattaagatgctaaactagattaactaagatatatgataactagcggtcgtagaagatagattagaatatctaaagcgatgccctaatccgccaacgcaaaccactgaaacaagtcatacctcttgtcagaagatcgagccgatgccctaactcaaagcaagaactcgtcgaaaaagtagaaaggtaaaaggtggcgatgcgctgaagttgtattgattgcgaaatagtttacaatgaccccgggtgtacaaatttatacccatgggtagatactagtccttgttggacaagaaagaaactttactaaaataaagaaaatataaattccttatcggacactaaacacactttcctcaagataaaaggaaactaacaaactcttcctaattaatagataaactgtcatggagcatcctctttgaactcggtcatttctagataaacttcctttaatagattcctttaaaccgaatctactaagaatccgactattggtgacttgataactcccatcggccgattccaagatgctaaagctgatagtgaatctaagccgatgatgacttcggggcttatcaaattttgatgttaacacatggttacagatatgatccgcaagcgcacagatataccattgtagcatttcacttggaagtattccaaggtatcgtatttatttaatcccaagggaagatatgataagagagtactttgctactaatttatatattacttgtatacatcaaagtctatgcaggggttaattaattcaagggtaggataaggttgacacgaagaatgaagaactaagatactctcactaatatatataatctaggctaaatggagaaagaataagaaaataatcattcctatacttctagtatacattcatctttagtttacaatcatgtagccaataccccctaactatgccctcgcggtgtttctagagactacccctgatgccgagttccttacaacaatccgttatgaccatccaaccggaaatgaatacggaggagtacccataccaggaaagtgtctttggactatatactaacatggaggaatacccgtactaagctatcaccatcagcagcccacctctactgacctgcagtatataaccccaattaatgatatctaataatctaagcaccacgcttacattattaaatacaactctacatccccaagaacgacatagagcaatcactcgcatgaacattaaacccacaccaatgcatatctcaggtaagctagctacacaattatatcgagacaagtataaagtaaagccgatactcagataatataaattaagtaaaagaccgaaactatataaagaagaatatttcattaactctataagtcttacaaaaggaggaaaagctactagagccatacccaaaatctcttgaagactcgaggactaaatgaactattctattcctactccactagcacaagaatactgaactaaacttgagagagagctcttgattttcttcttggagtgtgtgagggagtggaggaggtgatggccttatataggctactgttggtatttcttaacgacattactagaaatataattcccagcaatggcgcagaaatacttctggtatattatggttacagagttcatctgcaagcgcacggatataccattgtagcatttcacccgagactattctaagggtatcgtatttattttatcccgtgggaagatcaagtagagagagcttaactaatagtttatatattactttgagataatcatattctaagtaggggttaagataatacaagagtagagtgatacacaagcattactactcatcctcataataaattatctaagctaggtggaaagaaaagacaaagaaaatatattcctatacttctaatatacatagtatacatacattctagttaactgatatactagctaataccctctatccgatgctctcctggtacttcgagaagccacccctgactgctgagttccttacgatagcccgtcatgaccatacaaccggggctaaatacggaggaataccctccccaggaaattaacttaggattatataccggcgcggaggaatacccgtactgagctgtcaccatcagtggcccacctctcatccgcaatatatagccccaaataatgataccttgtaatctagacaccacgtctaaactatcagatactactttaatatcatcatcatgacatagagtaattgtatatgcaaacattatacccgcaccaaagcatctcccagataagctagacgtatatttagtataacatgaacataatgtaaagtaggtactcatatactcggaaagtatttcaataccataaatgtatatagaagagtattctaataaaagtacaaagcttacaaaagaggaaaggaaagctgttagagccatacccaaagtcttccgaaggcttccagactcctgatttctactctattcctattccaccagctagatactactaaactaaacttgagagaaatgagagagctattgcttgaggtgtgtgagtgaagtgaggatgagagctccttttatagcctcccaatgacggttgtgactgttggaatggtcggtaataccctccaaccgccactggggagccatctcagccgtccaggagaaccctggatcaaacggagctgcgggaggttcggccgaaccaccaggttcagccgaacttggggccggcccaatctagcccaatttcggctagcggccttctccgttgttcttctcctcagacttgtgaattttggcccagtttgtcgtgtcaattctgagttcttggcccattcatacatacgtctggttctcgacatcgtctgattgatttatcgtttgagttgatgtcgattctcctccactttagtgtcattccctgcaagaggttagcatgcctaatactagtggaagtttattattctaatacatttatgcattgcaagcatcattagttatcctctattttggtaatattaacggtcaaaactgatcgataacgactgtcaatagctaccaatgacggttgtggtggttggaatggtcgtaaataccccgcaaccgtcattggaagggatcctaggcatccacgtgcaagggggagccaacagccaaccctagttaggcccaaccggcccagtttttggtcggtgtgttgcctgttgatccatcagcccagtagtgtgatggttgggcctatttgatattatttctcttagtaaacaaattactattacatcgatggttctcaacattaaatatttatcttgccacaaaatttcacttagtaaataaattaatattacaccgatggttctcaacataacatattcatcttgccacaaaatttctcttagtaaccaagttactattacatgttctcaacatattatctcttagtaactaaattactattacattgattgttctaaacatattgatcttgcccacgaaattccgttccctaaactaattaatcctactgatcacaaacatatattgatctcgccacaattccgtcatcaccggccacgccaagcaccaacccgtgatgtgtttgtgcttctaatggtggctgctataacaatactgccatttttcatttaagcaggttgtccatagaagtcaaatttgggaacttcatctcttcctttttgaatctgatgcaaaattccattgttaacactaagataactgataaccagcagcttcaatagatagattagaacatttaaaacgttttactaatccaccgatgcaaactactgtgacaagtcatacctctcatccggaagatcgaagaagatgccccaactcgaaacaagaactcatt

SEQ ID NO: 65387 - DNA, 5179 bp, Oryza sativa
aaaccctttttaaattaaaatttaaatgaagaaagtcgcaaatattcatttaaagagcatataaacttcaaatggccataacttggccatttgaactcgaaattggaccgttcaagtctctaatttttccttaagaagtcaagaacccatttttgtgctttgttcctgctggttatatagagtttattagagtaaaagccttttctttaccgttggtcgtgtagacgctgcagcttcggaagatccgctcttcgtggaggttgaagccgacgtttgggaaagtgaccaaggcaagtcacatcatccttaagcacattgaatcctagtttataaaattattttgatttaaattattgcattatcgctttacttaaattcccgcgttatcactgttttatttagccatgcctatttacctttgttatgaccttattattattgttattgatattattaccttgttcaccctagattaaacaaaaccccaactagtggacactctactcatggtaccactagtatgattttaggtagatgcttcgctggttaattaggtaacattgggtggttttacaactctagactttgggaatattctcatcacctggacaccatggaatggatggattattgtggaattggattcacacctccccctctatgcaaaaccctcaaaatggttttaggctgggctcggggtgcatggttttgatagtagcatctcggccatataaggaccggtcttcgggcctctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagctgcggcccggtagtcgagatgtcatggcacagggccggtgtcctgctgctaggggctcagtcctgcctacctgtcctgggggttccggccgtaggtggggttgggtcggtactcttgtctatggctaggatgggttggaaactatgtcacgtcttccgtccgtataccgtggtggtatgtggcacgtggttacatctgaggaagatatgtcttgtgggtaaagatgtacacctctgatcagagtataatctatttgaatagccgtgccctcggttatgggcaagccgagcaatgtacccaagttagtgtttttaattcttaaaacctgcttaacaactaaaatgtggaatggttggcctgggttggcttgggacgagctgggacccagggtcgggttgccagttcggtctgaatcatcgtaggccttgggttaaggcaggttcgtgtgggttcatggccttgattaataatattgtttagctctagaatcgtgtatacaaaatagctttgagcaactaagtgtcttttaatgctgtttactgcaaaccctaaccctttatattttaacccccttgtactcccttgcatttattctgcacttgtgggtgtgtcttgttgggtacggtggttgtactcagtcttgctcaattttgcccaaacccagaagaggagcccctggaagatgaaggctttggtgtctagctcgtgcctgccgtcaagcgcctgtggtcatcgccctagtcttccgctgtttttcgtttgtcttcttgtgtgctgggtcttcgccgcccatgtaataaattaattaattacgcttccgcttgttaaactctgaattgtatcaacttttggtgtaccttgcctcctgggacaagaaataatgcacgcacgtaaggaacgcccgttgggttatttccggtcgtgacaattgggcacattggtgaaatatggatgcgtgaagacatatcattcaaaagatgccctttacaagaccatcaccgctcatcctaacaaggatggacatgggctcgggttttctggtggaagtcatgtgtctaagcgtgtgatggtaaatgggaaagaatgcttgatgtttgtgagagaaggaaaagctccacaagcaagtgaggtgacttgtcccctcactggtcagacacccggaagttccgagcaaaatgaccggaagttcctgccctgtaagacaggaagttccggacattttgtcaggaagttccgggcttctgataggccgaacggactaaccggaagttccgggtataatggcaggaagttctggctagagggtctttactatgattcatatgtaattttcaaaaattcagagggcaaagtggttgcttatttcaatgggaattacaatgatgagtaccgtacttgtgtgtgggtgccaaaggctttggtgactaacatcaagggacccaaacttagacaagtttgggttcctaaatcccaagcttgatttcttttgtaggcatactcctccagtggctcaagttgggttgtggacagtggctgcaccaatcatatgatgggagagaggagtatgtttacaagtcttaatgaggagggtggaagtcgtgaaaatattgtctttggacatgatggtaaaggaaaggtaatgggtctcgatcgtgtgtgtagtgcttgccaagccgggaagcaagttggcagtccacatcctataaaaaacatcatgactacaacaagaccactcgagcttcttcatgtggatttatttgggcccgtggcctacataagcattggaggtaacaagtatggtttcgtcattgttgatgatttttcacgcttcacttgggtgtactttctccatgacaaaagagaagctcaagatgtcttcaagcgcttcgcaaagcaagcccaaaacctctatgatctcactatcaagagggtgcgaagtgacaatggaggagaattcaagaacactcaagtggaggaatttcttgatgaagaaggaatcaagcacgagttctccgccccctatgatcctccccaaaacggcattgttgagaggaagaaccgaacccttattgaagccgcaagggcaatgcttgatgagtacaagacttcggatgtcttttgggcggaggccgtaagtaccacatgtcatgccatcaaccgcttgtacctccacaagatcctaaaaaaaacttcatatgagctcttgagtggtaagaagcctaatgtttcatattttcgtgtcattgggagcaaatgttttattttaagtaagaggcctcgctcatctaagttctcacctaaggtggatgagggattcttacttggctatgaatcaaatgcacatgcctatcgtgtcttcaacaaaacctccggtattgttgaagtcactagggatgtgacatttgatgaatctaatggctcccaaggagcgtaagttgttgtacatgttgtaggtgatgtggatccaagtaaagctataggcactaaggctattggagacatacgaccagtcgagacgcaggatgaccaacaagatagggatcaacctccgtcatcgacatccaatagccctacaagtgctgtctttgctgagctgaaagttccgggtcctattgatcagaacctccggaagttccgggttctacagtctggaacctccggaccagtggcagtgaaaacgtgccaacggcacaagtggatgggatcgatgctgcgggcactttagagcatactgatcaggctcaggtcccccagtgcaccatccaaggatacatcacactgtccaaagagatcatcccgtcgacaacatacttggtgacataagaaaaggggtaactactcgctctcgtgtcccaagtttttgtcaacacttctcgtttgtctcttctttggaaccaaccagggtggaagatgcgcttggtgatccggattgggtgatggccatgcaaggggagttaaataacttcactcgcaaccaagtatggactttggtggagagacccaagcaaaatgtcatcggcaccaagtggatcattcgcaacaagaaagatgaacatgaggtggttgtaaggaacaaagcccggttagttgcgcaagggttcacccaagtcgagggccacgatgttggtgaaaccttcgcacctgtcgctcgccttgagccaattagaattcttttagcctatgccgctcaccatgatttcaggttattccaaatggatgtcaagagtgcctttctcaatggacctatctctgagttggtctatgtggagcaaccaccggggttcgaggatccaaagttgccaaaccatttgtacaagctccacaaggcgctctacgggcttaatcaagcccctagagcttggtatgaatgtctccgagattttcttttgaagaatggttttaaaattggaaaggcggacactactctcttcactaaaaaatataagagtgatttattcatatgccaaatttaagtcgatgacataatatttggttctactaatgcctctttttgtgaagaatttagtagtatcatgactaaaaggttcgagatgtctatgatgggcgagttgaccttcttcctcgggctacaagtgaagcaagcacaagagggcaccttcatctctcaaaccaagtatgtgaaagacatactcaagaagtttgggatggaggatgccaaacctatcaagacgcccatgcctactaatggccacctagaccacaacgataatggtaaatgtgtggaccaaaaggtatatcgctccatgataggatctttgctttacttatgtgcatctcgtcccgtgtcgcgaccgagaaaattgcattttcccgaacgctagtgtattaatccccgtcccaggaaaagccggggtacaccatacaaacatgatataaaagacacatctttattatatcgataatatttacattattacaaaggcacttaaggcctgacaatcaaaaataaacagcagcggactagcgggcctacggctccatcttcacaggcgctcaactggggtataagccaagactccacctaagacttcttctccaaagcttctcttactgaaggggggagaaagatagagcaagaatgagtacaaccacagtactcagcaagccacaccggcagatgcacgactaatgcaagggggtacaaggggtaatgatataggggttaagttatgcagaaaacagcatttaaaagtcacttagttgcccaaagccattttataaagacgatcctagagctacacagtattattaatcaag

SEQ ID NO: 65388 - DNA, 14704 bp, Oryza sativa
catgtcgaagcgctagcctggaaaagacaggaaggctgcgctgttgacatgcggaccccacatgtcaacctaaaggaccgcggtagaccaggtacacagagacggtccacaggtcgacggaagcggaccccgtgtgtcaaccgaggcgagtagccgacaaacggactccacaagacaccacgcgggctgcacacgtggaaaccacgcggctaccgagcgaacacactaacacggacactacacggtcaccacccgcacacgtgaacgactaccgacaccggtacacgggtaccggggtcgacgaccgcacaacgggtacggggcgacaccaaaaggacgaggacagggcagcgagaggacggatccttaccaccacgcgacgaggcgtgggaacaacaacgacgaacaggcgtggcggacggcgagggaatgacttcggcggcgatcctgggacgaaggcgagacagggccggcacgaggcttgacgacgcggaggcgaggacgaagacgacgacggggctgctgcacacttgacgaaacgcgggcggcggacgagaacggcttgacggagggacgaacgccacaacgaccgggaacgacgagaggacgacgacgacgacgaccggggccggcgaggagacgacgagggcagccggcagcggctgcacggaggcgaggatggcgtggaacacaccgctgcgatgccgacgacggaggcggcgccgcgagacggcgagccggcgaggatgaacggtgaagacgacgacggacaccggcggtgttcggtcggaggggaggcgaggccgaggacgacgtcgcggctgcgatgccgaagatggtagaggtgcagcaagccgacgagccggggaggtggaaggggcggccgaaaggacactggcgatgaagaggatggagaggccggcgctgcgacggcgttccggcgaaaccgaggagcagccggggtggagggcgatgcggcgacgccgagggaggggacggcagcgccggctgatgcacgggcgcggtggaaggggctgccggaggagacgtcgacgaggaggaaggagaggccggcgcgggcgatctcggctccatcaatgacgccggcgaagtttgcgggaggatttccaaacgaatccgagagagagagcgagagggaaaagtgggggggaaagagggagggaatcacggggagtgatttctgtcacatcctgatttttgtttcaggatttataaattatttaataaattattattagaatttatattaaatgttcattaatttacaagtgaagttaaatgtgggaaataaaatttcctaaatataaagcatggatggatttaattttgattaaattctccatgattaattacactctctgaaattttctcagatgtttcggagctcaattcttaatttttaatcatacaaagagcatttcagtaattacccacatattaaattaatcattaaatggtctttttttaatattgttaaatactttgggtgtccaagtatgttcaagatttttcttggaattatttgagcataggaagtatttttaacaatttaaagatcatttcattgattaatttaattggaaaagtaataataatcctcttcctagtcttgggccctttccagcccatctccctcttttgtctgcacggccgtgcagcccaagtcggcccagccgagcttcccccttctctttctttctttgctttgttttcagccagcccaagacgaaaagtctaatttgcctccctcgacactgtttatcttctacctctagcagccgaactgagaccgatttggctcggtttttctcctccaaatctgacctttccccttgtgtttttctaaaattagttgaggggaaatattcctcttatcctcctctatctttacccccaaaaatcggagctaatcgttgagtatcttatccgaatcgaactcgttttcgagtttatctccaaaaccgagtttttgatttcccggatcgatttcttgcgggaggagtccgatctcttcaatccaaggctataaataggaccccctagtcctcctctttcgtttgccccctctcccgtggtctcccgtgcctcgtagcgccgccgccacgtgctccaccccgccgtcgtcgccggccgagctccatccgcgtcgcgccgccgcctccgtcgtcgccgccggtcgccgttaccaccgttaggtgcgcgggagggtggagaagcccggccgctatctccccgaagccgcccaccaccgcagccccgtcgccgccgtcgaccgaagccgcgccgccgctagacctcgtcgccggccgtcgtcgttcgtcgtttggttcgagggtgggtaccgttgggttcgtctcgtcgtcctctacgtgttcttgtcctccaaagtcgcagccgaccatccaatctccggcgaggtcgccatcttggttcggccattgatgaggtcatcatcatgacgtcatcatcgttttttttctttttcctgtttttctaatagattaaatcttcggaaattcataactaaatcatcgtaactcggttttgagtggttcaagttgctaaattcatctaaaatcaggatctacatgtttgtttactttatatgtactgtttatttggtttttattagtctttttcttcgttttgcgtgttagtttgtcgtttccgtcgttgcgaaggttcgtgagtgcgccggaagtattcaataagattaattgaagaccgattattgcaaggcaagtcacacagaccctaaacacaatcctttgagcatgttgatcctatatttaaattctctatttatttcaactgtgcatttattttcgaatgtcaccgggtggtgtgaacctattcctttgttatggccaatttgcattgattactttattccttgataccttgggttattataacttgactagttgagctttatatattggttcagctagatattagatatgattgcttagccatgcttagaaacattagcacactattgggataacttatgactcattgtttaatgatggtttaatcgtagctcacgatggttaatcgtgttatgataattaattgataactaaaacttgacaatggtgggttgtgagcacatggttttgaaggtcgtgctcatgacaattaaggaccggttcacgagctactgttgtgaaacattaaccgtaccaaccacaagccagcatgggcaacggctttaccttctgtatagcatgattcattgcggggcaccagactgagaagcggcgagaagtccgtgggggtcgctggggagtccatgcctctggttatatttatagagggggtgattatgatccaggaatggtgcactgtggtgagttgtgttgtgcaaagggtattgtcacagcctctattcgggtactttccagtatcgcgacgcatggtagacatgatgaggaggctgtgtcttgtgggtacagtggtacacctctggccagagtaaaactattcgaatagccgtgcccgcggttatgggcgggttgagcaatgtttttcgtgattagtctcacacctctcacaataattatggatgttatatctggtaataatttgcttagctcctggtttggagttagatctgtacagccgggtatggttgttcaggatggttgggcctgtgcagcatgggtgtgctgttcagtgttgattaaaatttctgattaattactccactgttttactcctcttaaatgttttgctaaatgctgcttttgcaaatgagcctatattatgccatcctttggtatccttgtgcacttgcatatttgctgtgtggcttgttgagtatgtcatatgctcattcttgcaataatcaatcaacctcagttgaagaaaaaggatccagaaggagaagacgtttggcttataccccagttgagctgcctgtgggagtggagccggaccttcgctagaccgtaattccgctgcagttttcttttcttttgaaagtatgtaacactattattgatgattctgtatattaaattgtcagtttgtgtacctcggctgattcctggacgaggattttatgcacaaataagttcggaaattactagtgaatttctgggcgtgacaatttccccctctttattgcgcgcgggggcggcgggatgcggcggaatccgcggcggcggcagcgctagggcacgggcgaggcggcgggcgcggcgcgaggtaggggatgacgggtgggccctacccgtcagcgagggtggcgggcgggcccgcccgtcagcggcacgcgcgcggggaggaggccgattgggccgcgggggagaggagagagagggagggaggtgggccgagccggcccaagaggggaaggggggaaaagactttttagggtttttctttttataaactcattttaactttgtttatttcttaataattattatttgtgctctgaaaattccactaaaatttgagggctctttttagaccaaggagaatttaacaaaaattctccgggccacatttgaatttttcttgtacgtattttagtgtttgccaatttcttttcgaattttaattaattctattattccttttagaaaatgatttttatttcgggatgaatttatcaggacgtgacaaatccaccccccttacaagaatctcgtccccgagattcgaggaggctagcatgaagataggttgggcggtcttctcttcttgtttgacttcttccgtcgcgtcttctataacgaacttgcctagcaaaacttctccactctggactgcttggctcgacctcctgttgcggatggaatcttctcttcacctgacttgaaccagggcgcaccttttagctgactcagactaggttgcggtagtttaatgatgcttccgctccagaacttctcatgattcataccttcggagtcaacctcatacaagttaccacttcatgtcatgcgtcaacactagcttgtcattactaggataccatatttgtcatcataagaatatcgtgcttgtcattcacttctaacttgccaccaactgcctcatattagctttcccggtctccgggtaatagctacttctgctatttgatgcaagggtcgataactttgcctttgaattatgcttcccaagagaaccaacttatcccacttgacatactttgacgtcttcccaaatggctttattgctggatttgttattgtctaatcattatcctgccaaatctgaggcttcgttgttagatgtgcttttaatctgacctctatagattatcttcgaacatatcacttgattcataactgggaatagctctcacgaacaagcaactcggattcactttctttacattcagtttacttcccattattatcttcaggttgtcctcagttagcattcaacgtattcctttatacctttaaccttgatgtgttctttcccattggatcatctcccaagacatggcattgcctggtaaccggtgcttgcacttttcactccgtgtagcatctgataccgagttgaagatttcactctttgccttcatagaaacacttttacccaggtcatcttgcttacttaatgacaaggtgactgttgcggggcaattacaatcaggggtcttccttgagcgatgcagagcatgtttctgtttatcaatcacctttcggcctacttctttcatgctagagaacatctttgccaatctcttttatcaatcttctttcggcttatctctaacaggtggtattctttaatgtggattgcggacgcttctggggacgatgaggtcctttggcttgctgcctttcagagaaaccttgaagtagttcgtcaaaagctagactgacgattgttgcctttgatccgaagaagacacatctgaaactcttagtccaaacaaatgtctctttggttgatcacttgattttcttcgccatcaacaggttggttattaactcgagattagtatatgattcctctgaaatgagaccctaggtctcctttatcagtaagcaattatacacataatcacatatccgcatcttccaaaagaatcctaatagaacttgtctgtattacacatttctcccttattacatgaatacaaggcactaccttaaacaaaaagggaagatgcttaacatcggtacattgtttctactatgggttatgattaactcgaggcctcacaggtatggcgtttgctccagtgaccacaaggcgagtgacttgtcttcttcttgcataatggccggagtgatggcgtaggttacgcttcggctgtggacaatctctagagaaatgacctggttctttgcagttgtaacaaatcaacgtcttctttgttgagctgtccatctggggacgatcattttgacttggagttggaattggtggttggaaatccttgctaacattggcatcagtggtaccatagttgctatcaccattggagtctttctcagtgtcaaaattgctaaggttgtcattctggattccaacattgatactatcgttgacatcttggtgaatgctactgacattgcacgctttattcgagtggtcgctaatgaggcaagaaccatggttgttggtggtatcatcatcattagtattgctagtgttgttgtctgcattgcgtccatcttcttggggcaggaactcttgatgcacaacagaagatccggtgatctgaagtggctcagtgcgctgtctttggttaccacatggaaatactgggatgttgacaatcctcctcttgcagttcgtcatccgattatgctcactttcgagttgcatggctttgtccacaagtttctcaaaatcttagtaatcctctagaaggagttgcactgcaagctcatcttttaacccctggagaaacttctcttgtttgtcttcatctgtttccacatcttctggtgcatagtgagccaaacgatagaactcgtgcaggtactttgtgacggtcaaatctccttgcttcagatagcgaaactctcattttcttaatgtgatcattcctgcgggaacatgtgatctcctgaatacagatgaaaactcgttccaggtgatggtatgtccttctggccgtgatgcttcgtagctatcccaccactctgaagccggtccaaccagctgaggagttgcgaagccaacccgctcctggtcggtgcactgaatcaaccctagcttcttctcgattgtgcgcaaccaatcactggcttccataggatcgacggcaatggcaaaggttggaggctcagttttgagaaattctgataacttgcactgttgctggactgtaggtacttgaacgttggttgtccctgctgggttgttccaattctgtaatagttgaaaggctgttgccaacatgttggtttggttaaccacaatttggattagctctggtgaggttttgttgatgcttttctcattcccactggcttgggttcttgagtcatcggatccatcattcccatagcctttgttaccagtgttatccatctgtcacaaggtagaggttgagaggggaagcagacaaggaaagaatggaccagaactagggacaagaccttaaaggaactaactcttcttgttgatatgttgtttgtttcacttattctgcaagttgattaagcaaacaacctagcatggttacatcacaacccaccgatgcaaaccacgcgctacacacacaagcaaggaacacacgactaacaacactaccctatagggtggcttaggttctgcgacgggttctccaagatcttcactccttcacagctggcttcactgcttcctccacttcgctagcggatcctgcagtcttccggagcttcggcgaacaactgacgatgtcttcttcttcactgacctgaccatctagtactagttgaaatttgaagaaggaagaaaagggtaaaccttttgcaaatagcattaggggaagaagaaaaagaggaactttcgcaaatagttttatttataaaatatgtccttaggttttatccacttggcttatcctacagtcgagatggctctgataccagcttgtcgcgaccgagaaaattgcattttcccgaacgctagtgtattaatccccgtcccaggaaaagccagggtacaccatacaaacatgatataaaagacacatctttattatatcgataatatttacattattacaaaggcacttaaggcctgacaatcaaaaataaaaagcagcggactagcgggcctacggctccatcttcacaggcgctcaactggggtataagccaagactccacctaagacttcttctccaaagcatctcttactgaaggggggagaaagatagagcaagaatgagtacaaccacagtactcagcaagccacaccggcagatgcacgactaatgcaagggggtacaaggggtaatgatataggggttaagttatgcagaaaacagcatttaaaagtcacttagttgcccaaagccattttataaagacgatcctagagctacacagtattattaatcaaggccgtgaaccctcacgaacctgccttaacccaaggcctacgatgatccagaccgaactggcaacccaaccctgggtcccagctcgtcccaagccaacccaggccaaccattccacattttagttattgagcaaattttaagaattaaaacactgacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacatgacatagtttccaacccatcctagccatagacaagagtaccgacccaaccccacctacggccggaacctccgagacaggtaggcaggattgagcccctagcagcaggacaccagccctgtgccatgacatctcgactaccgggccgcagctcgtgtagccttcatttgtcctagagatgtccatcgacccccgacttcgtccatctccatccgtgtacttttgtttataaccagactgagccacaaactaagccttacccactagacatgtggaagtacggtagtgctttgcaacagaggcccgagcttaatccttatagtggccagggtgctacttcccacaactggcatgcacccaaaccccaccggaaaacaggttttaggggttttgaaagaggaagagaggtgtatgtccaattccaccataagccaaccattccatagtatccaaatgatatgagaattcccaaagtctaaagttataaaaaccacctaatgttgtcctatttaatcagcgaagcatctacctaaattcatactagtggaaccatgaatagagtacccactagttggggttttgttttcctagggtgaacaaggtaataataacaatagcaataataataaggtcataacaaaggtaaataggcatggctaaataaaacagtgataacgcgggaatttaaataaagcgataatgcaataatttaaatcaaaataattttataaattgggattcaatatgttcaaggatgatgtgacttgccttgctcagagagaacggccttccgaaccttcggcgacgaccgaaaaccacgcttcgggaacctccggaacgacgaagactacgcgaagcacacaagcaaagctacaagcctataaagaagcaataacaatacataaaaagaaagcacagggttctttaggttataacaaacattaagagacttgaacgggtcgattcggagttcgtatgaccaagatatgatcatccgaagtttagtgctgttatatggagatttgcggattattataattaagctttgcaacaataaaacatgtggaagcgctagcctggaaaagacaggaaggctgcgctgttgacatgcggacccgacatgtcaacctaaaggaccgcggtagaccaggtacacagagacggtccacgggtcgacggaagcggaccccgtgtgtcaaccgaggcgagtagccgacaaacggactccactagacaccacgcgggctgcacacgtggaaaccacgcggctaccgagcgaacacactaacacggacactacacggtcaccacccgcacacgtgaacgactaccgacaccggtacacgggtaccggggtcgacgaccgcacaacgggtacggggcgacaccaaaaggacgaggacggggcagcgagaggacggatccttaccaccacgcgacgaggcgtgggaacgacaacgacgaacgggcgcggcggacggcgagggaacgacttcggcagcgatcctgggacgaaggcgagacacggccggcacgaggcttgacgacgcggaggcgaggacgaagacgacgacggggctgctgcacacttgacgaaacgcgggcggcagacgagaacggcttgacggagggacgaacgccacaacgaccgggaacgacgagaggacgacgacgacgacgaccggggccagcgaggagacgacgagggcagccggcagcggctgcacggaggcgaggatggcgtggaacacaccgctgcgatgccgacgacggaggcggcgccgcgagacggcgagccggcgaggatgaacggtgaagacgacgacggacaccggcggtgttcggtcggaggggaggcgaggccgaggacgacgtcgcggctgcgatgccgaagatggtagaggtgcagcaagccgacgagccggggaggaggaaggggcggccgaaaggacgctggcgacgaagaggatggagaggccggcgctgcgacggcgttccggcgaaaccgaggagcagccggggtggagggcgatgcggcgacgccgagggaggggacggcagcgccggctgatgcacgggcgcggcggaaggggctgccggaggagacgtcgacgaggaggaaggagaggccggcgcgggcgatctcggctccatcaatgacgccggcgaagtttgcgggaggatttccaaacgaatccgagagagagagagagatagggaaaagtgggggggaaagagggagggaatcacggggagtgatttccccctctttattgcgcgcgggggcggcgggatgcggcggaatccgcggcggcggcggcgctagggcacgggcgaggcggcgggcgcggcgcgaggtaggggatgacgggtgggccccacccgtcagcgagggtggcgggcgggcccgcccgtcagcggcacgcgcgcggggaggaggccgattgggccgcgggggagaggagagagagggagggaggtgggccgagccggcccaagaggggaaggggggggaaaagactttttagggtttttctttttataaactcattttaactttgtttatttcttaataattattatttgtgctctgaaaattccactaaaatttgagggctctttttagaccaaggagaatttaacaaaaattctccgggccacatttgaatttttcttgtacgtattttagtgtttgccaatttcttttcaaattttaattaattctattattccttttagaaaatgatttttatttcgggatgaatttatcaggacgtgacatcccgacatcatgcttagtgtgtgtatgtgtgcccgttttcaagcggagcctaaagagtgccatttgattgccgtcaagagaattctaagatatttagttcacactcctaatcttgcttgtggtatcctaagggttgtgactttgagcttttgggctattccgattcggattatgccgggtgtaaggttcatagaaaaagtacaatcgggacttgtcaatttcttgggcggtcccttgtttcttggttctccaagaagcaaaattccattgctttatccaccgccgaagccaaatatatcgccgccgattcttgttgtgcccaactcctttggatgaaacaaaccctaaaatactttggctacaactttaccaagatcccactcctatgtgacaatgagagtgccatcaaaatagccaataatcccgcccaacgctcaagaaacaagcacatagatattcgccaccactttttgagagatcacgagactaaatgagacatatgtcttaccatgtgagaaccaagacccaattagccgacattttcaccaagcctttagatgagaaaagattttgcgagcttaggggtgagctcaatatcttagactctcgtaacattagctgatgggtggttggctaattcatagccaaacatgtgtcactaaaatgtaaattaaaaaaaaaagagcttttgtgtcttgagatcacttcttgtgtagaagatggtcttgatactaggaataaagctcaaacattccctctattatccaaaaacccttttgtgaaattttgcaaaattttttgtgtgtgtttttattgagaaaatttggtttttatcccttcttgtgatgtatattgaccattcttatgtaatgttgattgttggctggtcatatgcatcataagtctctatatattcataggtttttatttctaaatcattgaattctcatctattcctttgaacttgggcctgactgccctctgttctgtcaggccggaagttccggtcatcccagtccagaacttccgggggtcgggggtataaatacccgggggagcccgagcctgttctctctctcctcacttcttctcctccctgattcccaaaccctagccgccgctacagtgctcctctcggcgattttctattcaaaccgtggaaatttgattcctctccgtggaatcaactacattggtggctaggaggttcatcccgcgatcgatttgcgatttctcctctctaggtagcacttttgatcttctcttttggttcatcatgtttttgccccgatctctaaatatgtgaacctagggagaaaaccttttggatagaattgttcctgctaccttgtagattgccgatctataggattttgtcacatgcactggcctggttaaatcctctgttcttcagttttgtaggccggaagttccagtgttcttggcccggaacttccggtctctgtctagccagccagtaaccttgattctgctactgtttcttttaaccattgcactccaaccttgttgattcttgttgcagtggtcattatgcctcgtgagaagagacagaagctttcacaagatgttcctgctgactcgagccccccagttcatggtcctagggggagattgggcaaagaaaacgttggagatttttacagtgggagtcagattccgatccatttcaggagggatggtagcattgtcattcgtgatgctccccgctctccctctccagctgcatcagagtcagataatggtggcaatgaggatgagcctggttctgaaagcaatcccttgagactttacaagacaagggttgttgatcctgatcctagacgcccaagagtgaactatctgaaaaatctgctcaagtgtggaaaggacaatgatgagtcctgatactttgcctgctaactctcaggatgacagattcaggaccttggtgcaggttgattggtataattctgtgatcatgggaagatctcatccagtggtagagatgaagtggctagactggcagtacatgtcctcaaagaacaacttagttttcaatgaggtgcgcaaggtgtgtgagcgcaagcacgtggcagatttgttagccttgcagtattcctggaatgaggaagtgactggtcagttctactccactgctttctttggcaccaccaagaaggggcttgattttgtgaagtggaccattcaggggcagcagtatagtgtctctatggcacagtttgctgcagctttggggttagatgatgatgacctgagtcgcccacatatcattgtagaggatgctctgtcaccgaccaacactacctttatgtatgagaaggatgctcccaaggattgtttggggactactcgagggttgcgtccatactatagagtgttgtactcgatcttcaggtggtctttgctccccaaagtgggagatgctacagctctttcaggtaggcatgcgctcctcctcagtcgcatgcgctacaacaagccagatttcagcatcatgaagcttatctggagtgagatctacgagacagtgtgtgagccaaagaggggttgcatctatgctccatatatcatgaagatgattgaggccaagactgggatttgttatttcaaggacaatcaacacaagcctttttgtcctcatgctcccactacttcaactacttctactgccagagtcactcgtgcttccacctcagctgctccttcttcctctgctgcaccacagcgttctgagtcttcttctcccataaagaaggctctcagggctatcttttgtatgtgtgccaagatagctaagaaggtaaacaagatagagaggcgtcagaaggaagattggattgcagcaggcaaggatgactctgacatttctgatgatgaggagtttgttgatccttttgctgcttatgagactgcttgagacattgctagtggtgagggtccctctggcacttctcgtttcttcaatgaggagtcctctcactccgaggagagcagcgatgatgaggagtcagatgcacctactgagaatattcct

SEQ ID NO: 65389 - DNA, 5427 bp, Oryza sativa
  unsure (1)..(5427): unsure at all n locations
tccttgctaaaatccagcgcacaagctctcagcatgtcctctaggacctggttggttctctccgtctggccatctgtctgtggatgataagctgtgctaaacgcaaggtaacttcctagggcttcatggactttctcccagaaatgtgaggtaaactgtgtgcctcgatcagatataatcctcttaggtacaccatgaagacatactattctggtcatgtataactctgctagcttggcactgctgtaatttgtcttaacggggatgaacctcgccgtcnnnnnnnnnnnnnnnnnnnnnnnnnaaatggaatcatatcctgttgcggtcttgggcaatccaacaataaaatccatacctatctcatcccatttccactcgggaatcctaaggggttgcagcaaacctgccggtctctagtgctcagccttcaccttctggcacacgtcacagagtgctacgtattctgccacatctctcttcatgttgggccaccagtatacttccttcagatcctggtacatttttgtacttccggggtgcaatgaatatgccgattcgtgagcttcctttagaattaatcccctcagtccaccctgtttgggtacataaatcctctttttataccataggacatccttctcgtcggttgaaaattcctttgcaaatcctgcagctagacgttccttcacctctcggatttcctcgttgtctttctgagcctcttctatttgggttctcagaagaggttgaatgtccagggtgtttacctgccctcgaggcactatatgtagatttagctgggccaattcctctttaagctcaggtgccatcccttccatttccaaatgattgcaatggctcttacggctcaaggcgtcggccacaacgtttgctttgccggggtgatagtgaacctcgagatcgtagtccttgattaattccagccaccgtctttgcctcaagttcagatccgactggataaaaatatacttcagactcttgtggtcggtgtagatatcgcaatggtttccaatcagataatgtctccaaatctttagcgcatgaaccacagctgcgagttctaggtcatgggtagggtagttttcctcatgtggtcgcaattgtcgcgaacctcgagatcgtagtccttgattaattccagccaccgtctttgcctcaagttcagatccgactgggtgaagatatacttcagattcttgtggtcggtgtagatatcgcaatggtttccaatcagataatgtctccaaatatttagcgcatgaaccacagctgcgagttctaggtcatgggtagggtagttttcctcatgtggtcgcaattgtcgcgacgcataggccacaacctttccatcctgcatcagtactcctcctagtccttgccttgatgcatcacaatatataacaaagtccttcctgatgtcgggaagaactagaataggtgccgatgtcagcttctctttgagttgctcaaagctttcctggcactgttctgaccacacaaacttcttctcctttttgagtagttgtgtcattggccgggctatctttgagaacccctcgataaaccttcggtagtatccaaccaagcctagaaaactccgaatttcggtcaccgacttgggtgctttccattccataacggcctccacttttgcagggtccactgctactccaccggctgagattacgtgacccagaaaagcgacttccttcaaccaaaattcgcacttgctgaattttgcgtataacttgtgctttcggagtttctggagtaccaatcgtaagtgttccgcatgttcttcctcatctttggagtagatcagaatgtcatcgatgaataccaccacaaacttatccaagtagtccatgaatactttgttcataagattcatgaagtatgctggggcattggttagaccaaacgacattactgtgaattcatacaacccatagcgtgttgataacgcggttttggggatatcctcggtcctaatcttcagttggtggtatcctgatcgaaggtctatctttgaaaacatcttagctcccttaagttgatcgaagagatcatcaatccttggtagtgggtatttgttcttaatagttacttcgttcagtgatcggtagtctacacacattctcatgctaccgtctttcttcttaacaaatagcactggggctccccaaggtgacgaactggggcgtacaaatcccttttcttgcaactccctaatttgctttttaagttcttctaactcattgaccggcatccgatatggtctcttggatatgggggccgttccgggtatcaggtcaataatgaactctatgtcacgatttggtggcattccaggtaaatcttctgggaacacatcaggaaatcgctgcactacgggcattccctttaggggtagcatggtaaatatacctccgacacgttcggttagcctaggatcttgatccatggttgctctcatatccgatccccagggtgtggtcagggtaacttctctacgtctacagtcaattactcctctatgctttgctaaccaatccatagccaaaatgacatcaagagtttgtggtatcaaaaccataaggttggagggaaacaccacatccctaaggcgaataggtacgtcaatgcaagctgtgtccacggctatttcacccccaggtgaatgtactaacattggttgccttagtttaactctggttaaattgtgttgttgacttgctttcagagatataaataaatacgatgctcctgaatcgaagagaactttaactggagtggagttgagtgaaaacatacccattagcacgccttggtcctcctgggcctcttcagctcgaacgtggttcacttgcccgcgtccaaatccggtagcggtcctgttagtctgcggagtcctgaatagacctcgtctaacagcaggggtagtagtcccgtgaatagccgttgcattagctccggtgcgaataggtgtcttgtttggatgggggcatttgttggcaaaatgcccatactccccacagttgaaacagcttcctggccttactggtccagtggcggcctgattcggtgcaggagctcggttttgaatggtaaccggcctgtggagattgccggaggcggcaggtcgactggttgtcaccactgttggtctccatgccgaagaggttgcccctttaggacgctggggtgccggtctggggcgggcggttcatggcaagccttcttttacgattgtgctccacgatcttccggtcgttttccagcctaacgaccttattgattaaactctggaaactatcgtggtcttgtccaatcatgggcccgcgcaactcgtcattcaagccttcaatgaatttgtcgatcgtttcctcctcgtcggcaagatctctagtcgcgtagcgcgctagctgagtgaaacggtttaggtactcttgtactgtggtattcccttgccgtagtctcctgaactcattcttcttcatcagcatcaccgcggcaggcacgaagttgtcacggaaggctgtggtaaattcctcccaatttggttctccagcatcttcttctcgggctcctttgtatgtgtcccacgagtctccggctggtccttccaattggtttgccgcaaagatcactttatcggcctcacgtactcgaacaagagttagcttcttctcaatgatccttaaccaatcttcagcatccataggttcttcagctgtggcgaatgtgggtggcttggtcctcataaactctccaaagcttgatccacagcggttgccttggttatttgcaatggcttgcaaaagttgggtttgggtggccataactccggccagggtggttaggtcaggtgtctcagtttcttcattgctggttgacgcccaacgtcggcttgccatctgtgtaggttgatggaataagtatcctaattttctaactagctcttatggttctatcccattaagggagttattttggtgtgaactttgtttcgcaagcatggtggaataaactcatttataacacaacagcaataatatcgtaaataacatcacagagttccacaaatagtacataaatcatgatgcaatcgactgcacacatacgcagtccaaataaggttcatccaaaagatacatcaaactaaccatctagctactcgtcaatctaggtaaggagggggggtgtgtgtctcgcatactatccaaaaaccatctgatacgagatcgaagttgcaaggagtccgtcagtctagtcctctagccatccgcaggatcctggggcaggtagagggtggtcgctggcacgcgcaaacctgagtccccacggctcagaagtagtgacctctggatctagcttgggcctcttgcccggaggtcgtgtgctcttgcgagcagtgctgagggtgcgagggcctccgaggaaggtgatgcggggaacaggggtctcatcctctgaaggatcagtgatgtctggctcgatctctggctcggtgtcggtcccctctgtctcggagtcgacctggatcggagtctccaaactggaacccagctgtggagaaggtgtagggatcagtggagtgtgtatcatctccgggacaggtggctgtgtcgttgccgggtccactaggtaaggtgctgcctcggtagctagcatactagcctctcccagaagagcgtggaatgctggtgggtacggcggggtaaggaagaagtagcggtcacggcctacttttcaactacaaagttgtaggtcgcgtcgagggctacaattttgatataaagtttgtcttcattagagttcacatgaaaaaattatgaattattttttatataaagtttttagaccgtcatgtttagggaccggggtgacacaattgaataagttggaggacctaaacgagtgatctgcaagtttagagaccgggatgacacaatcgaataagtttgaggacctaaacggtcgatttgcgagtttagggaccgggatgacacaacggtacaagtttagggaccggtgatggactttactctatacaataacttttcctggcggaaaagccatcaccccaagccatatgattaaaattgttctttggtggatacgtgaccttgatgatttttttttgaaagttcaaaccttgaaaatcttaaatccgagcacaatcccattttgacaggttgattcataaatcatcaaaattctttacaagtgtgcagaagttttatatcatgcatttcctattgaattctgtgatcgtccgttctcatccatataccatctgtttaatctctctcgagtaatctctacctgaaaaaattaaacatgaagcacatcattaaatgagaaaaatatgctcttctaatgacccatgaattttctaga

SEQ ID NO: 65390 - DNA, 2807 bp, Oryza sativa
gccgtcaacccgcaaggagtattcgtagataagatccatgcataagtaggcatgatcacgaacgttggggtattctacttttgcttctttgacactcagtttacaagccttttctgcaacagccttaaacgttgcaggggtcgactttgcactgggtgcatcgctgtcgatgaacccaacctttatcccggtccgatcaaaatgtatgcattggagataaaattatcaagtaaaaatattaatttatatatgtaacataattatacaaataattaaatgcacatatttaggggtatatatttacataactagtcagctagtagccagtctgaagcatgcctgagaagttaaataatttagctggctaattaattaagtaatcacgacgtacatgggaagctatgtagtagaaggcggacgcaacgtagaggtcatcctgccctgctccgccaccaccgttccagacgccgttgaagctgcagttcttggtttcgcagggcgcattcaccttcagtaacttcactacttcttctctgcacttgtggtagtctgcaccttgtggtgcggtcgttgcatcgtactgtttgtcgttgtaggtgtagttaccttgtttttgccaaatcaacaaaacaaattaaatctcacttggttcattaagcactaaacgttaattgattatatgaatcttaaaggattaaagggtcgatgcgtatagtaaacagaacaagtaataaggtagtatctagttaccactgaatccgcgcagcatgcagttgctaaatggtccatcctttctctccaggatctgcacgcgagaagcaaaaccgccatagtgcaaatagctgcaaattgttgattgatcttagtaaactacggttcaaaagactatatatgcattattttccatattttctacagtaagttcagatattaacaggctacagcctacaggcttcagtagttcagtttatttagtattcactagtacaatgtgtgcaacaaatgaattaatgttgcactttctaagtagtatattattcaccagcttgcagtggatcaagatataaaattaaacaaagatcaaattatacttaacaagagcatgaacttattaattgacctgtgcacataaatgttataatcttttcccttgagatactccttcacaacatagggatcttttccttcgggcacctttggagcgttagcagcggtgtttgataacatggcgtatgccatttgtacggatccacctccaagatcaaccacccctacggttttaaagtagtctcctcccaatttatccaggagataattcagagcaacccacatgtatgatccttcctgggatccctcaagaacgttgatccagttcgggttacactgatatttgctcttggtgtggactacatccctaacatgtattaagacccagagtactaattaaagagattattaagaataaaaatttattaagaatcaaagcaagaaatggttttgagttaaaaaaattgtatgatatgatgtatatcattgtggaattgcacgtaccgcttcaagaatttggttcgccttttcatctccaataagtctgagtccggcagttgcctagtacatgtttgattgaattaacaaagaacaaaatttagagagtacaaaaggtcaggccattttgtttcaggccattttgtttcagaggaaacatatcatcattaacattttgtcagtagttttaagaaactatttcgtcagataaaccatcatacggaaacatccgtacgtattagtaattttaaatttaagttcccgatgcaggtttcgtttaataattagataaagagcaaatcaatttagttgtgtacgtaccccaagtttaaggggagttttgttcataagtctggtaggaacaacggtgttggccttgtcaagcagaggcaatatggagtttgcggcatcctgaggacgtccagcgtaggagctcagcccaggatccacctacaacaacacacaaattaattagtcagtcagtagtaggattaaaatagctcaattaagtaggtagtaacgaatcgggatcatctagagtcgacctgcaggcgttcaagcttataaaactttctagcattgcccatattcatatatatgttaatgaatctagacttatatgtgtgcctagattcattagcatatatataaatgtagataatgctagaaagtcttataacctgaaacggaggtagtaggttagattaatgtggttaccttagcgaagagctcgatgtcgtcgccgaccttgaggaggtccagcttgttgtcgaacctgaagacgtgcacccgtgtgccggtgctgccggcgtccaatatcacggcgtacctccccggccccgctgcctgcccttccacgacgccgcctttctggccgagcaccgccgtgtcgtcagcaacggccggcggcgacaaagccagcaggagaagcatggccacgacaaggtgatcagccgccattgctaactagacaaggtgaggcgcaggtgctcatcaacagaatgcaaggggcaggttttaaagggagagggggaattaatggattactaacgtggagtttactctgcataattcagtccctaatcacagtgtccacccattagcatagtacaataatcaatcaacttttacacgggaccatgcatgctgcaaagtttcactgtgaatccacatgtgtaatcctagtgcgctagctttattgcttttgattgattagacgaactgttctttggtgcccagcgtgaaacacgatgattctatct

SEQ ID NO: 65391 - DNA, 3412 bp, Oryza sativa
acgaacaagctcgggcctggaggtactcttgcgggcggtgatcttcaggctgcggcagacgcggcggcgcttggggcgacagacctctccctaggcgatcttgagctcacatgtcacgcccggaatttctatccaaaattccaaacgcttacatgtgtgtgaaccctcgtccaggaatcagccgaggcacacaataacaaattgataatagagtacaattattactctaattaataagtgaataaaatgtcattacagaggtagatagttcctgtcaatcaataaagatctaagcatcggaaagataagataaacggcgcagacgactccactccacaggcagcttgaccagggctacacctaattctccacaccatcagcttcactgtagaactcttcctctaatgaatgattgcaaggtgagtatatgacatactcagcaagtcacgcagcaaatatgcaagtgcacaggataacaaaggatggcataatagggtttcatttgcataaacaacatttaataaacatttcagaatttaattaaacagttgagtaataattaaacaatatcaatctaacgctatacaacataccctgttgtataggcccaacctttctgaacaaccatacccggctgtacagatctatctccaaaccaggaatataccattccaaaccaggagctaaacaaattattaccagttatagcatctgttatcatgatgagaggtgtgagactaatcacgaaagacattgttagaccagcccataaccgcgggcacggctattcgaatagttttactctggccagaggtgtaccactgtacccacaagacacagccccacaacatgtcactatgtgcctcaataccaccacggtacctcggaaaggagctgtgacaatacccctcgcacaacacaatccaccacagggcacctttcctggatcataatcacccccttataaacaaggcatggactcccagcgacccccgtgggcttatctccgccacttctcagtctggtgctccgcaatgaaccatgctatacaaaaggtaaagccgttgcccacgctggcttgtggttggcacggttaatgtttcacaaccgaaactcgtgaaccggtccttaattgtcatgagcacgactctcaaaaccatgtgctcacaacccaccattatcaagttttagttggcaagtaattaattaaccaatcacgattgaccatcgtgagctatcattaagccatcattaaataatagtgaatcataagttatcccaatcgctgcactgcacggtgtctagctttttccccacggcatgcaaccaatccaacgcatccacggggttgttggagctagagaaggtaggtggacggatgcggaggaactcggcgagtttagagtgttgtgggggtggtggtggagcattctgttgtggcggattttggaggtggtggaggaaagcagtcatcatgtaggcctgctgggcgaggatttgggtgagaatggcgttggtgtctggtggtggtggtggaggcggaggaggaggtggaggtgggctgccatggttgttgtggttgctgccctcaggttggttgccatcaccggtattagcacttctcctggtcgtcaccatctaaaaaccccacacagaaccagcaaacagagagagctgacaattaaagctaaccatccacgactaccataattcttgaatttattactgctattaaattggttaattaaagttcaaattgcttaagcaaataaaataaagacaggctccgacacagttatgccacacaccggcataaccatgccccacacgactccaacaagaagacaaacgagaaagaacacacgcgcaagcctactaactgctcgtctaccgctgcgacgggccaggacggaaggtgagcaacagcgcatcctccgtgctaccaacgccggaggcttccccctcctgaggaaccacgggcgcgggctcggcacgaggggtctgaacgaagcaagtccacgccagggactgacgaacaagctcgggcctggaggtgctcttgcgggcggtgatcttctggctgcggcagacgcggcgacgcttggggcgacagacctctccctgggcgatcttgagctgatgcagctgcgcctccactgcgtctaggtccttcttcagctgcagattctcctgacgcggctccaggatcttcatgttgttctcgaccatcccacggcgcaccatctgatggaagtcgatacaagtcgcgtcgtacgcctccaccatgcgcgccaggtgcatgatggtagcgtcatcctccgagctagcatcccggaaggtggcgaagtcgcgggctcctccgtggcgagggtggtagcggtagggcgagtgctgcaactcgtccgggtagcgctggtgaagagtgccgatggcgaggagagcggcgttctggcaagcggcggagaaagaatctccacccgcggtgactgccaacgaagtcctctcgggtgagctagtgaggatcactgcagtaacctcccaagcagcgtggggctctgcatcgtcaccctcctgctccgggagcggcctgccctggtagtccactctatgcggataccccaggacaactcacatgccccacagctccaagacgaaaccagtcaggtccagaccacgacggctgatgctgccggccatctacaaacaaaaacaaaaagaaaagcaacatttaaaagtcagattttggcgataaatgaagcagcaggacagagagagactagagggttttcacaattaagacaggatttttatttttgaaaatattgctaaggcttgggatctaaggctcgtcctagggtcaagggggctctgataccaacttgtcacgaccggaaataacccaacgggcgttccttacgtgcgtgtattattccttgtcccaggaggcaaggtacaccaaaagttgatacaattcagagtttaacaagcggaagcgtaaatagataatttattacatgggcagcgaaggcccggcacacacaaagacaaacgagaaacagcggaagactagggcgacgaccacaggcgcttgacggcaggcacgagctagacaccaaagccttcatcttccagggactcctcttctgggtttgggaaaaattgagcaagactgagtacaaccaccgtactcaacaagacacacccacaagtgcagaataaatgcaagggagtacaagggagttataatataaagggttagggtttgcagtaaacagcgttaaaagacacttagttgctcaaagctattttgtaatcacgattctagaattatacaatattatttatcaaggccgtgaacccacacgaacctgccttaacccaaggcctacgatgattcagaccgaaccggcaa

SEQ ID NO: 65392 - DNA, 627 bp, Oryza sativa
tgaaaaaaaatcgccgaaagctttacatattttctttaattaggtatatgatatagaccatttgctataagtatattggtatggatgcatgctttgatacgtccaaaagtgcgacggaaattaaaaggaaaaatataaagcataccatgggacccaccatatgctggatgcaccacaaaaatctcccatcaatggtcatgccctgtcctctatcccattccgtttctcctctctctttctctgcgatacgatcgctccttctcaggcttgtgacgtgcacctgcatcccgcagtcctggcaccttttgcatctttgagtctggtgttaatagagatggcaatggttaattcaccgtcggggtcatgcccgtgtccccgtcaccacggtgaaaatatgtcactgtccccgcccccgtcaactacaacggggctataatttctctagccccgatcaccacgcggtgaatttttctccatggtgaacacgtccccggttaaacaacatattcacaatcacattatatcaaatatatccaaaatactccactcaacaaatcagcaaattatagatcacaatcacagtaaggatcattatcatttgtcattacttcattaggcaaaacacaa

SEQ ID NO: 65393 - DNA, 1107 bp, Oryza sativa
catgaacatgagttagatagcctttttttttggttttagtgaaaagatgaactctctaacctggtctgatgaagatggccatctttcgggcctaccgaccccaagaacgtactgtacatatcgaatgatccatggatggatcgatcaaaagactcgttgacaagaacgtttccccttttatcgggccaagaacaaatgtcgcggcgtgtgccaaatatgcatacacaaactttgttttctgcaagctagtcgatcgtgccggtcaacagccaggcgcaaccaaaggagtcgctacctagctagccactttctactggagtaggagtagtttctacacgatagatcgatgtagcatcacaataatggccagtggccatacccttttcagcggtagtaatattcttcttcattttccgtattttaatatttgaagtcttttttttgcctcgaagctctggtgagaattttgaaatgtgaaagaaccaatcctcacttaattccgatgcattcgcatgacaagcttctcccgtatctgtattatcaactccctccgtcttaaattaaaattagattattattattaacctattttatttatttcaaaataagtttatttttagaaaataaaaaaaatacaatgagagtagataaaatgaaaaatagttgcattgagaaacttattttgggacaaagaaaatatgctatagagtacatatgcttgtgctcatgtcactcatagtcatagagcttaattctaggcactactagtgtagtactaactccggccaaaaatatagctatctagtacggtatgtgacatcacgtccaaattcatagtactaggtgatgatgttacattcagtactaggtagctatattttgagacgaaggaagtagagtttttaagtagtccaaagataaaaagaaaatactggtaagctgctagggtcatcaagctcaactactccatcaacggtcaaggggtaatatttggcgtttagtgacgggtgaatcacacggaaatccccgctttagaatgtgggatgttttggttttggtataaagttaaaagttaaaaattaaatttatagaatttaccagtacacc

SEQ ID NO: 65394 - DNA, 16862 bp, Oryza sativa
  unsure (1)..(16862): unsure at all n locations
tcattgtaccatgaaccagccatggtgattgacctgttatgcattctttgagaatattataagaatttggtatatgcttgagtgttgagtgccttcaaaagctctacatatctatagattattacgaactaacactttcttgtgagtttcttttgcttgctaaccatgtcaggtacaagttccgatgaaccaacactggagaatctagcgcataaactgaagggcatggaaaattggtatgaagagttgatgcgtaatagtaaatcatacaaggaaagcacagataaacatttaaaaaccttaagtgaaaacctagtgaaagtagtggatcaaattgagcaaatgaatcaatcgcataaacaattaactgaaaacatccagaatatgaatattggacatgaaaatattgtgcgatgcattggtttacttgagactgcaggtgaagaaggtgcaggtgccactgctcatcgacaccaaagatatgacgatgaagacgaagagcaatctgttgctgacgatgaggaggaagacgagagtgttggaaatagaagacgacatcgagttagggacaaagatgatcctttatctaaggtaaaatttactatgctttcttttgatggtaagttcgagccttctgtttatctagactgggagctagctgttgagcaaaaattctcttgctatgattttactgataataagaaagttaaagctgccattagtgaacttacatcctttgcatctctatggtggaatgatatatgtggtagaggacttagacctagaacatgggattatatgaaacgtataatgaggtctagatttgtttcttcttactatgcttgtgacatgttaaataaactgcaacttttaagacaaggttccagttctgtagaaacatactatcaagagatgatgattgctttgtcacgatgtgatatgcaagaaactgaggatgctagaatttctaggttctatggaggtcttaatagagagatttgggatattcttgaatataaagaatacaataccatgaatagattattccattttgcttgcaaagctgaaagagaagtgcagggactcaacaagcataggagttcttttgcaggtgctacttccacacgacaattaacaccacgtcaatctactactgcctttcgtccacctacctccacgccatcccatgctcaagaaacaagcaaaaacgcttcagttcagactccagccaagagtgcaacttcagtagcttccactagacgtacccgtgaaattacatgtcataggtgccatgacattggacacattgctcgcgactgtccaaatcggcgagctctatttatgaatgatgatggtgagtatacttctgctagtgattgtgatgatgaatatgctttagctgccactgaccatgcaggaggacaagataacgatgtcatcaaggaagtccatttgcatccagagtcgctagatcagtatcctagcctaattgtcaagctagcacttagtgctaaagagaagtgtgaagagcaaaaccaacatcacaatttgttccaaagcaaagttcttgtgaaaggccataccatcaaaatgattattgataacgggagttgcaacaatttagcaagtgaagagatggtcaagaagcttggcttgactaccatccacatccacatccgtatcatattcagtggtttaatatatgtggtaagatgaaggtaacccgcttggttaaaatacctttttctataggctcctaccatgatcaaattgaatgtgatgttgtgcatatgcaagcttgttctgttattttggggcgaccatggcaatatgatagagaagttgtttttgatggtaggactaaaacatataaatttatgttcaatggtaaaagagttgttttgcattctatgactccagccgctgctttgaaagatgatcttgcaagacttgaatgtgaaaagaaagcgaaaagtgaaaatcagattattactaagaatcttgtttcacctagtacaacagaaccaagtgccacaaagaatgaaattaagttgacgggtgctttgttagcttctaaatataatatttgtgcactatatgagccagattcttgttgctatgctctattttgcaaagatcctatactcactttggctactgcttctagttccttatattctttgccacctgctattactaaccttttgcatggatatgagggtgtttttcatgatgagatacatccaaggatgacccctgaacgagagagtgaacatgatcacgaagatgagattgagtcgaggacaactccaattcaagaaggggaggatgatgaggacatcaattcatcggatacgctcataacttcacacgttcaaatgataatttcaagtccaagtccagttcggcctccggagacaacactgacttcaaacggatctagcgccttcatgccaactccgatttgggtgatcttggactttatggaaaacttatctgctaactttcaaacgcatccggtctcatgtccaaattcatctcgagtcaacggaaatcgccaaaacaagacagcgctgttgctgaaactgaatttgggccttgggccttgtaatagattaggcccatctcggaagtgtctcccttcacctccacgaattagcacttatccttagctttattttcctctataaatagctttgtacatcctcaaaaacatttgggttttgtttagttgaattttgccaagtgccattcaccttgtctctagtcttcgttcgattagtcggcgactattgattcagagcccccaatagttggtgtattgatttgccgggtcgattagacctaccacttcaatcgcaactatttctttgtgcttaatcacctattcgcaatatttagattgcatcttatcttgttcttgcagtgttctctcgtttgcattgcagggatcatcaaccgcgcgtcgcggttggtacggcatcgtttgtggtgtagcgattgcacggtgtcctggacttgttctggttggtagccacgtcgcaaatgtcgcactcgatcaaagcgagagttatcccctcaccagaagatcgggccacgagagagagtgtcatcaaaccgggagtaaaaagtgtttctctaccgtgtatggacataaaaaaattagtaggagaattttttaattatattaaaagcagtttattagagattatctatcatgctaatccttaatatagtttgatacaggttaatacctcttaatctgtgctaattatcatgaatcatgtcattaatgcggccaacttgagctcgttgtgaaacgctacgacacaatgatttctcgctaagcaaacacagcgacgttgaatctgctgggcttgactcaatccaatatagggaactaaatacagtaccgattaaaatttgaatttgtgataaccggttctactgttaaaaacaaagtgtgtcaagccttatgcagtaaagcacacacaagccttacaaactgtgtcgtggcaaagtttagcggtcaacaaattaaaccatccctatagagtggactagctagtgcaagaaaaaaaagagtcatattttcataatcgaataatggagcccctaccctgtcaacggacagcttgagaataaaatcaggtaaataccaattcaatcatggaggaagacttggtccctctctgaagcgtgcatatctagtaatgttcagccactagccagccgtacgtacgttcctccagctcacctgacgatgatatgtgtaacaagaggtgacgatgagtatattaattaagtacacagaataagaaaaccattgacgcatgtgattaattaattgggttttaattagtacaaatttataacattgatttatttgatattttatagcaacttcgttataaaaaactttagatgaaacataccatttgacattttaaaataaaacatatggtaacaaaaaccaaatataaaatatgctagatgcatctccccgtcggaaggttcattcaattcgcgggatgttgggttgtgccatgtgccttgatatacttcgccagttcgccgggtgtagtaacgacgactctcgtgtattttcaaagacgacgaacgcacgagatcgagggtgttctcgttggctctctgatatctcgactcgatcgatcgatcatgtcgagcttacgcgatcgccagccggccagtgtagtagcagcagcaaaggaaggagatgttgctcgcctatgcgagctgctcggtgtggatgttgctcgccgacgcgagctgctcggtgaggaaaccggctctccgacaggagttgacgatgtgggtgtggaaaccggcgatttggaagccggttgttcgacgggaagcaatgctacaccccacgaccacgagggcagagatcgcagctgctcgtgctttggcaggcgagtgttcactttccaatttctttctttttgattgatagtgcgtatatatacgtagctaggatgggcaagagtgatttttagtttaactaaatacactaatttaaagtttaattattttagttctttcttaaaaataaaagctcatttaaatatatgcacactcagtactataaacacatgcatacacatcctatcattatgagcataattctaaacggaaaggctaatgggcgggtgatcgctcccccacccgcccaccctctcccctctcccctatactactagatgtactcctccctcttctccccctttctcctctccttctcctctttctactgcagtagaccacacaaaattttttgaaaaacaaaagttagaaaaatttatgtatagaaattctatatataaaaaatttgaattcaaattcaaatttgaatcgggtatgtaaacttttgacttataaattttgggtctataaactttaggtgtataaactttagatgtatagaaatactatatatagaaaatatttgaattcaaattcaaatttgcatcagatataattcaaattcaaatttaaatcgggtatataaactttaggtttataaactttaggtgtataaactttaaatgtatagaaatactatatatgaaaaatatttcaattcaaattcaaatttgaatcggatatttgaattcaaattcaaatttgaaacgggtatataaacttttgacttctaaactttaggtctataaactttaggtgtataaactttagatgtacaaaaatactatatataaaaaaaatatttgaattcaaattcaaatttgaatcggatatataaacttttgacttataaacttttggtctctaaactttagatgtgtaaacttgagatatataaactttaggtgcataaatttactaaaatagaaaagtaatgcagtgccaaaaaaggaaactaggtggagagagggagggggagggggggggggaattgancnntncccncacccccaggcgagcgatcgcccattaggggtaccctattctagaggctagactaacatatgtcttattcttgacgagtatgtcgtctgccacacaattagcatttaatgcccatgccaagtttaggactttatcaaactctggaggttaaagctacatcaaaagaataactctagtgggccacaaatactactacaaattcattcaattaactctagtgggccacgaacacttctacaaaaaataacattagtgtcggttcgtaactaacatcagtaccgaaattagacacagcacaaaactttcagcactgatgacccccattcatgaatgtcgggttccgacctgacacagatgggcctggaagcacctaggtggaatctagatagactcatttgtgttatgtattctctagactgagtattgatatgagctcatctgtgacgggtattgtgtaccatctgtactcatgtatatacaaagccccaaccacaaatatctatttatacaagttgtatatgactcttcaaattgataggatttgaacttgagactctacctcacatgcacgtatctttaccaagtcatctacacatcaatcttgttagcaaatggatattttcccttttgagccttcctaactgagattttgaatcttgactttgagtatctgaatgaaaaatttgtcaactacaaaataatagattttagcgagagctaaaatttatatataaatttgtcacaatccgaattcgtatgataaagttaagttcatatatccaaaatttgcactaataaggttagggtcattcgtgccgggtcaatagaatacctagcaccgatgtgattagtataagtgccgggtattctaaagacctgtcactgattatcttctttagccaaaagtacggtcatctcgctccaaggggtaagatctgtcgcttatatgttactcatccgtgacggttaattagtggaaagacctggtactgatgtgtcaccgaacaataagtgtcggatgattataagatccagtactaatgtcttcttatcattgccgggtgaagcatatgtataactcaaacttttttttttcagaaaaccaccatcggtgttgggttttatcaaccgacactgatgaggaggcactgatgtgttgtcctgtgatagtgaaattatctgtggattggcctgcatccatccatccacatgtgcgtacttgtactagtataatttttattacacataagatgcgcacactactactatacacatactccctccttttcaaaatataaacatttttagaatagtgacaagttaaaccttttaacttcgactattaataatagcaaaaagataaaaaagatcaatcatgtaaaattgatgttactaagtttatcattaaataaattatcctaatatgtaactcttttttattttaaatatattactttcatagatattattggtcaaagacctgacctccccacctctgcacgttatctccaaatataccggctttcctttttttttttccaatttccccactttatctttacctttttttcacttttacttttttccttgtttactccataagggcctacgaccaaggcccattggcccgttcatttgtgcggtgggccggcccaccacgtcacctaactatttcttttttctgaaaaatagtataattaatcgattagcgaaaatagagtgactcgttagcgtataataattaattaagtattacttcctccgtttcatattataagactttctatcattacccacattcatatacatgttaataaatctagacacacacacacacatatatatatatatatatatgtatatatatatatatatatatatgtatatatatatatatatatatatatatatatgtatatatatatatatatatatatgtatatatatatatatatatagtaaatttgtttggtgctccatggtgcccgggcaccattgttgaaattgagtatatacccaattcaaatgagtatgaaactttttcaattacttagttattaacattaactactttactaactagtttaaagcaagtttgaactgaatttgaacttgtttttgttagattttgattctaggtatatagcatccatacatataattagttaggtatgtaatcatggattgtgaaataaagttaaatttgagttgttttgttgataagtataggtatgaatcaaattattataactaggtatatactcacaatttgaaaattttaaaaaatttgagtaattttgtgcattagataccatggtgccccatatgagtgtcctatatatatatatatatatatatatatatatatatatttcgaagattatgtcaaaatctaaaaatatttatattttacgaacggagggagtacaacacactcgcgcacctacaaagtacgccctaaattcaatatttacgagtatccgaatttgagtatgtgtggactctgtcatcggtgcttggtacgtgttcgtgcaactgcgcacccttgcaagtcatgaagactagaatacgtcaaatgcttcttcctatcaacgtctaattcaattttatgtttggattagaaactatcaagtgtttgtcaggagtagttatgcctaataaacagtagtattctactatactattattattcccattacaaataacgttaccttttcgttatgagttctactttcgataaaaaacacttgtactcccttttttttaaacatttatactcccttaattatcttgctagatatttttaatggaacaacgcatgcactactacatatccggacatcagtgatgggtcatccgtaatgggtcaacatgactttttagaaatgaattgtctctaacggaccgaaaaataactagtttaagatatgactaatgggaagggcccatcatagatgtgaggtcatctgtgacggatggtagttataacctgtcagatcacaactatggctcgtcacaaatatcatcataaatgagaccactcatctctgacgggtctttaacaccatatatcacagataacgggtgccaattatgacccatcactgataagggaaaattcaaaattttaaattttgcaaaaaaaaatctcggatttgggacatgccttgtataaaagttgttgctctcaatgatatatacaactttataactaacatcatttccattttaaatcattgaaatccctgtatatgcattacaagtgatgagatctacttataaaaaagaaattttgagttttttcaaatgacctgatggaaacatgccccacatcaaagtcattgagctcaactagatctacaaaactataattgacaatattttcatttgagatagtttaaggtgagatctattttgaaaaatgaaattttgaattattcaaatgacatcgaatggagatattctctatgcaatagttttataacacaatgagatctataattctttagttgataatgttttcatttgaagttatttagagtattaaatatatattaaatgattcgaacatgcatagacaaaataataatattgaatgagtaatcaatatgtgttgagtaggtgagttggtaaaggtgctctttggggaggtggaggtcttaagtttaaaactcataatacacatgcatgtatatattgcaaaaaaaaaagtggatttgtaggtagtgatatgtgaccatgtacaggatggctagtattcaaaatatgttactcatccagatctacaacactatatgcaagttgtcttaattgaatgcatcaattatacttttgcaggagtttgatgaattgttgttacagggataatgtttctattcaaatggatggatcaatccctccaaaaccaccgaggtatactgcttccttaggcacatgcaagccatgcaaccgcacggggcccctaatttttaggtggcccaaaattttatggttcaatataattaggatctctagattctttttttttttcaaatttcacttcttcagttccactgaaccagctagaacgagttatttttgggtaccatttcatatcttttagttaaaaatattagactagtaaaatataaataaaactaaagtttagactgaaaccaaatcaactttttatatatcagttatgtatttaaaagttattttgtcggaaagaaaatttggattctatatcaagtacaactctacatttcttaaatattacaactccacctcacttacgagttgctaattagtaattcaatatttcaggaaatattaatttaaaataaaatttgggctctagaactagtacgactcaatacttgttaatttcaagtttttcgaattattaaattatggaaaacttgacccaatacctattgagtttgtattcattgattccaaattttagaaataatatttaatcgatggaaaacttaaattaataatccatgacaattacaattttgtatatttattaatgtaacaaaatggtgttaattctatatatatgcgtgcaaatctcctactttggtatatactaaataattataactatgtatgtttataacccagttgccgccagcctcaaagggaaactcacaataactctgagaacacgggtgccactggtaacgatcaggctcaggatgagggttttctactccatgtcgtagcagccaatggggatggtgaaaactacaggaaatgcgcgacattgctctctgggatggataaaacacgtctcttcgcacgcaacagcgagaataagaccgctctagagtgtgcagcaaatgctgggtacaccaatatggtttttcatctccttgacatggagcgaaaacacaatttttgtggactgaacactaaaccaaatgagatcttgaagaagacaagtggacgctcagagacaccgttgcacgaggcagtgaggcagcgttgtgaacgtaagattgaagagttgaagggcaaggacagtggtttagcgcgtgtcccggacataaacggcatgtctccgctctacctcgccatccccttgggatacagagacatcgttgataagctaaccttaacctttggtgatgcgaatctgtcctacgatggaccaaatggacaaaatgtgctacatgctgcggctcttcagagtgcaggtaagggatgtataccctgcttaacgctggcgtggcattacacacgtataagttgtttttgttttctatataattatgcagagttggtttatatttagtcgattctgcctgatatctttcaaaacggttcaataagccagtggttttatgagaatgtctacaataatgcctgcacttgctttgcttcctctctgaaccctgcatcaacatttactttcgcatagccttcaggtggtgcttgtatttctcctgaatatcacattagtacttgcttgttatgctttcgcccttgactcattatacatagcacctttccccttggcatcatctggttgttgtcagatagtcaacaatgtgctttcataattgatcaaatcattgatcaacactatacattatttactgctttccttctcttgttacaaactcttttatgggcttgtgtgtgttttggttatgtgcatttatgcagaagccggaagttttcttagtatggttctattaacttgttgtaatcgtctgagattaataaaagctcctttatcaaaaaaaaaattataatcttgaggtagtctcctagcaacagtaaaaggctcacgtacgtgttaatggctgtgcatcctccagaatctttttgagtgcttattttggaatgaaagtttgatttgttctttgccatagaatttaggttgtacattctttgacacaattggtatcataactagctaggtactaattaacggaaatactcgatggcagaactctgaattgattctaggaaggagaggagatctcatgaataaagctgattggtctggaagtacacctcttcactttgcagcatcagtaggagttcagggcgtaacaactgcgctgcttgatggcatagaccaagatcgcagaacggactacacccaacggcccgacaacaatgggatgttccccatacacatagctgcttctgttggttcaatggacacaatcacctcattggtcaatgccgatcaagactgtgccactcttcgtgataatgttaaaggtagaacattgcttcatatcgccattgagaatcggaagtacaaagtagtcaaattggtgtgcaaagatccgaggttcaaggaaactctgaatttggaggacaacgacggtaatactgcattacatcttgctgtaaagaaaagagacgagtacatcttcacgtatctcctacagaataaggccgtggagctcaaccatgtcaacctagaaggctatacaccactcgatcttgcaaaagtgataaggatggaagactactttgcctctccccaggtatatgcataaaaccatcaaaattttggcataaattaaaatacatacaaaacagatctcctgacatttcaagtctccttccctgcagaacccaacagaatggatggtgagggtattggctcattctggagccgtcttcagtcctcgtaggcgtgatgaactgatccgtggtggtagctctcaagaacaagaaaagcacgggaaaaccctttcagagtcgactgaaagcgtgttggtcgcatcggcgcttatcgcgacactgactttcgctgcagcattcaccatgccagggtcctacagaacgacaggcccaaaggaaggcacgccagcactgggtgccctctacggtttcaaggttttcctcgtcgccgacatcttggctttcttctgttccgttgcggccaccttcagccttgccgagtacgggaaccgcgggacggtggatccccttgtccgctgtcggtactcacagcgtgccgtgtggctcttccatgtcgccctcaggagcatcatagtagccttcgcgttcggggtctcggtggtgatgtggaacatttctctcagtgccatcagcatcggtggtgtagccactatcgctgtcgtgttctacgggaacgttcctcttggtcaagatttcaggcttatgttgctgatgcaccgcaggtttggcttctcacgttcttggaacctgtatccttctacggcctctcatctcaactggacatcctggcagctcaaaagcttttccgcgacgctggtttggaatctgatgaatcttttttggacttatgtcctcatatttgcacttgctggcttcgctcaactgaagcagaaacattaacagatcacttcaaaattcgtcagggtgataattctgttgggattcacagggcatttaattattttgttttctgttttcttgcattccattcccaaattgatgtccacatgtcgtcctcaccagttagtcggagccatatgtatttccttttcttccattttatttgtattactaatgtataatgacatgtttaatgtttaattattgtgttccccgttgtagagattatgggtaccgggtacctcatggctgggctatccgactggttataggagatagatcatgtatatagaatatatgtataagaatagaactcatgtattacgtttacttgtgtatcatggaacggtctgtagtattggtctattaagatcgtagattagatataggaaacttaaaccatatggggataagtttttaccttgtaaggttgctcctttgcctatataaggagggtaggacgtccctttggaggcagatttacaactagatcgtcagatcaatactacatctggcggatacaaatccccaaacagaagtacagtattacctctcattgagagggcttgaacctgtctaaacccttgtctccgcatctatccacttttaggtctcgtgcgctaccccgtttatattgctgcatctatccactagcaagatgtttatctctccatgttactgaagctcatgaggataaaataatttggtagcaatatgcttagtgatgttgctcttaatataaccagtttccatctgaacaacacaagcagcattatcttcatagataatggtaggtgattccaatgaaccaataccacaagatgtcaatatgtggttaaccattctgcgaagccatacacattcacgtgatgcctcgtataatgcaattattttagaatgatttgtggaagtggctaccagagtctgtttagaagacttccatgaaatagcagttccaccttgtaaaaatacgaatcctgtttgtgatatagcattgtggggatcagatagatagccagcatcagtatacccaattaaagttgaatcctggttctttttaaagaaaagtccaagatctcttgtgccattaagatatcgaaaaacattcttaactccagtccaatggcgtttggtaggagcagcgttgtatcttgctaatagatttaccgagaaagcaatatctagcctcgtactatttgcaaggtacataagtgcgccaatagcactaagatatggaaaatcaggtccaagtacatcctcaccatcttcctttggtctaaatggatctttctccacgtctaaagatcgaaccaccataggggttttggaaggatatgacttgtccatattaaatttctccaaaattttttgggtatatgcactttggtgcacatggattccagaaggtaaatgctcaagttttagacctaagcaaaatttggtttgacctaaatccttcgtctcaaattccgtctttaaatgatgacgtgcttcattaatatcttgtgtattgccaatgatgttgagatcatcgacatataccgagataatacaaaatcctgtgggagacttttgataaagacgcacgggcaatcatcatttttagtgtatccctttagtgaaaggaattcacttaatcgattgtaccacatcctgcccgattgttttaagccataaagtgacttatgcaacttaacacaatacatgttatgatttaccttctgattcgggatgtcgattccatcaggaaccttcatgtaaatatcagaatcaagtgacccataaagatatgctgttactacgtctatcattacatattccataaacataatctatccactatatcttgtcgggtaaaccagtcgtgtgggtatatggtactgataatctttacagtagcccctgagaccttcacagtcgaaaagataatcttctctcagaccaaattaatccaaagccttgtgcttcaatcatcttcgccatagtctcccgagtgcttttaccaaaccataaggctatgaagggatgaaaataataataaagaatacatacccaggtgcatcgactagatgcacctaattaggtgtagcccccccactatgtggttagtttgaaaaaactaagcatgtagtcaaggaataaataatctaaccaaccgaatggttttggataattatagttaaccaagtgacttaatattaatatatagtatatacggtgtgaatccctgaataacatgatccaagtaatataccgactgcttgttaaaaaatataataagcataactaaaagccaactgcatgtttaaaaatcatatggtacatgactttaataaaatgtctttatgcagcaagtaaaggaattctctagagtgttgggttcacattgtgcgcatactgccaaaacaaaatatgctcaagtcccaataaaacatacaatatcaccacactcgagtaaaataacacttataaatggatttaccaaccacctgaaaatgatcaaaatatattatcagcctaaatccatatattggtcttttagaaaaatgcacacacatggccaaaagcaatgatatagtatccaatgaattgctttataaaaaacaaacagcgccttaacttatacaaaaatggtcattcttcaatgcggttgggtaagtgttgacggtcgttatcgatcagtttcgaccgtcaatattaccaaaataaaggagaactagtgatgcttggaatgcatatatatgttagaataataatattccacaagtattaggtatactaaccttttgcagagaataatcataaagtggaggagaatcgacatcaacacagacgataaatcaattggacgaggtcgagaaccagacttatgtatgaatggtccaagaactcagaattgacatgacaaactgggccaaaattgggctggattgggccggccctaagcggttcggccgaaccctccttaacaccatcaatccagggcttcgcttggacggtgtggattagcccccaatgacggttagagggtatttccgaccattccaaccatcgcaaccgtcattaggaggctataaaaggagttctcatcctcacttcacacacacacctcaagcaagagctctctcatttctctcaaatttagtttagtagtatctagctggtggaatagaaatagagtagaaatcaggagtccggaagccttcggaagagttcgggtatggctctagtagctttcctttcctcttttgtaagctttgtacttttattagaatactcttctatatacatttatggtattgaaataatttacattatgttcatgttatactgaatatacggctagcttatctgggagatgctttggtacgggtataatgtttgcatatgcaattactctatgtcatgacgatgatattagattagtatctagtagtttagatgtggtgtctagattacaggatatcattatttagggttatatgctgcggatgagaggtgggccgctgatggtgatagctcagtacgggtattcctccgtgcctgtatataatcctaagttaattccctggggagggtattcctccgtatttagccccggttgtatggtcatgacgggctgtcgtaaggaactcggcagtcaggggtggcttctcgaagtaccaagagggcatcggatagaggatattagctagtatatcggttaactagaatgtatgtatactatgtatattagaagtataggagtagattttctttctcttttctttccacttagctcagataatatatcatgagaatgagtaattaatgcttgtgtgtcactctacccttggattatcttaacccctacttagaatatgattatcacaagtaatatataaattattagttaagttctctccacatgatcttcccatgggataaaataaatatgatacccttagaatactctcggttgaaatgctacgatggtatatccgtgcgcttgcggatgaactctataaccataatataccagaagtatttctgtgccattgctgggaattatatttctagtaatatcgttaaga

SEQ ID NO: 65395 - DNA, 9637 bp, Oryza sativa
cctttttaactttgtttatttcttcttaattattatttgtgctctgaaaattccactaaaatttatttacgcattttaggcttttaggaaatatacaaaaatcctccaagccttatttgacttttaactttgcacattttaattgtggaggctttcacacggattttaattattctcggcataatttagaggatgtattttagggtcgttttgggacgcgacatcggccatcatacatcggcaaaacacaaccaattaagataataaaaactgctaagggcaatataacttatatcggccatctctaggcggtgtcaacacatcagctaacatgtatcggcagcatccagccgatcatgaattgacccaaacacttgggtaatatttcttcagatattttccattaagcgctcgttcataaatgtcgcgtcccaaaacgactctaaaatacatcctcgaaattgtgcaaagaataattaaaattcatgtgaaagcctccaacaattaaaatgtgcaaatataaaagtcaaataaggcttggaggatttttgtatatttcctaaaagcctaaaatgcgtaaataaattttagtggaattttcagagcacaaataataattgagaagaaataaacaaagttaaaaaggtttataaaaagaaaaaccctaaaagaagtcttctttcccccccttcccttcttgggccggctcggcccaacttcctccctccctctcctctcccccgcggcccatcggccttcccccgcgcgcgcgccgctgatgggcgggcccgcccgccaccctcgctgacgggtggggcccacctgtcatcccctacctcgcgccgcgcccgccgcccgcccgtgccctagcgccgccgccaccgccgaatccgccgcatcccgccgtccccgcgcgccataaagagggggaaatcactccccgtgattccctccctcttttcccccacttttccctctctctctacctcggattcgtccggatttgctcccgcaatcctcgccggcgccatcaatggcggccggatcttccgcggccgattccccctcgtccggccgctctctccccctcccaaccctatataaaccctccccgtgcctccctccaccgtttccgccactcgccgctctttctccccgccggaatcgagctcgcgccgtcgctctctctctccgccgtcgccgccgagctccggtccgccgccgttgtcgccccggaccacccctcccctcggcgccgcctccttcggcttcgccgcatcctcgccgacctcgtccacccctccgtttcgcacgccgaccaccggagcaccgtcgaccccgtccacccgagccgcgccgccgccttcctccgctccggtcgccgttcccgtcgtcgccgttcccgtcgtcgccgtcgatccagggtgagccgtggaccgcctattcgtttcccccttccctcccctctctcggccgccgctccgccgtacctatggccgccgccggcgaccataggggcgcgggcgcgccgcctcccgtcggccgtgccggcaaggccgccatcgggcgcgccccgcggctgccaggtggggcccggccgtcagccgcccgcgcccacgggtgcggctgacgcgtgggacccacggcgccggccggcgtcagccgcgtgggcccggtccaccgtggaccgtgaggctgacgcgtgggccccactcccgtggacccggtccgcgcgccctctccctcggctgacgcaataaatccgatttttaattaaaatttaaatgaagaaattcgcaaatatccatttaaagagcatataaacttcaaatggccataacttggccatttgaactcggaattggaccgttcaagtctctaatttttccttaagaagtcaagaacccatttttgtgctttgtttcttcttgttatatggagtttattagagtaaaagccttttcttttccgttggtcgtgtagatgctgcagcttcggaagatctgctcttcgtggaggttgaagccgatgtttgggaaagcgagcaaggcaagtcacatcatctttgaacatattgaatcccagtttataaaattatgttgctttaaattattgcattatcgctttatttaaattcccgcgttatcactgttttatctagccatgcctatttacctttgttatgaccttattattgttattgttattatttccttgttcaccctagaataaacaaaaccccactagtggacactctactcatggtaccactagtatgattttaggtagatgcttcgctatttaattagttaacattaggtggttttacaactctagactttgggatattcatatcacctggacactttggaattgttggattattgtgaaattggattcacaccgccccctctattcaaaatccccaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggacgaagtcgggggtcgatggacatctccagggcaaatgaaggctacacgagctgcggcctggtagtcgagatgtcatggcacagggccggtgtcctgctgctaggggctcagtcctgcctacctgtcccgggggttccggccgtaggtgggattgggtcggtactcttgtctatggctaggatgggttggaaactatgtcacgtcttccgtctgtataccgtggtggtatgtggcacgtggttgcacgtgaggaagattgtgtcttgtgggtaaagatgtacacctctgatcagagtataatctattcgaatagccgcgccctcggttatgggcaagccgagcaatgtacccaagttagtgtttcaattcttaaaacctgcttaacaactaaaaggtggaatggttggcctgggttggcttgggacgagctgggacccagggtcgggttgccagttcggtcttaatcatcataggccttgggttaaggcaggttcgtgtgggttcacggccttgataaataatattgtatagttctaggatcgcgtttacaaaatagctttgagcaactaaatgtctttaaatgctgtttactgcaaccctaaccctttatggtataattcccttgtactcccttgcatttattctgcatttgtgggtgtgtcttgttgagtacggtggttgtactcagtcttgctcaatttttcccaagcccagaagaggagctccttgaagatgaaggctttggtgtctagctcgtgcctgccgtcaagcgcctgtggtcgtcgccctagtcttccgctgtttatcgtttgtctctgtgtgtgctgggccttcgctgcccatgtaataagttaactatttacgcttccgcttgttaaactctgaattgtatcaacttttggtgtaccttgcctcctgggacaaggattaatgcacgcacgtcaggaacgcccgttgggttatttccggtcgttacaagttggtatcagagccacccttgaccctaggacgagccgtagatcccaagccttagcaatattttcaaaaataaaaatcttttgttatttgtgaaaactgtctagtctctctctgtcttgctgcttcatttatcgccaaaatctgacctttaaaatgttgtttttctttttgtttttgtttgtagatggccggcagcgtcacccgtcgtggtttggacatgactggcttcgtcttggagctgcggggcatatgcgtggtcttggggtacccacatggagtggactaccaggccaggccgcttccggagcaggagggtgacgacgcggagccccacgctggttgggaggtcactgcagtgatcctctctggctatcccgagcggacttcgctggcagtcaccgcgggtggggattccttccccgccgcttgccagaacgacgctctcctcgccatcgtcactcttcaccagcgctacccggacgagttgcagcactcgccctaccgctaccaccctcgtcgcggaggagcccgcgactacgccaccttccgagatgctagctcggaggatgacgctaccatcgtgcacctggcgcgcatggtggaggcgtacgacgcggctcgtatcgacttccatcagatggtgcatcgcgggatggtcgagaacaacatgaagatcctggagctgcgtcaggagaacctgcagctcaagaaggacctagacgtggtggaggcgcagctgcatcagctcaagatcgcccagggagaggtctgccgccccaagcgtcgccgcgtctgccgcagccagaagatcaccgcccgcaagagcacctccaggcccgagcttgttcgtcagtccctggcgtggacttgcttcgtcgagacccctcgtgccgagcccgcgcccgtggttccccagaagggggaagcctccggcgttggtagcacggaggatgcgctgttgctcaccttccgtcctggcccgtcgcagcggtagacgagcagttagtaggcttgcgcgtgtgttctttctcgtttgtcttcttgttgagtcgtgtggggcatggttatgccggtgtgtggtataactgtgtcggagcctgtcttattttatttgcctaagcaacttgaactttaatgaacccatttaatagcagtaataaattcaagaattatagtagtcgtgggtggttagttttaattgttagctctttctctgcttgctggttctgtgtggggggttttcagatggtgacgaccaggagaaatgctgctaccggtgatggcaaccaacctgaaggcagcaaccacaaccaccagggcaacccacctccacctcctcctccacctccaccaccaccaccagataccaatgccattctcacccaaatcctcgcccagcaggccaacatgatgactgctttcctccaccacctccaaaatccaccacaacataatgctccaccaccacccccacaacactctaaactcgccgagttcctccgcatccgtccacccaccttctctagctccaacaaccccgtggatgcgttggattggttgcatgccgtggggaaaaagctagacacggtgcagtgcagcgatgaggagaaagtcatcttcgccgcccaccagctgcaggggcccgcatctctatggtgggaccatttccaggctacgcagccagaggggcaacctattacttgggcccgcttcaccgccgctttccggagaacccatgtgcccgccggagtcatggcccttaagaaaagggaattccgagagttgaagcaaggcaaccgcttcgtgatggagtatttgcatgagttcaacaatctggcccgttacgccccggaggatgtgcgggaagatgaggagaagcaagagaagttcttggcaggaatggaccccgagctgtccgtccgtctagtctctggggactatccggatttccaacgtctggtggacaagagcatccgcttggaagccaagcacaaggaactggagtcgcacaagcgccgcttggcgaatttccgcaatcaacagggtgctaaccaaagggtccgctacaccaatccctatcccgggggatcctcttcgcagcagcaacaacagcagcagcaaccccgctctgcgccccgacctcaattcgtggtgcgcgtcccacagccgcagcagcagcagaatcagcaagggactcgtgcgccccgtcctcctacgccaacggtgcagcctggtcaaggccgcagggacgctcaaggtcagcagcgtctgtgcttcaactgcttcgagcccgggcactttgtggataaatgcccgaagccaaggcgccagcaaggccaagcgcctccccgctccaacaacggtgggaaggatgtcattcggggtcgtgtgaatcacgtgacggccaaggacgtgctgacaactccagacgtcatcgttggtacgttcctcgttcattccatccctgctaccattttgttcgactctggagcttcccactcgtttatatctgtgccattcgtggggagaaatcagttgggggtagaaaggcttaggaaccctctgctcatcaccacccctggaggggttatgacagcaaagtattatagccctgccgtccctatagaaattcaggggattccttttccctcggatctgattctgctagacaccaagaatttggatgtgattcttgggatgaattggttggctcaattccaaggagtagtggattgcgcgagacgcaccgtcactctgtaccgagggccggaacaaccggttgttttctttgcacccccaacctctgtcagtagttcagaactgcattagataggactgtcagaaatccccatcgtcagggagttcggagatgtgtttccggaagaactacccggtatgccgcccaagcgagagattgagttccggatagatcttgctccaggaaccactcctctgcacaagcgaccctaccgtatggcagcaaatgaactggccgaagtaaagaaacagttggaagagttgaaagaaaaggggtacatacgtccgagtacttccccctggggtgctcctgtgatttttgtggagaagaaagacaagacgaagaggatgtgcgttgactacagagctctcaatgaagtcaccatcaaaaacaagtaccctcttccccggatcgatgatctgttcgatcagcttaaaggtgccactgtattctccaagattgatcttcgttccggatatcaccaattacgtattcgcgaagaagatattccgaagaccgcattcaccacgcgatacgggctgtatgaattcacggtgatgtcattcggtctaaccaatgcacctgccttcttcatgaacttaatgaacaaagtgttcatggaatacttggataagtttgttgtggttttcattgatgacattctgatatactcacaatcagaggaagaccatcagcaccatctccgtctggtgttgggaaagttgcgggaacatcaattgtatgccaagcttagcaagtgtgagttctggttgtccgaagttaaattcttaggacacgtgatatctgctaaaggagttgctgtggaccccgaaacagtgaccgccgtcaccgattggaagcaacccaagacagttactcaagtccgcagtttcttaggtttggcaggatactaccggagattcatcgagaacttctccaaaatcgctcgacccatgacacagttgttgaagaaagaagagaaatttgtgtggagcccgcaaggcgagaaggcgtttcaaactctcaaggaaaagctggtttcctcgccggtgttaatcttgctggatactcgcaaggatttcatagtgtattgtgacgcttcgcgccaaggattagggtgcgtgctcatgcaggacggtcacgtggtagcctatgcctcacgtcagctatggcctcatgaaggcaactaccctacccatgacttggagttagccgcggtggttcatgctctaaaaatctggcggcactatctcattgggaatcgctgtgaaatatataccgatcataagagtttgaaatacatcttcacccagtcggatctgaatcttcggcaaaggagatggttagaactcatcaaggattatgatgtgggaattcactatcatcctggtaaggccaacgtggttgccgacgctctaagtcgaaagagccattgcaacactcttggcgtccgtggcattccacccgaacttaatcaacagatggaagccctaaacctaagcatcgttagccatggattcttggctattctggaagccaagcctaccttgctcgatcaaatccgcgatgctcagaagaatgatccagatatgcatgggatcctcaagaatatgaaacagggtaaagccgctggtttcacagaagatgaacatggaaccctatggaacggaaatcgtgtatgcgttctggacgacaaggaacttaaacagctaatactttaggaagctcacgaaagtccttattccatccaccctggcagtacgaagatgtacttagacttgaaagagaaatactggtgggttagtatgaagcgggaaattgcagagttcgtggccctttgtgatgtgtgccagcgtgttaaggcagagcaccaacgaccggccggacttctccaacctctacaagtaccagaatggaaatgggatgaaattaggatggatttcatcaccggacttccaaaaacccaaggcgggtatgattctatatgggtagtcatggatcgactaaccaaggtagctcgatttattcctgtgaagaccacctatgaagggaacaaactagccgaactctacttcgctaggatcgtgagtctccatggcgttcctaagaaaattgtatctgataggggaagccagttcacctctcatttctggacgaagctccaagaagagttgggtacccgattaaatttcagcaccgcgtatcacccgcaaaccgatggacagaccgagcgtctaaatcagatcctagaagatatgctccgtgcctgtgttctagatttagggaagacctgggataagagtctccccattgccgagttctcctacaataacagctaccaagccagcatacaaatggcaccttatgaagcgttgtatggccgcaaatgccgaacaccactattgtgggaccaagtcagggaaagccaagtgttcgggactgatatcctgagagaagctgaagctaaagtcagaaccattcgggataatctaaaggtggcatagtcccggcagaaaagttatggagacaaccgacgccgtaacctagaattcgcagtggacgattttgtgtaccttcgggtcacgccattgcggggcgtacacaggtttcagacgaaagggaagctcgcacctcggttcgtgggtcctttccgtatcgttgctcgacgtggagaagtcgcttaccagttggagctgcccgcatccttgggcaacgtgcatgatgtgttccatgtgtcgcaactcaagaaatgacttcgagtgccatccgagcaggccgattcagagcaaattgaagttcacgaagacttgacctacgtggagaggccagtgaaaatcctggacaccatggagcgccggaccaggaaccgggtaatccgtttttgcaaggtccaatggagcaaccacgctaaggaagaagctacttgggaatgtgaagacgagctgaaggcagcccatcccgatctcttcgccagttcttccaaatctcggtgtcgagattccgtttaagggggtaggtttgtcacgtcccaaaacgaccctaaaatataacctttaaattatgcctagaataattaaaatccgtgtgaaagcctccaaaaattaaaatgtgcaaagtaaaagttaaacaaggcttagaggatttttgtatatttcctaaaatgtgtaaataaattttagtggaattttcagagcacaaataataattaagaagaaataaacaaaattaaaatgattttataaaaagaaaaaccttaaaattttccccctctccccctcttgggccggctcggcccat

SEQ ID NO: 65396 - DNA, 1830 bp, Oryza sativa
ataaagtttgtcttcattaaagttcacatgaaaaagttataaattatttttaaatataaagtctttagatcgtcctatttgacccagatgatattcaaatccaagtttagggaccggggtgacacaactgaataagttggaggacctaaacgagtgatctgcaagtttagagaccgggatgacacaatcaaataagtttgaggacctgaacggtcgatttgcgagtttagggaccggatgacacaacggtacaagtttagagaccggtgatgaactttactcttaatctagatttgttcagctcttcagagacatcatctggcttgctggagctgtgctgatacgcgagcttatgggagaaactgaacttctttcaaggccgggctgcggacggcagagttcgaggagagtttgcccacgccgtgctcaccaacgaccgacgttcttgactcgccgtcaattccagccattgctgtccaggtgctttattttttttaagacagctaggaaggaaacccgcgcacatgcgcgggcacttatttaatgggtttgaaattttcttatgaatgttttatgggtaacctttttattgaaatgttttctactctattctaaacatgttttttttgtcaatgaattatttttcctaattatccttgcggcatataaattataaactaaaattacatggaactttttggtttttaatttatgagaaaatattgtgtcgtaataacctactcccttgagttttaaaattattgacgtcttaggctttgacattaaagttgccagttcttgacgttctaaacttagcctacttataagccattaaagagcatgtgctgcatgcatgttttctcattgctacagcacagctgctttgccttcctctattcgtgcttgcctgcttgcattctcgtgtgtttttctttttttttttgaatatttggcataccttgatatttttagtttctaaactaacatttttttctttgtatattatatatgtccttatggattttaggatatattaattgaagatttttctattcaaaatatggctagtaagactacttaggccccctttgaattggaggaaaaacaaaggaattgaaatcctacactattcatgcctttgattcgtaggaatgagaaaaagaaaaacgtaggaaactttcctattcctacaattctagagcaaaaacgtaggaaatttaacatccactctaacctcttggaaaactttcccagagtctatctctctcatctaattcctgcatttttcctgtggtctaatcaaacggtcattcctatatttttcctgtgttttgcaatcctctgtttttacacttgcattcctaccaaaatcctgtgtttttcctattcctccgttttttcaatcctacgattcaaaggggcccttaatgtcactaaagatagacttatatttatttcgattccctcctgcgcaacaaattcgagaatccaaatttttgtctcaagatgttaagggttgagtaccacatgtcacatctacaaacatatattgtttattacccaatcttattccaaccaccttacccaatcttattacggatatcatagtacttttccttcctccttagttgctcctaaaatcctagtatcccttatattatatgatatagatggtaattaccaagagcattatttataggcattgacatagccatttatgttggcaataatagacacttctttactaagtctactctcatcactccaaagtgatttccatggatcccaccatgcctgttaaaaagaagtcaaatgacaggtggcgtagtg

SEQ ID NO: 65397 - DNA, 11511 bp, Oryza sativa
gtcgccgccgagctccggtccgccgctgtcgtcgccccggaccgcctcccacctcagcgccgcctccttcgacttcgccgtatcctcgccgacctcgtccacctctccgtttcggtcgccgaccgccagagcgccgtcgtccccgtcgacccgagccgcgccaccgcctccctccgctccggccgcctcccccgtcgccgccgtcgccccggggtgagccgtggaccgtcgcctcctttcccccttcccttccctctctcggccgccgctccgccgcgccggtggtcgccggcggcgaccatcggggcgtgggcgcgccgcctcccgccgaccgcgccagcatggccgccctcgggcatgccaagtggctgccgcgtggggcccggccgtcagccacccgcgccctcgggtgcgactgacatgtggggcccacggcgccggccggtgtgagcccgggtgcacctggtccaccgtggaccgtgaggctgccgcgtgggacccactcccgtggacccggtccgcgcgcccctccccctcggctgacgcaataaaccctttttaaattaaaatttaaatgaagaaattcgcaaatattcatttaaagagcatataaacttcaaatggccataacttggccatttgaactcagaattggaccgttcaagtctctaatttttccttaagaagtcaagtcatatcatccttgaacatattgaatcccactttataaaattattttgatttaaattattgcattatcgctttatttaaattcccgcgttatcactgttttattcagccatgcctatttacctttgttatgaccttattattattgctattgttattattattactttgttcaccctagaataacaaaaccccaactagtggatactctattcatggtaccactagtatgaatttaggtagatgcttcgctggattaaataggcaacattaggtggttttacaactttagactttgggaataatcatatcacctggacactatggaatggttggattattgtggaattggattcacacctccccctctattcaaaaccctcaaaatggttttaggctgggctcggggtgcatggttttgatggtagcacctcggccatataaggaccggtcttcgggcctctgttgcaaagcactaccgtacttccacatgtctagtgggtaaggcttagtttgtggctcagtctggttataaacaaaagtacacggatggagatggacgaagtcgggggtcgatggacatctctagggcaaatgaaggctacacgagctgcggcccggtagtcgagatgttatggcacagggccggtgtcctgctgctaggggctcagtcctgcctacctgtcccagaggtcctggccgtaggtggggttgggtcggtactcttgtctatggctaggatgggttggaaactatgtcacgtcttccgtccgtataccgtggtggtatgtggcacgtggttacacgtgaggaagatgtgtcttgtgggtaaagatgtacacctctgatcagagtataacctattcgaatagccgcgccctcggttatgggcaagccgagcaatgtacccaagttagtgttttaatccttaaaacctgcttaacaattaaaatgtggaatggttggcctgggttggcttgggacgagctgggacccagggtcgggttgccagtttggtctgaatcatcgtaggccttgggttaaggcaggttcgtgtgggttcacggccttgattaataatcttgtatagctctaggatcatatttacaatatagctttgagcaactaagtgtcttttagtgctgtttactacaaaccctaaccccttatatgataacccccttgtactcccttacatttattctgcacttgtgggtgtgtcttgttgagtacggtggttgtactcagtcttgctcaatttttcccaaacccagaagaggagtttctggaagatgaaggctttggtgtctagctcgtgcctgccgtcaagcgcctgtggtcgtcgccctagtctttcgctgtttcccgtttgtctttgtgtgctgggccttcgccgcccatgtaataaattaattatttacgcttccgcttgttaaactctgaattgtatcaacttttagtgtaccttgcctcctgggaaaaggaataatgcacccacgtaaggaacgcccgttgggttatttccggtcgtgacaggcggtgacgaagcgagccggccgcgtggcggccgtgcggcagacggtggcgatggccatgcggcagcggcggagcgaggccgccgcgcggtcaggcagcggcggcggagcgaggccgcctgtcgggcggcggacgggcggcggcggccggtggggccgcacccgatggcggctggcaggtggccggcggccggcggcaacggcatcccatttgcacatttgtgtggataattttgtgattcattgcacgtttgtatggatctgtgatgtatttgatatgtttgtaatttttgtaggatttgtgatatatttgaattgtatgtataagtaactttaagatttgggatgttactttgatttggggatttgggtttgatttgggatatatcccactcaattcgggagaaaataaaaaagaaaaaaaaagaaaaggggaccatcttactgccgcttccctcaccaaccgggactaaagttccctttctttagtcccggttgataacaccaaccggacgtgaacgaaaaagaaagagattagatagatagattacgcggttgaaccaggactaaagatagcgatttttagtcccggattggtagttccggttttaaaaccgggactaaggggggttacaaaccgggactaaaaagcacttctccaccagtgtactacacatgttgtgaaccatgataatctcaggtctaaggattcaacagcaacactaaatgagatcactgatgacacaatacatatggctcttgcagtgtctcatgttgggtctatccaacaacatgttcaccaacatgtgtccatattattaatttggtatctctataccatgatccatgagacatgatcatcaattaatatatatgctgatcatataaacatatttgttccacatatgatatttgatcagaatcctttagaaatagtaacaaacaacataaagagtcccatgaaagaatcacatatagattaaccaataatgagttatctatttccaggaataatgtcggataaatatgtaaacatagtatgtgatacaatcatctttatgattgcctctaggacatatcactaacataaacccgtagcaagcagcgagcggcagcctccacgcgctactccgcgagcgctgcgaagctccggccgacgcggcagtccgcctcagtgccgagccgcggctccgccgcctcctccggcaatgcgtggagcgtcgcgaggctccatcacctccgaggccacgcgcgactccgccggtcgcgtgcggctccgagtctccgacaccctccactggctgcccgcgaccccgccgagtcgacgtcgcgaccgcgtgcggtccgtcgcctccgcggccacgcgcagctccgcacctgacgcacggctcggactcctccgccggctaacgtatagcgatgccgcgtgcgcatccgccgcctccaccggccacgagcggctcgagccgcggccactttgcgcttccgccggccgtatgcggcttcgtcgcgtcagcggccccgcgcggccggcttcgccgcctccgccggccgcgtgcgccgccggtcgcgcgtggcttcgccgcctccggtcaccggcgccggcctccgttggctccgccacgccggccttcgcaccgtaggcaatgccgcacccgccttggccaaggccgcctccgcaggagggccgtgtgcggttgcctggtctcatgacggccattgctgcgccacacatcagctgcacgaagtgggctcactcgtgcgcactcggcgccagcaggccctgagcaaagggaaataggcggcaggtatgcatgcaaatgcatggttgcatgcatggtcctgttcacgtatagattagaaaagaaaacaaacaaaaaaaagaaaggagaaaaggagggcgtacatatgggtccgcggcatgaccaccctcgtgggacgtagattctaatcactcgagtggatgtccactcatttagtgtatgttaactaaatgatcatgaatttttttttaaaaaaattacaagatagattaatatataatatatcactacataaacatgtaacttaaaattcaacttttataagttgtaaaaaaagtaacaaatcaaacttttgatttgttatttttgttacaacttgtagaagttgaatttaaatttgcatgtttgtggggtgatatattgtatatgaatctatcttgtcaaattttttaaattttttttatacccatttagttgacaagcaacaaataggtggatgtccacctaggtgattaaaagtgtttccccaccctcgtgcgatccacgccgcagcatgtagccgcatgcggcttcgcagctccgcctccgaggccccatgcgcctcgccaccaccgcggacaggcgaggatccgccggccacgtgcagccgcgagtggttccgcctgccgtatgcggcttcgtcaccacctctgcggcgaccgcggtttgccgcccccgcacggccccgcttgcttccgccgatcgcgccagccggctccttccgctcggtgtgcgtgcggccccgccgcctccacagcctggcgcgcagctgcgcccttctcgaatggtcgcgcatgcgaatgcatggcactgttcacgtgattctctctctctctctccatatatatatatatatatatatatatatatatatatatatatatatatatatatatatatatatatatatatatatatatatatagtaaattataaagagtgctccactcgcagcaaggtccagggcggcgctgccacggccccgtgcggttccgccgagctccgccggacaagcacggccttgtacggccccgccgcggggccgcgtcatgtgagacctcccccctgcggcctcgccgacgcggcggttgggccgaaggccacgcatcccgagccttccggcagacctgagcatgggcacacgccatgcacggcctggtgatggcgctgtcccagccactctgcgcagggctcggcacagcgaccgccgacacggccaagggtcagcactaaagttgcatttatctccctagtggattttggtgattaatgataaataaggttaagggactaatgtgtttattgagatattcaggtaattagtccctcccaaggtgaacttaggacatcaaaagatgcttggagacccctacaacattcattcaaagcggatttgaagctccaaggtcaataggatagtttaatttttgaaatcgagttttaggaaaaaccgtactattaagaggggttccaagtgttgttctgagatataaaaagtgctcttagtgggttccttgtggtagaatatttttgggagccatttttgcaaatgggtccagaccggatagagaaggctggccggaagttccggtccctggacccggaacttccgaaccttgcgacatgtgaaattttcctaagtgttgtctggaagttccgaatgtcaggaacttccggacctcttccagttcaaaaatgtgagtaacggctagatgtcgtcacctagccgttatatatatccagatcgcaccttttggccattttcacttcagttctttcatgccctaggttgttctagactctcccaagatccctttgcttcctccactcaaatctagagccattcttgtgagattgagagaatagatgagagtgtaggagtgatttggagaaggtttgaagactaggtgtgtttgagcacttggatatcttgtgggctgttacttgggcttattactcttggagatcttctcctaaacggttaggtgccacctgagagcttccaaagatcatgtggatgtctcgagaaagtttgtgaaggttttccttacctccgcaaggaaacgaggtaagtgagtaaagattcttgtgctgagatttcagaggttctcctaggtagagcaacttgcacttgtggtcttttctagaaggatttgtgagttagatcttggtggtcactcaaattctagaaaatgacctagaaatgttgagttgaaggcctcggacttcttcgaggttctttgcacgggtgaggcaagaggttaatcgagacccagctctttggagcacctcaacggagagtaggattgcaagattcgaacttcgggaaaaaatcgcctttgtcttctctgtgatgattctatgcatgttgctgtgattgtgtatttgctctttcttcctgtagtttaattcgtgcaaattagtttaagtctctgctagatcttcaattttttctgttgcccggaagttccggtggttagaacaccggaagttccggacagtctgagcagatcggaagttccggtgttccacacccggaggttccgaacctgctgaattttaccgctgtgatttgtttgtgaatttcaggaaaacctatttaccccccccccctctaggctacatctttgcgcgttcaagcaccacctacgcgctcaagatcggctcgcaccaccgctgttgccctgcctcgggcaatagtaggtacaatatcatgcaattacatttcaaatcacatgtgagacctccacgtccaagagactgatgaagcaatctccgcggcggagtcagtgttgagaccgtcctagctccggccggatggagtagttcaccatgactcttgaaaacaaaaggaaaaaaaggtcatgatgagattcacgtggcctctggtccgcgaaccaatttccttggccaagtcatgtgagacctccgcgtccaagagacctgtgaagcaatctccgtgccggagtcagcgttgagaccatcttggctccagccggacggagtagttctccacgactcttcaaaacaaaaagaaaaaaaggttatgatgagattcacgcagcctttgccccgcgaagcaatttccttggctaagtcatgcgagacctccgcgtccaagagaccagtgaagcaatctccgtggcagagttagcgtcgagaccgtctaggctctggccggacggagtagttctccgcaactcttcaaagcaaaaggaaaaaaggtcatgatgagattcacgcagcctttgcccgcgaagcaatttccttggccaagtcatgcgagacctccgcgtccaagagaccggtgaagcaatctccatggcggagttagtgttgagaccatcctggctccggccggacggagtagttctctgcgactcttcaaaacaaaaaggaaaaatgtcatgatgagattcatacggtctccggtctgcgaagcaattttcttggccaagtaatgtgagacctccgcgtccaagagacccagtgaagtaccctccgtggcgaagtcagcgtcgagaccgtcctggttccggccggacggagtagttctccgcgactttaaaaaagataggttagcaattgagatatatatatatatatatatatatatatatatatatatatatattgcagtcttaagctgtgtaggtttgcaattctaagcctcggctaaggctccgcaagttgctccaaattccgagcctctctacggtaggctctgcgttcggagcccgtggtaggctgaattcggagccactcaaaaaaaaaaaaaactacgtacgctcatgcacatcaacccgtgcgttcaacttcggctggcctccggcgcggggcatgcctccacatcgagctccggcttcgaccttgtgaccccgctgatgcgcgataggccgtggctccttgccggctccacccaacggcgccgggagctagcgccgcgccgcgcttcggcctcgcgtggtgggccttgaggcgccgacaatgctccgcgtggactcggcctcgtcgcgccgccgctgttccatgcttcggccatggcgaaacagcgtcaggccccacgacgccgcttccgtgtcgtgcttagactgcttcgcggaggcttcgtccttgtgcgccgccgctgaacaacggcgcggctactagcgccctcaggccgtcagaagcacaagaaaaagaagaaagaaacagagaggtggtgcgcggcacagcatgcatcgcacatgcgtgtgcagccatcacgatcgtgtgctgtcctgcagtgctagctagaatagctaatacgtactgccagcatggtcaggatggaacccacaaccacgtcaaacttgacgaccacgcgccatgcaacgcgcgcgccggggtactccgcctcctgctctgccagcacactcgggaaccgccgcctccgctagccccgcgtggctcggaacgctccggagctgccgctagcgcgccaagcttcggccgctggtcaccgcgcccggcgcggcaagggaactccgtgcatctgtcgccgcctcggccagccggcatcgtcgcctccacgagcgccgcggggctccggccgtcgcggctccgtcgcccacgagcgcctccgctgagtcgacgtcgcaaccgcgcaaggctccgtcgcctccgcggccacgggcggctctgtcgcttccgccgttcgcgtagggctccgccgactctgtcgcctccaccggttgcgcggggctccgccgcccgcacatagctcggcgcggccccgccggcgcacgcgcctccaccgctcgttcgtggctccgcacggtcccacgccggcgcacgcggctccgtcgcttccgccggtcgcgcagggctccgccacctccatggccccgcgcggctgcgtcgcctccgccgccagtgctcccgcacctatctccgacgcacgcacctacgcgtagccccccgcgaagccatcctttgtgaggcggcggcaggcaacatgcagttgcatggtactgttcacgtagaagtaaaaagaaagtcgggactgcctatacatcatggcaccatggtatctaggtgtatgcatgcaatttaaatagttgtataaaaattttataaaatttggtaagatagatcatgataatataaaacactatacaaacatgcaagtctaaattcgattgatatatgaagaaacaaaaataataaattttatttgcactttacgagtactattcactgtctgattttattatttttgtttctctaatggtagatcaaatttagtcctgcatatttgtgtatagacttgtatcatcacaaaggatgttactacattttttcaatttttttataactatttgagtcacatacaaataatgagtgccatggcacctaggtgtagaaaaaccttgtctgatatattataggacaagtgacagattttttagcctcatatcatgcaaaggaatagaaaaagaagcctccacgttcgctctcatggcctagaaattctcacattaatcggagaaaaagaaaaagaagagtccatatagaaatacaatttagaaattgttgaaattcggaattgaaaaataaggaatattagaagaggagactagagtccatatagaaatacaattaggaaataactgaatttcagaattaaaaataaggaatattagaagtagagtatatagttcatatagaaatacaattaggaaataatagaaattcggatttaaaagtaagaaatattagaagtagagtatagagtccatatagaaatacaattaagaaaaaatagaaattcggaattaaaaaataaggaatattagaagttgttaacaaccaaatttggtaacattagcagcggagagaagattagatcgaagcaaagtcggaagcggagatcgagtttgaaaacagggtaggaatcggctgaagtccagatcggctacgacaagatcggctgagtctgagtcgagctaaataagccgatatagccgattccgacaatacgacttgtgcgcgacatcgggttcaagttaatgtacttcaagatgattgccacacatggatagagtcctggaaaggcaattgtatctattaattagaatattttatgtgaattccttatagataagtgtgggcaaaagtctgccgcaaagacttgtggtatcttagagtttgttagagataatggttgtgtccggtatgggcatatcttgtaatcctcgggtataaatagaccccgagccctatgtaattttgaacacacacattcaacataatttcggcgcatcgccaccctttttgctttagttttgtttcgacgagttcttgctttcgggttgagctgcatcgatttcgatcttcaacaagaggtaaaattcgtcgtgatggattgcgttcttaggattagtgcttccatcttcatgacactctaatcttgtttatttaattcatcaaattatcatatatcttacataatctctagcaatatcgccatctagactactatccgccaatatctgtatgcagaagacagccgattaggttagatcttgacgttgatctagattatataagatatctatcattctatgaaatttctagtggcttgattgtctagatattgttcttctttttatacttaatgttgcatcagttgagtttgatctgttaagtcgtgcttagaatatcgatctctagcctgccttctagttgccgattagaatagtatcggagtttcagccgatcgtatctgatttaacttcatttgttctatatgccttattgatatgttaaatctgccctttatgttaagatattgccgtatctaagtatgttaggcttttgctcaatatattatacttgctttaatatcttgatatagagtagtatcggagtattagccgatacatgctagatctatctgatcggctatgctataaacatatatagtcttgttattgacatatatttcgatctaagtgatttatactgtctcggcatgatgaccgatctatcccaatcacttgatttaagtagacatcgatataaggagtatatattgttaatatctacagccgatcgagtagatttagtccttttttacttattcatgactgccgatcgacgcacagatgacatcggctcaaagataaatgatatgtcatcggcatctagccgatcggctatcgtttataaatttaactacggtttctttgtttctatttcttgttgattacaggatcaaatcaactggcacactaatacatccgaaggcgaattttggacctgcactggagttaagcagatctcccaagccacgtgttttctgtcaacacgcttttggcacacccggtgggacctgattagaagtcagacgtcagtccctcctcatggccgagaaacagccaccgccaccatcaagcccaggttccgttaaaggcaaggcgccgaagccaggattgaccgacatcattgatgacaacgtcatg

SEQ ID NO: 65398 - DNA, 1739 bp, Oryza sativa
agcatataaacttcaaatggctataacttggccatttgaactcagaattggaccgttcaagtctctaatttttccttaagaagtcaagaacccatttttgtgctttgttaatgctttttatatggagtttgttagagtaaaagccttttcttttccgttggtcgtgtagacgctgcagcttcggaggatccgctcttcgtggaagttgaagccggcgtttgggaaagcgagcaaggcaagacacatcatccttgaacatattgaatcccaatttctgaaattattttgatttaaattattgcattatcgctttatttaaattcccgcgttatcactgttttatttagccatgcctattacctttgttacgaccttattatttttattgctattattaccttgttcaccctagaataaacaaaacccccaactagtggacactctatttgtggtatcactagtatgattttaggtagatgcttcgctgattaattaggtaacattaggtggttttaaaaccctagactgtggtaatattcatatcacctggacactggaattgttggattattgtggaattggattcaccccgccccctctattcaaaactctcaaaatggttttaggctgggctcggggtgcatggttttgatagtcgcacctcggccatataaggaccggtcttcgggcctctgttgcaaagcaccaccgtacttccacatgtctaatgggtaaggcttagtttgtggctcagtctggttataaacaaaagtacacggatggagatggacgaagtcgggggattcgatggacatctctaggacaaatgaaggctacacgagctgcggcccggtagtcgagatgtcatggcacagggttggtgccctgctgctaggggctcagtcctgcctacctgtcccgggggttccggccgtaggtgggattgggtcggtactcttgtctatggctaggatgggttgggaactatgtcacgtcttccgtctgtataccgtggtggtatgtggcacgtggttacacgtgaggaagatgtgtcttgtgggtaaagatgtacacctctgatcagagtataacctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcgtaggccttgggttaaggcaggttcgtgtgggttcacggccttgattaataatattttatagctctaggatcgtgtttacaacatagctttgagcaactaagtgtcttttaatgctatttactgcaactcctaacccctatattataattccattgtactcctttgcaattatgctgcacttgtgggtgtgtcttgttgagtacggtggttgtactcagtcttgctcaatttttcccaaacccagaagaggagcccctggaagatgaaggctttggtgtctagctcgtgcctgccgtcaagtgcctgtggtcgtcgccctagtcttccgctgttcttcgttgtctttgagtgtgctgggccgtcgctgcccatgtaataattaactatttacgcttccgcttgttaaactctgaattgtatcaacttttggtgtaccttgcctcctgggacaaggaataatacacgcacgtaaggaacg

SEQ ID NO: 65399 - DNA, 2076 bp, Oryza sativa
acatcacgagttggagaggtacgctgaattccacgctctttgcaggcacgaatttcagcatggacgttgagaaagacccagcaggcttgcagggtgtgtttcctggttttgtggataggacaccaggaccttgtcacctcggaagtaatcctcgtcggctcgtgattcctgtcggaaagacaaggcttggccgcactaggatccttctcgggctcggatgttgtcgacgttcctatctccgcttcggcgggaggatccttcgacatggagtcgccctgggttgtagccactgcattctcgtttccggccattggcggaccagctgagatcggcactgtggtgtaaaccggaaagacgatttcgccgacctgagtccacaccagtgttgttgaagtaggaactccttggttgaggttggtgttgacactgttgtcgacaaagctggatgtcatagtagtagaaccttgagcaccaagtccacctacctggcacgccactgtcgacggggaatacccgtagaccggatatagagggtattggggtacgctggtacgaggatctacgtagtacgacatcaagcaaacaggaaacagagattatactggttcaggccccttggtaggtaagagccctaatccagttgatatgggattatatgatggaaaccacagattacaaagggaacagtggaactcgacgataccgacaagatcgtagtcgagttgatccgactagatctcccagcgacttggctccgataagcttcggcttcgtaggctgtggtggagttggctctgagattcgatgctttaggtcctcccgggggtcccttttatatcgcaggtcacctgtctcccagttggactcggagaaaccggaccgaacacgacacaatgacgacccagttctgaccgagtaggactccttccatctgtgaaatccatgatgaatttccttaacgtatgccgaaaacatccgtatatgcgtgaacataccatatcgatatgtgacgtatatcgaagggtagagggtataccttactcgtaaccctgacagtagccccccgacttctgcttaaatgaactggtgaaactgatcgcgacttcacatgtcgaaattgtcgttgttctcggtgtgaggacggagagacaaggagtgatcgacaacatcgagtgaagttcaacggtcatgagtgaatttaaattgaagtccgaaaaactgccacgcgtaacggacccagaaattcgcaccggcggaggtgcgtctatttaagggagttttggggatccaatttgaggtctgcccgttgaaaaaactctccagcttccaagcgtccctcgtcttcttcgctcccgcaaaaaccctagccaactcatctcggtcctttctccggcgatctccggtggccatggatcttgacaagtctacctccaccagtgtgtcactgaagaaactgcaggaggatggcgcccttcccagtcgcgggaccgcggagagggaagtaggaggtactgaaccccagcctgtcctgggtcgcatggttgcggttgaggactttattctctgcggttttcttcctccgccttctgaatttctccttttggtcttaaatttctatggtctttccttgctccatttgaaccccaactccatcgccttcctgagtatttttcacctttgtgaggcctacattggggtagagccgtttcttgacctcttccgcttttactatgagttacgctggatggaatccaaaaaggtgtccgggtgtgttggtttccgacttcgggatggcctgaagtcacgatacatcccctttcagtgcccctcatctcgcagcaaatggcgggggaggtggttctatcttcaggtagaggattcggatcctgccttcgttgttcctgaggagcagccagacaaggttccatcttggaccaccaaacctgccttgaccccgtccctccaatctttcatcgatatcgttgacgacctccgagaacgggggttgtcggggtatgaagttgctgccgatttcattggtaggcggatccagccgcttcaggctcgagcccttcc

SEQ ID NO: 65400 - DNA, 2993 bp, Oryza sativa
atcaaacggtcattcctatatttttcctgtgttttgcaatcctctgtttttacacttgcattcctaccaaaatcctgtgtttttcctattcctccgttttttcaatcctacgattcaaaggggcccttaatgtcactaaagatagacttatatttatttcgattccctcctgcgcaacaaattcgagaatccaaatttttgtctcaagatgttaagggttgagtaccacatgtcacatctacaaacatatattgtttattacccaatcttattccaaccaccttacccaatcttattacggatatcatagtacttttccttcctccttagttgctcctaaaatcctagtatcccttatattatatgatatagatggtaattaccaagagcattatttataggcattgacatagccatttatgttggcaataatagacacttctttactaagtctactctcatcactccaaagtgatttccatggatcccaccatgcctgtttaaaagaagtcaaaatgacaggtggcgttagtgatcggaggtccctggagctgagatatatagatgatgcgagagagagagagaggatgatcgatcctatatgtctgatgcggtgtgattgtcacaataaaggtggacgatagacctcaaatttaggagtggtgggagttgatattggggcatactatagcaaaggagttgactacgtcagctcttcaattgtgccttttgaactttggatgtcatgtgctataataaattaaaattaaggatataaatatgtattttataaaattatagatttggataacacccatttgagaagaaaagagaggggaagaaacacatgatggtggaggcttgagggatagggcaatgactatactttggctttttaatggcccacaaacttaattatggttttagttgttagagagggaaaaaaaaaaggaaagatgtgtgtgtcgtggaagggcgcaagctgcatggaggagggtggggaggacagaaatcttcacttgttgaaataattggtccgccaatttgatttaatattaagggttagatgttgtttttcttcagaattttcagaatttgtacaatcttttctaatctttacagctcgatggcattacagggcgttcttgtttttatgaaagtccttttccagcaatgttgattaataattaaactaacaataaatgtggttagtgtcatgtatgtgatatccttatgttcatatttgaaaacaatccagcttatgttaatttggtactcaatacaggtctttaattgttcattcaattaatagaaatacagtggttgaaaccaattataaattgcatgtacaattaaaagttgtggtaaaagaatcaaatcatcaataccacataaaatcctcgtatgcatgccattaaatctttaatatcttaaaattaaatatttttaaagtcattaatagttaaatttataaaagtttgaccacaacattgttcaaaacgtcaagaattatggaaccgaaggtagtaaactttattgttgaacattgtaaagcaaattttgatagagtcatatgatatatatatatatatatatatatatatatatagtaaatttgtttggtgctccatggtgcccgggcaccattgttgaaattgagtatatacctaattcaaatgagtatgaaactttttcaattacttagatattaacattagctactttactaactagttcaaagcaagtttgaactgaatttgaacttgtttttgttagattttgattctaggtatatagcatccatacatataattagttaggtatgtaatcatggattgtgaaataaagttaaatttgagttgttttgttgttaggtataggtatgaatcgagttattataactaggtatatactcacaatttgaaaattttgaaaaatttgagtgattttgtgtatttgatatcatggtgcccgggcaccatggtgccccatatgagtaagaattagtataattatttaaaatttattatcactaatattaattgttatctcacctgtactcatggagaaaagaatgaaaaagagggaagaaaaagtatttatggttttcatggttttctcggctttatcctcatttaatttccaatcgtactttacgtttgtaaaagtagagtagtctgcatagatatgcatcggatccatattaaaaggaatgattctttttttttttgcgagtagtacgtacatacataccttgatcaccatccatatgcatcggatccatattagtaggaaatattttaatagatttaatctaatggtctaaaatatcgggtccaccaatttaagtgaaaatatgttttgcttttttcttagaatttatttgatttctctaatttattagagcgccaagtggcggcttaggagcgtttataggaagtttaatggacttttagtatataatagatagatagatagaagatagatagatagatagatagatagatagatagaagatagatagatagaagatagatatatcattctgttcatgtgaaattttggaattatcttgcgtagtagtaatcctgttgcttaaaatacagttcttgtatgagctttcaagtcttagtttgctatgccatgatgcttttatttgatctaataaagttgagaggttccactggattttctaggcaagtatttttgttctttttttttataatgttccataatactcttttatatgctctatatatgcaaatactgtaagttttttcatgctttacttatgttttttttttcaaccaggatgctttactcatgtataagataatcccttatatgctactgaaaattggtctgatcccttatatgccactgaaaattggctcttcccttatatgccattggttcaaatttatgcaccatctcatgccactaccgtcagttgaccgtgtgttgaccgttaactctcaagtaaaaaagacatt

SEQ ID NO: 65401 - DNA, 2965 bp, Oryza sativa
atacagtggcatatcgtccgttttctcgtttggtagagcttcaacttttaaatttaactttaggagttagatctgaagtggagttgtggaacagcttaacctagctccacctctctagttcattttgttagagtgctccacccagctccgccccattttcggtggagctgaaactgtttggctgagctccagctctaggagaggtggagctggaactggagatgtgccaaacaaggccaggtaatagtaatacgatgtgcaaatgcaagaactgaactctgcctgaactctgcacaaatgcaatgatttccataccaatcaaatgattcaaaagttgagtgcattgcccccttgcaacaaaatttataccacaaaaaactagagctctgacaattaacaattaacagaggttcattacatcacgtttcatgtaaaatgttgatgaaaatctcccaatagtagaacactactaaaaggaaccaggctaacggactgaagcttgctctcacatacagagcaacaatttattccaataactttcataatttcattcagtccacatatgagtcttcagttggtttcttgtatgattacaggtcagtcatgtggctgccatcgctgtcgcctgcaggggcgtctgatgcagatgtaccggtgcatcatcttcagatatcaggccatcttttaccggcatgggagtgttgtcgcatttctcgttggaccgaggaactgtcaaagctgcattgtcaagaaaataaaccaagacaaaccagtataaggttctgaatatgcaaacttctacgtatcaaattgtcttgactctttctcattccacaaaaaataaaaatcttagtccaacttggctaaatgtcaccattaagaaaatgtaaccacatatgtaccactatccaaattattttagaacactcaaagaattccaagtagttgtaatgttagggtcggaatcgtctccacgaagaaacgcaactacgcggatgtggcaaccgggccacgcagcgtcgaaggagatcacgcgagctgaaaactgacgtggcatgccggaatagggataatgatccgattgcttacatttagagaagagtttgttatccctttttattagctaattcaattcaattgtaagcctacttaagggccacgaaatcatgaataaaccaagcaagattcaatctatagtcccatctccaattctctactctctcatcccctgcttttgctttcgtcgccaatcatgggccggacgtcgaagaggctgccaaagcctcgacctccggtatttaattcatatcccattcggtcattagccggtgctcataacacgtattaagatagaaagagaatatcaaaattacccacaaggaaattatatgagcatatttgtcagctatatactatcctttttaacactgctggatgacaggtacttcctccgtttcacaatgtaagtcattctagcattttctatattcatattgatgtgaacctcatcttaataaatctagatagatatatatgtcttgatttattaatatcaatatgaatgtgggaaatgctagaatgacttacattgaaacggagggagtatatcgcaaagagagcggatataaaaaaacatcaaattcctttaaacaagagggcgcatgatctatttccttataatggtatattcaaataaagaagtgaacctcatcttgagatgattaaatcgggagaaaattatttgaagtaccatacctgccgcctcttcattaggcactggatgctcacttgttgaggtgtcccaagaggaggatgcaaatggcgctgagcttgatgcaaaggaagaaagatgagatgaaggcgatgagagctggtttcctggaatctgttgtaccatacctctagttgcacttgactacatcaagaaacaaggacatggacaattagttagtatgatattacaaaattttcgtgaaaacataaatctaggcaataaggagaatcccatttaaatttataacttgctggcctctagggagttttttaatagaaggaacactctagtattttctctatgaagtgttaagaactactgaaaaaagtatgattcatgttctggtacccaattagatcacctcattagaaaagggatcttcaattcgagcacaactatacaacaaagtttccgttcgtcatcattttcagttggtagtgagaaactggttcaaattggcatacaactttctcaatcaccagtaactcaaatctatcaaagataaattaagtattgacataaggaaatttcaaaggaaacactaagcaaattgtttttatttctttaataaaatgtaagtttacctcagtgacaacttcaggctcctcaattctatcctcatttaggtgtgagatggaggccaaatctttacttggattattccttaaaagttcaatctcagcaggttcctcataagtgatctctgaaatttcactgtttcttgatctgacctgctcagctttctccgaccgttggcaggactgggaacttctggtacttagagaaaaggattgtactatacaatcctgacacccagaaacatcaagctgaagatttttaaggttttgaagtgattcaggtagtgctttaagtccaagacattgtgacaaattcagagactctaaattattaagcttgtcaaagcacgatggcaaatattcaagcctagagcagttcgagagattcaaaaaccgaagagaggtaaggcattcaaagattccagcagtttaagatcagaacaatatgaaaggtttaggcttttcagatatgcaagttggccaaatgattgtggtaatacctcaagtttcaaacattttgacagatttaaatactgaagtgaatacatgtcgccaaaaagtcgggcaacatttggaattcaaaaccacttaagttaagatctaccaaagaaca

SEQ ID NO: 65402 - DNA, 620 bp, Oryza sativa
catcgcatgtcggagcttgagaacaacttgtcggaaatccatggctcattgcgggtcacctatactggtctgcaccagctcgccggggagtgcggtatcaagtccaccatcccggcgaatcccgatgagttctcgctgacgtcttctcttgcggagctggtgacggtgatggaggagatcccctccaagcatgcggccaggatcggagaggagacgtctaatgggatctacaccggggtgtgccacgtccttgcatgtgtgaggctggcgcaccctgaactcgatctgtggaagatcttggatcagggggcggttagcgacgcgcgcaaggatgtgatggaggaggtcggcgatctgggggagtccgtcctctcgctttttgaagagtagggtcttagctctcttgtactctttagtcatgctttgtaaaacttttattggtctcaaccgccctagtgtgtgcggtcattgccttagctttatttagcattttgatcttgagtactttgttgtcctttgttaccatttcctttgcccttccgtctggatcgacttgatttgttgtgttctcgggagagaagagcagcttgacttagtcgtttccatgctgagcagatctc

SEQ ID NO: 65403 - DNA, 2044 bp, Oryza sativa
acaaacactgtacaacaaacattgcataatctttatgatcttctgcttaggtagtgtatcagatactgaaatatgcttacgcatattctttgttctgctaatgcattataataatactttttatataaaacaatatgttttctcaataaagttatattcatgtgtatgtggccaggtgctattttatacgcttagtgcatgacattgtagcataatggtggcatgtgcatcatcttcaaacggcgcagcgtagtgcgcatttctttctagtatctttggaatggcaagacaaacctatacccttttaggtgctaagctatacataattacttttatgttacttcaaagatgcaattcacaatattttaggttttgaaaattggacatactagagtgcttaggatgcaataacatacaaaaccttcgttagccgcatatgatatataatataattatgttttcagatgggccaaatgacatgcatctgtagctcatctcctgatgaaggtggtcatcccagagcttcagtattgtgcgagctattctgagatacactgccactggagtcgctcaaatgtaagtaattattttaaacagttatgttctacttgtttggttatttgtttaaacaagtactaactgcccattcactttatatttggggctcccatgtaatattatcccacctaccatggcaagaggctgtctcaaatatagcaatgctcacgcttcggccactctttgttttgtggtgggaagataagaccaaggatatgttcttctgtattggcctggggatcaaccaactgatgttctagctattgctagctcaccatgtctaataggcaaacactaaatgattcgtatcgccgattcataatattgagcttctaaaaattatccctacaaaggattgtgcatattcagtcaatggtgcttgccatttctgaaacctgcaggctactttcactaaatggcacaaaatgcccctttgtgttatttgctatagctgcaactgttgtgatcggagatgttttgcgatatagttactacatgtattgattcttccatgctatatatcccagcatggcacatcactctgtaaggatataatgcacctccaacagactgtatgtaatctaagcatgagaacatgcttacttactgagtgcctgaatctaacaggaggtgtacatccttaaatcatagcagtacgtctataagagcctaaatttaaacataaaaccaatcaagctcattacagcttgaaatgagctacttgttctgttgtcccacacaggctaaattgccagctaaatataacactttcagtaagctccaataacatgcgtcttaggctcttttagacacgtctattacacccgcgcggcgtagcgcgcgagacctttctagtgtagtcaaagtgtccaggcatttcaagtttgccatcattcgagttacaagcttctaattatgtacctaatacatttgatattaccttttcaaatcaaatgaacgaagggaaacactcaatcaataaaaactatttggaattaaattttttcttaaaccgtatttgttttgtatgcacagctgaccgcagcgttacgccgcacatccccttctagttggtattaatctagtagtaaatccaatcaccggtccctaaacttgtatacttgtactgttgtgttatctcggtccctaaactcgcaaatcgaccgttcaggttctcaaacttgttcgactgtgtcatctcggtccctaaacttgcagatcacttgtttaggtcctccaacttgttcagttgtgtcaccccggtccctaaacaggacggtctaaaaactttatatcaaaaaataattcataacttttttatgtgaactctaatgaaaataaactttatatcaaaattgtagccctcgacgcgaccgacaactttatagttgaaaagtttttgaattaaaactgtttagggtcccaaaatattgttgcatgtttatagattttgaaattttaattaaattacattttgggacaaaaa

SEQ ID NO: 65404 - DNA, 20713 bp, Oryza sativa
cccctagggcgaaaccctaactcagaatgatctggtccagccattcttccttagaaccgaaggaagcctcctggatgcttgccacgtcgttgatccaaactctccacgccgcactgatccgcgtgctccctctccaaaccagtgacgagccgccacgtcacgcctcagcatgcgagagcgcgcgctccaccgcgtggatcccacgctcacctgcgcgcatccagtccaaagcctccacgcgtcccgccgagctgctcccgcgcatgctcgcgaaatcgcgcgtgggtcccagtacaactcccgcctccgagccacttgaaacagcgtggaccccacgcccgcacgcgccgaattccttgccgccgcgtgtccactgcgcgcgcgtgcctcgcgcgatctcccgcgcttgcccgcgcatggtgccaatgccgtgggccgtcgtcttgtcttgggcctgctcggcctggcctccctgcctgctgatccatccatcatcttgagccacgaggaagggctggattggcttggcctccctgccaaccaatcacagctcacatgcaccaatgggctagcaagctcctcatgcacacatgcatgtcttgcccccgtgcatggcattcggccatgtgcacgcatgcacaaccgaagcaccactgtccatacttgcatatgcacatgccagtgcatgtatacaagctcctcttccattctccattctgttcgcgaacccggcacttgcacttgaccttgcgaagtccgttgcgaagacctcctcacacggtgttcgtccaccgtgtgcaaccttatgtccaatcttgtcacccggcatccttgatcgctttggacctcaactcctccctgagtctagtcccgatccgccgttgaccaagatcgaccccgatcacctgcacacacatgaaccaaacaaccgttgtcttggcacagatgtcgcaatctgaccaatgttagtccacgcacacacttcttgcacttccagtacttgtcaatttcccatcacaaaagaactataaccacacatggtttcacactcaatcatgtcaagtgcaatccattgctgaataagtttcttcttttctataacagttcctttagggaagattgaacaatatacaaagcataatcttagctcatggggcatattataatatattatcttgaatgatggaaatagtggtgaaattttgtcttggggataatcttcctctatcttccacatttcttcatcctttgcagcttgccaaatctcacgcctttgtcgttgagcattcaccacagaaccgagaaaattggctaccaagggtgtgccttcacaccttctaacgatttcttctccatattccctgaacaacgggtcacccggacctgtcattgccctttgagagaatatttttaaacaatcatcctcagataaagctgccagcttgtacagtggaacggtggaaatcagcttagctactttattgctatgagtggtcactatgatcttgctttctgtatgtctaccagtaagcaacatctgcttcaattcattcacttcttcatcctttccccaaaggctatctaatatgatcaagcaactatatttatttagcacacgctgaacagcattcttgattgactgcagctgcatatttccctcaattttttctgtagtttgtgaaactatatctcttccaattttttcaaggttgatattacccatggaaacatgaacccatatcctaaagctgaatacctctgttcctgtattattgaaaacgaactgtgctaggcttgtcttcccaaaacctacaggcccaactatggatataatggaaagctcttcagcgctgttttccattaaaatgtccatgagattatctaagtctgcatccctcccaacaattgcaatgtcagtatttctgtatgatgttgtttgcttctcctcaaaattcactgctgagttgatatgtgaaaggaaatgatactgattgggcaattgttgcctttgctgtaacatctccctcttggacttcatcttataaaccatgctacctttcagaagcattggattcgatagtgagcagaataatgacccctgtaaatttaccaacatatatacataaaagtagtctttatcatgaaatatattttatattttgataacgatgttgctggaagacaaaaaaggggacagctaaacaagagttggtgcatcaaggagccaaggaaggtaccagcccttacatagctgatagatacacaagtctttggtataaaccttgcattttctcatataatacgaaggacatttttttgcatgcctacaagtttctcatctctcactatctagtccccctcaagcaaatgtacagtctaaagataagttacgtgtaagtattcggcttatctcttactattaccaaataatttcttaacaaaaggaaggatgcttctaattatcgattgtgttgacttatataagctacgctagatgacaccctgtgcgttgctgcaggatgttggtgtgtaaagtgcaattgcaaaattgcaatatatggaactgacaaaatgattaatccaacaacccaaaaaagattgatgtaggctacaaagactgggctaatccaaacagttaccatcgaaggatgtcaaagataagatgatattgcttctttcagccccataggttgcccaaagaagaataagccaaagccaaaatttgaattttaaaacttaattttgaagttgatttttaagataagatattttcaacatattttttcagcattgacttttaaatcgctgagaacacatatataaaaattttacacaaattattatttggtcgctaataaaccattacagcttataatcagcttttgggcaacctatgagaccctttctttatacagcttataaaaaagaagaaaggaaaaattcccaattccgagctgattcgcagttaggcaacaagccattctagtggtgccacgtgcccctactaatacactccagatccaatcaccggctaattccgaaaattaaattgaaattgcagaaggaattcttctggactaaagaaagggaagagattggctttccgaagagcatccattaccttctgagcatagctgcccccatcgaactgctccttggaagagtagtacccatcaacgatatcttcgatgtcgtaagccagggacttgatctggccgagccagtgtcgcaggttggccctgtcgcttccgaaggagttgttctcggcgtttttcagaagggtttccaggtacaccaaggtatccttgatgccctccaaatcgtcgctgaaattgcagcacagcttcacctcgccctgcgcgacgccgacgatgccgttgatcttccgggcgacctggctcaccgccgcggccacaagcatctcggcgccaaccatgctgcaacggatgggggagctaggagtgaccggagggaagacaccaatgcagatatgggggaggtattgcaaaacggtgttgactagacgaatgaagggggaactgttgtctttgtagtcctcgcgtcgtttttacattattaaatttcatttcggatcaccgattgatgtttcagttgccaactttttgtgacaagtttacaaccacgatcacagcatcttacgccttgcgatgatcttagagtcgccaactacctcaatctagtaaaaactagaccaagatgggttttgataactaaaccgactagcgaagccgatttctagatagctacccgtcttgtgggcaaaacggaaggttttcaggacaaacctacaaagaggtgtcgcactctcgcagcggcggcggacaatttacagcgcaaaatgacaaagatggacaaactaagagaaaactaaaagcaatatgaaaaacgagtcgattgattgatagtagattggttagttataattgaaccggccatgtcccttatataggggttggtcttgccctttacaggccctcctccacgtccaactcgggatagaatccaaaggaaacccgaaacataccttcccaagcaaggaaacttcgagacccggtaaaacagacctggacttggacttgccggtcagaccgaccacacaccgccggtctgaccggccctcaaccggcggtctgaccggccaacacacggcggtcagaccagcctactcggaggaaatcggtagacttctaaactttggcaatttttcctattttaatcctaggtgccaaatttgggtgtaaacatatgcccccttgcctttttgatgaacaacgtgaatctaaaagcatagaacatgtttttggtcttagggcgataatccaattaccggccatagcacctcctaagcgtcttgccaaacgctcaggaagtatttcttcaagtatttctcgttgattgctcgctaaaaacgctccccttgaagtgtctccaaaaaatacacgttccctcgaacaatgccgcataatcgataaggaccttcccaactaggagaccacttaccgaactccctggatcgagtacccaaaggcaaaactgtcttccaaaccaagtctccaacttgaaacaacttcactttcacccttttgtggtacgccttggccaccctcttcttctctttctctatctcttccaaagccttcaagcgtttgtcgatgacttcatcaaggttgtctcccatcaatgtcttgtaatcttcacttgacaaatcatcttgcttgatataactaagagaaccaagatttacctcaaccggtaaaacggcttcttgaccataaaccaactcaaaaggagtgattttagtggcaccatgtatagatatcctatgcgctcacaatgcttcggaaagcacctcatgccacttctttgggtgttcttcaatattcttcttcactagcttcaacaacgtcttattactcgactcggcttgtccattagcctgagtatagtaaggagaagaactcaacaatttaacaccataagattcggcaaaactctttactttcttagacataaaagaagctctttgatccgtagttaatgtttgcggaataccgaatctatgagtaatatgcttcaaaataaagtcaattacctccatataagtcatattcttgagcagcacggctttggcccacttagtgaagtaatccgtagcaactagcacgaacctatgcctctttgatgacgaaggataaatttgaccaatgaaatccaaagcccaacctcggaacggcaatggtttgatgataaggttcaacacggcggcgggcgccaagtgaacattgccgaaccattgacaagcttcgcatcccctatagtattttaaacaatcttcaatcatcctcggccaatagaaccctgctctcctaagcaaccaattcatcttgtgggccgattgatgagttccacaaatttcttcatgcacctctcccatagccactttagattgatcttcatctaaacacttcaataagacaccatttttatttcggcgatataaatcttcatcaagcaatgtgtatttgaacgcttgccgccaaattttccgatcaaccttaagtgtaggatctttcaaatatctaataaaaggaattctccaatcttcttctgtatcttgggcacaaatgtccgaatttacaattaattcggcctttgaatcaattgtggcgtgccccccagtgctctgtccagaaccggtcagaccggccgtgcaaggccggtcagaccgcccggggtggccggtcagattggcggcatgtggctggtcagaccgcccctggtcaccggtcagaccgcctctggtctccagttttaccaattttgcacaaagacttaaaatcaagcatcgacacttctaataccagaaataatcccttcttcacattatagccagatgcttgttgtgccaaatcatttgctctagaattatcatgcctagcaatatatctaatagcaaaattatcaaaattggcaataatatccaagcatgagtcaagatacctatttagtgatccgtccaagcatttgtagactccggcaacttgttgcactatcaattccgaatcactaaacgcttccacgtgcttagctccaatcatctccatcacttgtaagccgaataataaagcatcatattcggcttgattatttgtacaataatattccaaacgaaccgatgcctcataacacatgccattaggtgaaaacaaaactacccctatgccttgaccttctttgcaagaagaaccatcaaaataaatcatccaaagtataacttcaactgagcaaacttttttctcataagcaatatctacatgatgatctactataaaatcacatacaatttggcctctcatagatttcaacggttcataagacaaatcatattcaatcaaagcatatgcccacttaccaattctcccacttaaaattgacctttgcaacatgtgtttaataacatcggcttgacacagccctgacaccggcgtcgtcccggccaacctccacctccacatccgcccgcgccaggttgaaggtggccacccccgcgagtcccgccgccaccatcatggcaagccgccggctttgccagccactcactccggcagcggcaaggcagagggaggttgtggagaggggtggcgccggtggctaggtttccacccccgtgtcgcctaagcgggagacgacgtggggtctttctatagcccctagctatttaggctttgcaacagacaaaggtataatgaggacggataaagtactcaattttgtacgaacaaaattatgtgctcaatttcttctttttttttaaactacgcctttggtgttttcggttcaccctatttagtgtaagcaacccttcaccaagatacttttggttttgggttaattggatccatgtcgctgtaaatgtggtaaataaaaaaaataccaccactattcatgttattggctgtgtgccactaaaattttctaaaattagaaccatgccacttctgtcattattttcgtcctcctctctcacttcgtcatcctactctctcatgtcggcacggggacaaggcgaggcggcgccggtgagcggcgaggatgaggcggcagggagcgggtgcggtcgtggccgccgccagcgaggacggtcgcggggaggttgcgaaggggcgtgcggagttcgccgaggggcgcggccgccgtcggtgaggatggtcacagaggggcgcggatcttgcggaagagctcatcaacgacggggaaggagatgccatggccactcgccgacgccgactcatcttctccccgtcctctcgacgctcgccgacgcctcctcgtcctctcgccgctcgccgaactactccccgctatatgctccccacgcctggcatcaaacgcaaacgcatcgggagctcctcagtcatcgacgacgacggcggatccacgcatctcgccgggagctcctcagacaccagcttcaacgttctctccgccgcatctcgcagaccgacgatgcctcaccgcgccccccggacgcggacctccgcccggtcagtggcaatggcgatggtccaagtgcgcggccgcatcgggaagcaggccacagccttgcttgcacggtgcacgtcggcgtctcgctggcgcggcggccgcgcccgctccccgccgccttatcctcgtcgctcgccggcgccgcttagccttgttctgtgccgacgtgagagagaaggactgaaataatgataggagtggcatggttccaattttagaaaattttagtgggacccaaccgataatgcgaatagtagtggtatttttctaatttggcatatttgcagtgacatgatccaattaaccctctgtttttttgtgttttgggagcatgttagccactaggccagcgcgacaataaattagacagggcaagcgagcagtctattcttgatgatgttgccaaattcattgtattctgtgcttaatttaatttaaatttttttaaaaaacttctatggccactagtgtctctcgcacaccttatttatttcaagcaaccaccaaacaagatgtttttcgttttttttctgagcatgttggccccttggccagctcgaccactatatcatcctcgcagtgcaacacctccagctgttgtttagagcaattttaataatatatttaataatatagtcaactactaactttaaaattacacacatcatcttaatgctacgttcgttacagcctgttcccaaccccaattcctcgttttccgtgtgtacgtttttcacattgctaaacgatacgtttttgcaaaaagtttctataccaaagttacttaaaaaatcaaattaatctatttttttaaaaaatagctaatatttagttaatcacgtgctaatggaccgctccgtttttcgtgcagaggagatatgccttaagttaacgtaatagcccaagcaaattatagttaactaaagatatatcctacacttttaaaattacacacatcatcttaagttaacttaataacccacatataatagttaactgtatatatatattacaccattaatacaaccccacatttatctcttatataatttattggaactcgtactacaactaacaatgaatctatagcctacttttttctatctcctctcctctcttctccacattaagcataaatctgtagcccacttttttctatctcctcttctcttctccacattaagcacaaatctgctgtgccaatttacacaacccgcttacatcactttacatatagtcccctatcgactgctgtagcatataggccctgacccacataattcagtggcagctactcatatccactatataatgccttgatatataaaagatgtacaggcctacatagactactccctgtcattttcatttttgtcaatatcaaactactctaaatttgattaagtttgtagataaatatagtaatatttacaacaccaaattagtttcattaaatcaataattaaatatattttcataatatttttatcttgggttaaaaatattactacttttttctacaaacttgatcaaacttgaagcagtttgactttgaccgaagtcaaaatgacttatagtctgaaacatagagtatatattcaaaatgacttatagttatacatgtattgtcttggtctctcttcttctccaagggagtcttatatttatacccacggatatccccttgtccaagtagaactagggaaataaatatgaatatgttcggagtagtcattatagtttccatatagtactctgcttctccttctttatccggaaaatcctccgtatataaggtatgattccgtataagactcgttaaatggtgggccttgccgagtttaacctaagactattaggtatgtcttatccataagttaaccgtgaaatttggtaaacccccaggtcatcatcggcctaaaatcaatatcggcttcagagttctggaatcggccgatgggagtcgtcaagtcgccagcagtcggattcttggaggactcggttaaatctattcaaggaagcttatctaaaagagaagagaccgagttcaaggaggatgcggcgtggcaagttatttattaattaggaatagtttgttagtttccttttatctttaggaaagtgtgtttagtgtcctataaggtttttatgtttttcttttatttttagaaaaatttctttcttgttcaataaggactagtatctatccatgggtataaatatgtacacccggggtcattctaaactatctctacgatcaatacaatttagtgtatcaccaccttttaccttttctactttttcgacgagtttctacttgtcatggttgtttgcatcggcggggctagggtttcgacactctgatcttgtgcatgtaagaacctatctatcgtatgtctctgttaatctagtcttaacatctcgatttagttctatcggttgtctctcgctttagggtttctaccgataaggtatcggttaaatcgtcttgctagattagattagtttagacatccaccaccctgaaaatcaatcaaaggcttgattgtctagatattatgtttcttttcatacttagtgctgcatcagtacattcgatctgctaagtcgtgcttagaactataatctctagcctgcttgtggattgccaataaggctttcatcggggtttcaactttcaaccgatgagttatctggacattccacaggcttataaggattgcatatataagttgaaataacacaacccttaggtgccatatgaaaccagaaaatgcccaacatagtccgtgggctgttgtgacggcgatactgtctccgttttataaaaaactaacctattatatccggtagtaggttgattttttatgggatggagggagtacaaccgtaggagtattagtgatctatgacctatgtcagccatgtataaaaaataaaattaaaaacatctttcgtgggttccccagtgcactcattcgctttgtttatgcgtacgatttttttttccctctcggtaaggagggctgagcgaaggcgttttcgtaattttctctctcgatggaatcttcctcccttctatcttatctaccctgctgaaatgcaaaaccagaagtccaaaaccattcttttcaaaaaacagaattccaaaactgccatgcccgtatggccacagccggtgccgccgtggaccggcttctacggcggctagccgcagatgctggtcgtttgaagctgccctcgagcatagacgaggatatggcgcaggtacggcggaccctggcaaggttgcaagatgtgctgctaagcgtggaggggaaatacttcaagatgagcatggaggcgcaggaatggatgaggaagatcaatcagatttcctatgacatccaagatctactagatgaatttgaggactgcagtgaggccggatctcaaaggggcagttcctggattgcaaaggttcgtcacaatcctttgaaaaggggtaacccccatagtggaatttcgttttcagattacgtcctgatttaagagattttaagtccttttaccttttttcctttagaaaaataactgtgtcaaatgttcactattaattatttcatccttcaacaaattattgtttattttctgtacaactggctgtgcaaattacaaaagttctactgctgatgacctgaaaaatgcaatatgacattgtttcagtattatagctgttcccatcgttcaagtgactaatactttacctgtaaaagtattgatgtctggagtatttcttatgctattactcctacagttctgcttcatccttctatggccatgcattgtttacttcttagctacgcagtgtcagtgttatattgctgtatccttttagcaagggttctttctatgaccacgcattatttacttctagctacggcagtgttagtgctattgtatacttttagcaagggctctcccctactgttccccaaaatgaatcctttgaaatatgattatcaattgaaattaactcactaaaactacgacttcaatgtataatttgcaggaaatattgttgtgttcctcaagtccttgtttctttaatagtagtagattgcaaagaataaggataatcaaaagaaagttagatctgtcaacagaagattctgttgtattgagtttaatgcagcacagtccatccaaccttaagcattgcaatgagccagtaatttttgatggatataaaatccttgggagggacaatgacagagaaaatgtaaagaatttgctcttccaaaatgatgctgataaattttccatcattcccattgtcggccttgcggggatagggaaaacagctctagcaaggttaattttccaagactatggagaagagtggaactttgatcaacgtatatggatctgtatcgacaggaaattagagcttaataaaattgccaatgatataatttcacaggttaacaaaaaagaagaaactatttcagagtttgtcctgaatgatcaaattcataacaacttgcagtttatgaagaatcgcctccaagaagttctttctgacaaaagcagtttgatagtcttggatggcttgattagcacagataaaaatcagctaattgaattgaaggagatgttgaggggtacagagaagtgcaccaagatcattgtgacgacttccagtgaagtatctgcagatctaataggcactgttccatcatacaagttgcaccctttatctgacgatgactgttggggaatattttgtcagagagcatttgataatggagccggaaacatggaccgtgctgaaattgggaggcaaattgtgaaaaggtgcgaaggcatacctatggcagcgtattctcttggttcaatgatgcgtaacaaggatgataatgcctggttatgggcaagggataaggaaatatgggaattgccaaaagtatttgctaatgggtttgagttacttgcaccattcagtgaaatatatcacagtatgccctcagctttaaaatcatgcttctcttacttgtcaatcttccccataggattcgtaatagatagagagaagctgattcaacagtggatagcacttgacatggttggttcaaagcacggggctttacctgcttatgtgcatggagagatgttcattcaggaactcttatcactattcttccttgaaatccaaaagataccctctgtaagtaacttttttttaagctaaagccttgtctatcttttgtgtaccagtacataaattacacgtgaataataatgatatttttcggtgattgttatcttactccttttcttttactttaatttcgtgtattagcacgtggaaaatctatatccttaaaaagtatacaacattacatttgttgatggttgttaaggtggtaaagcgtcctaagatgatcccgggctgccttatcgccatagcagtaaggcgcaaggtgaggcaacaccttagacactccatactaattaggtggcaaacaaaataatctaatctgatagcaaatcaaagttgtattttaagagcagtacaacacacgtatatataccttgttcttggcaaatcttgagcccactagatggttatagtaattacttaactagatatcaatttattaactaaaagaacaccatcctatgaatacacagagagaggcggcatgggggaagagcaaagcagggtaaatatgtgctgagtactactactaacagggagtcagggagcaaaacagagcagtagagggaggagtatagtagatgagatgtagaggagagggaggaaagaccacaacatagtagcaaatgagggagcagagtagataggatgtagaaaaggggggaggaaacaccaaaacagagcagcagaggaaggcgcaaagcaggatcacgtagaacagagaaagaaacagaggaaagtagaggtggagggaagaggagaaagaagagcatgcctgcttttagtttttgtgtcaatggtgaggaccaggatgatggcgcaggtgcagaggaccaggatgatggtgcaggcatagggtagctgcaggcgaatggatcgccacagcctcaggctccagcgaccctctttctgttgttttcacattgatttggtgggatttggcacgtggggaccttttcaccctaaaagttggcgcttgttagttctgtttcgcgtccaggacccatggcgccaattttttgggcccttgaactaatcggggcaaaaaccgtgtcctcgacttcctgtggcgtcacctttagctgttgtagcgccaaggacgcgatatagacgccataacggcgcattgggtataaggcggacaccataagcaatatggtaaggcgggctagacgcactgactcctggtagcgccttactgtcatagtgacgctttggcgacgccttgacaaccattttgttccaagagtaaaatgcatggaaggtcacttaacttgtttaggtgtgttaggtagatcactctacttttaaaatgcacatttagttcactaatgtgagttaagtgagtcatttacttatctaactatccaaatgagtataccttgtatacatggcatgcaacctacgattgaaaaaattgctttcggacatgtgcataaatcgcatgcgtattttttttccctttctcacaacactagcacttggaaatacacggaattagggaaaccaaatcatttcacttgtaattgttttgatgagttcttctagttctcagtactctctcacttgccatcaaactcgctggtggcaatgataagctatgaatataaacagtgacggaggcaaaatcctaggcggcaacgacgacaagcttaacagcaacggaggtgaaatcgtagggggcagcggctgcggatgcccaaacattttttccaatcctatgtggcacacgtgtacgaggtgtgctcatgtggatagttagatggctaaatgactcacttaactcacattagtaacccacatgtgcatctcaaaagcaaagtgacctatgtgacacacctaaacaagttggatgaccctccatgtattttactctttgttctaattttttatttgaacaaaatatgctgtcacatctagtaaaattactgtggcacagaagggtgggtacataaattatgttaggcatttctattcaatttaaatttcaaggcctatttgaagcttagatcacatgattttttggatgaaacagaagtctaaaattaagttcctacaagaattccatgttccaaagagaacctgatgtgtttaggaaatatttaaaccccttctgtcaggcagaatactaattacattggagtaaatttacagaggcagagacccctcgtgaaatacattacctattctgtacaaaaaaggggagatttatatttccaataaattgacatttagtaagcattaacatagttaaactttgcgatgttgctgatgcagtatggtatcctagttatcctgtcatttatgtttttcccattttatgtttgctcatggtgtgtggtcagaaagtaaggcactgcatgtaaattatgtgctaatttcctttaaaaataagacgttacagcatcatctatgggccttctgtaactgaaacatgtagctacgagtaaatcactctatctaactctgctcatttagtaatagtctttactatgaatgatgtgaatgtttttatatatacttctgtagtttgctaatgatgattgatgactatagcagttcacatggtaaacatgatagcagatcatgattttgttactatattttaatgtgattgcaaattggtagtacttgtctcaatgtgctgagaaacaaatattgctaatttttttcatagaaagaaacattttttttgggtgtttaaactaattacctttgatgtgctagctaaatgcggaagatattcaaacacgcagcttcctgtgcagaagcctgtctctgtcagtgcttactgctaagcatttcaacatttagtccaaattgaaccatgttgttttggagcaaattgtgagattgatatgtttgttttttaggccactggaatcagtcctaccaatcgtcgtacattactccaggtgaatagcttggtgcatgcttttgcaaaatatgttgctggtagtgacattgtaatttctgatggtagagagctatcaaggggcccttcagctgaaaaggtctcttccacttacgctgtgctgataaatcacacaggacactcaacccttcagaaagatgttctcaccggggccagggcaatatcattcaaaaactgtcttcttgcagatgcattcttaagattgaatcatctgcggatcttggatcttacctgttgttatgatctagaattgccagcatccattggctatttgaagcttctcaggtatcttgctggttttggcttaagaattcgtaaattaccaaaccagatgagtagcttacaaaaccttgaggctttggatttctcagaatcacaccttgaggagctgccatcattcattggatcttatcagaagctaacatatttgaaccttcagagatgtgagaaacttcggaacttgcccagaacacttggggatctcaagagactagaatatctcaacttatcatactgccccggagtcagtgaggatgctgactacttatgcagtctccatgcacttcgattcttagatctctctggctgctctgagcttcaacagttacctcatttgtttggtaacctaacaaatttggaggatctaaacctgtcaggttgctttaggctcgagagactgccactgccagattctattacaggactagtaaatttgcagtatctgaaactttcacatgtcatctctgagctgcctgagtcgctaagcaagctggaaaggctccatacgctagaccttactggttatcgtctaccgctatcatcaggcgtccctccaacattggcagacattatacggaagatgcctaatctcaatattatgttgagagatcgttatggtgttgaaatgtcttgttcctccatttctactggtggaaatgggagagggctgcctctcaatctcaaaaataaaaaaattgtggtgttgcaatttcagatttatgtacaccataatattcgatgctcaacagataatgcaaatctcgtgacggaggaaacatctgatgagagagttactctgcggaaaatacgaagcttacatgacctaggcgatctccacgatattcaccatttagaaagtcatgaaaaaatagaggagatgcaagaacaagcgcgtcaacttgttgcttccagtcgtcttgatgaggtaattaaactatcgaacgaatccctttcatttgttctttgatcaagcctgctgaagtgctgatacattttcatccctcaaggaagtcccctcgttttccatatcattcaaataatctttaaaagaaagtaaaaatgtagacaaaacataatgatatatcactccacagaaattagtttaaatcggcgtatacaacttttttaaaaagcaaatatgactgtgaatagcgcacatattcacaatcgtatttgtttatgctgtttcaacttgtataaattgaaaataaagttgtatatttataaaggaacatatcacattaatctatctcattattttttaatgattatttgaatgacaaatcaaatgtttttatgactatttaaatgatatataaagtggggtatatttgcaaggataaactatctcccatatactcggtaagtctctcgttctataaaaaaactcaagacgtgtcctatcacagaaacatttagggcgctcctagtggtattgtgtatactaaaatactatacggtaccccgcacgttgttgcgggatagctgcattcatatgaaaaggactttaaaaaaaattccgctatagaaaagaacaaattaaagcaaaacccaatttgtagttaaacatctgaattatgatttagggtgttagcttttcaattttctatgtatcaaaatcagtaaatggtgtcaactaaagaatcttttaagagaaacaacaaacccacataaacagacaaacatcaagtgcaaaatgcactatgcatatggtcgcaaaaaataaaatataataacataagcatcatatgaaaaccatgaaagtgtgtatatatagttatgggtgccatgcatcccaattcccggagaaatatatactatgataacaaatttaaactattccattaaacataaaattaattaaagactaatgtagatgagtaagtgctaaaattgctcttgttgatggatgggattttgaggctgaaatggttggctccttcaaccgtcttgcaattatcattcatccgtataatttcctacagaacaatcgacgaaacatgaataattccattgcacagaaaataatttttctccaaagccagctgacctgttaatggcatccctaaggctatgttcggttccttgggattaaacccccaaggggaacctatctagggagggattgagtggatccctcccatgtcacttaatccctgtgggatgaattcccttgattttcctaatccctgtcttcaaaacgtttgttcggttttggctttgtgcgcctgcttaaatcccgtgtcaaggcagcaataggcaacagcaacaacagaaggagtactggtgctttcctgcttcaacgttgcacgctgtccattgagtttagaatagcaaaattgattttcaggttggcagcttagaatagcaaaaaaatattgcaaaccgatatttttgtataagtgaaaagtgcaacatgatgaaattcacttcagtaaaaaaatattgcagtaacctcatcaattacgcgaaaatcacattgattaatcattaaaacaaaaatattgcagtatcatcaaggcctgtatccggtttaaggcaaggaggcatcacccaacaaagcttgaggtcacttgacaatacagagacaactaaatacagtcatagtagtgaaatttgacaataaaaaaagaaaaagatgaaactatgtcatgattcacttgagctataaaaataaatgtgagctgccacaccaggactcccagaccaaatggttacatcagcaatatacaatggttcagagatcaacatttgttgctcctgcaaaaagccatcatcttgtacatgtttgctcattcactctgtatctgaaccaccatcctctcagacttcctccaaaagcctgtagagaagaaagaagtttccttcagttttcagttgtaaaatgcaataatttaggcaatgcttttgcgcagtgagcaattgtctcaaatttcctgaaaccagccaactattgatccttggcaacatttttaccaagttttcagtttgacaagtgattgtttgtaagctgtattgtgtgctttgcccaatagctagcagtgctagaaacatggatatgcatatgagactaatgctagcagtgcttcagatatcaaaatgaaattaggacacatataagattgagcaagcaaaaaactgaattcaatagtagctatagtagaagcaaaaatcagtagtctgcagattaagcaagcaatagctgcaaaaatcatgttttacatccagaatttcttcattacatggttctacaagatctactaaaaatggaccaacctaggaaattattttttagaccatttgaaccatgtaccaaaatagttcagatttaagttgtattctgccgactgccaagagctttttacaggcctgaactaaagctgcacatgactcatttttcttactacttcaatttgaactttgtactttgttcagaaaatatggcatgtggaatggctcattgatctacttgtattatgggcactgtcaagtatgggtgagattacaagagcagacaacttgttggaatcacttctgatgaacaacatttgtctagtatttctgaaaaatgaacagcattcacttctgatgcctcaatattattacgcactgcatgtttttgtggcattactattacctgccaactaattttaagaataaaccattttcataacctttatgtacaaatttaaaacaactcacattgagaatcagaaaacgtggtctttcaactactcaactaccaggagaatcagcatattctcactagggcactacaaacagaggatcagatccaggaaggacatgatcagagcttcagactatgttaggaatattactcagaacaaatcaagggagaaagaagaataaatcaagaaaccttgtgaggaacaaagaacagatccatgccctcctgcttctccttgccgccgcaatagcacgaggtcacgagcgcaagaaaccctaacactggaagaggaggctaggggagatgggaagggaatgaactcaccggggagaaggtggccaccggaggagagagcgtgccgttgccgtcacgtcgtagtcgcgccgcgccgtgcagccgtccccgccgcagcgccccctctcattgcgtcgctgcgtcgagaggattttttcctcgccaccagagaagctgaatatttcccggccgatgacgaggggaaaacactggggtgggccgggataaaatctcgcctggacttaaccgaacgcctatacttgcatgggctggtatcctttccacgccgggattttccacggggattagaccccgatcccagccgggaacggcccaaccgaacaagccctaacggggaaacttaggctggctggccacagcatggacctcactcatctacagtaaaaatggtcggagacaaaaggaaatcaaccgaagctggccaatacaaacaatctattctcagggatgcatgcatggttgtgaagataactgagaatagaaggcaaaatatagaatctaacaactagcttgagttcatacggtgtgcttgaggtgaagtaaatacatgtttaaatgtcacaaataatttaagaagaatattaatggaaagaaacggcaacgtaatggagagaatacaaatcacggatagactttacaattgctcttacatgcatgaaggtatatttaaagttgaatgtgccataattgttggtgaaacggttggggctctaataatagcagcaattgg

SEQ ID NO: 65405 - DNA, 6868 bp, Oryza sativa
ttagatctgtgcagccgggtatggttgttcaggatgggtgggcctgtacagcatgggtgtgctgttcagtgttgattaaaatttctgattaattactctactgttttactactcttaactctttgctaaatgctgctttcgcaaatgagcctatattatgccatcctttggtatccttgtgcacttgcatatttgctgtgtggcttgttgagtatgtcatatgctcattcttgcaataatcatcaaacctcagttgaagataaaggatccagaaggagaagacgtttggcttataccccagttgagctgcctgtgggagtggagcttcgctagaccgtaattccgctgcagttttcttttcttttgtaagtatgtaacgctattattgatgattcagtatattaaattgtcagtttgtgtacctcggctgattcctggacgagggttctatgcacaaattagttcggaaattactagtgaatttccgggcgtgacaagttggtatcagagccatctcgactgtaggataagccaaatggtcaaaccttaaggactaattttccgaaaacataatttgtgaaaatttctcctttcttccttatctagaattctttgcaaattgtttcattgtctactctcctctctcgttcaacttgaagtagttctgaaactagtggttgaaacctgaagacgccaatgaggtctactgatggaggttaagtaaagtggatcgaggaagaactgaagtgccaagtggtcaagatggaatgaagtttggatcctgtcttagcacctataccgccaaagtaattttgaagaatagttagtagggtagaacgtttgttgtttgctttgtgtgtaggtatggttgcattcccatcattggagaagttcattgatgagtgtgtgactatactaggttgcttgcttaatcaacttgaacaatataatggtctacacacatcagatcagtgttaacctggttaaggtcttatctttagtgtaacccctctccttctatcctttctaatctgcaacagatggtgaacactcacgctagtggaagtggaaacaataacaatgaagagaacccaacccttgctcaagtgctggctcaacagacccaattgatcaacatgttagtgcaacaaatgcagaaccagcaagggaacagcgggtgtgtttcaaatgttacaagccagggcactttgcaagagagtgtccgaagccgaagcatcagcagccgcaaggtcaggtgaacaacattgttgtcacaggagccaatgcagtgccagttgcgtcttcatgagttgtgtcttcaagtgttacagctcagccaccagtttcaaagcggcattagttttctttaaagctttagaataattatcggagttatggaataagatagactgcagtttacctatgcctttttctttctagccgttccgaatctcgggacgagattctttgtaaggggggtagatttgtcacatcctgatttttgtttcaggatttataaattatttaataaattattaatagaatttatattaaatgttcattaatttacaagtgaagttaaatgtgggaaataaaatttcttaaatataaagcatggatggatttaatttttattaaattctccatggttaattatactctctggaattttctcggatttttcggagctcaattattaatttttatcttacaaagagcagttcagcaattatttaaatattaaattaatcattaaatggtctaattataatttaaatattaaattaatcattaaatggtctaattataatttttttaagtactttgagtgtccaagtattttcaggatttttcttgaaattatttgagcattggaagtatttttaacaattgaaagatcatttaagtgattattttaattggaaaaagtttttaaatccttccctaagtcgttgggccgattttggcccaactctttctctctccgcgcggccgaaccggcccaatcggcccagctgcagccgagccgccctcttctctctctctgtcaaagtctgtttgtggtccctccttcaatcgggcctagcataggaaaccacacagaaaagtctagtttgcctccctgctacagtgtcgtccctaacctccagccggctgcctagctgagcccgagccgcgcgccgcgtcgcctttccgcctccaagtccgctccaatccgaccccgtttcttccggatttttgaggggttttgatcctctcatcctcctctatcttttcccccaagaatcggagcaaatcgttgggtattttatccgaatcaaactcgttttcgagtttatctccaaaaccgagttttgattttcccggatcgatttcttgcgggaggagtccgatctcttcaatccaaggctataaataggaccccctagtcctcctctttcgtttgccccctctcccgtcctctcccgtgacccgtagagccgtcgccaccgtgcaagccgccgccgccgtcgcttcttcgtcgccggccgtcatccgtcgtcgttcgtcgcgttggtgagtaccatcgggttcgtctcgtcgtcctctacgtgtacatgccctccttttccgcagccggccgctctatctccggcgaggtcgccatcttggttcggccatgggtgatgtcagcatgacgtcatcggtttatctttttcccgtagattaaatcttcggaaaatcataactaaataaccatagatccgtttcaggtggttcaagttgctaaatttttctaaaataaagatctacatattaaaattatccataaattgaattaaatttatttaattctttttaaatgggctttaattagatttaatcttgtaaaattcataataaattcatttgaagtcagaatgaggccgttcaagtctcataattcatctaaaattatgatctacatgtttgtttattttttatatactgtttatttggtttttattagtctttttcttcgttttgcgtgttagcttgtcgtttccgtcgttgcgaaggttcgtgagtgcgtcggaagtgatcaagaagattaattgaagaccgattattgcaaggcaagtcacacagatcctaaacacaatcctttgagcatgttgatcctatatttaaattctctatttgtttcaactgtgcatttattttcgaatgtcaccgggtggtgtgaacctattcctttgttatggccaatttgcattgaatgccctattccttgataccttgggtaataaattgattagcttgaaccttatgtattggtttggttcagctaaaagttatatatataattgcttagcaatgcttagaaacattagctcactaatgggatgaatcatatatactacattattatttatggttatatttaatggtagctcacgatggttaatcgtgtgatgttaattaattgataattaaaacctggttaaggtgggttgtgagcatatggttttgatggttgtgctcatgacaattaaggaccggttcgcgagctactgttgtgagacattaaccgtaccaaccacaagccagcgtgggcaacggctttatcctttgtatagcatggttcattatagtgcgccagactgagaagtggcgagaagtccacgggggtcgctggggagtccatgccttgtttataagggggtgattatgatccaggaacggtgcactgttttgagttgtgttgtgcaaagggtattgttacgattttcccctttgcaatgccgtggtggtatttcggggcatggcaacatgtgtggaatcgtgtcttgtgggtacagtggtacacctctggccagagtaaaactattcgaatagccgtgcccgcggttatgggcgagttgagcaatgtttttcgtgattagtctcacacctctcacaataattattgatgattaactggtaataatttgcttagctcctggtttggagttagatctgttcagccgggtatggttgttcaggatggttgggcctgtacagcatgggtgtgctgttcagtgttgattaaaatttctgattaattactctactgttttactactcttaactctttgctaaatgctgctttcgcaaatgagcctatattatgccatcctttggtatccttgtgcacttgcatatttgctgtgtggcttgttgagtatgtcatatgctcattcttgcaataatcatcaaacctcagttgaagataaaggatccagaaggagaagacgtttggcttataccccagttgagctgcctgtgggagtggagcttcgctagaccgtaattccgctgcagttttcttttcttttgtaagtatgtaacgctattattgatgattctgtatattaaattgtcagtttgtgtacctcggctgattcctggacgagggttctatgcacaaattagttcggaaattactagtgaatttccgggcgtgacaccagccaatgaaccctcggttgttaatgagggaacatccacaacctactgggcagattgcgaatcaaccaacccaagatcaagttgctgccatgcttttgccacctccacctattgttgatccagtgcagcagcagccgattcagcagacatcaccaatccagccagttgtacagccgatccaacaacaggtcgtacaaccagctcagcaaacaccatcaaggcagcagcctctgcaactgattcagcagacgccaccaaggcagcggcttcagccgatccaacagactccgatgcgacagcagatcgttcagccgattcaccacccggggtcggcaaatgcatcggcagggtttgcagcacctggtgggcaacctgcgcaacaatttgtaaaccaggtcgtcccagagcatttggttcaccatgcacaaccggatggcacggtggtgtctcagatggttcctaagcacttggtacgcaacatccagtcgaatcttcataactaccaaggaggtaacttgagctatcaatatcagcctccttccccgcaagcccaatatcagccggggggattggctcagccccagttcgcacctcagtttggtcaagtcgagcccatgcagcaacaaccacaaggagcagctcagcaacgaccatgggccgatgtgatcgcctgtcgcgaccgagaaaatttgcattttcccgaacgctagtgtattaatccccgtcccaggaaaagctggggtacaccacacaaacatgatacaaacggcacatctttattatatcgataatatttacattattacaaaggcacttcaagcctgacaatcaaaaataaacagcagcggactagcgggccaacggctccatcttcacaggcgctcaactggggtataagccaggactccacctaagacttcttctccaaagcttctcttactgaagggggggaagatagagcaagaatgagtacaaccacagtactcagcaagtcacaccgggagatgcatgattaatgcaagggaaacaaggggtaataatataggggattaggttttgcagtaaacagcatttaaaagacacttagttgcccatagctattttataaagacgatcctagagctacacagtattattaatcaaggccgtggacccacacgaacctgccttaacccaaggcctacgatgattcagaccaaactggcaacccgacctaggtcccagctcgtcccaagccaacccaggccaacctttccaccttttagttgttaagcaatttttaagaattaaaccactaacttgggtacattgctaggcttgcccatatccgagggcacggctattcgaatagatttactctgatcagaggtgtacatctttacccacaagacacatctttactccgcattccatggccttggaacccgtcgtaaacatgtgacataacccttcacccatcctagccgtaaacaaaagtaccgacccaaccctgcctacggccgatatcccgggacaggcaggccaggattgagcccctagcaacaggatctagaccgggtgcgccacacccataggggtgagaccacccgtgtactagtccagtgccatggcatctcgactaacgggcaccgacccgtgtagtcttcatttgcctagacatctcgattaccgagccgcagctcgtgtagccttcatttgcctcagagatatccatcgtcgcaacgacttcatccatctctatccgtgtctttttgttcaggactagactgagcaccgagttaagccttacccattagacatgtggttatagtgctttgcaacagaggcccgaagaccggtccttatagtggccgaggtgctactagcaaaaccctgcacctcgagcccaacctaaaaccattttggggttttgaatagaggggggaggtgtgtgttcaattccatcacaagccaaccattccacagtgtccaaatgatatgagaattcccaaagtctaaagttataaaaccacctaatgttgcctaattagtcagcgaagcatctacctagattcatactagtggaactgttaatagagtacccactagttggggttttgtttatcctagggtgaacaaggtaataataaacaatagcaatgataaggctataacaaggattaataggaagtgctaaataaaacagtgattacgcgggaatttaaataaagcggtaatgcaataatttaaatcaaaataattttgtaaagtgggattcaatatgctcaagggtgatgtgacttgccttgctcagagagaacagccttccgaaccttcggcgacgaccgcaaaccacgcttcgagaaccttcggaacgacagaagctacgcgaagcacacaagcaaagctacaagcctat

SEQ ID NO: 65406 - DNA, 579 bp, Oryza sativa
tggctaccatcacggccggtcgatgtcagagcagcgagatgaattgtttgtactcgtacttgaccagattaataacaaagataatttagctacaatcatggatagagaatcttgtttaacaaaatatgataggcgaccagtagatgtacactgcagcccatagcaattcaaaaatctccgtttaattgacgagcgtgcgagcgtgggaggggaccggtggtctccaggccgttggttggttggttggttatggttgatgagcgatcgggccaaccccaacatggagacgctggactgcacgagcgtcgcagtggacggtgtggtgccgcaacgaggggatcgaacgaatcaacgaatgatcgaaatcctctcggaatcggtagcatctctttaaaagcgacgctctatcggttagtaattaaacatatttatcatttaaactactaggtattgatattaatatgatgcagaaagaattaaaaaaacagattttaaaaatagtctaaaacggtacaccttatacgaaaacgacgctcggtcaatcaggaatttcatcttaaacgaaccatatgtaagcca

SEQ ID NO: 65407 - DNA, 1254 bp, Oryza sativa
taactaatgactcactataatttaatgatggcttaatgatagttcacgatggttaatcgtgattagttaattaattaatgtgctaactaaaacctgataatggtgggttgtgagcacatggttttgttggtcgtgctcatgacaattaaggaccggttcacgagtttcggttgtgaaacattaaccgtgccaaccacaagctagcgtgggcaacggctttatcttttgtatagcatggttcattgcagagcaccaggttgagaagtggcggagataagcccacgggggtcgctggggagtccattacctctggttttgagggggagattatgatccaggaacggtgcactgtagtggattgtgttgtgcgagaggtaatgtcacagctcctttccgaggtaccgtggtggtactaaggcacatggtgacatgatgtggggctgtgtcttgtgggtacagtggtacacctctgatcagagtaaaactattcgaatagccgtgcccgcggttatgggcgggtctaacaatgtttttcgtgattagtctcacatttctcaccatagtaaatgatgctttatttggttataatttgtttagctcctggtttggaatggttaattcctggtttgaagattagatctgttcagccgggaatggttgttcagaatggttgggcctatacaacagggtatgttgtatagcgttggtttaatattgtttaatacttcactgttttattaaattctcaaatgtttactaaatgctgcttttgcaaaataaaaccctattatgccatcttcgggtatccttgtgcacttgcatatttgctgcgtgacttgctgagtatgtcatatactcaccttgcaatcattcatcagaggaagagttctacaatgaggctgatggtgtggaggattaggtgtagccttggtcaagctgcctgtggagtggagccgtccgcgccgtttattttattttccgctgcttagatctttattgattgagaggaactatctacctctgtaataatattttattcgtttaaattagagtattaattgtactctattatcaatttgttattgtgtgcctcggctgattcctggacgagggttcacacacatgtaagcgtttggaattttggatagaaattccgggcgtgacaagttggtatcagagcttccttgaccctaggttatgccaaatggttacccatagaagccctctaaaaatgttggaaaaatagaactgttc

SEQ ID NO: 65408 - DNA, 18704 bp, Oryza sativa
ggggtccctctctgcgccgaggtctccaccagggttcctctccgcaccgaggttgccgccgttagatccagtggcacgacgggcggcgacgctagatgcagtgatgggcggtggagatggatgtggcgcaaagggaggagaggatgagagagagagagagagagaggataaggatggagcagatgcgcgaggacttggtggggttaagtagtggctcgtttcaggttttttgaggtgtcggttctctaagaaccgatacctacaatatattattatagttgttgaaaggtgttggttttgtattttttttcttcccatggaggtgagaacggtcaataggtgttggtattatgagctggtatgtatgagggtttaataggtgttggtattatgagctggtatgtatgagggttttttttaagtagtgttggcaacttggcataaaaggtgaacgagaatttattttccctgctttcacatggaaacaactgaacacacaaacaatgtagggggtgtttagatcttgggggtgtttacatccaggggtgtaaagttttggcgtgtcacatcgggtattatatagggtgttgcatggggtgttcgggcactaataaaaaaactaattacataatccgtcagtaaatcgcgagtcgaatttattaagcctaattaatccgtcattagcaaatgtttactgtagcaccacattgtcaaatcatggagcaattagacttaaaagattcatctcacaaattagtcacaatctgtcaattaattattgttttatcctctatttaatacttcatgctgatgttcaaacgttccatgtgataggatgtaaaattttagggtgggctctaacccgggccgtaatcttctgcccagtggatacagttcagtcagtgtgatcattatgcttgtatggactacaaggcacgctgagaactgggctgctggtatcgcaatggttacagtatggttcagccaccaggcataaccgattctttgttgatgtgggagtctcgccaaatgtcctacaaatgaaagtgcgtgtgcttgaagagagatcaaatttgaaaagtgacaagacagcgttggatttctcgggtagagaaaggttctttcctctgtttttttacaaaaatatcaggtttttcccttttctggaaaattaacttgggggcgagagaagccagaactctcgacctcaggatatctccttaacgttcggcagcagcacattgtgtgaaagttatttcgttttccgcgagcacgttttccaaattactaaatggtgtgtttttttaaaaaaaaatttctatatgaaagttgtttcaaaaaatcatattgatacagttttaatttttaaaataatttatatttaattaattatgcgctaatggctcacctcgttttacgtatcttctcaatcttctcttctctcctctcaaactcaatgttccaaatagtaagagagattgagcctcattgatcacggggtttacaatatatatgggggagagaggcatgttggcaggagtgcgtgagggcctgaagacgtggggcaccaccgtgccccggagttggttgccgatccatccatatatatggatgagatcatatatcttgtttcataatagattcaatctattttcatccctacacatatttttttattgaaagtctatctagcagcttgaactttgaaatgagatatccagccctccgaactactatataatatcgtttatattgcaccctagtgtagtttttacaaaatgatttttatctaatttacatatatgttggattagtttaactaggtgacatatgcattggaatttggacatatgtgttaaaatcatcagcgaaatcttctgtttccccaactttttgctcttaattgcttacaaaagaatgcccatataattctagtatgacaatactatggagtataaattggtcacatgtgatttgacgatatgtaaacatgctacattagttatttaaaactgctgatttaaggttccaaatacccaaaactactatccaaaagccactatactatatgattgacgatatgcaaacatactacattagttagcagtgttctttccgcgcccgctttttaaactgctaaatggtatgttttttgtaaaaattttctatacgaatgttacgttaaaaaaatcatattaatctattttttaaaaaagttattaaacaattaattaatcaaagaaaatgcgttgttccgttttacgtgcgcaggaggtgagttccaaacttcacctccctaacacagcctatttttttacgatgctagataaacttttatcaagtatatgtggtacatagactttttcctttttaggctgagctaaacaagtacttactcgccagtgtagaaaaattatttggcatggtctgaatttcgtgaatatcggcgatttttcatcatgtccaaacagttgggcgaacaaattttttgcggaaccctaagaactactggctactgtcaacttgccaattgagctatggagatggggaagaagtgaaattagcttccgttaagaaaagacaaaaaaactaaaaagcaaatctgtttgttccatgtcaacgttcacaaacattcataagcaggcaccatgctaactcttgcctgtacaaaaacaatgctagctgccgcttcaacgcaggaagaaacgcaaatccacgacgctcagaaccttgaacccgttcaggctgcaacccatcacaagcctcggcttcttcggcgccggtgggcagtgcagagcaccttcaagtcctcctcctcctccacagagagctgttggcgtcgaagctgctgcttcttcttcctcctctgaacggggccgcttcgtcttcgcgggatgtagggttacagcttgcgcctcctggatggttctcttggctagaattttgattttcctctgcaaacccatgttttcctgatgaacccctgagcattgaacagaactagagattggtcagctagctctcagacttgagggtgatgtgaacaatcaaaacaaaacaataggagaaagagttgtgcatactagcagcagcagcagcctaggctcgtcggagatgtccacgggagggaatggatatgacagaacgacagtgcgatgtgcatgcttataagcagttcagtaaaggaagcaggaaagatccttgcaaggggctggaaaaggaagaaacaggaacgctagatacagtaaatgccagtgcacaaggaggcagagggctgagatcaagcaatttaggaatctgaggaagttgcaaacgagatgaaaaggaggaacccatcagttcatttgcgctaaaacttgtcttctttcaataacagtaaggaaagattaccaggatgcaaaggaaagaggaaagtgcttaatttgcgagaggacggagggaagttagtactgaggggcacgtgagcatgagcaaaagtgagcaagaaagagaataaaaggaaaaaacaaagagaaaaagaatagctttgtctttgctgcaaaaagaagattgaaggccgctaggtatatgcaaaaagccaaccagttataattatccatatttttggtgtgttttggaggaatcagctcgatactttaaagttaaatgcaaactttttgagctattaaatgatacttttcaattcaactcatcttttcttttcttcttttttttttttgacaaaaggcatacacgacccagctttactgaagccataccgggttctgatacaactacacgctggagactcaacacagcatagctcgcttagaacaaaacagaaccgtctatatctaagaaatgccatcgatgaatacaacttccgggaaatgccatcgtacgaatcaacctctcccaaaaatgccatcaccatcactactcccttagctatactccgttggacatggtgaaaagaccatttgccccatgtgaatgctacataatgtatctgcaaaactattgtatgatactttggtaaagagtggattttctcttgtaatatttgcaccaggtaatattcttactaaaactaaaaatgagacattatgatattttcaattttcacacacatgtaatagtagcacaattatataggaactcattttcgagttctagaccaaaatttgtctaaatttattgaatgtcaggaactaaagggaatggccaaatacctaggcatgaactcacatgaacaccactatgctcagaacagcacaagcagaactctaaaaaagtgaaccttgaaaaaaacaggacttcacatcaagataaaatcattacaaacatcaataatcatatattcataattgaatcattacaaatcaacacatttcagtgggtaaatggacctataccaatttttgtcaatgacaatagaaacttggatttcctcacttctggataatatatcgcagatgaccaccttcagggaccacagtgctgtcgcctgcgtcccccgtatcactacctgggagtgaggcgccaccgcctccagcctcacttccaccgccggttggagtggccctacctcctcctcgggcccatgcaccattgtctggggccaccctagcacctccttgcgcccccatgccgccgcctaggagcgcagcatcgcagcctcgcccccccccccacgccaccgcccaacgtagccctggctgggagacccacgccgccgtcgccgtgaggattcaccccaccgctgccatcattggtcgggagcgccgcggtgccgccgggatccaatcagcttcctcctagatcggggctagggttaggtgttgtttccattttgtcgaatttgtctttactaggtaaaaagaaataaaggatagagtaagtatagtatgtactgagggcactttgggcttttctaaaaaaaaataaataggtgtaacggagtggaattaacagaaaccaaacggtagtggcatttttgggagaagttaattcgtacgatggcattttctagaagttgcgttcgtcaatggcatttcttcgattaggacacttgtcaattgcatttcatggattttctcgagaaagaacagcgaactattctttttatcgcagtccaagcacaagagatgaaattgccaccattgtcatcttccgtggagaatatgggtacccggtacccatacggtctgcatatccgactatagataggaggtgggctggattcatgtattatataactagaaaagatgcccgtgcattacaacgggttgagccaatttaatttgtacatgtgtcggcggccattgtttcgtttattcatgtgcttatcggaatcacttacaacaaaataaaagactatttgtgtgcaaatctctcatacacaagttcttagcgactcaaaagcaaatactgtaaaataaagtacgataaaaaaaccaaaaagtcaaatttaaaattacgttctaaaatttaaaacttggcttataggaataagcataagccaaacaatgaggccttcaaacacgagctcgatttgttgcccagctttatctcaagtcgggcaggaattgatgacggatggaatcagcaacttcgatcatactctatttcggttggcgtgttcttttcaaaagtaaaactgattctggattattgtaacggtatctctggtagtacgtacgagcatgtgtggagagtgacttgaaatcatgctaacatgtcccaggaaccgtgtcgtgtaatatgaatagaattggataatctgggcaacggcgtatgtgatatccacatggactctacgacacggactttctttcgcagttcgctcgcgagtcatgacttcgcaatgaatgttacacgtaacggaatcagatacaggcgacgtaccatagttttcacaaaaaagaaaaaaaattttaaatcacgggtgagggcgacgcagtcccaatcggacatacggcaaaggcaaatcatgcgcgcgagggcgttgccgtgcaaaggcgcctgtggaaatattctcaggcacgggcccgattgccgtgtgtggcaaggggcgcgtgaaatgctacgggcctaattaatttgcacgcatcttagataagagggacactctggcgtaagaaaaaaggaaaggatttgacataaatataaaattctagcaaaaaaatcttcaatttttataatagtagagatagagataaagtatggctcggtcacaatgttgccttgtgttctattgtaggacctagagtcccgattgagtactaccatgtaatagattagcaaactgtatcgtgtccggctaggtttttctctttaatttgtatccctgcccctaacctatataaggtgagtagggagaccttaaagggtatagcaacataagccacagtcagatcatcggaccaatacaatccccaaacaaaagtaatgtattacctcttattcagagagcctgaacttgtctaaactctcgtctttcgcatctatccacttttaggtctcgtgccctacccccttatcattgtcaatttccaaaatcgatagtttggcacgttaggtagcggtcgcgtcgagtttgttgtcgagaagtgcgatagaatcaacttctagagaagtgttgagatcaatctcaacgagtttgatggctcaaatctctaacctgggtttgtcattccaatctaacttctattagattgatatctaaaggtagattgatctcctgttactttcttgttttcaaatgctagctgagatcgagatgagtggtcgtcatcccagtgcgtcagcccgacgtgctccttgatgcactcaatgcacacgccggtgcgggtcacgctcatcatgggaacaaggcaggtctacgggttgtgtccacaacctattaacgttaatcgcacgcggagccgccggcaaccacgatttaactcgtgtgcatgtgtaattcaaccggcatgcatgacttaatcacacacaatacattgatatatgaagcatctatatctttcagcttactgacggattgattttcatgattgctttgttttgcatgtatgacgattcaatcacctgataagatcgatcaacccacctccatccgagctatacatgtgttgataaccaaatttgacacgggtcatgttatagctagtttgagccaaatttagaacggaattgctaactatcgtttgactgatttatgagccttccatcattcgcatttttgccgtaggatatggtttttgagatccgtgctagcatctagctgctaattaactaggtccacgttgctaattaactaggtccacgttactgttccctgttgttaaactagccgtacgtgtttttcaatgctaatttatttatgatcccacgcgtactaattacatcgtacttacactataattatatattaattacatatgtaattttagtgtatttacgatgtaagtctgaaaattacatatataattttagtgtatttacgatgtaagtttgaaatctacttgagcccatttgagccccatgagcttcagattgtccacgtggctcgtttgtttgttttttgtattttgtttgtgcatattaatgtcatccgttagatgttgatttaaagggtaagaaatgtgcatcataggaggctaaaaaatctgtcacatgatctataggcagtaaccaaatttgacacgggtcatgttatagctagtttgagccaaatttggaaactaccaagtcattcccgcgaaggccagtctaaccgccgtagtgtggctggtcagaccggacaatgagctgtgatcagaccgccgggtggtcagaccttcagcatagagtcagagtccaatttaggtatttctcgtatttccttgttttagatcggtgttggtatttcttaacgtcacaaatgcagcacttcacctgggattattcttaggtatcgatttccacaggcaacgggtattacttccttatcaggttcacccaaggacaccaagctaagatgcgcaaaggatagagaggatttcctagtgagaaacattgtctaaggaaagtttaattttaatcctaacgcgataattcagacactggcaacccgctgttcctagatgtcgctctactacataccctgacagggaggacttaagtgctcttgagggctgtcaccacctctacacccacctcaaacgtactgtgggatacacaacaattactggatataaattacctaaacaccacgtctgagcaattaatatctactttagtgtttctaactcactaaagcaatcactatattttagtcgattatagtgaacaataattcttataagaggtaattctcacaagtactcacaagtaaatctaaattactcagaaagatatttctattgaaaacagagtaattaacagaataaaataaacatgagaggattaccgacatctccgaaattcctccgacttcttctactctactctcttcctaattctagtatacaaaatagtacaacagagcctcttataattcagctcaagcttggaagtgtgtgaagaagtgaatgagtgaagctccttaaataggcagttaatgacggttgtggaacgggaattgtccaaagtgccctccaaccgccattaggatcaaatcaggagcatcccttccaaaccccaggatcaacggtggagatcagggttctgggctggcccatctggccctcaattttggcctgtggactcctcctgttctgccttatccattactgcgagttttgggctgattctctggtattttagtgaagtctaaagcccctcccttgtatggatatgttccttcttcactttagtctgattttcctcccaacttcggtggtttaggacctgcatcaattaaacacgaacactcgtggaatatgttagaattaacacctaccactatattggatgttttattatctgagttttatgcaaatgctggcggtataaaaatgtgtatttaatagccgccaacaatagggatttctcgagtcctagttgatttctaagcctaattggacgtgggaaagaccatgggaagtaagtccacccctaatataaatataagggggacaagttcgattgaaacaataaccactcaatcgtcaaaatcaatttagttatccaaaccctctatattctacatctccctccttgcttccaatcccaagtaaattctccccaaatcccctaattgctcgccgcctctcgtctctacggtgttaaaggacatcctagctggcctgccgagtctagcacaaactagagcgcattcaccctaacggggtccctcctgggtgtgtgttcggcagcctctacccacaccctacagcggcgcgtctccgggtgattccgtgggttgcacataacatgctcaagttgtggcggcgcgattctacatcaacaacatgcacatgcgtgatctacctgtacaggtacacatcaaccagtgactgttctagccagaatccacaaagcatagatgttaacaacaaaatttggtaagatacgtggacataaggatggatccgaagcggatttgaaggagttagtttggtttccaaaatgaaacaatgcatctgctggagtctgtatcagtcgatatagagttggatttgattagtcgatacatatgatttcgagttcatgatgagttcggattgaggattcagaattattgccatacaaggatagagtctaaagaagcaattgcatctattaattaggataagagtaagctttcctttttgtgttttagaaatctatattagcatccacaatgggctggtgtgtttattttgtgaagtttgaatcgtgtccgatatgaacaagttttgtactacgagtataaatatatgcccagggtcttgtatgaagaacaacaacagttcaatatactctcagcgcatcgccaaactttttgttttcaattttctcaatgagttcttgtttcgagttggggcatcttcttcgatcttccgatgagaggtatgacttgtcacagtagtttgcatcggtggattagtataacgttttaaatgttctaatctatctattgtagctgctggttatcagttatcttagtgttaacaatggaattttgcatcagattcaaaaaggaagagatgaagttctcaaatttgacttctatggacaacctgcttaaatgaaaaatggcagtattgttatagcagccaccattagaagcacaaacacatcacgggttggtgcttggcgtggccggtgatgacggaattgtggcgagatcaatatatgtttgtgatcagtaggattaattagtttagggaacggaatttcgtggcaagatcaatatgtttagaacaatcaatgtaatagtaatttagttactaagagataatatgttgagaacatgtaatagtaacttggttactaagagaaattttgtggcaagatgaatatgttatgttgagaaccatcggtgtaatattaatttatttactaagtgaaattttgtggcaagataaatatttaatgttgagaaccatcgatgtaatagtaatttgtttactaagagaaataatatcaaataggcccaaccatcacactactgggctgatggatcaacaggcaacacaccgaccaaaaactgggccggttgggcctaactagggttggctgttggctcccccttgcacgtggatgcctaggatcccttccaatgacggttgcggggtatttacgaccattccaaccaccacaaccgtcattggtagctattgacagtcgttatcgatcagttttgaccgttaatattaccaaaatagaggataactaatgatgcttgcaatgcataaatgtattagaataataaacttccactagtattaggcatgctaacctcttgcagggaatgacactaaagtggaggagaatcgacatcaactcaaacgataaatcaatcagacgatgtcgagaaccagacgtatgtatgaatgggccaagaactcagaattgacacgacaaactgggccaaaattcacaagtctgaggagaagaacaacggagaaggccgctagccgaaattgggctagattgggccggccccaagttcggctgaacctggtggttcggccgaacctcccgcagctccgtttgatccagggttctcctggacggctgagatggctccccagtggcggttggagggtattaccgaccattccaacagtcacaaccgtcattgggaggctataaaaggagctctcatcctcacttcactcacacacctcaagcaatagctctctcatttctctcaagtttagtttagtagtatctagctggtggaataggaatagagtagaaatcaggagtctggaagccttcggaagactttgggtatggctctaacagctttcctttcctcttttgtaagctttgtacttttattagaatactcttctatatacatttatggtattgaaatactttccgagtatatgagtacctactttacattatgttcatgttatactaaatatacgtctagcttatctgggagatgctttggtgcgggtataatgtttgcatatacaattactctatgtcatgatgatgatattaaagtagtatctgatagtttagacgtggtgtctagattacaaggtatcattatttggggctatatattgcggatgagaggtgggccactgatggtgacagctcagtacgggtattcctccgcgccggtatataatcctaagttaatttcctggggagggtattcctccgtatttagccccggttgtatggtcatgacgggctatcgtaaggaactcagcagtcaggggtggcttctcgaagtaccaggagagcatcggatagagggtattagctagtatatcagttaactagaatgtatgtatactatgtatattagaagtataggaatatattttctttgtcttttctttccacctagcttagataatttattatgaggatgagtagtaatgcttgtgtatcactctactcttgtattatcttaacccctacttagaatatgattatcacaaagtaatatataaactattagttaagctctctctacattatcttcccacgggataaaataaatacgatacccttggaatactctcgggtaaaatgctaaaatggtatatccatgcgcttgcggatgaactctgtaaccataatatactagaagtatttctgcgccattgctgggaattatatttctagtaatgtcattaagaaataccaacaagcatttctggcgtcgttgccggggaagattcataatagagattacttgaactaatactttatatttacatctatataatcatttcctttgcaggctaaccttggttgttttcactttttgttgtgaaaacagggtagtgcatgacaggtttcaacctgccggaaaacttcaaagaaaatccagaagctttcttccgagcgtcaggccgcgagtcgttgcttcgcagaaaactctaccaacggagaaaccagccctaccagtgccaccgaccttcaagactatggccagcaagactcttcgcgagttcgctgctccctctgctgacaatgtggccattgggccgcaggtcaacataggggacgtggattttgacttgaagtccagcctcatgacgatggcacaggctagcccgttctatggcaagcctaatgaggatgccaatgctcatctgcaacagttcctggagatctgtagcacgtacaccattaagggtgtcagtcccgacgtcgtcaggttgcggctatttccgttctcccttctcgggagagcaaagtagtgattttatgccaaccatgctgctgtcaacacctgggacaaatgctctacggcattcctctcgaaattcttcccgacgggcaaaaccaatgcccttcatggaaggatttccagtttccagcagacaagggacgagtctattcccgaagcatgggaatgactgcaggagtacgtggccgcctgtcctcatcatgggatggacgactggctgatcctgcagaatttttacaatggactcaccccaatgtcccgcgatcacctggacgctacggctggaggagccttcttttctaaaacggttcaaggagtcgttgaactgatagagaagatggtctccaatatgggttggagcgaggaacgactccagacccgtcagcgaggcatacacaccgtcaaggagacagagctacttgctgccaagctggacctcctcatgaaacgcttggacgaccatgagaaaaggccacaaggcaccgtcaaggccttggactcacacgtcacgtgtgaggtctgcggcggcacgggtcattctgggaatgactgcccggaaacccgtgaggaggcgatgtacatgggcaacaacaacgggtaccgtccacaaggaggtcaggggtggaaccaaccacgcccatattatcaaggaggtaacaataacggtaacttctctaaccagccctccctgaaggatctcatttttgcgcaagcttaaaccactgatggattaagcaaaaaacttgctgccaatgataaggtcctagagaacattaatgtcaagttagatggctttgcttctgcctttcaaaatcagctgagctttaacaaaatgacataaacccagttagctcagttagcatctttagtccctgcaaatgaaactgggaggattccgaggcaacccgactcctccattgaaaatgtcaaggcgatcacgacgaggggaggtaagtccactcgtgatccgccatatcctaaccctgcaggaactaatgggatgtcaaaagaagcgccatctaatgactcggctgacaaggagattcagccagaaaagaccgtgctgcaggaatactgtgacacacggttgctgccgtttccccaacggatgaggaaaccgtcagtggacgagcagttcgctcgttttgttgaagtgatccagaagatccacatcaacgtgtcgttgttggacgctatacaagtgccgacatatgcccgttatctcaaagatatactcaacaacaagagactgctcccaacaatggaggtggtcaagctaacggaacaatgcagcaacgtcatactccataagctcccggaaaagaagaaagatctggggtgtcctacgatcacctgctcgatcggggcacaacaattcgaccaggccttatgtgaccttggagccagcatcagcgtcatgccaaaagacgtcttcgacaagctcaacttcacggtgttggcactaacactgatgtacctccaattggctgactcatcagtccgttacccggtagggatagcagaggatgtgccagtcaagatacgggacttcttcatcccggttgattttgtggtgctagacatggacacggggaaggagacgccactcatcctggggcgtccattccttagcaccgcaggatccaacatcgatgtgggaacgagtagtatccgtttccatatcaatggcaaggaggaaagatttgagtttcaaccaaggacggaacaatgctccatggtcagaataaagtacgggtcgaacccgcagaatattcaagtggttaaagtggagccacccaaaacggacagcctggtgaaatttatgcagaacttcctggagaaggaaacaacgatgcccaggaaccgttattggaaaacgccggtaaaatcacccgtaccggccaagaagttagagcaaccggctcagaagaagccgtcttccgcaccaaaaccaaagaaggtgtggaaggaaaaccaaagacgcccgctccatcacctccggagacgggtggaaaatccgcgcactgaaccgaaaggagggacggtcttgcacgtcggacctaaaatgatgcgaccttcatcaaaaggtaaattggtatgtatccgcatatttgctttcaacaatttgaattcttgcatcatcacatatttgaatttcaaaatgcatttaggctttttgaattttgaggaaattcttcaaatgaatttttcagagcaaaccaaaataaaattttcaacgaaaatttactgtgccacgaccacactgatcgttggaatccaacggccaaaagtggggctggttgggcccaccaggggttcggccgaacaccctggttcggccgaaccggccaggcaacggctccctgccacttttggcagggtaacggctagtaggtcccacatgtcatttctgaccgttgtgggcaccctataaaagccagtcggctgggagagggaattccatcccatttcaacacattttcattcccgctccaaagtttgctctcaagttcattcaagctttgatagtttccctcaaattcaaaaatttagttgcatatatatacaagttgctttggtgaaactaactggcaggtgaaattcttgtcacttctaacccccgccgagttagtccacttttgctccattgtgcagtatgaggaggcgactgtctcgtctattcaaagggtccggctcttcatcaagtcatcatgatgagtctagtactcgttcatcagctgatgtcttgatggaagacgccaaagttccgcgatgactcctgaacgacaccgacctcgaccttgtcagtgatcgggagagacaagcctactacatgctgagcgaccgggagtatgctcacacgcgagaatactcttcggagttgctaaaaaagataggtatggatgttgaattttgttctatctggaaagtttttggttggaagagatttgctgtggtagatgagcctggttctcatttgcttactttgcaatttctgtgcacttgaaagaaatagaatatggtatttcttttcacttttttcgtaaggagttcacactcacatggaaaggcttgagtacacttcttggatttcacaattcctataaaatcgatctccggaaaggaatttctgggttcgagaaaaataggttttgggaagacatttctggtgcttcaatttgcaagaaacctagaacgaatgatatccataatcctacacttaggctcatgtacaaatggattgctatgactttgtttcctagaggtgatctgatacccattaggggatgaattaattatcatgtttgccatggttagaaaaatcaaaattgctcctgtgaaatgtatgataaggcaatggttagaaagtataaagttctctgctcctgtttagtgcacttctctgattactcggatagcaaaagggctaggggtcgttagcgaccaaattgcttttatctcagccgctcgtccgcgtattgatgaggcttatctagtgcaagggcatattgtgaaacatggagcagatggatctttgatatactttttccccggttgtacaaatgaaatcccgttgccaaatgcggggtatcatttgtacaactgccatgaagtaaccattcccctgcagaccatagaagaatctcgtgcaggtggaacatacagggagacgcgcaacatgacaaggaatgagcaagaaagttcatcatcctcaacacccgtgcagatgtatgatgcaggttgggcaccaactgggatgcacccgggtggacccaagctccacgccatagcatcggaatctcaacctggacaagcgccagtgaggaccggtggcatgcgcctcatgacatccaatggggggacaatcaacctcccagatcaagtggtgtgcctccatctccaagtgaatggcgctcgagttcctctcgttgggacttgggtgaaatcactaagagaatggacacccttgatatgcagacgggggagatccagtacaacctcacggaacacatagctcaaacgcaagaatggcaacaatctgctaatgctcagttcgccaacaacaacaacatgatgcagcaaaagcacgatgaccttcaagcgtacttccgttttcgggggttcaatccttatcaaggaccctgagcgaaagccaagcttggggggagacatcgctcccccctattgaggtaacttgtatcacattgcatatttccctttccaattgcattttataaaacttgaaaacaacataaaaatttgcaaaatataaaataccaaaaagataggataggtttgagtcaagctaggtaagacaagctagttctctttgttgaaatgataaatagttgctctattttatatctctgatatatgggttcttggtaaatactctctcaaaggttaaatataagtagccaacaattatccgggaacctcaggtaaatgggctgcacttgctgatctaagtctaggttgttgtgagatatgagatagtaaataagagttactatgatcctgatactagtttgacttgaattccggatgttttgtttttcaaactaataaatttgaaagttcctcatttgatataaattcctaccagagccaaaaatatgctatcatgattaaaccatatacattttggttgcttgtcattccattgaactctatcaaactcttgtgacttgtgtagatacttctcatgctctatgatcaaggtcatacacccacatatatgcatatgccaaactcctacactgggagctaagcaatattccattccatttccatattaccatcaaaataaattctccatgctttcatgtgctttcttctcctaaagaaaataatatactttttgaaaaaaaaagagagaaggagggaaaggcatggttatgaaagaaaaaaaaataaagttatgctccatcaagcatgagcatgattgaaaaaaaataatatagccatgccctctcctaatcaataaaagaaggatttttgggagaagaaagtaagcgcaaaggagaagcattttctttatttttttattcatgtgccattccaccatataccacacacacattatgcacgatcttgatcttgagtatgtttagttatctgctctagtctaagtttttgacttagtaataaatgtgaatgcaagtatgccatgtttgatccctaccgagctctacatataaaaccttagagtaggaatcaacaagacaacatttggtgaggaattcatgttgatacactaagagagactgagtgaatcatttgaggaacttggttttctttttgcaaaatcatttgaaaacttccggaataagagttgaatataaagatcgggtgattggtactctaaattgctgttcaatctttcaaccgcccaaggcaaggaaaagcagtgtctcgtgggaatcaggggtaagggtaagccaccgtgccaaaaattatttaatctgagagagagtacatataccttgcacctgtatctttgagatatgcagcatagtagcaactcctgatcaacaaccaagtctttgattcctttcgtccttcactcgggacgagcaaaggtccaagcttggggggttttgttgacggtcgttatagatcagttttgaccgtcaatattaccaaaatagaggagaactagtgatgcttgcaatgcataaatgtattagaataataaacttccactagtatttgcagggaatgacactaaagtggaggagatgctttggtgcgggtataatgtttgcatatgcaattactctatgtcatgtcgatgacattaaagtagtatctggtagtttagacgtggtgtctagattatgaggtatcattatttggggttata

SEQ ID NO: 65409 - DNA, 26067 bp, Oryza sativa
ctccaccatctcgctgctagcaattgtggcagttacctccatcaatgatcatgcagcaagaacgctctttgatgacgtacattgtttggacaatgtgtgtcagtgattttgctccgccttctccatttgtgcactgaggacacgctgcacaatgaggttctcatagtgctctgcatcattagccctaatatgctcttctggcggctcctcattatttgcatggtcagctgcaagcaaagcaagtgtatcctcatcgaaatcactagtagacaaatattcaccatcatttttgactaccaaaacatgcttgctagggtagtcacgctgcatgtgcccaaagcccttgcaatggtgacactgaacatctcttgttttacccgtggatgcaattgaagaagcactcgcggctagctaaacagcctttgtcgttgaacttgcaggagggccacgtggcttgttactggatggaggaggtgctgctcgactgggtgtgggtgtggaagatgaggaaggagtacggccggccggagaagtggtgcctgcctatcataatgtagatttacctgcacttccctttcagctttacaagcaagatgaaacaatcgagtcatattagtgtaatctttgtagtctacgatgtcataaatctcaccatttaaaccacccaaaaatctagccatagcagcgtcctcagtttcctctaaattacaacgaagcatgcccatttgtaattcctgataatattcccctatacttttcacaccctgtctcaattgttgcaacctattcaacaaatcacacgcaaagtaaggagcagatcatgcccgcatgacccgtttaaaagcatcccaagtttgtggcatgttattaggatttttcttgccatgttctattcaccaaaccgaagaaaaatcagtgaactaactagtaactttagaattctcaggaaaatcatgccatgcaaatttttggtcaacaacaatctcccaagaaaggtacgcatcgggatcatattttccatcaataggaggtatcttaaatttaattttagaaaaaaaaacatcatcattattgcgtaccttgcgttggcggtgaccacccatacctctatgattattgcgtagttgtcaacgatcaagagcatctcgatcatcttgtttagtgtcagcgtatattcatcctcaatgccgtcttcattacgtcgaccattacctctagcattgagatcatcaaaatgcctcacaagagcagcaaggctagtgttaatgcaagcgatcgatgtctccaaccctgtaagcttgatgttggtggcgatctgtgtggactccaattgtccattcttctcatttgtcacctgcaaatcagcatcaagtccttctttgtgctacttaacttgccttgtaaaatattttatgatgcctttggtgcgtggggaatgaaacgcaccctcctcatcattatcctctgaacatgccatggctaataaaacaaaggcaacaaaaacaacaaatgaggaaatataagccctacaactattgggatgtagcttttgcaagatgctcactctcagcctatcttacaagcccttaccaattcttaccttactcataggaggggacgtcaacccacaagtctgcaaccgtggaacgaggtgtatcggtgccgtagcaacaagacctatcaagttgtagtcaggtttgtggttgagttgtcaatgggctgaaagtaatgctcaagagaaaactagcaaccaagttagccaaatcaagttgaataatataatcgttcaaggtttgtacagtgctggtcacaggcccggtcctgtcaattcagtggcctggagcgaagctagaaaaatgggccctttaatacaactataataatataactatgtttctaataaatttaatgcataaaaaaacattcttataaaacaagttatatatcttaccttaaaattttcttctaacatgtaccgatgcgaagtcatcgacgatggcatcaatatcaatttcatctaatagtttcttctcgatgcataaagttgccaaaccatttaatctttcttgagacattacatgatttcactgtaaatttagaaaaaagtaagtaatttatgaaaattatgtcatactagattcaattcaacattataataaaaatgagtgctggcaaattacctagttgagaactaaagaaaataactattcactgccctagttgcacagctgcaccgcgactccgcgaggatccctaaatcctaaatcaaaatttcagaaatcagaagaggagcaattggggagtaacattttgcatcccaaaatttaaacatataaacttagcatacatcaaaggggagagcaatggggtacctcctggtctcctagaactgaacagagagtcagagagataagagatttgcatctggctaccggctgtcgtggtgccgctgacggcactgagcacgacaccggccgttgacgcatagccgcgcgcagtcgtcgacgtagctgaaacatggctggaacctgggagggtggcgaacagccgaacatgcgaagagtcaggcgattgcgagcgaaggcgaagcgatcggacggaatcacggaaggaagccaaatcgacgcaatttttttcctgtacatttgcttcttcctctcctgagctagtgggcttcttagttcctatgggctattatgtacagcatatatggggttgggccccttcacttcgtgggccctgtgtggaggcccagctcgacccccccgggccgggcctgactggtcctaggctagccgaagtagagacgtgagcctaaccacaaagaacatcacaagacacaaacctaaacaggaacgatgacagtggtgacaacaggaaatggcggaaggtgctgaggagagagatggaacttttatttttatttttttgatattttttcacagttaggagcacattggaaccaaccacataaattcttagctcaaacggacaaaatatgaagcatgtaaatttttttcaaagttctatctaaaggttttgcaaagcttctcgcctcaaaaacataattttgcaagtggaatttcgcgattttaattttgtcgagtgtggaatttggcgatgtaatttttttaggtagatgtccgtggatatattatgccaaatttcgagtccatatgaaaaagatacgactattttaagggagatcactcgaatcagggttctatttcctttaaggtagatcactcgaatcagggttctgtttcctttctggtggcagcaggctcaacgacaattaaactcaataaaaggaacatatcaaacacaaacagaaaggaatttggtggatggctgtgatggtgctgatgacgacaaaagtggtgatggcggcggtgatgaagatggcgatgtgcgtggtaagaacaagaaactctaatagactaagtgctaagaccaacaagttgacacaaccgatgcaatcgaaaactcaacaagccctaactaatctaattttttttggctttttctagactataggaaaaaaaataaacaacggagggtaaataatctctcactgatcaaccacgctctgataccacctgttgtgaacccgcgagggatttgtatcccaatctttcaataagaggcggagataactcgattggatgaagacgacgtttatggcccaactataaccgtccaaggacgttgcgccttagcaaccgatataccgtcaccaatggtcgtcacgaacttgtggtgcacgacaacccgacctagagggcactcgtatgccctgcaagcaatcgaagaacaagtagaactgctagatgaatatgaaagtttcactaggaaatcacaatatggcagggttccgaatagaagcagacgggcggtttcgccaacacgcgcgctgcaagcaggtagcaagttgctaactctgatcatcaaaaaccaattgttcttggcagtggctataaaggtataagaagagggggagaacaaccacatgggtgttggggttgtgctctaatcataggacgcgtccttaatggacccaacttgatacatagcctattgggcccaaataagttgacgcaatacctttgatagaaaaaggctcggtgataaagcgatgattgcggccactccagaattgatatggacatgaggccagatccatttcaaagtagacttgataagctttccatgaagtacttgcacgcccaaatcggagttcgtaggaagtcgtggcggtcgtcacaagttggagttgtcctgtagtttgaatccagcccgcgcgaatcctctcccttttgatcctctctatcattcctaagtaaaacaagagtgcacatgtctctgggggtataaataagatgaacatgaactcaagaatgaactcacctgatagttgagttgacgtgcacaagcgcaggtaatgttgatattgacgtgcacaagcgcaggtaatgttgatatttcttaacgacattactaggaaattaatcccaagcaatgttgccagagatattagacggtattcttatgggttatagaataaatcctcacggatataccactgtagcatttcaactggaaatatttccaagtatcgtatttatttaattccaagaaaagatatggtaagagagtactatgctataaattcatattacacttatataaaatcaaagtcttttgcaggagttaatcattttaggataaggataggttgacacacagaaggatcagtttagaatactcttgataattgataagtctaggctaagtggataaaaaaaaagaaaaatatcatttatgcacttctagtatatagtcattttagtatacatttgctattgtacaactttatggctaataccccctaactatgtcctcctaatatattgagaaaccaccccatattgccgaattccttactacaatccgtcatggctatccaaccggttaaagatatggaggagtacctgcaccaagaaccttcttagccctatatacgacgtggaggaatacccgtgctgagctatcaccatcagcggcctacctctacagatctgtggcatataacaccacttaataatatctaataatctaagcaccacacttacattactaaatattactctacacctctgcagatgacatagagcaaccatatgaatgaacactaagccaataccattgcatatctttggtaagctagccacatatttaatacgagtcaagtataaaccaaatttggtactcgaataattatacaagtatagtaaaggaccaaaactatataaagaaaaatatttcattaatggataaaatcttacaagagagggaagagatagtagaaccatacccgaattctccagaagacttgaagaactaaggaagactattctaattctgactctactagcactagagcaaaatatgtaaactaaaaagcttcttcacttgattccttgttggtgtgtgttggaatgaaggagatgaggtccttttatagcttgagaatgacggttggaggtgccaaaacaggtacaaccgtcattggaaggtcagtagtaaccgtcgttggcttgggcctaggccagcggagccaagcctgggtcggccgacgcctggcaggcctccctgggccagtccttccttctgaacgtctcctgatggatcctgggcccagtggtatggtggttggtcccatttgcaagtgtttcaataggtttgtgggcccatctatccatatgtctaccgcatgtcgacctctgattggtgattttccatcatttcttcttaatttatgaagtgatctcctgtatacaagtactttgtcaagtactagtggaaataggttatttctaaatgaatatgcatgcaagcatttctagttctccattatttccaacagtattgatggtcgaaattcgtctataatgaccgtcaacaggtaataggaccatgaggttgtagtcgtggagacgtggatgtatcgatggtgttgatgtcctcatcatgagagctcatggagctggagtcgccaccgggccgtcacacgagatccgccaccggggatgccgctcgagatccaccaccggtcggcagcgtagagatccaccactggggccgcctctcgaagcgaggaggaggatgactgtcacatcctgattttcgttttaggatttataaattatttaataaattattattagaatttatattaaatgttcattaatttacaagagaagttaaatgtgggaaataaaatttcctaaatataaagcatggacggatttattttttattaaattctccatggttaattatactctctggaattttctcggatttttcggagctcaattcctaattttaaccatacaaagaacatttcagtaattatccacatattaaattaatcattaaatggtctgattataattttgttaagtactttgagtgtccaagtattttcaggatttttcttgaaactatttgagcattggaagtatttttaacaattcaaagatcatttcagtgattattttaattggaaaaagtttttaaatcctctcctaagccgttgggctgatttcagcccaacatctctctccctcgcgcgcgtgctgtgcagcccaagtcggcccatccgagctcctcctctttctttctttgctttgttttcagccagcccaagacgaaaagtctaattctcctccctgctacagtgtcgtcttcaagcttggacagaagcccgagctgccgtcctgtgctctagccgacgccgcttcctccaccaaatccgccgcatcccgtgctccgtttgcaaaattagttgaggggaaatattcctcttatcctcctctatcctttcccccaagaatcggactttatcacgaagaaatcaacgcggaatcgaattcgttttcgagtttatctctccaactaaccctcggattttccggcttcgattcctctcggttggagtccgatctcttcaatccaagcctataaatagcatcccctagtcgtcctctttcgtttgccccatgtcccgagctctctcgtgccccgtagtgccgccgccgcgccacccaaaccgccgccgtcgccgccggcgaacagccgcctcgcgccgtcgttttagccgccgccgccgcctcctcacgtcgccgtcgggtgcgcgtggaagaggggaagctcggccgccccttcgccgtcaccaccggtcaccggagagccgccgccgccgcacaagctcgtcgccggtcgtcgttcgtcgcattggttagtaccggtgagatcgcgttgttctcctctacgcgtaggtaccctccaaaagtccggccgagtcttctagcgccggcgaggtcgtcgctgatgtcgagtcgacattgatgatgtcagcgatgacgtcattaatcccttttcttagttttctctattagatgaaaatcgattaaacttcggaaattaataactaaatcatcgtacctcggattcgagtggttcaagttgctaaatttttctaaaatcaagatctacatgttaaaaatatccacatgtactggttatgcttgtttttgtactattttgttgattttgttctttcgttttagtttccgacgttccggaggagagcgttttcgttgaggaaggttcggaagtgtttgcggaagctcaaggcaagtcacaaagatcccaaacaaccctttgagcatgttgaacccgtttaaagctattgtttgatttcaacttatgcattattttcgaatgtcatcgggtggtgagcctttcacaattaattaatggccgaagatggctttattttcctatgggttataatttgattagctagaaccttatatattggtttgggttcagctaaatgctatatatatataattgcttagccatgcttagaaacattagcacatgattgggataactaatgttacactatcacttatggttatatttaatggtagctcacgatggtcaatcgtgattggttaattaattattgccaattaaaatttgtcaatggtgggttgtgagcacatggttgtgaaggtcgtgctcatggcaattaaggaccgattcgcgagctactgttgtaaaacattaaccgtgccaaccacaagccagcataggcaacggctttaccttttgtatagcatgattcattgcggggcaccagactgagaagcggcgagaagtccgtgggggtcgctggggagtccatgcctctggttgtatttatagagggggtgattatgatccaggtatggtgcactgtggtgagttgtgttgtgcagagggtattgtcatagcctctattcgggtactttccagtatcgcgacgcatggtagacatgatgttgaggctgtgtcttgtaggtacagtggtacacctctggccagagtaaaactattcgaatagccgtgcccgcggttatgggcgagttgagcaatgtttttcgtgattagtctcacacatctcacaataattattgatgctataattggtaataatttgcttagctcctggtttggagttagatttgtacagccggggttggttgttcaggtttggttgggcctgtacagcattggggtgctgttcagtgttgattaaaattgatgattaattactctattgttttactactcttaaatctttgctaaatgctgcttttacaaatgagcctatattatgccatcctttggtatccttgtgcacttgcatatttgctgtgtggcttgttgagtatgtcatatgcttattcttgcaataatcaatcaacctcaattgaagaaaagggatccagaaggagaagacgtttggcttataccccagttgagctgcctgtgggaatggagctgaagtcatcgctagaccgttatttccgctgctgttttcttttcttttgtaagtatgtaacgttattattatgatggatttgtatattaaattgtcagtttgtgtacctcggctgattcctggacgagggttttatgcacaaataagttcggaaattactagtgaatttccggacgtggcaacgaccacgagtgggcctgccgctgctctactcgccgcttgccagagatgagcccgaggatgccgtcgatgctccacgtcgcgatggccccgacgttgctccacttggtgcttgccggagacgagactgccccgcccacactgtcggccttgatccacgtaggagaaagccaaccttgttttgcgccgtcggagttcaattcgctgatgccggagttcggtcccgccgccgaagctccaccgccaccgagcttggttgcatcattggaacttgatttgccgctggaggggaggggatggatggggaacgggagagggtagacggagatgggtggcgccgacggagatggagaggagagtaggcgatgaagctgggggcgatgttggtgaggcggcgaagatggagaggcgtcggcgtcttcgttgggacttgggaggggatgaggattaaatgcaattgggagcgagagaacggggtgagggggaggaaaaagtaagggatggctgacaagtgggtcagtgggcaggcatgattatgtgtgtagatcttttttttttgttgcagggtctgaaatataaaaaattggatggtttgttaatacaaaatataggaagggctgacatagaagaatttaagggctgagatgaaaaaaagttgttaggtggagcctccattgtggagctagtgtccatataggaacctcatcctatgtggcatagcgaggcatgattttgagtagattgtactgctattgtccttagggaatccacaatgtgagccacttctagagtgctgtagaggaactcagctcggaatggaggatacccctggatgggctcctcaaaatctgaaacaacttaatagagacactccaacccacaataggtatcacagcctacaaagccccatatttatttttactatcctacccctaatctctctctctcttgccccctcctttttttcgccaccgcactcgcctctccctctcgccgccgcctccaactcaggcccagcgcaccgctgcggtggccgacggcaagcggcgagaggcgggtggcatcctccctggccttctccgtcacgccatcgtcgccacccaccccagctctctctctctccggtggcggccgcaagggcgacgagtaggaccaccctcgccgccggagctttgtcgacgagggcgacgaggagagccgcctactccgccgcgaacccgttgcctccgccggggatccgccgttgccgccgctcgccgcgcgctctctctctctcgtcgctgctatttccggccgtagctcgagatcccgccgctccctctgccgatggctaagacgagcccggcagacggctgccgcacggtggccgactccgcccaccgcctctctctctcccgctagcagaggctgaggagacggcgcacctcggcggtgcccgaggaggagctcggctcagcggggtaggccgtctcgcgatgagaacggaggagaggagagagagggggagaggggtggaaggggaatatggtggtggagagacagtcgcctgaggcgtctgtcgccgcagcgcgtgcctctagcccgttccctagccgaaaaggaggaggcgcgtctcccaagcaggggtcgcgcgccatcaccagggcatggctcgaacggaaaagcgaacggccgtcgctggggcgggttgaagacacattgtagatggccttattcacccagtgaatagctaggagtaatttagaattatatatttgagaccaaaatatgatagcagaattagcggcgaggtccgaccttggaagtgagctgtttacacggtacagaccagtgacaccggatagtaggggaggcagtttgagacgttggatgcatttcaagggtggattttggggcactggacgcaagtcaatagtatccgagtgcagtacggcgtaggtggcctccgagtcgtcgcgcccggcctagggaaattgatctcccccgcatccccgtcccctcggcctcgactgcccacccgccgcctgcgccgatctccatctcgcgagggcgagtagcagcctgctgcttctgccgcatcctcgcaggccggtgagcaccctgctcgcgtcatcctctttttaatcccttatcttctctcctagatctggaagcttttctctccgccttagttccacaaacaatagatttgggggttcaactgaaccccatcatgcccccggttaggtcaaagattctgtctttggcgaattgggaggtgaattcatgggtgagccgacgagcttcgtcgtgatttcctattcaatttggggatcttctcgctgtttgacgtattggccgtatggcatatgcagaagtcgatgtgaattcattgcttctccaccttttacaacgatatcttgtgggctagattttttgtcgggctgggactagcttgtgtgtattcttgattttgtcttcaaagatgttatcctaaaggggtggacaaactgctttgcttttgtcgagaaatttggtcagtttattaactgggagttggttgaaattacacccaaagtctgccaacttttagtgagcgcagtttgtagaatctattatttacttggtcaagaagattgtgcctatacataaatagttactgctagttgagaaatcttttctacattcagttaagcttggatttggatgagatattacaatcttctgccaacaaaagacatagttttcagcatgttgtttttgttgtaaccagaatttctatactgtgaagatgtatgtacaacagaaaatttctcttatgccgcaaagctgcatgccatactcttatttgccacatgatttgttggctttgtaaaaatgccacaaagttcagttgtatactcgtttatctgccacactttaccattttaacccaccaaatgtgcaattttcccttcttctgcaccctctttctctcttctatgagtttgtgaatggagcttggccgcacgggctggtgcccactgtgtttggcccaacagaaaattatatcttaaaaatgtatgtctctctatgggcttttacacccaggcctaggacctaggtccgccactgcggccgggagcagggcgcgtggaactggctttcaggaggaaagccgtgcgcggagtaggtgggctgcacagagccagttgctgagggcaggacgcatattgttgtgctgctggcggccagaggcggaggtaatgctaaggttgaagctggctactggagctagggtgtcatagctcatgccgagctcaggtgcacggagatggcgtgcgcgttggacatgcaggagtggggcgtcggacgtgcaggagtgggctggctgccaggtctggctcaaactttggccggacagagctaggtctgtccttgctggacacagagaagaagggtggggataggacaaaaatggagaaggagaagaaggtgggcattaatttggaatttcacactgtattgtggtaaaagaatgaattggtactcaattttgtggcattttagtaaaggcttcaaacttttgttcaaaatgagagttttcgcatccaactttgtggcataagagcattattctctttgtataatggaataccgttaacttgtctcaggtgcaattgttattaagcagaacccaagggccgtgtaccacatccttgaaattgtgtattgtctgcttctaaccggaaaggcaatacatgcgaaaactttcaatgggtaatgtgtagttgcacattgatatatgggaaaaacatgcagtggatattaaacatgggaaaactatcgcataaatttctaaaatatctcacatacaggaaggttatattagacaaccatataaaatttcaggacatatgaaattgataaacagtgaggaaaaaaagagtattctttatttgtgtttttttctttgctatttgtaaacttaatatctcacaaacaaagttgagttttatcttgaattttgtatgcccatctaatttcatatagctatcattgagttctttttttcaaataaaactctttttgagaacttatattctgtggtttacatgtttccgacctagttaaacatttcaccatgtatttacactggatatctcggaaatctcacatcgtactcctatatccacattgtctcatgtatagttgtcgatagatcccatccatacaatgctccacattgcatggcaacagatcagaatgtctgatgtttgcacttcagagaacacaaacaacaatttaattggcacataagagggcacaaacaacaatgaactgaaatgaacagacaaatcagtaattgcaagatgtttgcatagaaatcttgaaatgcaactgataagtgattatggttacaaattggaccatgcaagtaggctttagaatttctaagctctgctcagtgctattttccttttattagtgcattgaggcggatcaaactcatctacatttttggtaaggttttggaatttagactttggaattcaaactcatcagcacacattgatttcctctggagtatagacgcttcaatgccggatatcgtcttccattaggagtacatgttcaaaagattcaatctcgtggaattcacatgtctgtacaggttctgaacaaaagagttttaaatggaaggaaatgtaatgaatataactgcacacagcattttgatgaatataaatcagtatccgtgactcttgattagttatggataaaattgaaataggtcatcttatggatttcttttaaagtaaaatcatcagatgattagcattttaatgatgatgacatggcttaatatgatggctcatgttatactcaaaaatataggggagagattttctgggatggaatacattagtatcttgttataccatgtatgttaatttgattaaaaaatatcatcttcatcaatataatttattttcctttgtggctatgagaaacttttttaacatttctgttaatttcgttctctgccaattgagggaaagggaggtaaaaatgttcacagtagcatggtgaatgcaactgtagcaagctatcaaaggaatagatcatgtaaaacatgcacaatttagctataatctgtacatattggcttaaatttacattcataatgttcgttgctcagtatgtggattcatattgtagatatttttattatatacataaatttcatggttctgcaggctgttcagcacaagcaattcggaagttctgtctgaaactacactgaagattttggagggtccttaagcaggttttttcaaacatactgatggatggggaatcccagacgagtaaattatcatgtgagcacatgtactcttggtacttcaccagggaagaactggagaaattttccccatctaggaaagatggtattactgagataatggagtcagaaattcggcagttgtactgttcattcattcgggatgttggcattagactgaaactgtatgtgccaatttccttgttgagtgtaccttttaatgtcagtatagctcacttttcaaacttatatgttggttttacggctagtttgtgcccttagttagcacacaataatttcttttattctggaagtttgctaagcttgttacctattttaacatttttctttcagaccacagatgactatagcaacagcaataatgttctgccatcgcttctatctgtaccagtcccttgccaaaaacggatggcaggtaaggagcttttttttttaatttatctcttttgttgtggtgggttggtgtcttttagaaaaagcatttttctgaaagaatgttttagaaaagcaattggatacaatcttctctttaaaaaatatttactggcaaaggttctcaaggaacatatataacccttgcatattttttatacttgatcagttcatatactctttgcaacttgtgcttaactttccgatctattatcggttgtacaataaatatgaagctgcataataacactaacatttaatcttgtattgcttattaagtgcatggcgatgttacagtgccattaggtgatttagaaattcaattccaaagggatctacttgtgccaatcagtaatcctatattgtaattccttacttttttactgtgctgtaaagttttgatatagtctgatttatggttgatttgcttgggatgtttggaagatacaatagtattgagatgtattgtacaatacaatagaacatcctttttgaggacaagtctgttcagcattcctgttgaagttacactattgccattagccaacaggaatacagcttacaatcctgttattagaagctaaaatactataactgaccatctaataagtataaatcctccagtaagttttatagatttgattcgcctcaccacattcactgtattcctgtcatgcggttatttaattgagaaacacattcttgtctctgcaattaatctggagttgtgctcgttatctgcacttgcagatgttacttgctgacatgtttcttcattgctcaagaaaagaaaaaaaaagctgtgcatgtgatgcaagctgtctataactaaatactattacaagtaattggtgtttattttatttgcttattgtcattccagagccaatagctttacttgttttttattgcagacgattgcaacagtgtgcatatttctggcttcaaaagttgaagatacaccttgtcctctggaccaagtaattagagtggcctatggaacaatgtacaggagggacccagctacagctcgaagaatccaccagaaggtatagttggatcattaattgagttttcagtatatatgtaccatccagttaatggttgacaagtagtatctatcaacaggatgtatttgagaagcagaaagcactaattttgaccggggagagattagtccttacaactgttcggtttgatttcaacatccaacatccttacagaccactacttgatgctatggaaaaacttgggatctctcagaaggaagtgaaacaagtagcttggaactttgtaaatgattggtatgagatgtgacatatcactttgtgacattattgttttgatgcttcattcattcaactgatcaatctggatgtattcattctgttgctcgtaggcttaaaacaacactgtgcctacagtataagccccaatacatagctgctggttcgctctacctggctgctaagtttcagaacgtcaagcttcctgtgcatggagggcatgtttggtggcaccaatttgatgttgccccaaaacctttggaaggtatgtagactactaagctgaaacataatagtaccttgtgtattcttggtatttacagtaagagactaagagttacactgctatagctgtccttcagcaaatgagggagatggttcacatgaaagcaaagctgtttgctcatcccagtccggctaagcaaaaggaagttctttttgaaggaatgctgctcatatcaaatagcccagattctgtgttgactcaatctagcttgtcagtaagcagctcgagtcctgaaattggagaccccaatgaccacctgcaggtggattcaagtcaagacatagtgcatattgaggatcgtagcaagtcatatcctgaaaggaatttatcgaatcttactgctgatatgaataatcccggtaaaacacacaataaagaaagcttggatcaggccttaaaaatcaaacatggtggactgatctcatgtaatcagcagataccattagatgcaattgcaaagattgatagcagcactgctaaatgcgtggaacagaatattggcatttgttgcagctcaagtaacacattcaatggcaaaatcttgaacccgttctcaataagtcagcgaagtggtgataaaacaaagttatgctcagagggtggatcatcgcttacagatgtggacagcaaaagcactcaatctgtcgaaccgcccactacaatttgtaaccataccagtgacagtctcaatgtggacagtttgtgctctgatcagagactggctaattccactgcaggtaccacggagaaggcatcatttgtattgcctgtccagataaaggttgatcatttgtgtgtggagcgtaaaaaggtagatgtggcacggataaaggatttgttgatgaagaggaagagacgaagagaaagacaagggcggtgcattccttcagttgacctaagtgaagaagcctggattgagagagaacttgagtctggtatagtttttaaaaaagttgaccatgttgttgcatcgtatgatttaagtgatgaaggctggattgagagagaactggaatctggaattgttattggacaaaaaaatgaccagcctgtatctttagatggtttgactgaagatgattggattgagagagagcttgagtctgggattatagttgaaccaggaccagctggtaagaagctaaagtcaaagcttctttcagagggtcatgagataatgaatagcaggtgggaaataaatggcaaatcaatgcaaaatcaagtcacatagaatatgagatatccatacagataggagcaccattgtttactcgtgttctttatttgattgaattaactatacacctcgtgtacttgaaatgctaggggtgtgcatgggaaagatttttgttctttgtataactagtaacagtgggaattcacaatttcaatctttaggttgtaggtgcaactgtacaataattaagtgtaaatgtacaatccgtccttgttagcagctaatccttcattgtaaactgtacctgtcatcaaaacgaaaataatgttctggtgtaccgggaagctttttttttttttttttaaatctgcaacgacgatttcttattactgaaattcagtgagatcacgaatcaccaggaaccttacaaattctgggatggggtcaacccaaacaaacgattgacccgggttccaactcacccaaatgagcaagttcgtgagcaactttattacaagaacgaggcgcaaaagagacctcaaagctagcaaactgaaactggagaagcgtttttatttccgtgaagattgtagcaccagtggctaggtcatgcgatgaggacttaatcgccaaagccagtatggccgagtcagtctcaatttccacagcagatacaccttggaccgagatggttaacagagctaccaagcatgcccttgcttcagcagaaatagcatcattgacgaattcgatgcgcccagcacccgcaaacaaaagcatgaccctcatcgttgcgcaaaacaaaaccccatccatctgttttgcgatccgcttgaaatgcaccatcaatattaagtttgtaaactcaagctaaacgtatgctataactttgttggagtagaagttggccacattaatgaatcaatcagaaagctacagttttgttgtttccattattaaactgtggggttcgtaagcctgatggctgtgctatgttcagctcatggaatagcattccttgtgcccgttgaacaactagatgttgtggagcgcctagggttgctaataccttttgtttgattatctttttatatcttttgtccgatcatatgtttataccttttatcctactatgtagtaatcataaatacatgtttatgtgctatatgtagaatgcaggacattgaacacacttcatatatatttcatatatagatatatcttggtttccgtaaggaactagaaactaaccacggctttgccgcgcattagtatatataggctagctcaattggatggacccaatgcactgttaattatgaagtcaggtaaataagaattgatcataactaaatatgtatatccaaaacaaaaaaaagggctacataatcacaaaattttacattcaacttacccgataatctagttttacataccatcaaactaagttgcttttgttactgacaatgagagatcaactttgtttctccttataaaaagaatatgaggttcatatcaaataggtaaaatttgcaacaggacatctgaaaaacgtgtaattagctaggggacatcgtaagaacgtgtatttgctgtagggcatcgtaaaaaactggtaattagccgctggacactggtgggattattttattatttttggaggaataggagagagaaacaatcattaaagactagtttacccttggctcaagttaatccaacgtgggccgctaaacattttctttagttagtcttcactaatcacgggcttaaacacatcttacattctcatcaccaagcaaagagcaagagaggagaagaaacgatggtggatgtgaagcacacggtctcatttttacaggatcaaactctcactctcacaatctctgaaccttttgtcgaatatatgaatagttaactgaagaacagagtagaacgagcagagttttggcacagcgaagtaccctgctgcttttctggtttcctaattattctcctcaattacagagtttgttacatgcataacagaaaaaacacccgattgatctggatccactactgaccgtgccatcccacgatccaattcagtccaaccgaaaaactagctagaaaacagctacatgctaactggaagtaaaacggctgctgacagattctaacacagccaaccatatgcaatgcaactacagaaactagatgcacaagattgcattatttagctaacatcgcaggccgccgctgactgctcgttcggcaccgcgttcgcgccaatggtcgccgtcggctactgatgagtggctgagcgcgttcatgtctacatcaccgtgctgggcatgaaggacatgaagccatggagcagtagcaccggcgacagtgggcgagcgaaggaggagcggcaacggcaggcgagcctgggaggagcagcgacagcaagcgagcgcggtgggcggagcagcgacagtgggcgagcataggaggagcggcggcggccgcgggcgaggttgaaggcgacggttgagagcagagagagagagagagagagagagagaacgagagagggagaaaaggataaggaagaaaaaagaaaaagaaaaaaaaatcaaagggtagatctgtacttacacagctgtttctctctccaattcttccggatataataaaataatcccgagggtgtccagtagctaattaccagttttttacggtgccctatagcaaaaacgcgttcttgcggtgtctcttagctaattacacgtttttttggatgtcctatagcaaattttgcctgtcaaatatgttttccttacaaagatattgtatgatcaatactttcagattagcatcaatgatgaaataaggagatttaactatttgtaatgaatagaaagtaagacaatattttcagtgaggataataatataacttatcaccgaatccaccgtcttgtgatatctcatttaccacagccttgtttggcatgagcattgctctctcactgaattgtacagtggttaaagtcccagttctgcacctgcatttctcagtcccagcactctatgtcaacttaagaaaatgtaaataaggtcatgaacagaaaaaacatgtgttctgaagaaacggaacataacaatgtagctccttgaatttgagctatggtagactttaattcagattttaatatctaaaggataaggcagtgactcggttatcagaatataacatgaaacaaataattttgagagagcataatacaagtatatgtgatctaaaagaaatgcagcttgttatcaagacaaagttctttgtgactatagggtagcccaagcagaagttctggttgtgatcttcgttcatgcagaggtgaaaatggaaagcaaagaaactctagttttaaaagcaaaatagaaagggcaatttctttctgctgttcttataggtcaaaattgtcccactgatgtgagcatagtagaaacgatttcttggggttagttttgctagattactccgtgccataaaaaagataaagaagattttataaacaactagacaaatgtccataaaattagcatcaggtaagcaaaaggttttggatcttaacgaacaatcatgtaaataacttatataactgctaactttttttaactaatgctaactaaatttaagctcaaaatgccttactatgttttctttttctctctttctttttttttttccttttgcagattagtgcagcagctacctgaccataggtgaacgcatcgctgctaacaaagtatacagataatgaaatgatttggaggtcatttaatcgatatctgattgacgtcctcaaccattgacacatactcatcagattataatatacatgaaggttacgggtcattaatctgctgattgtatgcatggaaagcatgaagcatcatgtcagatatggaaaccttgctaataaattaattgaattcagaaaaaaaaatctagatgcatttttccagttcaattaagaaagtgtagatgagtcagtattcacctaaagaaacgagtaccggaattgataacttgtgtgtatctccggtgagctttattgcctctttgccagagaataaacaaaattgaggatgacggtggatgaaaggctgccgccgtctagctcgttcctccacagcgaggtcagggagaaggaggcctaaagatgagcaggaataaagggagaaaacctgcagcagctgtggattaaccagagaccgtcgggggtggtcgactggagcatctcgctgaggaggatgtcgtcgtcgtcgtgtcgtcgacagtgtcgccgctcagcccgtgcatgtcgtccgaggggagcccagaatagggatgggcaggaggcagcgtcggcgctcgttctgcccggatctggcgcccttgagctcgtccgatgagggactggtggcgtggcttggatggtgcagcggtgacgtctgaaggggatggataggaggcggtgatggggaggagaaggttgccgtggtgcctggcatgggaaggagatcaggagaaggatgcagcggcggccggcagcaataggaggcggagcgatgaggaggggaggcggcggcgtttcgggatggcggataggcgggcgagaattttcagaatatgccatcgaatacgcaatgcttttaggatttaccatttaatttgtgctactttcagaatacgctatcggagtgcgaattttcttcgttcggtgccattccgtacccccaacgtcaatcacaccgtcatcgtccatctcccggcgccgccgacgtcagttcgccacctcccgcgctcgcgggcgtcacgccgtcgtccgtccgccgccgcccgctctcatgtgcgccacgcagtcgtccgtccgcccggcgccgccgtcgtcagtccgccaccgcctgtacccgcgtcagccgcgccgttgtccgttcgccgccgccatcgtcgtcgtcctccgcagcttcagggcaagcaagcgcggccaccgcgcgtgtttggggcggagctccgcatgtggggcgcggcgatgctccagggctgagcccggagctgcgtcaagatggcgacgatatgacgcgggctcctcgttgcctggattggtgtcgtcgatgccctggacgtcgacacgacgatgcgaccaccaaggccgtagaggccatcgccgtcgaggcctcatgccgcgaccgtgagaacacctcggttttaatcaccggggaaaaaaaggagtggctgtgtggggaacaagtagaagaaaaggaagctgaaaagaccaagcaagcaagcaacaaggagtctcctgcttgcttatgcgtgatattttgcattttaaggttgatgcttcgttctgggaaaaaaatatagcgatttgtgaatgttttcagtctaagattctggatggtgccattttgttttgagctcacacgtttcacccacccatcattctcaagttcgtcttgctgctatgtttgcatggtttctcctctcgaaataccaaaaaaagagagaaaagattgttgtctttgattcataagaacgaatgtttcctgaatattgagtaaggaaagagaatctgcttaaacggctttgtggcggagctggcgagcaggcagaggccgccacatacgacaacgtcgacgagctgttggtgaggacgacgacggggcggctgatggtgggcgacgacgacggccaagctgatggtagatgacgatgagggcggcgccgggcggacggatgactgcgtggcgcacgcgagggcgggcggcggaggacggacgacggcgtgccgcacgcgagcgcgcgaggtgacgaactgacgtcggcagcgccgggagctggatgacgacggtgtgaataacgttgggggacggaatggcacggaatgaagaaaattcgtactccgatgtgacgtattctgaaagtagcacgaatttggtggtaaatcttgaaagcggtgcatatttggtggtatattctgaaaattttcccggcgtgtgagctggtgacaccgccggactgacctcttggtgctaggtggcaaacgacaagataggggaagcctcgaggttggacctgacgcaaccaccaacgtcggaggagagtggagaagagccgagaggagtaggaaggcgacgacggtgacgatggagcgaggcaccggcaatgccacaaaagaaagagtaggggccggtgttggcagcagcaggggcctgggaggtaaggagcggagcgaaggagggaggagtgcgaggcgaggagctcaccggagcccaataacctcaccgccttgggaaaggaaggggatgaaagagacgtggggagaaatgaaaaagaagggcaagatggccattttgttcttagatcgggtgacatggcctcttgcgggctcaaaaatgacacacgagcaagaaatcctctctatccgatggcagaacagcgaagttatccgagagagtggcatttgagaacacgccatccgggagagtggcaaatagtccaaaaccccctccctccttgccatagaggccgtcagtgacggcgacagttgctgagccggctagggcgtgcacgaggcgcgttaccctctgcctccttcctagctggagccgttggtgagggcgagctggaagtggcggaagctagaactggccggatctggacctacaactcgacaccggcgatggagatgaatgcacgttaaggctgccgctaaaccaagccacaaatgaggagattacagtgaaggcaatctggcaatgcgagtggagcaccttgcaagcaaatgaagaaaatacctagaagtgaaatgtcttttgtagttgctatgtcagtcatttggcaaaatgctgggatactggtttattctatagtttgacagaattagttcctttagctagcttgcaatttttagttgcagacttggcataagtgatgggatggcatcactgacactgagtaagctgtttttatcttctttttccctttacctttcatgctggatataacgagcctcgatatacttgtactaatgaaactaggaggggttagacctcaatactattatactattaatatgtgatcctacttgtcgtacacacaatatatcttaaagtctgtgttatagctggctataaatttgtagaacgttgctcttctctctcctcttttatccttttgaaatatgtttataaccgacttatagtctactattgtatctcctctaagatatacaccgtcaacagcaagttctaatcagtgaatccaccggcagctatacaaacatcagaacacaagaaggaaaaaagcagcagcaacctaatgaagtggtaaatgctgcattcaaacggcagaagaaaaaggaaaaggagcacgtgtcacgccttgaaacccccaacacagccttgcaaaccgactggatatgaggaatctttatctcttataccgatttctgggtccgatcccttagcgttgattgggccacgtggctaaacctggaagcaattttacatatgataaaatcgcgccacgtgtcctatcccgtaacacggccccacacagggaggaaggttggaggagagagaccccgagctagaggaagaagaagggcaagatggtcattttgccctcggatcaggtgacgtggtgctttgcgggctcaaaaatggcacacgagcaagaaatcttctctctccaatgaaaaaaatagcgaagtcatccgggagagtggcatttaagaacacgccatccgggagagtggcaagcagtccaaaaccttgatttttatggatctcgattctcgagcgacgagaggttgctggcaacaatgggagcaaggtgaagcgccagcgacaccgcgtggccggccaatggtgagcaccaacgataagcttgcagtttctgataatttttagtgtagcagagctattaggccattcacaatgggtctacatggcattcagtctcaacccctaaaagcgaatattccttgccacatcatccaaccgcgtggctttctcaagtccgagtagccaactttggctatgagttcctgctctcaggcgggccccacactcattgctacaggaaagaggggcgaggggcgaggcagccaacggggagaggagcggcggcgccgcggggcaggtcgccggcgagctcgatctgcaaccggcaccgtcgctactagggccacccgatgttgtcgtcgctgctcgggccgtccctccacccggcgcctccgtcgggacggggtcgacgttgttgccgctgctcggtacggggggcgccagatctgagtgctggtaggagaggaggcggcggggtcgtcgccgctgcatgccgccggtgggaggagaggagggggcgggggctggggggtcgtcgccgtgtgccgcctcgtcgtcccagcgccggcgctgccctcgccgccgcgctctgccgacgggtgtcgaaacaaggattcggcca

SEQ ID NO: 65410 - DNA, 17023 bp, Oryza sativa
gcctcatccctcgccgctagcctcctccacagtcgccgcctcgcctcgctggagcagcgtgagctcccgttgccgccaccgcctcgcctcgcctcctctgttgcaccctgccaccgctcgccgcctcatcccctgccgctcgcctcctccgccgctgccgcctcgcctcgcttgagcagcgcgagctcccgccgccgctcgcctcctccgccgccgccgcctccgcacccaccaccgctcatcgcctcatcccccgccgccgccgctcgccgcccgcctgctgctgtgcgcgtgagatagagagagagaggagagagagaggaagagtgaaagagaagagagagaggggggaatagtggaataggagtatgataggtgggtcccacattttttaaataaataaattgctgactggactgccatgcgtacgccacgtagatcaaaaccaccgtggattggatcaaggggggtaattcatccggtttgcatagttaggggtgaagaatgtccggttttgtagttagggggtaattcggactaccgcaatagtttaggggggtaattcgtactttttcctttagaaattatactgggcccttagctttctcctcagcaatggtcgtatctaccactgatctgatcatacccgtcaatgtattgactagcacaccagattaattaatcaaatgcatgatgcacagctaagtcaatgtgaccttccagagttggcttgtattcttctttatctccatcaccttcagacttcttatctatcttttcttcaacaagctttgggaactcgactttattcttctgaatcagcttcccttgccgagtcatactataagaactgagatacatccgctgcatatgttgaacaagcttctctctgctttcttttcatcagacaagtgctcaatagtgacggggatgatgttgtcgtcggtgatttcaatgagagatggcggcatgatgaatggtgaagtggtcccaccgggcgcgctaaaagagtgttgatgagaaacacaacggtctgggagatttctttcactcctatgctggttcaaggcttgcctcaagtatcaagaaagacaataaacgtaattagatgaacgatacccgatcggccaatagagccgataacgtatcatcaagacccagccgataagttaaatcaaatcggttgcggttttgagatggatacgtaaagcaaaaagtctgaatatgtcctatcggctgtaatactatgtcttttgtttttatcaatcacttttagatagcattatagaaatagccaatgatccaatatttagagcgagaatatataataatccaatacaaacttatataaacaggttaatctagataaatgtatcaaataataatctatcaccagatataatagattagttgagatcaatcagacttgatatatttatacagagtgatctatctatataagtggcaaatatagataaaacagattatgaaatatgcattattatgtatattaggtaagatcagctgaaactccgatgctatccttagttatgattaattccaggctagtttatagggttcgagacaagactagggttgttgcaactcaaagtatgttaagaaacctaaagtctaaacaatcaagaaattaaccacttgttaggatggtaaatacgttagctaatctaatacagtaaagcaatttagcttataccagcataaaccctaaagtgagaatcagccgatatgactaaatcgaaatactaaactagattaactaagatatatgataaatgatgaccacggtaaaaaggctaaaatcgacataatagccctgatagtgcaagccatcaagacaagttacctcttgtcgagatatcgcagccaatacccgactcgaagccagaactcatcgaaaaagtaaaaaaaaaagtggcgatgcgccgaaagttgtattgattggattctcgtcccttattacaatgatctagagtttatattcataccccaagtacaaaacttgtccattatgggcttgactcaaactttcccatggataaaaacaacaaataagtccatacgatggactcttaccatatctcaaattcaaactgtcattaatatcctaattaatagatacatttgccttaaatgagttccatctttatatcgcaatattggttatctcgtggcccaaaccgaacccaagtctaactgtatcggctgctttccatatcggctcaatcaaactccgactctattttcagctgatacgctgtcagttgatgcgcaatctgttagaactatatacgatatgctccctccattctaaaattagttgatctctaggatttaaactttctcaagaatagttcgataaattcctacaatcctatctacccttatcagcaaattaaattcaatattacttaccactcaccaccaataatattttttccattaataaaattgtcactggatacaaggaatacttctattttgtgatatagagggagtagaaagtacacaccaatagttgataccccttgcttggttggtgttctatgcacgcatgatgcatatacataggttgtgaaatgtattggagaacaacccaagtgcaacctcatattcctttacattcatataaccgcagcatacatatagatacaaaaactagagaaccagtcagaaaacaaaactagagcataaatacttctcacaaatacacaacgtaagaaattaacccgaaaaagggaaaggaaatataccacccttcagttttctcttccctcttaagcttacagttatcatctccactgccacgtcagcaggacgtaataatatataaacgagataaaacagtcatatgtgttatagatcaagcaattttttccttttatttgataaggattacctaatgttggcttttctttttcagtaagccaccgaatttcttcatcaaagccttcttttgctggttctgcttgactaccaatttggtgttactgttggtcttctctgtggacaacctactgccattgccatcagcagcaatgtctctgtctgtgtccaacagatcaacttccggttcaccgtcgtccctctccttagataagttgtagctgttctcccacatcttagaaactagcaaaactggcccatctttctccgtgtttccctcgtcatttcctatcagagaatacaagtccttgattttctctgaaccagatgattctttgacatgcagatgcaggccatcattctctttgtacgcttttgtgtctttgcctcctctgtaattattatccttgtccatcagagcttccagttctcttaccttctcctctagttgagcatttctgttctccatgtctcttgccgtctctagtgctttacccaaccgagttctcattgacatgatctcttcttctgattttgtgatagagctaacaaagctaagctctttggatcgccactcctcagatgtggtcttggcttctgcttccagctgttccaccttattcttcaagcagatcctctcgtagtttgcttcatcaagcattacctcatagttatccctggtgttgttgaggctgatgttgagctcttgtaattttgccctggtgtgctcgatctctttttctttgtgcaggtaattctcctgtgactctcttgcctcagcagacatctcttgcaatgcagaggccatatcctccattgcttttctaactttctcgcattcatatttgctagattctagttccttagctagcttatccttctcttcacatatggcctcaatttgggagcttgtaaagcttccatccttgatagtacccctcttctcttgttccatcgcgccaagccttgacctaagctcctggatctctgtccttaaggctaatgctcctctctgcgcggcatcgacgcgctgacctgatgcattgatatcttcattctgcctcaccacttcatgttccaaggactctatcttgtcgtgaagaagagcaatttgagactcttttacctgcaacaaagcattcgccgcatccaattccttcatcaccgaactcatggattcagccttgaggatgctggactggttggctagctccagtttgatctcaaaaagttgagccttcttcttccattcaccaaccaatccatctgcttctctcctggccttgatggcattggcaacatcagctctgagaccttcaacggcaccttccaattcagccaccttctcttcggcaaccttggctttcttgagcttgatccttagtaccgacgtctcggcctccagcttcctggttttctcagcggattcttttaccttgctctctagctcagaattaaacgaatccttgagtcggttgatttccgcgttgaggagctccacctgggcggcgttcgcctcgccggctctgatggcgtcatcggcgtggctgagcgccaggttcttggcgtcaatagcgtcagccagttctagcctcgcctcctccagctgcgctaccatggaccgcagcgccgcggcgtcggcctcctgctggcgccgcgttgcctccagcctccgctggagctcatccttcctctgcgtggactcgatggtagtctgctccagctcgatggctcggaacatctcggtctcggaggcttcctccgccttcttgagctcggcgagggcgtaccggagcttggcattggcctcatcggccgtcctcctggcgtcgtcggcgaccttacgatgctccgtctccttctttgccagctgttcctttgccctcctgagatcctcctggatcgccgcgagctgttccatggactgcttcttcacggcagtcctgtgcttctgcagccagcaattcaattcaattccagtgggcgcaggacaggagtcgctcaaaaaaaatttacaaccaaacaaacatctctcaagaatctaagcaagcagtaaagatgatcaatggaccgtacctcggcagaaggcagtgtactgatccgggaggagatcttgggcgagcggtggtcggctgacgacggcgacggcgtcttctccaccaacgccggggacctctcggcacgcgccgccgcatgacgtgggatgccacaggccaccggcctagcggtggcggccacatgtggcgtgctcttgctgcttttggcagcgtcggccgtgctagaactgcagcatgtgtccaacaaatcttattttgctcagaccaagaactaagtcaaatggaaccaaaaaggcagccaaacaattgcgggtaaagaagatgagagattgatgccggattggcacacttacttgagcctggacgagcccgccattgcttctgcctgctgctccccgagcttccgaattggagcgcgcggtgggttgaagaaaagaaaagaatggaggggaggggcagtgcagtgggtgtcggtgttgatcgcccactaggggcaaggggaataatagaatctcatcgccaacaccagcaaaaccagcaatcgctgtttggcttcaagaacagatcttcctttttttcttttttactgtgaaagatcacaatcaccatcacattctgtggtgtactggtgtggcatgggtaggctggctggctttacttgggtttgcagctgttgccgcctcgtcctcaaagggcaagttttataataaatgtggtggtcacctccaattttattcacatcatccatccaaaaaatcaaaattaacttatgtaaatgcattgcatttaatacactagtctcaatacacttgccaccaatcagtccttttattttctcttgttccttaaaatttgtgtagaggttgccctttgcatgaggggtggctcctcccctctctcttcttttctctcctccacatcattatttaagcatacatggcactttggagtttgtgcttaaaaccttatagtacttgccctaaccacccttgcaaatcctgcctctccgagaaaagcgacagcgcgtgtgtttgtgtgtgtgacggaccgcacaaaaaagccacgcctcctgtccgccttgtctcgcgcttgcttctcttccactccccccctctctcaccgctgtctggttttcagtgtgacatatgtgtgggaaaaggcaggaggttttataattttttttattttctttttattttctaattttattaataaatctttccaaaaattatttttaaaaaccgaactggcgtagcagcgttggttggccatgctagctacggtggcgtggaagatctattaataaaattaaaaaaataaaaagctctgaaattttttttaggttttataagaaatacaaggaaaaaaacataatatttgctactttgtgcaaaactgcaaattaaaccatgttgatgagcaaacgaaataagccacaaccgtgtacatgcaccgtgaaggacagcaagctggatggagtattggcatcaaatatgtggcattagcaaactatggcgtacacatgacatatagtactgtgctctttgggcagccatgatatatgccaacgtatagttcactttttgcctcacaggagctagctttgttggtcgagctggcacgtattcatgattaactaggtactaattggtacattacatcagagagggcacgaaaaagaactggacacagaggagcacacctcgagacaatttaatttaatttatttttgcttctgaatacggccatccgggcgtcaagcatgtggggcagttgttgtgcagtgaagcatcaacacacaacaggacattcatgctggccaattcgtcaaaacgatcagggcaatgtaaaaagtgtacccttgtcatcctaaaaggtattccacgcacagttacatacaccgacaatgtgccttatggaatacgccgacgaggaaaatcaactcgatagtacagtgctaggagcctaggagctctacaccactatcaaatgcacgtatatgcaagcgtacaagtaaattaatatttgtttaaacaagctagtaatggtacttacatagggtttaattagtggcggaaacgtgttacttacatgggtatgttaaggcatattaagagatattccattcaaacatataaccacataattttttaaggaatattttaggttaaataaagggagcaaaatagatgcctttcgtttagccactcgtgaacatataccatcaaacacaggtacttattcattatcatactcgcacaaatggtggccaaatgataacgccaagataacgagttcatcctatcctgacttttatcaataggacggtagctagaagatgatatatgagtgtctgtgcaaagtcctattgatgcaacagagataaaaagctagaatgcactacaaaaattggggtgtagaatatccccaaaatgtcacgaccggaattaacccaacgggcgtttcttttgtgcgtgtattattccttgtcccaggaggcaaggtacaccaagagttgatacaattcagagtttaacaagcggaagcgtaaatagataatttattacatgggcgacgaaggcccagcacacataaagacaaacgagaaacagcggaagactagggcgacgaccacaggcgcttgacagcaggcacgagctagacaccaaagccttcatcaaccaggggctcctcttctgggttgggaaaaattgagcaagactgagtacaaccaccgtactcaacaagacacacccacaagtgcataataaatgcaagggagtacaagggagttataatataaagggttagggttgcagtaaacagcatttaaagatgcttagttgctcaaagctattttgtaaacacgattctagaactatgcaatattatttatcaaggccgtaaacccacacgaacctgccttaacccaaggcctacgatgattcagaccgaaccggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaatagattatactctgatcagaggtgtacatctttacccacaagacacatcttcctcacgtgtaaccacgtgccacataccaccatggtatacggacggaagacatgatatagtttccaacccatcctagccatagacaagagtaccgacccaatcccacctacggccggaacccccaggacaggcaggcaggactgagcccctagcagcaggacaccggccctgtgccacgacatctcgactaccgggccgcagctcgtgtagccttcatttgccctggagatgtccatcgacccccgacttcgtccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttggggattttgaatagagggggcggtgtgaatccaattccacaatactccaacaattccaaagtgtccaggtgatatgaatatcccaaagtctagagttgtaaaaccgcctaatgttacctaattaaatagcgaagcatctacctaacatcatactagtggtaccatgagtagagtgtccactagttggggttttgtttaatctagggtgaacaaggaaataataacaataacaataataaggtcataacaaaggtaaataggcatggctaaacaaaacagtgataacgcgggaatttaaataaagcgataatgcaataatttaaatcaacataattttataaactgggattcaatatgttcaaagatgatgtgacttgccttgctcactttcccaaacgtcggcttcaacctccacgaagagcggatcttccgaagctgcagcgtctacacgaccaacggaaaagaaaaggcttttactctaataaactccatataacaagcagaaacaaagcacaaaaatgggttcttgacttcttaaggaaaaattagagacttgaacggtccaattccgagttcaaatggccaagttatggccatttgaaggttatatgctctttaaatgaatatttgcgaatttcttcatttaaattttaatttaaaatttggatctattgcgtcagccgaggggaggggcgcgcggaccgggtccacgggagtggggcccacgcggcagcctcacggtccacggtggaccgggtgctcccggctcacaccggccggcgccgtgggtcccacgcgtcagccgcacccgagggcgcgggcggctgacggccgggccccacatggcagccgcggggcgcgcccgaaggtggccacgccggcacagccgacgggaggcggcgcacccgcgccccgatggtcgccgccggcgaccaccggcgcggcggagcggcgcccgagagaggggagggaagggggaaacgaatcggcggtccacagctcaccccgggtcgacggcgacgacgggaacggcgaccggagcggaggaaggcggcggcgcggctcgggtagacggggacggcggcgttccggcggtcggcgggcgaaacggaggggtggacgaggtcggcgaggttgcggcgaaaccgaaggaggcggcgccgaagcgggagaaggtccggggcgacgacggcggcagaccggagctcggcggtgacggcggagagagagagcgacgacgcgagctcgattccggcggagagagagagagcggcgagtggcggaaacggtggagggaggcacggggagtgtttatatagggttgggagtgagagagggcggccggatgagggggaaacgggcgcggaagatccggccgccattgatgcgccggcgaggtttagggggaaagattccgaacgaatccgagggagagagggagggaaaaatggggggaaagagggagggaatcacggggaatatttcccccctcttgattgcacgcggggcggacgggagcggcgggatttgcggcggcggcggcgctagggcacgggcgaggcggcgggagcggcgggaggaaggggatgacgggtgggccccacccgtcagcgtgggtggcgggcgggcccgctcgtcagcggcgcgcgcgcggggaggaggccgaatgggccgcggggaggaggagagagagggaaggagatgggctgagccggcccaagagggggagggggggaaagactttttaggatttttctttttataaaatcattttaactttgtttatttcttaataattattatttgtgctctgaaaattccactaaaatttatttacgcattttaggcttttaggaaatatacaaaaatcctccaagccttattggacttttaactttgcacattttaattgtgggaggctttcacaaggattttaattattctaggcataatttcgaggatgtattttagagtcattttgggacgcgacaaacctaccccccttaaacggaatctcgaccccgagattcggaagaactgacgaagagatcgggatgggctgccttcagctcgtcttcacgctcccaagtagcttcttcctcggcgtggttgctccattggaccttgcaaaaacggattacccggttcctggtccttcgctccatggtgtccaggattttcactggcctctccacgtaggtcaagtcttcgcgaacttcaatttgctctgagtcggcctgctcggatggcactcgaagacatttcttgagttgcgacacatggaacacatcatgcacgttgcccaaggaggcgggcagctccaactggtaagcgacttctccgcgccgagcaatgatacggaaaggacccacaaaccgaggtgcgagcttcccctttgtctgaaacctgtgtacacctcgcaagggcgtgacccgaagatacacaaagtcatccactgcgaattctaggtcacggcgtcggttgtctgcataactcttctgccgagaccgggccacctttagattatcccgaatggttctgactttagcttcagcttctctcaggatatcggtcccgaacacttggctttccccaacttggtcccacaatagcggtgtccggcatttgcgcccatacaacgcttcataaggtgccatttgtatgctggcttggtagctgttattgtaggagaactcggcataggggagactcttatcccaggtcttcccgaaatctaggacacatgcgcgaagcatatcttctaggatctgatttagacgctcggtctgtccatctgtctgcgggtgatacgcggtgctgaaatttaatcgggtacccagctcttcttggagcttcttccaaaagtgagaggtgaattggcttcccctatcggatacaattttcttaggaacgccatggagactcacgatcctagcgaagtagagctcggctagtttgttccctccataggtggccttcacaggaataaatcgagctaccttggttaatcgatccacaactacccatatagaatcatatccaccttgggtttttggaagtccggtgatgaaatccatcccaatttcatcccatttccattctggtacttggagaggttggagaagtccggccggtcgttggtgctctgccttgacacgctggcacacatcacaaagggccacgaactctgcaatttcccgcttcatactaacccaccagtatttctccttcaagtctaagtacatcttcgtactgccagggtggatggaataaggactttcgtgagcttcctgaagtatcagctgtttaagttctctgttatctggaacgcatacccgatttctgttccatagggttccgtgttcatcctctgtgaaaccagcggctttaccctgtttcatattcttgaggagtccatgcatgtccggatcgttcttctgagcctcgcggatttgatcgagcaaggtgggcttggcttccaacgcagccaagaatccgcgacccactatgcttagattcagggcttccatctgttgattaagttcgggtggaatgccacggacgttaagagtgttgcaatggctttttcgacttagagcgtcggcgaccacgttggccttaccaggatgatagtgaattcccacatcataattcttgatgagttctaaccatctcctctgccgaagattcagatccgactgggtgaagatgtatttcaaactcttatgatcagtatatatttcacagcgattcccaatgagatagtgccgccagatttttagagcatgaaccaccgcggctaactccaaatcatgggtagggtagttgccttcatgaggccgtagctggcgtgaggcataggccaccacatgaccgtcctgcatgagcacgcaccccaatccttggcgcgaagcgtcacaatacaccatgaagtccttgcgagtatccggcaagattaacactggcgaggaaaccagcttttctttgagagttttgaacgccttctcgcattgcgggctccacacaaatttctcctctttcttcaacaactgtgtcatgggtcgagcgattttggagaagttctcgatgaacctccggtagtatcctgccaaacctaagaaactgcgaatttgagtgactgtcttgggttgcttctaatcggtgacggcggtcactgtttcgggatccacagcaactcctttagcggatatcacgtgccctaagaatttgacttcggacaaccagaactcacacttgctaagtttggcatacaattgatgttcccgcaactttcccaacaccagacggagatggtgctgatggtcttcctctgattgtgagtataccagaatgtcatcaatgaaaaccacaacaaacttatccaagtattccatgaacactttgttcattaagttcatgaagaaggcaggagcattggttaaaccgaacgacatcaccgtgaattcatacagtccgtatcgcgtggtgaatgcggtcttcggaatatcttcttcacggatgcgcaactggtgatatccagaacgaagatcaatcttggagaataccgtggcacctttaagctgatcgaacagatcatcgatccggggaagagggtacttgtttttgatggtgacttcattgagagctctgtagtgaacgcacatcctcttcgtcttgtctttcttctccacaaaaatcacaggagcaccccaggaggaagtactcggacgtatataccccttttctttcaactcttccaactgtttcttaacttcggccagttcatttgctgccatacggtagggtcgcttgtacagaggagtggttcctagagcaagatctatccggaactcaatctctcgcttgggcggcataccgggtagttcttccggaaacacgtctccgaactctctgacaatggggatttctgacagtcctatctgatgaagttctgaactactgacagaggttgggggtgcaaagaaaacaaccggttgttccggccctcggtacagagtgacagtgcgtcttgcacaatccactactccttggaattgagccaaccaattcatcccaaggatcacatccaagttcttggtgtctagaagaatcagatccgagggaaaaggaatcccctgaatttctatagggacggcaggactataatactttgctgtcataacccctccaggggtggtgatgagtagagggttcctaagcctttctacccccaactgatttctccccacgaatggcacagatataaacaagtgggaagctccagagtcgaacaaaatggtagcagggatggaatggatgaggaacgtaccaacgatgacgtctggagttgtcagcacgtcctcggccgtcacgtggttcacacgaccccgaatgacatccttaccaccgttgttggagcggggaggcgcttggccttgctggcgcctcggcttcgggcatttatccgcaaagtgcccgggctcgaagcagttgaagcacagacgctgcggaccttgaacgtccctgcggccttgtccagactgcgcggctggcgtaggaggacggggcgcacgggtcccttgctggctctgctgttgctgcggctgtgggacgcgcaccacgaattgaggtcgaggcgcggagcgaggttgctgctgctgcgaggaagatccccctggatagggattggtgtagcggatcctttggttagcaccctgttggttgcggaaattcgccaagcgacgcttgtgcgactccagttccttgtgcttggcttccaagcggatgctcttttccaccagacgttggaaatccggatagtcaccggagactagacggacagacagctccgggtccattcctgccaagaacttctcttgcttctcctcatcttcccgcacatcctccggggcgtaccgggccaagttgttaaactcatgcaaatactccatcacggagcggttgccttgcttcaactctcggaactcccttttcttaagggccatgactccggcgggcacatgggtcctccggaaggcggcggtgaagcgggcccaagtaataggctgcccctctggctgcgtagcctggaaatgatcccaccatagagatgcgggtccctgcagttggtgggcggcgaagacgactttctcctcatcgctgcactgcacagtgtctagctttttccccacggcatgcaaccaatccaacgcatccacggggttgttggagctagagaaggtaggtggacggatgcgtaggaactcggcgagtttagagtgttgtgggggtggtggtggagcattatgttgtggcggattttggatgtggtggaggaaagcagccatcatgttggcctgctgggcgaggatttgggtgagaatggcgttggtgtctggtggtggtggtggaggcggtggaggaggtggaggtgggctgccatggttgttgtggttgctgccttcaggttggttgccatcactggtggcagcatttctcctggtcgtcaccatctgaaaaccccacacagaaccagcaaacagagagagctgacaattaaagctaaccatccacgactaccataactcttgaatttattactgctattaaattggttcattaaagttcaagttgcttaagcaaataaaataaagacaggctccgacacagttatgccacacaccggcataaccatgctccacaagaccccaataagaagacaaacgagaaagaacacacgtgcaagcctactaactgctcgtctaccactgcgacgggccaggacggaaggtgagcaacagcgcatcctccgtgctaccgacgccggaggcttccccctcctgaggaaccacgggcgcgggctcggcacgaggggtctccacgaagcaagtccacgccagggactgacgaacaagctcgggcctggaggtgctcttgcgggcggtgatcttctggctgcggcagacgcggcgacgcttggggcgacagacctctccctgggtgatcttgagctgatgcagctgtgcctccactgcgtctaggtccttcttcagctgcagattctcctgacgcagctccaggatcttcaggtcgttctcgaccatcccacggcgcaccatctgatggaagtcgatacgagccgcgtcgtacgcctccaccatgcgcgccaggtgcatgatggtagcgtcatcctctgagctagcatcccagaaggtggcgtagtcgcgggctcctccgcgacgagggtggtagcggtagggcgagtgctgcagctcgtccgggtagcgctagtgaagagtgccgatggcgaggagagcgacgctctggcaagcggcggagaaagaatctccacccgcggtgactgccaacgaagtccgctcgggtgagccagtgaggatcactgcagtaacctcccaagcagcgtggggctctgcatcgtcaccctcctgctccgggagcggcctgccctggtagtccactccatgcggataccccaggacaacgcacataccccgcagctccaagacgaaaccagtcatgtccagaccacgacgactaacgctgccggccatctacaaacaaaaacaaaaagaaaagcaacatttaaaagtcagattttggcgataaatgaagcagcaggacagagagagactagagagttttcacaattagcaaaggatttttatttttgatgatattgctaaggcttgggatctacggctcgtcctagggtcaagggggctctgataccaacttgtcacgaccggaattaacccaacgggcgttcctttcgtgcgtgtattattccttgtcccaggaggcaaggtacaccaagagttgatacaattcagagtttaacaagcggaagcgtaaatagataatttattacatgggcgacgaaggcccagcacacacaaagacaaacgagaaacagcggaagactagggcgacgaccacaggcgcttgacggcaggcacgagctagacaccaaagccttcatcaaccaggggctcctcttctgggttgggaaaaattgagcaagactgagtacaaccaccgtactcaacaagacacacccacaagtgcataataaatgcaagggagtacaagggagttataatataaagggttagggttgcagtaaacagcatttaaagatgcttagttgctcaaagctattttgtaaacacgattctagaactatgcaatattatttatcaaggccgtaaacccacacgaacctgccttaacccaaggcctacgatgattcagaccgaaccggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaatagattatactctgatcaaaggtgtacatctttacccacaagacacatct

SEQ ID NO: 65411 - DNA, 631 bp, Oryza sativa
atatggaatgctaactgatgtaagaaagtacttaaccaccatccacttcaagaataagaatttatctttatcttatgtcaccccatatctgtatctcagtatcctgattttcttatagacattatattgaaccatagagactatatatagtgttgcctgtattatagaaatttataagttgactggcataaaacggtcttattttgagtagcgctggtaactaattatcccatgaaattgtgaatgcacccttaactgttacaagcacttcacttacagctcaattatcacacctcagccacaattacaagctaaattttgataatgttccgtacagtatgatgatgatgaaggtgatagggtgttgctcactacggatactgatcttaccggggctgtgctccatgctaaatcttctggattgaaggtttgtcttttctgtaatcctcaaatagattggtccctctgttttcacattgcgatctttttttgttcattggattatgactattgcttcaccggagtgaaattttcaatttcagtcattgaggttggacactgatgagtcaaaatccagttctgaggtgacaaaacacagttctgaagtaacaaagcacgcttcttgagtgac

SEQ ID NO: 65412 - DNA, 6988 bp, Oryza sativa
aaaaaatttaataagcgttagattaactgcaggccccgccgacccactcattgatttttgcagaaatcccctcattatttcggtatttccagtcgagtccactgaatcagagccgttcaaccccacgcgtggacacaatctgaccattcgtctcctatctagatggctccgtccttacctacccgtggaatcggtcgtcgctcatctccccacgttgcatcccgtcatccccatcgagcgatccccttcctcctgatttctgtctagaggcggcatcgatgctcctcgcctcctccaagatcttccatcgtaggtcgtcacccacgacggcttgccatctgctatcccgtgcccagatgttggatgcatgatctcctccgtcggcacaatccgtgtagccgcatccatcggcgttcgtctccccgtacggtggcgaccggattggccactgaccagtgcctcatctccgtacacgggagtggggttttcttctgttcaagctccctcctcggctgctccgttcatcttctctggatttctctggtgagtctgctacattctttgccttcttttatccccttccttcacccttctctggtcaactacatcagtggctgcaagcctgcaagatggagctgagttgggaggctgagcaagcagcaacaggaggaatcaaggaacaagggggaaaatgtgagggaggaggaaactgggatacctaagtaatttgctaatgcgtttttaggctacctattccaatccctcatcgtatggtgtacattcagattcagatatgattggcttgatatttaggaggtaggttcgtgctttgtcctaatttcagttatttgtttttattttcacaaaattgttcaatttggatatacctaactttttcagtctttagaggccaaatcaaggaatgcaaataactatagagttgtacagggttccttaagccctctattaaggtaaagaacatggaaatctaccaagtagaatagaagttatcacaatctgaactctgttgtattgcagttcaaccataactcgagctgtcaacttgcaagggttttcatcctgtctatatggtcaaatattgccactctgtaactaaatgttgtaaggtatgtgatcctcaatccaatgtttgcgtattaatttacttattgtatcaagcttttctattaacagagttgtggtttcttgtttttcttgttctgtatatattgcaattcaatatttttatatcagctactggatgacaatgattttcgaaaactgacatggcacctcacttggtcgcattaacgaatctagagtcatgttctacttaatttcagcgatatgtgcagttcattatgattttctctaatatatgatgtgtctcagcctgtgagatagttgccagacacttataatcggtaggtcatccaagatacaagtacaaagcaagagatattcatcaaagggtacacaacaattttgtaggtaagtggctttcagttttgttgtaaaaaaaacttatgggaaattttagatgtgctactttattcgctgaagtgttatctgtatagattagtttcacctcattatacacgagttcatgcaggaccaacacaaattattgccatgcattctctatattcttcactgtgtatgatacataacgatataagtgatatgatggcattaaactattgagaactgcggtttggtattatgtgccagattacccatttcaaaattatacaaatgaaacatcctattgcaatagctattgttcggctttaaatatctgaagaggattttaccaaattgttctttcgtccaggacagccatggtatctgattattctcaattgttcttgatcttcagacaagtgaaaaatcgttggtcagtttgaaggaacaaatttcctcttgcaaaatacctattcctgtctagagggccaatgcactatcctcagctcaggaaaacataatggatgaagctgtcaattgttccactgagaaacaaacacaagataagataatagtgaacattcatactgcattgatctctgctctgagttctgagcaagaggtaaaccttatgaactttcttatttgatttatttctgagatgtgcttattaaatttttgcatggtggcattagtaatgttatatggactatcaggtcaatcttgacgcttcttgaattgaatcaatgcaaaaaaaacacgataattatttttgccctttgtatcatggagaattagtagacattttatgttcagatattatagtcatatgtgtttacttaaaagccgtgggattggttgaaggttagggccgccacgtcagcaaattttacaaaaaagaccctgtgtttttgttaattacatactggttcccaccaacatcgtccgttcgatctcgcggtagagccgatctaaccgtccacgtgtccactgtggcggccctttctcagccgtgggatcgtcgaattggcaatcaacggcatagatttcgtccggccggaccaaaccctagccccatcgcccgtctcggacgcagcctggcgcacgcctctcccttctacgcgactacgccggcacgccgtagcctctcgccgccgcctagcccttcttcctttgcgcgcgccgtcgccgctgcatcctcgccctcctccggccatcctcgccctagccgcactaccaagccccgcgtgtgtgacctcgcctgtcgccgccgccgctcgactgccgcctccgccgccgatcgcctgccgccgccgccgccgccgcggttgctcgcctgccgccgtgccgctcccctcgctccgcacaccaggccaccttctcccctcttctcccctctcatctccaggccacccaccgcctccctcttcctctccctatcctcggtgagctacagatccggttcgggggtcatcggaatcgatggtctcggccattggtctcctcgttggtgaatcattttgatacccctttcagccacaattgttttgtgcatacatttagcacaaaatccacaaggtaaggcaatggttttgactcgccattgagcatttccattgcgtttgctggtgtttttacatgatcccacatcttgccttaggttctgtggagaaattgatgggctaggatgaggtgttggtcgcagattacagagaggacgacttttatgctgcgcatctacagtcatactgagcaaatcctctcttaagcagggctgcgatatttagattatggtgagtttttcttgggttcagattatttcatatgaatttagctgtcagaagttccatggttattggttttgttgctgcattgtatggcaccccttgatagaatgacgtcaggaaggaaaaagaaaaccatgctaggtactacaaggctataagtataaggttatatgagagtattctgcaaacaggatatgcaatggaaggatattctttttattaactttgctaaatacctgccaatagcccaatactgacatcaaaaccccctagctctaatactgggagcataacacgccgatagacagtgtgcaaagcttttactgatgtctaatttgttgcaacaaaattattactacaccggatttatgtggtttgttgtgtttgtccagttcaacaaagaaagttggtaggatcatggaggaaatgaatcttatggttattttttcattgcttggtggtgtttcagacaactcagtctgctgccatatatccataaaacaaaacgttccgacaggtagttatttagtactatcctacaaacttacattctgccaaaaaaaaataactttcagcgtgcctgttatttttataatttaatgtgtaaatgatgaagagtgcaagcatctttctcctctgccttgacacaagagtttaggcctctagaatgtcctagcagcactgaaagtactctatgcatataagcatataaattttccatgttgcaagtcacagttatgccagtttgcttctggttatgtccacaacatattcaatgttgcaaaataaatataatgtagccatgcttcaggttacagcttccaatccactcttttaatattatgtagtgtggcatatgcttatgaaagtaatccataatactactatcttctgtaggctttcacatttaactattttattttgttgacatcgtttaacctggtttttttcccccttttcctaagtggttggttgatactattccaatagtataggtgcataccgcttattggtttattttgggtaatcacatacgcgatgtgcctacttctacatttgactattagaccatggtttaaaatgctatttacttgcttacttctacatttaaattatcaggaattgtgttcatcttttagaaataacattctgtcaggtcagagatttcggatggtagtttgcagtttgctcatgaatttgctttgtacttcctccgtcccataaaaaccaaccctagggaaccaaacctagggacgtcctagggatgaatccgtccagattcatccctaggtttggtttttatgggacgaagggagtataaattaagactgtcattttactgcagttggcctgcattcatattgaaagatttaacaccatcttacccttaggatctgtcgagtgactgatgaattacgatgaggtgttgttcatagataagagagatgtcttgtgtggtaccactctgttgtgccatcctgccgagggacccatctagctttgtcctcactcttaagcatggtatgtactatgcaatattcaatcgataatctccttgtgaaatttgtcaacaatattagatgcactactagaccccaacaatttccttctttttttttgtttttaactacaacccagtgattccttttattgcttccatgtagtatggggaagaatattctttcatgcagtaaggcaagaaatcattctgtcataagttaatacaattctcttatgattatgtagtatgcactaggttagttcattctctctcgactagattgttcgctgtctaggattaactaggattaaaagggatatcatattccttaaattaatgtttgcttcttttggtttgtggcaagatcagattcatgttcatgctcagttttgtggattcaagtttgaagaacacaaacaatatgcaggtgcatcgttttttatttatttccatattgttcatgtacaacattgtttaattttaggaaacactaactgcttcatgttgttcctacctctattctgaaagaggtacagtttcagcagggagattcatcttgcaggacacaattcatcttctttaccacagtacggttaacaaaagcttaattatattataatgatcatatacaattatgcttcacttctattaagggaatttttctttacttcagattatttcatatgaattcagttgtcagaaattccatgtttattgcttctactgctacattatatatggtatgatatggtggtgccaccttacctagcttgatagaatgacatcgatggcaaaaaaaaaaaaaaaaaaaaaaaaaaaagcatactaggcatcactacaaggctatcaatagaaagcttatatgaaagcattctgccaacaggatatgcattgaaaggatatactttttattaagattgctaaggtttctgccagaaatgacatgatgcgtacaatgcagatattatagatgatgtacatgctattgttgatgcgcgattagattagtttatggggtttgttgtgtcggtccagttcaataaggaaggttgataagatcatggaggaaatgaagcctatgattgttttatcattgcttggtggtgttttagatgactttgctgctccatgtttgacaaataggacataagcaggtagttatgtaatgctgtcctacaaacttatattctgcccaacaaaaaaaattttagaagatagctcttatttttataatgtaatgtgcaaatgatgaagactacatgcaacttatttgtctttgcaccactgtctttgccttgatccaagggtttggccgggcctctagaatatgctagctgcaccaggaatgttctatgcatataaattctccatgttgccggtcaccagcaattgcaattataagattctatcttaagttcatgacggaatacttctcttatgcttactgtttgtgccacttcttaatccatggccatcatgtgttgatagatgccatatttctcttttcttctctcttcgtataaagtagcctctaacgctggaagtacacatcccagtaacctattgttgtgtgtatattattcccacaattttcattaatttttgcaataacattgcatcatcttttgcaaatcagttttgactattcttttttttcaggagattcctttctgatgtatataatggtgaatagagaaactcatgcaagagcaataccacctcagttactgccaaaagatcagagaatcgcctttcaaaagctgagccagcattgctgctcttgaaaaacacatctatttctactatttttgtttggtgatatttgtatcccaaaacctatatttagactatatcatggtgtgtatttttgtgccgttttggtaattgagacattttttctctattggtcatgatttatgctacataaaagagactgtacatgggaggcctctctatatacgatattacttctcttattttgtcattaaaatcattagtacagttgtaagttactccttggcaaactccaatggtttatcggctttacaaacactgtacaacaaacattgcataatctttatgatcttctgcttaggtagtgtatcagatactgaaatatgcttacgcatattctttgttctgctaatgcattataataatactttttatataaaacaatatgttttctcaataaagttatattcatgtgtatgtggccaggtgctattttatacgc

SEQ ID NO: 65413 - DNA, 679 bp, Oryza sativa
ttttgcttccggcgccatcattcatctcgccgcttccggggcggtgtccgggtgacgacgacggcatcgatccatcggctagcctgtatggccgtgcagcagagattccggccaggtgacagcctcgatcataattgaggcgatgcaattcttgtacaaaaattgaaacgatacttctttctccagggatatatatactcagtagttgttgtaactctgacaattctgcagctcgtacaattctatacacaccccttgctgggtaaatctgctacgagtacattttttttaataatcgtgtacatatatcttcaatgaggaatgtagtatatactggccaaagaatactacatatatactgaaaaaaaaaggggggcagtatatatatactccgtcaacgaaaaaaaatcagtatatactactattatgcaaaaaaaaaaaaaacaatctagcttcaatgaggaatgcagtatatacgtgctggccaaatcgtcattgagtacatactgacaaaaaaaaaagagcagtacatactactaatttagaaaagtggtatatactgaaaatctagaaaaaaatggtatatacttagtacactagaaataacagtatatactagtatgaaaaaaagttactaccaatgtatgaaaagtgatatatattagtagtccaaaaatcc

SEQ ID NO: 65414 - DNA, 637 bp, Oryza sativa
acttagggagaaactgaacttctttcaaggccgggctgcggacggcagagttcgaggagagtttgcccacgccgtgctcaccaacgaccgacgttcttgactcgccgtcaattccagccattgctgtccaggtgctttattttttttaagacagctaggaaggaaacccgcgcacatgcgcgggcacttatttaatgggtttgaaattttcttatgaatgttttatgggtaacctttttattgaaatgttttctactctattctaaacatgttttttttgtcaatgaattatttttcctaattatccttgcggcatataaattataaactaaaattacatggaactttttggtttttaatttatgagaaaatattgtgtcgtaataacctactcccttgagttttaaaattattgacgtcttaagctttgacattaaagttgccagttcttgacgttctaaacttagcctacttataagccattaaagagcatgtgctgcatgcatgttttctcattgctacagcacagctgctttgcctttctctattcgtgcttgcctgcttgcattctcgagtgttttctttttttttttgaatatttggcataccttgatatttttagtttctaaactaacat

SEQ ID NO: 65415 - DNA, 1284 bp, Oryza sativa
accaaatcctagtcaataccttgctagtcaaattccactcgtcttccaagctccatatcagctacaatattacctatataccactttccataatcttcctcacccccaccatatattctccacctacctacaacatatacataaattatagagccgagctgaaatgctatcctatttcagtatcgactcgagaacaactaaaccttagtttccatacgacctaaacctagctaccaccaaccaataccagtcacataccctcttaaccaataccattatccaaactagttacttctcatcctcctactaatcaaacccacacatgaaatataagcgacagtagttgcttaatcccctctagcctccaaccctttagaacctacacataaaatatcagcccagtaatccatataccctataaaagagataggctataccctaaaccctagccctcctaaccgtttatctctttctttctattttatagcttttattgaatttggttcttcttcttcttcagtagagtctattatatttggatggcagcctgtggtatttcgagcatcggataatcaagttgcctatctcggatttatttgcgttggagcaaggcaagttattattcctcccctttgagcataattatgctatattctatatctccattatctcatgcattagtcattcatgattttgaatgcataacctgaacatatagcaaaccagatatgctagcttttgcttagccctacctagttagactgtataaaatataatgaacttagattggaacagtatggtagaattggttgatttccgggtggctagtactgttccaaccgacataagactgcccaaatacttgtgaagaacaaacgagtacgaccacagttctaggatggggacagtggttctttttaagtcctcgcgcaggaggaaaacttatgccgagcagggcaattgtgatatttaccgaggcgcaagtaaatatttgtttgagataaattatgatgtcatatgacttgtttgtaaaccctaattgcgatgacatggtgtcatacaatcagtcctctctaaataccccgggaacgccagaactcctatcgctgctgataacgttacgttcagagcatatggggactagagttcatggaacaggtgccactattgttagtaacctaatgctgggctatgactaaagctgatgattatcgacaagtcgtgggccgtgggtaaagcgtacatttactacagtaaagtataaatgaatctattcgaatagcc

SEQ ID NO: 65416 - DNA, 3172 bp, Oryza sativa
attgtgtgtttgcatggtgttcctaagaaaatagtatccgatcgaggtagccagtttacttcaaagtgttggaagaagctttaggaagagatgggttctaagttgaatttcagtaccgcttatcatccgcagacagacggacaaactgaaagggtaaatcagattttggaagacatgttgagagcttgtgctttagacttcggtggaagttgggataagaatctgccttacgcggaattctcgtacaacaacagttaccaagctagtcttcaaatggctccttatgaagcactatatggtcggaagtgccgcactccgctgtcgtgggatcagacgggagaacgtcaggtttttgggaccgatattctgagggaagcagaagagaaggtaaagatcattcaagaaagattgtgtatagcccagtctcgtcataagaattatgctgacaatcgccgcagggatttaagttttgaggaaggagatcatgtgtaccttcgtgtcacgcctcttcggggagttcatcgttttcacaccaaaggaaaattggcaccgcattttgtgggacctaataagattgtcagtagaagaggagaggtcgcctatcagttggagttacctcaatccttggcagatgttcataatgtgtttcatatgtcacagttgaaaaggtgtttaagggtacccactgaagaagccaatcttgagtagatagaaatccaagaggatctgacatatgttgagaaaccaatccgtatcctggagacagatgagagaagaaccaggaatcgagttatccgtttttgcaaggtccaatggagtaatcactcagaagaagaagctacttggaaacgagaagatgaattaaagtcagctcataagcatcttttcgccagctcttccgaatctcgagaacgagattctgtttaaggggggtaggtttgtcacaccctaaaaatcctgaatttataaattgttgtttaaatggaattattagaaatgatttaaaaagcctagaagaaaagatctaattttaaataataaattccaatataaaagtgggctagataaaattttattaaatacttctatagttcctagatttttctggaatttatttgggccaaggaaatatttttaataaatggaattgcatttcatgaataatttaaaaaagaaaaaggttttaaaaatcttcttttggctttgggccgaaagtcggcccaattctctccctctctctcctcggcctgcttgcgcccggcccaaccagccagtcgagccgagccgccgctcgcgctcctctctcccgctgacaggtggggcccacctgtcagggccatcgtcttcctcgcgccgcccagccgcgccctaccgcgcaagccgccgccgcccccttccaaaattcgcccgcgtctttatatctcggatcaaatcaatagaggggaaatgatcctcgggatccccctccttccttttctcttttgaatcttcggctaatttcgtttggaaatcgttgaattcgagcttgattcgaattcgttttttcctcctaaccctagatcttccatcgccgttgccggcggccgtgggcctccatcgctgctcctagcccctatataaggacccccgggacctcctcttttcgtcgctacgctcgcctcagctcgccgccgcttgtagcaccgcctccgcgacaacccgtgcgccgctgtcgccgctgcgagtccagccatgcgccgccgccgctccggtcgtcgtcgtcgctcaggaaggctgccgtcaggttcgccaagtcgtcgccgtcctcatcccatcctccgtttccaccgaggaccgccggagcactgccgtcgtcgtcgacccgaacgcctccgccgcttcgacctcgtcgccgtcgccgtccgttgccgtccgccgttgtccaagctctcggtgacttcaacgcgtcgccctctacgcgtaggcgccctccgtttgcgccgccgcgccgtcgttcgccggtgagcgtgagttgccgagccgccgccggtgatgacgtcatcgccgtgtcatctgtagacccgtggtggattagatcgatctcggccgttcgttttgtctagattagatctcggccgttcgttccgtagaccgtccccgtgcacctggtccaccatgaacccgagcccgctgacgcaataaatcatttttccttttcaaaaataattctttattccgtcataattcaattaaaatctaaataattgatttaatccgatttaatctttaaaaactcataactaattcatcttagctcggatttagttggttcaagtctctaaatttttctaaaattgagatctacaggttaaaagtatccacatgtactgttcatgattgtttatgtgctgttttggtgattttgctcttttatgcttcgattccgacgttcctggagagtccgattttgcaggagaagactttgaagagttccaaggccaacaaggcaagtcacacatatcccaaacaatcctttgagcatgttgatcccgtttaaagctattgtttctattcaactactgcatttattttcgaatgtcattgggtgggaataacctattgcctttgttatactttgtcgtttgattaataattggattagctagaacattatatagttttagctaaaagtgcataggatgcttagccatgcttagagacattagctcatataaatgggataacttatgattcactattatttaatgatggcttaatgatagctcacgatggttaatcgtgattggttaattaattaatttgccaactaaaacttgataatggtgggttgtgagcgcatggttttgatggtcgtgctcatgacaattaaggaccggttcacgattttcggttgtgaaacattaaccgtgccaaccacaagccagcgtgggcaacggctttactttttatatagtatggttcattctggagcaccagactgtgaagtggcggagataagcacacgggggtttctggggagtctatgccttgtttataagggggtgattatgatccaggaatagtaaactgctttgaattgtgttatgcagagggtattgtcacaatctctattcgggtacttgttaagtatcgcgacgcatggttgacatgatgttgaggttgtgtcttgtgg

SEQ ID NO: 65417 - DNA, 6830 bp, Oryza sativa
tcttaatgccactagaatttcaccaattcccttatatgcacttaaaattggcttctcccttatatgccactagttcaagtttttccacccttttatgccacttccaccactatagtgttagttgactgttagtcaaaggttagtttttttcataaatgaccaatatgccctctcaactaaaaaatgtgtaaacttcaaaaaaatcataactagtttattttaaatcttttttaagtgaacaaaattttgtcataaccagtgaaaaatgctctttatattaaaaatattgttggaaaactgcatgtttcatgcttacattgaaaatttatttgtgatggtaatggtaatggctaaaattgcatgtgatgcagaaaaaatcaattttcatatgttatatccagtagctatattagtactaaaatacctattattggttgtatactaattctcaagggcaaatgcatctttttacaatcaagttaacggtcaactgacggtggattgacggtaatggcataaaagggaagagaaacttgaaccggcggcataaaagggagaagccaatttaaagtgacatataagggaaccagttaatttagagtggcatataagggattctctctatatacttatatacttagtacactagaaaagcatatactggtaagaaaaaagttaccgccgctcaggaaacggcgagatggatgatggcgccggaagcaagatctatgcatgcatccaaagaaaattaattaaacagaagttcacaatcatatttggaaacgaatgatttggtgcatacctatagagatctaacaagaaaacaaaaagaaaacagatccatcttcttgatgatcgatgacgttgctgtatgattcagcgagcagatcgatcacgccgtcgcctccggcttgccgatgggctgcgctgtggacaccattgccactggatcgtgacgtcggctccggcttgctaatgtgactgcatcgtagatgcagaaacgccgacagatcacaccgtgaatgtacgccgaattgccgccgcggacgccgagtcgcctatcgatctcacggtcaccgccgaattcgtccgtaaatcaaggtctcgccctgggatcgatctgtggtttgatttggcaccaccgtctacgaacgagagtttttaaaagtggttttcacggttgttcggatcgctatatccacgaaaatcaaaacgggtccggtagttagacccagtaccaggtttgatcgggactaggccgctgatgtacggtggatgagagcaggagtacgtacacctgggtgtatatatatatatagaatcggatctctcttttgtactcccaggtgtatgtactatcttttcttaatggatatccattagttcaaaatgaataattagattaaaaaaagaaaacaccattctttttttcaaattatctgcatgcaacggctggtgcgtaggactaggttaaaaaaaattaatggtagctcgttaggagtatatacctttttttctcattataagtatatacttaggctgcttgttgttagaagtatatatacttgttttgcagtattagtatatcctttttttttaagtagtagtagtacataacttcttttttcatttagtaccactatacttaggctgcttgttgttagaagtatatatacttgttttgcagtattagtatatccttttttttaagtagtagtagtacataacttcttttttcatttagtaccactacataccactttttaatttaatgtcagtacatgtatacctttttttccggatatattatgatatcttggaatgggtatatactgattttttcttggatgaagtatatatactgatatcctccctgaatgagtatgtactgatcttcccttggaggaagtatatatactgatctctttttgagtgagtacatacttatctcttctaagagtgagtacatacggatctcctctgagaatgagtatatactgatcttttagattagtagtggtttatatttctttttaattagtaagtggtatatgcctcttcttagtcagtataatttttttttaatcagtatatactacattcctgagaagtttatatacttctgtttgatctgtatttactgcgtttctcattgaaggagtatatgctagaacgttttttagtcggtatatgctagtattttttttgtttggtcagtacgtacatactatttttacctggtagtatcaacgatcaaagaacagtacgtatataccactaagcagtgcatgctgtttaaacaaacgagcagtgtgtaatcatactgattacaataacgagtggtatgtaagatataatcgattaagaagtacagaaggttaagttataatcaactaagaagacggtaacagtacatagatacaactgagattaagaaaaagaaatcatagctacagaggaaaaactgcatcactgcatcgccatcgtcgtcagactataatcttaagctaagctaattgttacatctctaccagaaaccaaatcacaatgggagatgtgcgtacatgttcgtatctgcggtcttccaccgttgccgcgtgattcattagctgggaataactctacaaactggcatcatcgtgcatggtcgatctgtggcagccgccggccgaatcgttcgattcgtttgcctcgaccagccgtactgattttagttggaggagagttcgcgtttcttgctgcggtagtggaactgtggaagccgccgccgaccctgatactgttgccatgggaatcctgcgaaaggggagtaatggatgtaaacaaccatcaatgataattcaagcattgaaaggacgtaaatctagtcgatcggcaccatcgacggggagcacaacccaactacctgatgtcgttgctaatcccatccgtctgaggactgtatgaggaagcgggtggtcgaactggttgatggagcgcgccgtccacccgtccgtggctgccgtggcaagattgctccagttcttccaccgccggcggacttcgcgacctccaaccaagctaccgtcaaggaaccgtcgccgcctccgcctcgcgtcaaaccgcaaatgtcgcgagagctgttcgatctgttgagtactaaccggtgcgatttatataattaagcgctaattaaggatcatggattattattttacaaaaggaaaatcaaaacgggtccgttcggtgatccgctaaggagcttcatcgagatggctgtgatggacggtagatggaaccgggtgtacgtactcccgggagtacataatcattttcatatatatatatatatatatatatatatatatatatgacatatattaataatatgtatttatacatatatctatgcatatgtacatgtacaaaatagacatatatgtatatacttaacattttatgtgcatatataatatatttacactaaagtaaatgtgtacatatataaatatagatatgtattacaattcattatgtcctagctacgacttcgacgtagtcgttatctcagaagttaacgacttatgaattgtagatccgtcgtagtagaattcaccctcgggatcaaggacttgttcattgatgaatcccatgagttgttcttgaacagccgtgataaagtcctcgtgtgtgaggttgtccctcatgtgaataacctatgaatgtatgaagttaattagtaaacaagaaatcgatacatacgcaatgaaattttgaatggtttatttatacgtacatcgagttctcttgtggtgatgatttgggttgtaacgcagtggcaatactcgcatatgtagtagccgcacaagttagttccctcttcctgttttgcacactatatacatgacaaacgacgagagattttatatttgaattagagattcgatataaattttgatcatgtactcactacaaatttgaacctccggcgaagtttttctttccaagtgccacggaccaaatgacggaaccgataccaagccctacatgaagtttaaaactatatatgattcgtactagcaatagcaaaattcgtaataattaataacactggaacatatgacattacctgtttataagttcaaaaatctggtcaaaagtagactcatctttattcattgagtcatagacattgactctacattccttcaagtcgaagagtaaaaggacccagtggaatatgcaatttgtgtgagatgatatatgaaacactgtgcatctatatgtacgggaacgaaatttgttcggtagatagtaaaaactaactctgtgttgtacggcagtagtatgaacgtcttgaaatgctgctccttgaggagatggacgagattgacctctgtgggttgcggatacttggtgaccatttcgacgtttactttccgagggtcgatgaatccagtattgaaaaacccccgctgtcgagccctttgaatctccattctacaacgatgaaggaattgttatatatggtgtacatatatacaaggagctaattaaaggaacgtaagaaatataactcaatgatatgtacaaaatccatgcgctcagaatagagacgtcgagggcatctagttggtatagttcgtagatatccttgaaattgatccagagaacatcttctccttgtaagaagtcggagttcttgattctcgctccaataatctccctaccgctggcgctcatctccatgtaccattcatggaattggtacatctgtgtgggtagggactgcagctgctcaggcttgacaagcggtttaccaagttcgtcaaggtgtctcacttccgcctttggaggtgcacctctaagtaactgagccctagttagcccgatatcagaaatgaattcttttattccaatttcttgcccagtcaccaatggctcgacctcctggtttggttgctctccaagctgagggacttttttggactttctataatatgctttcctaagtgttcgctcatagtccgttagctttaaggcctgcttgagtggtcccgacatcttctggaagaacttgttggcactcgggtctataggaatctgcttttctggacttcgaggcttcaattatctcttcacttctacagccacataagcgtcaagctcctcttgcgtgcaatcgtacggcggctccttgttctcggcggcgtcaactttcgccttcttcattgcccttgtgccggcaggcagtggagcttggtgagttcttgacttagaaggtgccggaggacacggcgcaggagcctgatcaggaggagacggtgcaggagcctgaggaggagacggtggagccggaggggatggtgcacgagacgccgcttgtcgcccagggaggatgaggtagcgcttgcgccatagtataatggcgtggcttgtgtcacgtagatgcgtctcaccgtctcctccagggtagtccaattcgaggtcctcgtacgtggcttccaccagctcaacttcgactctcgagtatcctgcaggaatcggcctacagtggtaagtccctgaagggtccgttgggatggccattcccgacacaaccttcacgtgatgagaggttatctattagtaatcaacctaagcagaaacttgcggaatgtacaagtccaaaaaacataaactacgggcataccttgattgataagttcttgaagggaatatgcagctcacgtggtgtctactgcgtgatttcatcaacggggcaggtggttacgtcctgagtttgcatagcatccatgctctgtgatcctacctgccccgttgggtcatggatcaattcaagttccttcttataaacttgtttatggacacgaagcggttttgccatgggaaactaaaatcggctccagacgattagatttacaagacagtttagcagccgatgagtattacaatctcatggtagatgaaacagaagatttggtccaatccagattgagagcccttgccaaggtgagtaaggataaggaacgggttgctcggcattataacaaaaaagtggtgcctaagtctttttctgaaggagagttagtttggaaattgattttgccggtaaggactcgagacaacaaattcggcaagtggtcacctaattgggaatgaccatttcaaatacataaggttgtgtccaagggagcttacatgttgcaaggacttgacggtgaggtttattgtcacgaccggaaataacccaacgggcgttcctgacgtgcgtgcattaatccttgtcccaggaggcaaggtacaccaaaagttgatacaattcagagtttaacaagcggaagcgtaaatagttaacttattacatgggcagcgaaggcccagcacacacagagacaaacgataaacagcggaagactagggcgacgaccacaggcgcttgacggcaggcacgagctagacaccaaagccttcatcttcaaggagctcctcttctgggcttgggaaaaattgagcaagactgagtacaaccaccgtactcaacaagacacacccacaaatgcagaataaatgcaagggagtacaagggaattataccataaagggttagggttgcagtaaacagcatttaaagacatttagttgctcaaagctattttgtaaacgcgatcctagaactatacaatattatttatcaaggccgtgaacccacactaacctgccttaacccaaggcctatgatgattcaaaccgaactggcaacccgaccctgggtcccaactcgtcccaagccaacccaggccaacaattccaccttttagtagtaagcagggtttaagaaatgaaacact

SEQ ID NO: 65418 - DNA, 1065 bp, Oryza sativa
ccggaacccccgggacaggcaggtaggactgagcccctagcagcaggacaccggccgtgtgccatgacatctcgactaccgggccgcagctcgtgtagccttcatttgccgtggagaatgtccatcgacccccgacttcatccacctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgcgcccagcctaaaaccattttggggattttgaatagaaggagcggtgtgaagccaattccacaataaccaaaccattccatagtatccaggtgatatgaatatttcccaaagtctatagttgaaaaaccacctaatgttacctaattaaattgcgaagcatctacctaaaattaaactagtggtgccatgagtagagtgtccactagttgaggttttgtttattctagggtgaacaaggtaataataataacaataacaataataataaggtcataacaaaggtaaataggcatggctaaataaaacagtgataacgcgggaatttaaataaagcgataatgcaataatttaaatcaacataattttataaactgggattcaatatgctcaaagatgatgtgacttgccttgctcgctttcccaaacgtcggcttcaacttccacgaagagcggatcttccgaagctgcagcgtctacacgaccaatggaaaagaaaaggcttttactctaataaactccatataacagcagaaacaaagcacaaaaatgggttcttgacttcttaaggaaaaattagagacttgaacggtccaattccgagttcaaatggccaagttatggccatttgaagtttatatgctctttaaatggatatttgcgaatttcttcatttaaattttaattaaaaatcgtatttattgcgtcacccgagggaaggggcacgcgggccggatccacgggggtggggcccacgcggcagccccacgg

SEQ ID NO: 65419 - DNA, 1210 bp, Oryza sativa
cctcctctcccgggcctctcctcctcctcccggcccacctcttccctccccctcccggcccagctccctcccctcccctctctctcccgggcctgcctctccctcctctcctcctgggccgcctccgggcccaagccgagcggcgccctcccacccgtgccgcgcacgtgcgtgcgctgaccgcgcgcctggccgcgtggggcccacgcgccggtcgtcttcctcctcccgcacgggctcttctctctcccgtgcaaacctagcgccgttcctcctccaaatccgccccaatcaagccggctctttccaaattaattggggggttttaatccccattgattcctcttcaattccccccaatttcccccttgaatcgtgcccccaatcgccgggaacggacgcgccaaccccggtcaccttgcaaggccgccgggcgcctattccgccgccgttccccgcctctcccatggccggctccctctcctcccctataaaatggaatccccatcctccgttctatcgttttagccccctcccgcgttctcccgtggcctcaccacccctccccgccgccgcccttctctttcccccgcgccggcctcctccagccgcctctccctcctcgcccgagcgccgtccggccatgccgtcgccttccccggcgtcgcagccgcctcctcttccccggcgctgcctccgattcgtggggaaatcatcggagacgcgcccccgccggcgtccagtggcgtcgccgccactacaccgtctctggccggctgctgttcgtcgccggtacgccgaccgacgtcgccgtctcctccgtcgacgtcgcagcgtcgtcctctcctccggctgctcctcagtttcgccggaacaccgccgccgccgcgccggcctctcgtttctcctcgtcgacgtcgccttcggtagccccttccgccgtgcccgtgcgccggccgacgtcgccatctccacctccggcatcacagcggcaaggtcgccctcggcctcgcctcccctccacccgaacaccgccggtgtctgtcgtcgttttcaccgttcatcctcgccggctcgtcgtctcgcggcgccgcctccgtcctcgtctccgtgcagccgctgccggctgccatcgtcgtctcctcgccgtccccggtcgtcgtcgtcgtcgtcctctcgtcgatcccggttttgctcgtcgtggcgttcg

SEQ ID NO: 65420 - DNA, 53492 bp, Oryza sativa
aagatggatgcgtggagaccccccaaaagtataaaatcaaagcggaccggaactcgagaagtgcataggatagtttattttttgcaatcgagtttttagaaaaaaccgtactattaagaggggttctaggtgatgctctgagatatctcaagtgctcttagtgtgaaccaagtgtcaagtttccctaggagtcatttttgcaaatgctccattggtccaaaaatgcaagtccggaacttcctgtcttccaggtccggaacttcctgtctagtttccagttcaaatttgtgagtaacggctagatgacgtcacctagccgttatacatatacagctcgtttccagctcgttccttggccttccactttcactttttgaacctagagctgttgctagcctctcccaagtgtttcttgccttctccactcaatctagagcctaattcttgtgagaaagagagattgagagggagagaagaagatttggagatgtgtgaagactaggatcttgggtgagcacttggaatatctcgtgggctgtcatctcggtgctaattactcttggagatgatctcctagacggttaggtgtcgcccacgagaatccgttgcatattgtggatgtcccgggtaagtttatgaaggatctcctctcctccaaaagggaacgaggtaagttaatgaagttcttgtgctgagattctagaggatttccaagtagagcaacctacacttgtggcgaatttctagaagtagtttgagttggattttggtgatcactcaattctagaaacttgcctaggggtgtttgtggttgaaggctgtggatttcctctggagtttttgcacaagtgaggcaagaggttaatcgagacccagctcttgagctcctcaacggagagtaggatcgcaagattcgaacttcaggaaaaaaattgctcttgtctctttctgtgatgtttttttggatgtttctgtgatctatcttctacttagaatacctgtgcatcatcttgtgaagattggcttagtctcctgattcgaaatatgaatttcatccttgttttgtaacccggaagttcctgtcctaagaacaccggaagttctgggcctggcaggccggaagttccggagttccttaccacgatgttccgggtctgtttgaattttaacgctgcgatttgtttttaagttttcagggacagcctattaaccccccctctaggcttcatcagcacgttcaacaacagccaagaaatcaagtacaaggtggagaactcgagtgtaaaaaagttatggtttgttacaactgcaaagaaccacgacattactccagggactgtccctaaccaaggaaaaaaaatcgcctccacattttcgccaatttacaagaagcagacatgccaatcgccaagtgttcactggagcaaatgcagtacctgtcaagcctagtgctagtcagaagcaaccataacactcttgtatcgatgttcaagtacttttgttttatagttgttctctaccaaccgtgtaataaggaagaaacgggaaataatgaatgagtttggcaaatgtatgaaggatccatattgagactgcaagtgttgtgagttgtgtacattttgttgatgattaaggagacctagggtctcacttccgtaagctcataatctgttatgaatcaaataacctagcaattgatggcgaagaaaatcaagtgatcaaccaaagagacatttgtttggactaagagtttctgatgtgtcctttttcggatcaaaggcaacgatagtccgtatagcttttgacgaactatttcaaggtttctctgaaaggcagtaggcccaaggacctcattgccccagaagcacccacaacatccggagtgaagagtacttggttgagaaaggtcaaaaggtgattaacggaagagatcggaaaagatgtttggttactgggaaaagaagtaggtcgaaaggtgattggtaaaggataatgagaaacatgatttgtgtcactcgaggaagactcccaatagcaatcgaccctacaacagtcaccatgtcattaaggcagatgaattcgtgagtaagcaagatgaccacaggtagaagtacttccatgaggacaaggatggaaacctttgtgacatgaccaagaagtcaagaagttaacctgaacagttggaatctaaagctcggttcaaccttcggctctgtattagatgctacctagaataaaagcacatgcactagtatcgttcaacacaatttcctagcaatcgatccattgggaaagaacacatcaaggttgaaggtgtgaaagaatacgttgaatgctaaatgatgacaacatgaagagaatagtggaaagtaaaccgaatgtaaagaaagtggatccgagtttcttgttcatgagagccattcccagttatgaaccaagtgatatgttcaaggataatctacagaggtcagattaaaatcacatccaataaaaaagcttcagacttggcaggataacgatcagacaataacaagtctagcagtaaagtcatttgggaagacgtcaaagcatgtcaagtgggataagttggttctcttgggaagcataattcaaagttagagtgatcgacccttgcagtgaatagcagaagtatctagcacccagagaccagaaaagctaatatgagacagttagtggcaagttgtcaatcatggtatccttggtaagcgggatatgatagtctaaagcatttggtggtaagctggaaggaaacgccaagcatggtattctcatgatgacaagcatggtatcctagtaatgacaagttggtatcgacgcacaacgtgaaattggtaacttgtatgagattgacaccaagggtatgaattatgagaagtcctcgaactgaaaccccgtcttcaagtaccgcaccccagtcgaagtcagctcaaggtgcaaccaaggataagtcaggtgaaaagaagattccatctgcaacaggagatcaagccaagcagttcagagtggggaagttttgctgggcaagtttgttaaagaagacgcaacggaagaagtcagaccagaagagaagaccgcccaacctatcttcttgctagtcttctcgaatctcgggggcgagattcctgtaaggggggtggatttgtcacgcccgtgataaattcatcctgaaataaaattcattttctaaaaggaataatagaattaattaaaattcaaatagaatttggcaaacgttaaaatgcgtacaagaaaaattcgaatgtggcctagagaattttttttaaattctccttggtctaaaaggagccctcaaatttaacttgaattttcagaacaccgggaataattattaagcaacaaaaacaattatcaaaatttattaaaaagaaaaactaaaaattaatcctccttttccctttgggccaagtctggcccaaagttttcctctctccctcggcccgcggctgaagtctctcttccgtccctctctttttcctttcttctctgtcgaaacataaattcggcaataataaaagagggtagcgcacgagacctaaaagtggatggatgcggagacaaggatttagacaggttcaggccctcccaatgagaggtaataccctactcctgtttggggatttgaatccgccgagtgtagtatagatctgacgatctagttgtctcatatgccccctagagggcctcctgcccaccttatataggatgaggggcaggattacaagatagaaaccttaatcaatacggtatcggtttcctaaatctactttacaatattatcaaaccaggactttgggccattccgtaagatacaaggaaacgtaacacccaagtcatgatctgttacatgttccatatatataagttatcccctataactagtaggataaccatgccgtgtgggtatggggtacccataatctccacagtagcccctgagaccttcacagtcgaaaagataatcttctctcgaactagattactccaaagccgagtgcttcaatcatctttgccatgatctcccgagtacttttaccaaatctgaagactgtggagggctgaaaaataaagtcaggtgcatcgactagatgcacctaataggtgtagcccccgattatgtggttaactgaacaaaccaagtatatagtcaaggaataaataatccaaccaaccaagtggttcaataattatggtcaaccaagcgacttgatattaatatgtagcatatgcggtgtgaatccctgaataacatgatccgagtgatataccgactactttgtaaaatatgatgagtgtaatctaaggttggccacatcattgaaaattcacatagcaaaacagctataaagaagcttgtatgttgtgaataaagaaatttccaaagtattgggcatacgccatgcgcacactgctttaacagatgtgcttaagtccctaaaagacacatggtttcaccacacctggaaatatatggcatatgtggtgtaaaatccgagtaaataaactcataaaggatttaccaaccgcctggaaaatgaccaaaatatataatgagcctaagccataatattggtcaataaaagtgcacacttacgtggcaaaaagcaatgatattgtatccaatcaattgctttatgaatccaaacagcgccttgacttatataaaaaagtcagcgggcagctatataaagcattactgtttggcaccttttaaaatgcattgtaccaactcctaaaaagttgagtaactgcggtataaaaggattttaaggtattgagcacttgatcacgcgcactttggcctaagcaaaaagaacgtgacaggccacacctgaaaatatggactgcagacatattaggcctaggccaaaaaatatgccttcgacaccctttaaaggatgacgcatgtaacatgctcccgagtaataaatcttccgggtaatatataccaagtgtagctcatatgaatagcttctgatctgagtgattatcccttatgggatactccaaaatagatataaagattgaatcccgactggcgcaagtatttggttgataacccttacggggaataataaatagtccagtctttgagcatagaaaataaatccatgatcatgaattcatgttgcatgtatccggaacaagtccaaattgaaggtatgatacttgtgtttgaactagtaagcccctgatcatatagcctgtccttctgtagtcacaatggtccattgatggtagcaatcaaaagtgatgaagttgcatagccatggagacgaagaaaccagtcgacagtagtcaggtcagccatcaatgaagatgaaagcgcccagtgataaagttgtgtagtcatggcagcgaaataatcaatcggtgacagacgaggcaaatcaaaggctatgacgaaatccaccaatcctaaagatgaagaaaaaagtcggcgacgacaaacgcaactgacatgatgaagatgacgatatcggcgatccagtcaatagcagtgtcgcaaccaatgataatgacgaagacgctcatcagcatttgcatagtaggtcaaccgtgaaggtgaaataataagttggtaaagacataatcatccattagcaacaacggagatgtcagggtcgatgaagcagaggtgctagtgatgatgtcagtgactccaaactcccagacatggaaatttaatcttgacctactgctttgaagcgaagacaaaattgatgactcccagagttgacttgttgactgattaattgattgcttcatcttgacataaagcttgtcgaattttgagccatgtatttgtgtagcccccgactcttcggttagttgggaaacaactgaacatagagtcgagaattatagcttcttgtcgtcgagtagtcattgcttgattgaagataatggctctcctgaatattggagagccacttgttgtagtaaaataacacggcatcgcatgccgagatgttgaggttcacaaagacgtcgtggttggtgaagtagcaaagcttgcgaagtagaggcaatagagtttgccggtgccgaagataataaagatgaagccgctctaccatggtgacaaagttgcatagccatgatgaagtgaacacgagtcagcagcaacagaagcaaaccggtagcgaagacgcgcaattgtgaagataaaagcaccagtcggcggcggaagacgatgatgtccatcaatagtggtagcggtataaaccagacgtagaggcaaggacaccagtcaatagcagacgagacgaccggcggtgaagacgataaggccaatcaaaagtggcagaataatgcagccatggaagtgaagaaaccagtcggcagcagatgtagacagcttgtgttgaagatgatgacgcctattagtcgtggtggcaacgtggccagccgtgaagacgatagcaccagttggcgtcatatgaggcggccggtcggtgaagatgtacgcgttcaacaacggcggcataataagccagccgtgtagacggaaacaccagttggaggcggacaaggcggctgatcggtgaagacgtagacgcccaacaacggcagcataataggccagctgtgcaggcggaaacaccagtcggcggcgaacgaggcggccggtcggtgaagacgtagacgcccaacaacagcggcataatatgctagccgtgtaggcggaaacaccaatcggcggcggacgaggcggccggtcggtgaagacgtagatgcccaacaacagcggcataatatgccagctgtgtacgcggagacaccagtcggcggcggacgaggcagctggtcggtgaagatgtagacacccaacaacggcggcataataggccagctgtgcaggcggaaacaccagtcggcggcggacgaggcggccggttggtgaagacgtaaacgcccaacaacggcggcataatatgccagccgtataggcggagacaccagtcggcggcggacgaggagaccaatcggtgaagacgtagacgcccaacaacagcggcataataagccaaccgtgtagacggaaacaccagtcggcggcggacgaggcggccagtcagtgaagacgtagacgcccaacaacggcggcataatatgccagccgtttagacggagacaccagtcggcggcggacgaggcggccggtcggtgaagacgtagacgcccaacaacggcggcataataagccagccgttgaggcggtgacaccagtcggcggtggacgagacgaccggtcggtgaagacgttgacaccgaacaacagcggcataataggccagccgtgcaggcggtgacaccagtcggcggcggcgaaagcaagcctgtggtgatgttctgactgatccattcctggatcgtaagagataagcttaaagccatgaatcccttttatgcatatctatatctggatcctgtagaacaaacatataggatgagtagtatctgatataaatataatactcaagaaaaattcaagtattttaaaatatttataaatatgtatttcttctcttgtcaattttgatttccccgagcagatgactcattacgtttaaacactctgcccgactagtcatagccaccaagcaccgggagtcggcctaagcacttcccaaacatgcatatgagtgacatgagttcgtcattaatggaacaaagtttcacggatcggagtttactactcgggtacttttgcaattattaagagcagaaaataaattatcttatctctatgcttttgatttattccgaataatacttagcaccttgcgttattcggtccatccaccaagcccccgggtgctaggaatcggcccaaaggcaactatctattggcaaaccaaacgaaaagcataggaagatggaactccataactcgataggcacttttgtactcagaatatgtcgcaagcaatcaagataaatattatgaaaattgtttaaaaaatatgatataacatctgtagcccccgactcactagtcaacggcgaaccagttgacgtagtgaggcagaggaaaagaaaaatatcatataaagaaaattaatgatgacatagcttcgtaatattccgcttgatgatggcagaggtgaccagcgtgggaacaaagtcgtccatcaataacaatgaagacaccagtaggcggcaacgaaggcggttgacggtgaaagcgaagatccccaccaacagcggcataataggccagccgtgttggcagagacaccagtcggcggcggcaaaggcaagccggtcggtgaagacgtggacgcctatgaacggtggtgtgaccaaccaaccgtataggcgaggacaccagtcggcggcgaaggaggcaggccagcggtgaagtcgtagacgcccaacaacggcggcataataggccagccgtgtaggcggagacaccagtcgacggcggtgaaggcaagccggtcggtgaagacgtggacgcccatgaacagtggtgtgaccaaccaaccgtgtaggtgagaacaccagtcggcggtgacaaatgccagccggtcggtgaagatgtggacgcccatggacgatggcataataggccaaccgtgcaggcggaaacatcagttggcagcggatgaggcggcggcgcacaaaggcgaaactcccgagcccgcggcggaagcagcgtagtcgggctgtgttggccgggtgaagaccgaagcgcccgacgtgcggcgtcacatccaggtcgtgcttgccctaggagcagtcgggccgcgttaggcacgcaaaggcggcactggtccgcagccccccggcgtgtggaatctccaaacatgcgaacaaaatagccaacacaagcttcagttaagttgcgattataaataaatctaattagaaattagagattaatgctctgtaggtataatgcacgtgtcggtgcatatatgcagtatgcatgttggttcgtttgccaatagcatgattgactggagatttggccggcattaatccagcaacacatgcatggattaatacgtggcagagatgacctcagatggatgccgcccgtctcgtcgtcagtacatgcaaaaacagagaaagcacaacagagcaaattaatctgattagaaattaatctaatgataatagattggagtatccgaggacgccatcagggagagatcggtcttgctgcctcgcaacaccagcgcgaggtcaccatgagcactatcgcgagcgcgatgtgaggccaccgctgacaccgctgcaggcacatgcagcacacgatctccctcttcgcgtgtcggcggcggcggtgttctccggtcgagcggaactgatgaggcctcgtcggggagataactcctaaaagtggcatctccttcttagttagattgaatctctcctgactggtttgaatccaagtcagagaatgagagcttgtcgaagttgtcggcgacgaggaagtgacaatcccgtagcgaagacgaagccggcgactcatggagttgattccatcgcatttctcgataggaaactcgacgcacccctacctggcgcgccaactgtcgaaacatgaattcggcaataataaaagggggtagcgcacgagacctaaaagtggatggatgcagagacaaggatttagataggttcaggccctcccaatgagaggtaataccctactcctgtttggggatttgaatctgccgagtgtagtatcgatctgatgatctagttgtctcatatgccccctagagggcctcctgcccaccttatataggataaggggcaggattacaagatagaaaccttaaccaatacggtatcggtttcctaaatctactttacaatattatcaaaccaggactttgggccgttccgtaatatacaaggaaacgtaacacccaagtcatgatctgttacatgttccatatatataagttatcccctataactagtcggataaccatgccgtgtgggtatggggtacccataatctccacactatctatcccaggcctcccctcctcctcccggcccacctcttccctcctcttccgcttgggccgcccctaccctatcccggcccagccgacctgccgccccaggccacctccctcctctccctcgcgcccctctgcacgtgcggcgcacgtgcgcgcctcgcgccggaccaatgggtccacccacccggtcgtcttctacctcccagccggctcctctctctcctctctcccattaacccttgcaccaattcctcccccgaatccgctccattcatgccggattaattcaaattggttagagaaatggaatccacatcccttcctctctagttcccctaactttccccatttaatcccatccccaatcgccgggatttaatcccccttctttgacctctcccgtgactggcactccctccttgccctataaaacgaagtcctcatcctcccctcgttacattttggtcccttccgagtctttagccacctccacgccgcctccttctcactccctagcaccggccgactccaaccgcccctgccgccgcgtcagctagccggccggccgtgccatcgcctcccccggcgtcgcagtcgcctccccttccccggcatgctctccgtttcccgcggagacctccggaagtgcatcctcgccggcaacagtggcgttgctgccactgttccgcctctgccgcgtctcctgtgcgtcggccgttgtcgccaccacctctcccggcaccggaactccgtcctcttcctcggctaggccacgacgtcgcccgaatttcgccggaacaccgccgtgccacgccggcctctccatccgcctcgccggaatttccccggtcggcccttcctccacacgtgcaccgtcggccgcgccaccaccacctccggaatcacagcggcgagccggcgacatcttccttggcatcgcctcccctccatccaaacccctccgcggtccatcgtcgtcgtctccgttcatcctcgtcgtcgacgtcccgtcggtcacccagctcatcgtcttgctgcgccgccaccatcatcgtcatcacagcggcgtgttccgcgccgtcctcgcatccgtgtagctgctgccggctgccctcatcgcctcctcgccggttccggtcgtcgtcctcccgtcgttcccggtcgtcgtggcattcgtccctccgtcaagccaattgcgtttgccgccagtggttcgtcaagcgagctgctgcagccccgtcgtcgtcttcgtcctcggctccacgtcgtcaagcctcgtgctggccgcgtctcgccttcgtccaaggatcgccgccgaagtcgttcgcctccatcgtccccgagccgtctccgccgtgcccattcgtcgtcgtcgtgccgcgccttttcgcgtggtggtaagggtgcctcctctcgctgccccatcctcgtcctttcggtgtcgccccgtgcccgttgtgcggttgtcgaccccggtacccgtgtaccggtgtctgtagtcattcgtgggtgcgtgtggtgaccgtgtttgtgtgcctgctcggtagccgcgtggtttccacgtgtgcagccgcgtggtgtctggtagagtccgtttgccggccactcgcctcggttgacacacggggtccgcttccgtcgacccgtggaccgtctctgtgtacccggtccaccgtggtcccttaggttgacatgtggggtccgcatgtcaacggcgcagccttcctgtcttttccaggctagtgcttacacatgttttatagttgcaaagcctaattacaataatccgtaaatctccacgtgacaacattaaacttgatgaccaaatattggtcatacgagctctgaatcgacctgttcaagtctcgtaatgtttgttataacctaaagaaccacgtgctttctttttatgtattgttattgcttcttcataggcttgtagttttgcttgtgtgcttcacgtagcttctgtcgttccggaggttcccgaagcgtggttcacggtcgtcgtcgaaggttcggaaggccgttctctgtaagcaaggcaagtcgcatcacccttgagcatattgaatcccagtttataaaattattttgatttaaattattgcattaccgctttacttaaattcccgcgttatcactgttttatttagccatgcctatttacctttgttatgacattattattgctattgttattattaccttgttcaccctaggataaacaaaaccccaactagtgggtactctattaacggttccactagtatgaatttaggtagatgcttcgctgattaattaggcaacactaggtggttttataactttagactttgggagttctcatatcatttggacactgtggaatggttggcttgtgatggaattgaacacacacctcccccctctattcaaaactcccaaaatggttttaggctgggctcgaggtacatggtttttctagtagcacctcggccactataaggaccggtcttcgggcctatgttgcaaagcactaccgtactaaccacatgtctaatgggtaaggcttaactcggtgctcagtctagtcctggaaagagtacatggatggagatggacgaagtcggggctcgatggacatctctagggcaaatgaaggctacacgggctgcggctcggtagtcgagatgttatgacacagggccggtgtcctgctgctaggggctcaatcgtacctacctgtctcgggattctggctgtaggcgaggttgggtcggtgcttttgtcatggctaggatgggtaaaggggttatgtcacatcctttatgacgggttccacggccgtcgaatgcagagtaaagatgtgtcttgtgggtaaagatgtacacctctaatcagagcataatctattcgaatagccgcgccctcggttatgggcaagcctagtaatgtacccaagttagtggtttaattcttaaaacttgcttaacaactaaaatgtggaatggttggcctgggttggcttgggatgagctaggacccaagtcgggttgccagttcggtctgaattatcgttggccttgggttaaggcaggttcgtgtgggctcacggccttgattaataatactgtgtagctctaggatcatctttataaaatagctttgggcaactaagtgactcttaaatgctgtttattgtaaaacttaacccctatattatcaccctttgtactcccttgcattaatcatgcatctcccggtgtgacttgctgagtactgtggttgtactcattcttgctctatctttcacccccttcagtaaagctttggagaagaagtttaggtggagccatggcttataccccagttgagcgcctgtgaagatggagccataggcctgaagtgcctttgtaataatgtaaatattatcgatataataaagatgtgtcttttatatcatgtttgtgtggtgtaccccagcttttcctgggacggggattaatacactagcgttctggaaaaggtatttttccgggcgcgacaatcaagtggatcattggagcgagtgaacaccggaggttgagtatgatgaaattcagcgagtcccccggcggcatggtgtccaccaccgcctgcaccttgggcaatgtgggcagcggtagcggctgcacttgctgtgatttgctgaaggacggtgtttcgagccacacggttgcactccacgaccataagaacctcagccatggtaggacaaggtggcggttcatcaccacggcttcgggaaccctccggagcatcatgggattgagagcgagtgctgggatgagtcatcctatggatatgagattaaacataattagtgatgggagcaactaaggattgataatggcctgaaagttagcacgcatcatacatgataaactaagtttaggttaccgacttaatatgaatgcacaatacaaatgcatgcgaagctaagtctatctttgcataattagtttcaatgcacaataaaaatgaacaattcatttatatacaaatgcgataagttatgttagcatgatatgatgcaaccaaataagaagcattaagaatcaatcgagctcatcctatactaaagctcgaacaagaagcaataaaccaaaatagttttccaattgcgatcaacatagcgggccaaaagcgtatcaatcgtcggaacatgaaaattcaaatagaccaacactgcaacttggccactactgctatatgacacatttctatctagcgtctctcagctgggagtacacttttgcaatatatttggtcgaatttttaagttggtatattttacttcttccgaaacaaggttctgaaatttctcaggttgccgaacagcagccactttacgaatttttagagagggctaaagaagtgataaaattctgaacatttttgtggttgttcctggagtagttgcctagctccagaaaaattttgacagcaaaatagtgattatttgattacagactgttccagaaattccagatttggctatttgacattttggaggtttaaaacatgttcataatttgtcaaaaattttggggagactaagagcaacatgaggaacagcaaggcaccattttagagtgactattgcacattttaattgtacttacaaactgagaataaagtttaattccctcaacttaccgggtgcattatcggtctaatatttgaatgggagaagtaataaatttattttgtcaaccaaattagaccaagatgagtggaaaatctgagaataaggtgagaaagaacactagaatgagatgaggagtaaaaatgattcacacatactaagattttcacaatcgactcaagttaaatattttgcaaatcattttcaaattgccaacttagctctagcctacagtcggcattgctatgataccaaccgttgtggacaccccgagtattataccatccagtgtccaacgcgaccaccacatactattggagaagtgggttccatacactcataaatagccactcgtcctcaatgtgtccatgatcgcggttgacaaccttctgttataataaccggaatgtcgagtagtgagcgcaagacataaccgtaagatagcttgccagtccactccgtcatatgcccgtcaaccactcgaaggtggcgaccaaaagcataccccagtgactcgatccaaagcactatccccgattatctcaagcgatcaaaacccattactcatgcttagctagtccccaggtatgcgactagcctcacactttcatctcaagcaattaataaacatagcaagtaccataatagggttaaagtgcaacgaggtacatgacacataatagggtccgaggtcccaacatacaacacataaatatagcagcggaagtctcaaatagagttcataagcaaaagataaaaccggtggtgccacaaccccagtagggcaaaccaaccgggcaagagccaagctgcaagagatcactcattgccctcgccgccctcggcagagcaatgaccacataagaagcataactcataatcggaatcctctcctgaaattgcagacaccgggttaagtacaagattgtactcgcaagtcttacccaaaattatatatacataaggaagagagaagtatgcaagcttttttagcctatagtgggtctctaggttgaacatttgtataaagctaattttattgagcaattaatgagtaaaataagcaaggacaagtaaatctagcatcatattaatttatggacagcaagtatataattctgaaatgtataagcaaatgagcccaaacggcgctctcatcatcaaccatggactaccaaagtccataccaacatggcacaacatgccaacaccaccatcaaacataatcccatctataataatccacatttgatgctaatcataactgactaacacatcaagcattgtccataaccgaggacgcgtctattcgaatagattatactctgatcagaggtgtacaactggacccacacgaaatgaacaaagatcaaatgctacacaccccgtcgagtgcggtacacaattgattcaagctcattacatgccctttcttagccccacccaaccacctataccatgctggggttcccgacgactcagtcacgtgcgtgcgtgatgtcaccaaggcgggcgcgccacgcgggagacacccccggccaaacctaggcacctgaggccctccaaaggctacctgcctcacgactctccaacgtggtataaattatcacagtagaactagtaagaacaagccgatcccaaataaggcatgtggaaaatacgtaggatgcttgattagatgtcaaaatgttcgatccttaacgacctagacggggcaacttgcatcaggggaaaccaacctcccatcatcgccctatcacccgtccaagtccaacatatttcatcaaccattatttagtgtaagtgctcaagttttatgcctaaaaatgcaagttgtctatataccacaattaatagcattgtccatccctatagttctattagcactaagcatggctaagcattaatgaataagacatcccaagtaattccaaccagtggtaatagggtataaggacagcaatatcacaagaactaaatgcataaataggttctacccatacaccataaaccgacaatattaatatctaggcaatgcatgcatatatatacgtatagattgcaaccaaatcatttttagagaaagcatagattctatatgcttaggtgcttgccttgctgctgagggtagtcactatcctcctcgggatatggctcgttactccccggaatctccgaatctatcgaaaagaagcaatatgcgaataagagccaaataaacatgcacatgcaaaatgatcaataaattatgaaataaatacagtgggtagatcatattttaacttgaatttagttgaaataatcaccagattatcacttatagtttgggagatatgaaaatgacaagctctcaggtgctgaaaatggcagttctgcaaatattaacatttccttttgtacattacaagtaaaatgcatttcaaaccaagatttcataataatgattatttttagagtaatgtacatcactcacagctcctaagaaaaattatttcacagctataagtgttgtcattatttatttatggattttaaaagttagaaacataggaatgctaaataaactcctaaacatgatttaagaggtagtttctccaaaaacaacaccacaacagcaaagagtactaaaatataagctcaacaaaattggtttcacaattttaacttttaccaataatttcttacgaatttcttaagagctagaccacacaagggatacatatagctatttatatttttactgggaaaaccagtacaaaagttggtcattcttatttttcaacactgaagatcatgtttttcttaatcgacaaaaatttggttcactgaatttgcagttcatatgaattagttatgaatttttaaagcgcaaacctctttcagctcaaaagctatctcaaaaatcgatttctattttcactcccccttttctccaacttccaccggacttcgctcacatggcagcaacctggtcgtagggtcgtgcgaggctaaggcctcgggctgatggcaagagatggagcaaggcctcgggctgacggtaagagacgttgcctagggctgtttcaaccgaaatcaaaagagattaacaccggatgagctacagccacctcctagctgcaataatgtagatggatgacctgttgaatgttgctgtagatgttcaacatgaagggaactaaaaaaaggcaccatggatggcatggaagctcaccaaatggtgggaaacaaagtcatgttgctgctgcaaccatgcaggctgaaaccaccactctcttctcctatttcgatctctctcaactctccatgcatgtgcaagatgttgggatggatggaaagcttggatgatggggattgttgtggtctaacttgcagggattgatcttgggctattggatgggatttggggaggagaagtgagatgagagctcagcttgaggaagaaaagaaagaacaagcagtgaagatgaaaggggaggaagaagaaggggttttctctgccccccttaagtcctgaggtgggagcacgcccatgggtgtgttgtggggctaaagaggcacccaaggttagtgacaagtgggcccaagtcatggctgtctatgagggtgagagaggtgggtgaaaaactgagtacagattcgtttatgcaatttccaggatttattttctttccctctcttggtaaattcaatttgactaggtaaaactagttcaaaaattaagggatttggtgtggtgataggtgttgttttcttggttccatttttcaaagtttcactcaaaaattcgaaatattttaattctggtgaaaagatgaaattggttaggctgaaagttggtttgaatttttaggaggcctaaacagagagtaaaaaatccacaaaatttatatttgttggtgataaataaactagtatttgaataaattattacacatgtacacttatgttcaagttattattcaaatagaagtggtttcaattttaccgattagagttaattttgttatcgcctatgatcaaattgcaatatagtaaatatgaaatctaaaggacaacaaatgcacttctaaatacctggttatgaatgtagggctgttacaccagatcggcccaagccgatcgggcggccacggtgcggcgcgctggggcacgggcgcggcttaggccggccggccgagcgatggcatgcggcagcgcggccaccggcgcgggaagcggcggcgcacgcgggctgcggtggcgagcggtgccgaggcacggtggcgacgcacaagcggcggccggtgcggcaaagagaggaaaagaaaggaaggggaggaggagggagatgctcaccgagatgacgatgaccggcacagggaaggacgacgacgaccacggcgatggcggcgccggcccggcaagtgagggggcggccggggagcgtcgtggcccgaggaaggagagagagaggggttaggccgcgcgcggcgaccgaagacagcaaggaaaggccgccagaggcgatagaggtggtggtggctcgggttggcagcggaaccggggctccggtgatggtttggggatctggagtggcggctagtgtgcggggcagcgcggcgaagccgagggtggcggcggatttgcgtggcgatggctgacgcggcgaggagcggtggctcgaggcgacacaggcggtggtggagctcgggtcgacggtggaaacagtcctcaggcgatggaatggacgggtggagtggcggccggggcgtggcacgacgtggcgaacccgaaggtggcatcggcgcggtgcggcagtggctagagtggcggtggcgggcagctggaggcggttgaaggggcagtggctcggttttatggtggagatggagttccgacgatggaatggggaaatggagtggaggccgagtttgcctgcgcggtggcgaagccagcagtggaggcgacgcagcacggcggcggcaggagcggcggtggcgcgcggctggagaccgccgacgagcgacggagctggggcgcacatggggagagcggggaaaggcgcggggagctcggggaggaggtgaaatgggagagtatggccgggggatgatttatataggcccgggagggagtggctcgggccgggatgggcggcaaccggcgtcggagtggaggcggcatcgtggggtggggtggaggtggctcgtcgccgattttcgcggggcgtgagggggaagtggtggaggacgtggagggggtcgtgcccgcgccgacagttgcgagcgcgggaggcgggagtggcggattttgcggcgacgtgggcggggtggttcggccggccatggtgatttggatggggaggccagaggtaggaggtgacaggtggggtccacgggtcccacctgtcggggagagagggagggagagttggaacggggaggaaagatggacttttgcaagggcggccgagggagagagaagctggccggagagagggaaagagagggcgcgggccgtgggaggggaaggggaattgggccggggcggcccaattacaaagaaagggaaagttaatttgtttttctttttatttaattggttaaatgatctttgtgactttaaaattagatattgagctccgaaaattcgcggaaaatttcagagtgttcattagggcacagagaatattacaaaatatttccggccaatgatttttaaaggaaaattttaattccctctataatttacttgattaaattgatttaacttttatttaatttctagaaaatgaattattgaatgatttttaatcccgaacaaaaatcggggcgttacattaatacaatgagcgtttgggaaaatggtagcatttttcccgacgtgacaatgtgtctgccacctatttagtttttgtgggtggatcttacaatgttttactccggtgaaaagttgcacgttatgtaaacatgttatgttttacttgatcaccagaaaggataaactaagagaataagaacaagcaaaaattacctatctttaatgtttgtaaaacaatccaataatctactcatctcagcgtttgtcttcttcaaattaatggttgatgtagcaatttgagtttaaatcgattaagtttcttaacactcatatggttgatccataagatgacaacatcaaaaagcatcaataccgcacccacaatgtgcaaaaatttatattaaggcagagaagctcagatcgatcaattgtagcaacacaggaaaaataataaatgaacattatatgttacacatggaatcgtcttttgccaacgatgaaaacatcacctcttgatcaaacccatggtatttgttcttcgcatattaccaacgaaacaagcgctgcaagtgaaatttcaaatggcaaagttaaatttatgaaatcaatgattaggaaggaaaaacatttttttagcataagtatatagtagatgagttcataaagagaacaagcaacactaattatttggtgagaatctcatatattttggtacaccggtcagcgacaagtgcaaaactttacttcttgtagttgagggtcacaacacagcagcaaaaggatgccttttaatttcccttttttaccttgcttttcttcttctttttcttctcaatgtatgccatgatctcctcttgccgctcaagagtctcctgcaaggcctgaaaaaaacatataatatgcgtgttttagaaatggtttagtaagagtagtagaacaacatgtaatttgttagtctcaatacatttaataatacagatctatgggattaatgtaataagaatgtgcttatcatcattaaggtgaaaacagacaaaccttcttggtcgctgcaagttcctcctccaatgcactaacacggctgacggcagtctttagcatctcctctttatcagctggcatttctgcaggcttggtgagaatcgcaatgaccttctcctcaatatcggacaaacgctttgtagaagaaacatattcagctactgacacagcctccactgatatctcggatagttgttgtgcttggattttggatgtactttgtgccccaagggtagcaccaagtaccttctttggcatgttgcggctaacacggagcattgttgcaatgctcatgacaagagccatgatacccccatagagtggaggattggatccattagaggcatttacaatcgctgcaagaaaaagattatccaatctgttagttaaaaactaactagagagtaacaatattaagtcacaagattattaggccgcaaagatgtttaacctttggttactgtgacattctcatctggcaatcccttgctctggcaaatggcatctatggccttctctaccattggaacatcacaagaataagctgatcctagggtctgcattaaaaaaactccttttatatgaggactaagcttagaaagtatttagaaaagaaatatatgaaccactacaccacaagaatgaaaatttatatgatgactaagcttgggaagtatttgaggttttacacttttcctagaactgaaagatcatcacaaagttacttgtctgtgcatatctatcgcattatcaactgacgagcccacttaagcttgtaagttaagactcaaattttttttattctagtttgtctagggagattgaacctctagtttcatccataagacgtgagaaatattcttttagttgtatggttcaacactaactgcaagtttgtttgcgcaaaaaaaacacactttaaatttgttaaagtacaaacatgtcattgttagaaggacaatagtggaatttcattttctggaagaatagtggaaattcaccagtgataaagcataactcacaggaagtatcgtaggaggaagttcctcgcaaacaggcgataatgaaggatgttcaattcgggcacaggatatttttcgtgacaaagtgcacccttcatatttgaaagactcctgcctctttattttacgtaaataaaataacagatgtctaagtactatgatccaatacatttagaaatacttaaatatgaatgtgctagtgcaaagagcgtgtaacatctttgctaccttggtgtgcatggtgtcatcttcacaaatcatcattttctcctcagcatccagatgattcaaactaagatttccacaccacccagccccgctttgaaccatctaaacataatatagcatagaaattttgagttccttgtcccttatgaattgtaatttaagaatttgttcaaggataataaaggttcagattggaacagtcaccttcaatatttcagcatccttccaggggcccttgtcagccttcatgcaaccaccttcacattggcaagttccaccaaaaaactccggcagctcactagacaacataaattaatagaattaaaatggtgaacattgtcttcgaatatgatggttaacttagagcatcaggtgttctacctagcatcgatcacctcaagaagcttgctctggtacttgttgcccaacacctaaagaaatgcacagattattgataatcaatcttcaagttgagcactcatagacaaagtattggaagaacactaacatgaatctttgctgtggtctttgggtcaaggaaactcttcactgtgctccaaagaagtcggaatcctggcccagcattaatgatgaacattcgacacaatgtctgcaaaaacaattacatgcggcgagaactttaataaatccagcacaaaattttctgcagaattacaaccaatatattgtgcatccaaggcattacctcagggtagttatcaccatcaatcttttgaagctgaccaatgaggtctcttgcagctttgctgaattgtttcatcccctaaaaatgtattttttttcttagattataaatagtaaaagtgcaatcatttaatgaattatccaaatatttgcacatacataccaccccttgcacatcaagaattgttgtgctttgatcaatgtggcacttggcagcaattgagcaagctgggaacttaacagcaaagttcttctcaaactccctgacatggttcttgataaaacgatccattgtggtaacctgcattagcctattgacattgatctgcccaagacgttcaatgtagacaggccttccttccttatcaaccccatggtaaccttgaggatagcattctgccaccttgtcagcttcttcaaattcaaaatcctgagataggatttgaagaaaaatgtgtcaactgcttataaacaagggtatgtgtcaaccatagaaggattagtccaaatatattttaatcttaagcaattacctcaagaatggtatctgcagcgaattcctttctccactgcagcatatcaacccacatttgctttgccttctccacatcaaactttcttgccttcaaaaacctatgtaatctcaaattttagtaatacttttttcacataagaaactataaataacaacatgatgtgctattttcagattatacaccttagcatcatgtggtagtcatcatggtgagatggtagcaactcttcaagtacaaggagctgacggaaggcatctacagcctgcacctcctcaggatcacgttcatccgcaattgagatggatatgaccttgctactcctcctccccttcttcattgaatgccttaacttttgtgaagcactcattgccttcttcttcagcgatatgattttggctttcttctcatcctctgagtattcaacattggatttcctcttctcttcatagtgaccatctaaggttgctgacacatcgtgtatgtcagttggtcatgtatattccaatataccagattctaaatattttctaaatagttaagttagaaattaattctttgatagtgaagcgggagaataccattgggaaaagggcatacgctttatctgaaaataatgtttatactttgagatagaagataatataatgattttttaataaaaaaatacacattattagggtgtaataatccactttaaacaataagaaaatggttgtgacaattatttgctttacttacgagagcttagacggtgttcaagaggtcttgataggacttctgtcatgactgttcggctctatctggacctgaacagttatacacattattatttgattatatcacatgctatgtctcaatgtataataaaggagaaaacgaataattttctaaatatcttgatgacctaaagtattgcttggcagtacgatgcagtgtaaaataagacaaaaggtctcagtttgctgggaattttttaatgcttgagcagtgggcctgtgagacactaattagcctcatctcatggtatatatcatagtccatcagtataattataagtttagtaacatgtgttccttttctggattaacaaaaaatttataaaatacacatataaattaatgataacgttgaaacaccagatgataaaaacctacaggtgcctgagattgtgcttgaagacacaaattcaacacattaatttacagccaagcccaaaattcacaagaacgcttgaataacacaaaacagaataaatttcgctaaaaaaatagcagaaaagtaatctaagtggaagataggtgttatgatctggaataatttgaataattcttgcacccattataagtcatgacatgcaacacaatcagaaccatcaaaaatcaaatgaagaaattataaaggcccaaaaaaccacaatgaaccaagaatgtaccaaatcctagatccccttgacaatccctggccgaccacccaaagaatccaaaatacaaataagcaactgcctccgatgtagattttcccaatcttatgaaattggagcacaacaagtattgaaccaggtagaaaacaaagtagagcctctttatcctcagtccacatgggaaaagatgtataactgatgcttacattttatcattaaataaagaacatacaatgccggagcaacacaattattactaatgtccataggaagaaccaggatcaaacaaggaattggaaagaaaatcatgtagtggtggaagagaagagcatgcacgtaccaccaagaggaggagcctggatgtgggaaggggaggaggtggtcaggtgggtgtgggggtgggggcagaaatggaggggcagacagaaaaatagactcatcaatggcgcgcattccccgctgccaaacaaggagagtaccataggcaggacatctggagctggcgatcgatgtttctgttctacaattatgacatgtacggttttcttccaatattagataattagaccaccaaacccttattagatgtgtccttcctgtatagaacggtttgattttcctattaatagaaaagacataatttttttgacacagcataatgttttctgtaactacatttttattgtaacgtgaaaattttgtcatgactcatgcagccatacacctacatgaacgagtatttatttatacatgtatatctaaatagatgtttttttaaaaaaaaatcaaccatgttattgtatatatcgtatatatgctcatgctttatctctcactttttttatttaatctttattagtagctttctgcaatatatattatttttatattgatatgggtgaattgtgtgtagtgcgtgaagatgtactttttgatgtattgtgttccgcaactcatacacaacgacactaattaaatgctaatatttctaaaaatccaaatggagtgcaacccaatttttttccagaaataaataatccaacaaaataaataccaatcgtccagatctaaaacaatttttattgggtttttttctcaaaaatattttcagtgtcatcgcaatgaaatacttcactgggtcgtatatcaatcatccatgccctggtgattgccccaacaaatgcttactttcaaaaaatgacgggcaattaattggccatatgcaaatatccatggctaatctatgccataattgaccactagctaggcacttatccacttctaagtttcaaatgatagagtggaatggaaactgggataaccccgcaggggatggcagcgtttatggagtgctggtattccgtataaaattaaagtgaatggccagcgattaatttaaaatgggctagcacttggcttagagttgcagagaaggaaaatcaagacaggggtaagatgtttgttctgtcaaagggaagaaaatgttgtccataggttttgggaatgcccctactccaggtgggtttggagtaagggggaaggaaagctaggcgtcaacttcttggtgccaaatgaggaatacaacaactataaaatgtttgccttgtgggtgtttgacagacttatggatcaagcagaccatgtaatacatgcagtctttgtgactctacataacttatgggctgttcaaaaagatggacgccatgctcagatgccagagaatccaacaggagtagctatgagaattgtggcacaactagaggaatggtcaaacgtccatgaaaataagatgggcactgtagcgcatccgacacagcattgggaaaaaccagaagagggacgggtgaaactgaatgcggaaggagctttttagaaaatgaaaatagaggggcagcaggtgtggcgatgagaaatgagaagggagactttatggcggctgctgctcatgtttacagtggaattggggatgcgacgtgcatagaaatccatgcgtgtaagcaagcagcaggattggggcagcggagttaggatttacaaagttggtaattgagactgctcattggaggttatcaaaggagcttaacaggtcggtccatggagtgatgatccaagactcaaagtcattttgaaggacttccaggattagaagctgaggtgggtacatcgtttggcaccaggtggatagtgttgtcctcgggtggctctatggttccatctctgccgatcttctccaagagggcgatgacccacgtcaccactactcggtccgtctagcatgctctcgaactccagttcttgggcaacagcgagcagcgcgccctcatgcttgaagctgaattccgcaccttccatcaaggcgatctttcaatcaccgactatttgccacaagatgaaggccatggtggacactctctgtcgacgggggtgttagcgaccaaatttggtaattcaagtattggagatggagataaaactgaagcagaatccaagatagagatcgttccggaaacagagtaagaattggctaaagtccgaatcagctgcgaccagaatcggcagagttcgagtcggacaaggttagccgattgagccgattccgacaatgtgactcggtacacgttgtcgggttgagttaatgtgcttcatatggattgccacgcacggattaagtcctgaaaaaggcaattgtatctattagttaggatattttatgtaatttccttagaaataagtttgggcaaaagtctgccgcaaagacttatggtattttagagtttttttagagataagagtcatgtccgataaggacatattttgtatctcgggtataaatatgacccgaacccatgtaatcaaacaacacacgttcaatacaatctcggcgcatcgccacccttttactttcgtttactttcgacgagttcttactttcgggttgagttgcatcggtttcgatcttcaactagaggtaaaacttgttatggcggcttgcgttctcgggattagtgctttcatctttatgatactctaatcttgtttatgtaattcatcgagttatcatatatcttataatactttgacaatattgttatttaactttcaatcggccaacatccatcattggaaggcagccgattaggtttaatatcaatgttgacttagattatataggatatccaccaccctatgaaacattcaaagccttgattgtctagatattgtccttcttttcctacttatagctgcatcagttgagtttgaccttataagtcgtgattagaatcttaatctctggcctgcttttgagttgccgattagggtagcattagagttccagccgatcttacctgatttaactattttatatcttatatgcctgattgacatgttaagtccgccctttatgctaagatcttgtcgcatataggtatattaagcttcatgtttgatatattttgcctgctttaatatcttaatatagagtagtatcggagtattagccgatacatgctggatctatttgatcggctatgctatgaatgcttataatttcctcgttaatatatatttcgatttaagtgatttatactgtctcggcatggcgaccgatctatcccaatcacttgatttaagtatatatcgacggaagtattatatatcattaataacttcagccgatcgaatagatttagttctttttttacctatttatgactgtcgatcgacttaaatatgacatcggctcaaagataaatgatacgtcatcggcgactgaccgatcggctatcgtttatagatttaaccgctatttttcctgtctttgttccttgctgattgcaggataaaatcaactggcacgctcacgaacctaaaggtaagatttttggaactgcactaaagttaagcagatcttccaggcctcgtgtttttcgcatcaacacgcttttggcacacctggtgggacacgacaaacatgtcagcagaaaagccacctctgccatcgacaggcaagtcgtcagaccctcaaaccaagattccaaaaccgactgggtccgacgttaatgaagggaacattgttccagtcactatagacaagttgtcaccagaacaaaagaaggattttgaattaatgatgaagagcgctcaggagcaattcatgaagtcgttcgtagaaactcgcgggaaagtctaccaaaagtacaaagtgaaagtagttgttgccgacaaagttggctcaagctcatcccaaggtgataaaggcattgcagatggctcaggcaataaaggtgacggccttcaggatgaagtggttgaggatcttgatgaagataacaatgaagtgcaaccacagtttaacaacttccaagatcggattgactacgcagtgcaacatgctttgatcaaccaatcaggagtcctagtcaataccttaacaaacatggtaaagtctgtggttaatggtacaatagctgagcatcaagctacagggccagtttatcttccaggaggcgttttcccaaattacagaaacttggtaactggtaaccagcagtctgctaccaatgcaccatcaatccagccgatggcatcagcttcgactccagcacaagctgcaccatcatcggcaccaaggcaaataattaataatcctcgcctcttgtctaaagaacaaccgcaacatcctggtcagaatatcaatcggctgtcccaagagcaaattgcttcaatgtttttgccaactcagccgattggtggatccattcagcagacgccgccaaggtagcagataggtcaaccgattcaacagcagacaacttagctgattcagcaacaaacgatccagtagatgctgactgggttgaggacgcctgataatcagccgtcgcatcagaatgtgactcaagttgtccctgagcatctggtacacgttgtacaaccggatcaatcggttgctacccaagttatccctgagcacttagtgtgtaatattcagccgaatgtccagaactaccaagggggtaacttgaattatcaataccagcctccttcgcctcatgttcactatcaacaggggggattgcctcagcctcagtatgctcctcagttcaaccagtttgagccgatacagcaacaagcgcaaggggtgcctcagtagagacaatgggccgatatgattgcagatgtgatgagggagcagtttgggcttaagccaaaggatactggaaacttgtatcggtatccgtaccttgagtggtttgagagggttccattacctaaccgatacaaagttccagatttttcaaaattctcaggataggacaatgtctcaacttatgaacatgtcagccgattcttggctcaatgtggtgaagcatcggctgttgatgctttaagggttagattgtttcctttgtccttatccggatcggcatttacttggttttcttctttgccatacaactctgtcaatagttgggccgatttggagaaacagtttcacagttatttttacagtggaatccatgagatgaaattatctgacttaacagcaatcagacaaaggcatgatgaatctatgcaggattaaattcagagattcagagagatgaggaataggtgctacagtttggctttgaccgattctcagctagctgatttgggttttcagggtctgataacttcgatcaaggagaagttttcatctcaggagtttgaaagcttatctcatcttgcacaaaaggtaaccctacatgaacaaaggtttgcagaggctaagaaaaatttcaaaaagatcaaccacgtatacccttacatgtatggttccgatgaagaggatgattccgaagtagcaacagccgagtaggtcaggagcaagaaggttgtgccatgtccataggtgagaagttctgggaaagaggaaagatttgattttgatatcaccaaggctaataagattttcgatttgttgcttcaggaaaaacaaattcaacttcctgctggtcatgtgattccatcgactgaggaactaggcaagagaaggtattgcaagtggcataattctggttctcacaataccaatgattgcaaagttttcaaacagcagatccaggttgccattgaaggggggaagattaagtttgatgattcaaagaagccgatgaaggttgatggtaatcatttccatgttaatatggtgcatacagctggaagatcagctgatgaaaggaaaactcgagcttctcagttgaattcaaccaggattatcaacaaatatcaaagaaggtatgacaagcagcaggagaggtattgcgaagaagatgatggcgggtttgatcctcattgggactgtgagttctttagattttgctggaatgaggggatgaggttgtcgtccatcgaagattgccctgggtgcagtgataacacagggagttcaagccgaccttacaatagaggcaatcggctgaatcaggagagggtgtccgttccctcaacaaggcactatccgttatattggatatgctcagacgcccatgccatatggtgaacacaaccatacccatagtggtcacatgggtagctcctatgaaccatcgctcagactagtccctactacaacggcctcccaatgcaaggctaaacagtaaacaacttaataagccaaggtcgccccataaccaacacatgtggttgcacggtaatcttagttggtgacacatagttcagtccttaatcgactcgggcgtacactcccccctatcgatgtgcaactaccaccatatgcacaccacttgccgcccaagcctaaaatcatcattttttttttcagatttcaattttcacaaaaataacagaggcaacccctccatacaatattttttttcaattatcccatttataaagagtaaatatcatgtcataagtaaccatcgggaatttctaagcatggctaagcaatagctatattagtagctcgaatatacccacggtggtgcttggatactaccacataaatacccatcctagtgcttcaacagtaaggataaccaatatatcaaggtaggtaatgcagcatataggtcatttctaccgataccccattttttttataaaacatcgcatgcaatttataaaataataaagcatttgcgaagatattggattcaacatgatcgaaggaggaatagaataggacttgccttgattaggagttactcaaatatctcttagtcctgcactcccatcaacggcaacaatcgattcgtcctctatttaaatttaaacatgcattcaaatgaacatccaataaaactccaagataaaatatgatgcatggtgcatgaacatgttcagtgtatagaggatgatttaatataaatttaggagaaagaatcgcctaaatccaatgttgtatgtgcaagttattgcatttctaatatctaatatacgataaaaacgaagtttactattcaaacttaatttagtgaaaattttcacaatagtggtgataattttgagtgtacagtcttcaagagaacaatattatgaatctaacaaattttggttcacctcaatcggagttaaaatgaattctctatgattttccaaagtttcagcattttatagtgcataaataattaaccgaaaccattttcttagatttattaatttgtttataaagaaactacagcgcactgccctgattacgttttcctacagggaaagcgtattcatgttctgtgtattcattttaaaaccgtgggtccacatgtaagtgtctcgtaaataaccctatactttttattatttacatataaatccgaggtcccacttgtcagtgtgtggctttttttgcacaaagagccctataatttaccctaattacaggacaagttccttcttcttcaacctacaggcagctcgattggcagaggcgcggtggctcgggaagtgctcgccggcgacgagcagcgacggggatggctcggcagaaggccggggaagctagagtggtcctttcgcacaccctagaggcggaggcgtggccggggaaggctggaggcggcgagcgccatggccggtgttggcggtaggttcgggacggcgacggctagcgcgctacgatcgacagcaattcgattccttcctaggggagggtctagggactacgagaatccttaccccgtgcgtggttggagtggagacggtccgaggcggcgtggcgacgagctccctaggcggtcggcggcgacattggtggcggcggctctccggtcgaggggtcctaaaatagattgcggaaatggatttagggaggtcctatgatcttggtggcgcgaggaatcgagagggaactcaccgaggcgacggctcgatggtgtgggttcggcggcggcgctctgttcggccggcgcggggcgtgacggtggcgcggccgttcccagcgaatcagagggtttaggtctttggctttgggagtggaggttgagggtggtgtggagagttagctggcgcgagggttcgatttatacgcgaggaaggagcgagaggcaagtgcggggaattgtcgcgaagtgctcggcgtctctcgcgcgcgcaggcggtggtcggcggggaacacggcttgcagcaggcgccggctttgcgcagggattgcagagggggtgcagggatagttacggggagccaggggcggtcggtctcgccttgtcgcttcgtgcgtcggctttggcagggggcggcggctccgggttggcgaggcgcgcggcgaggccggctttgccaggcgcagcatcggcggtgcagacgtgagtcagagggctttgcagacggaggcagcggcatcggctttgcgcagggaggaggcagaggaggaaggctgcgtcggtctggcttggtcggcatcgggcagagggccacggtgttggattggccacggcggctgcggtggtcggagcctgggcgtggcagggaatcggcagggacggcgtcggctttatgcagccttggcacagcgggattcgcgggcagagggtggcgcagtgtcgcgtcgcgtcgttgctcgggcagagagagggagagagggagagcaagagagcggcagctccagcaggggcggatctacagtgttagcatcggtgtcaggcgacaccgatgactttcggcaaaaccaatagttaaactgcttatccatatattataacacactaatataagtataattagcatgctatgacaccgatagacacattatgacaccagtgaatcaattttctagatccgccactgagctccgggttgggcgagccagcgagggacgcggcgaaggcagcggtagggcctcgggcaggggtgcaccagctttgcctcatctttgccagcgagaatcgtgggcagaggttgcttggtcggcttggaaacgatgacctcaatctcgcacgctaggtgctcgatgaattgcctgaaagaaatagaaggagagaagggagaaagacagagagcagggatatggggatggtggctggcaggtgggcccaatgatccttaggcccactgatcagagagataacgggagaagggatgaggtgaggggatttctctctgggtatttccaagaaggctgagagtttgattaatttttggatatgctaatgtgctcaaaagcttgtgctaaaatttctagaggttagtctggtcaagacctccacttggtaaattttggggatttttctcaagagcagtttattttttgaaaattcaaacaagttcactgtttttattttaatttgaatcaaattttggatgctttcatctttttaattgagatgcaaaacttgtgagatttgtgaaaggttatttcaagtctctaccacttattttaattagttttttttgttatgtttattgcatgcaaatgcgttatgaggtgcatggaaaatccaagaacaccaaaattaacttcaaatgacaaggacaagatcaaaatcaaatttttgctaagttttcttcattttctttttttttagcttcaaagaattcttggtatgttacaattccgattatttctcgcattgttaaattaagatttgctccaggttaaacaaaacattttctttgggcgatttattgatgaattgtaaactaagggaaaggggaaaactccgggtgtgacagctaccccgtccaggatcgctccctcatcctcaacaccctcaacggtttgagtttgacaagacattcagtctagtcatcaagccggccacccgtcctgttgacgaaaaatccacgctcggcagatagtgccggaactatattggcgtgaactaagtcaacgaacacaacagccgaggagatctccttaactccaatgcaggtccaaagatagatgagatgagggcgtactagttagtttgatccaacaaccgtcaacatgtgcaaacaacagatgaaatagccgatcggctgacaagccaatggagtaattctagccgatgctgatactagccgatgccgataccaactaatgtcgatagggttttgagcaatcggctatatgtccaatgtatattctgatacttaagtaaataatgatatatagacaatcggttgataataatgtaattaagcaacaatataatccaatagaaaccaaccgactaataatgatatgatagaacaaatattgatccgatggttaaagcatacatcggctagaggtccggtgtcataaaatccaaatgattagataatcagttaaacctttgttgcaatcggcgaaaccaacttgtatgtaatcattataagccgatgcaacatccagataactcatcggttgaaaccccgatgaaaccctttattataatcaaagacaggttagcctttataattctaagtatgactagggatgatgcatcgcaaagtatgctaagaaacataaagtctaaacaatcaacctttggcaaattttcagggtggtggataccttagttaatctaatctagcatgataatttagccgatactagcataaaccctaagacgactctcaaccgatatgatcaaattaagatgctaaactagattaactaagatatatgataaataggtaggcaaaaatatcaaccgaaccagagcgatccaagaggttgaagcgatgcaaccttgagcaacactaatgtagctaatacaattgccagggccgacggaacataggacttaccccttcaccagatattgaaagctgatgcatccccgcattaggagccatgttccgccgtgataagtaaaaatctcggaaaagagagtgacgatgcaacgagagtacttgtattgatctgtaagatagtttacaatgaccctgggtgtacatatttatacacataggtagatactagtccttcttgacaagaaagaaactttcctaaagataaaaggaaaacataaagtccttagtggacaagaaacatactttcctaaagaaaaaaggaaactaacagattctccctaattaatagataaactctcatgccgcatcctccttgaattcattttcttctagataaacttcctttaattgattaatttccttaaccaaatatagcaagaatacaactattggcgacttgataattcccatcggccgattcaaggactctgaagccgatactgaatctaggccgaagatgacttcggggcttaccaaatttcactgttaacacatccgcactgtcctcagcctggcagtctcctgcagttggcccatcgactagcttgatgtcaagaacatgtcccttcattgcactctctaggagatagtctactgcatccagcctcccagcttcatcgactccactcggctagacatggtttgccgcctgaacaagttcctctattggtacaacaggtttgcggcattccttctgcccattggtttctctgagaccaagttcaacacttcactgtttgtccaccattgtgcctctggcatagtgtacctcctggtctacgtcgacgacatcgcactcactgcctcctctgcatagctcctccagtggaccatctcctctatgtagtttgagttctccatgaaggaccttggtgctctccatcacttcgtcggcatcatcgtcacacaacagacttctagccttctcttgcaccagcggtagtatagtctcaacatcctacagcgtgctggcattgcagattgtaaaccctgttccactccagttgacacctaggccaagctatcatccactgatggcgcgccggtggcagatcctacagatttttgtagctttgctggagcactacagtacctcacattcaaccgaccgggcatctcttattcagctcaacatgtgtgcctctacatgcctgatcctcgcgaatctcacttagcagctctcaagaggattttgcggtacatccgtggcaccctggatgatggacttcaaatctagcgctcccaggccgctgatcttgtcaactcgcaagtccacctccggctatgtggattcctggtcttccaagcgcaagaacattgtctcccactcgagtgctgaggccgagtatcatgctgttgccaatgttgttaccgaggctagttggttgcgacaactcttatgtgagctgcactcccctctatccaaagccacactggtgtactatgacaatgtcagtgcggtttacctctcatccaatcatgttcagcatcaacgcacgaagcacgttgaaatcgacttacactttgtccgcgagaggtcgccctttgtgatgttcgagtgttacatgttcctacctcgtctcagtctagtgatggtgaagccaatatagacacgtgatcaattaacagtggatcagaaaatcggacgctgcagaacgatcccatcatactccttctccacacgcaatctccttcgcaccaccatcacgtaactcctccggatcacgggtcatttaactatttgccacttttaaaatatggcaattaaggatttgccactcatgtgtctatgacatgtgggctctcatgtgtctataacgtgtgggccctcatatatctattgtcacgcccgaaaattcactagtaatttccgaacttatttgtgcataaaatcctcgtccaggaatcagccgaggtacacaaactgaaaatttaatatacaaatcaatcagttacatacttacaaaagaaaagaaaaacagcagcggaataacggactagcgatggtttcagctccactcacacatgcagctcaactagggtttaaaccaaacttcttttccttctagatcctttttcttcaactgaggtttgattgattattgcaaagtgagtacatggaatactccgcaagccacacaacaaatatgcaaacacacaagggtaccaaaggatggcataatataggctcatttgcaaaagcagcatttagcaaatatttgagaatgtaaaatagtagagtaattaatcaatgttaatcaacactgaacagcacacccatgctgctcaggcccaaccatcctgaacaaccatacccggctgtacagatctaactccaaaccagaagctaagcaaattattaccagttatagcatcaataattattgtgagaggtgtgagactaatcacgaaaaacattgctcaacccgcccatgaccgcgggcacggctattcaaatagttttactctggccagaggtgtaccactatacccacaagacacagagcctcaaaacatgttaccatgcccttagtaccaccacgatacctcgaaacgggattgtgacagtacccctcgcacaacacaatccaccacagaggcatggactccccagcgacccccacggacttctcaccacttcacagtctggtgccccgcaatgagccatactatacaaaaggtaaagctgttgcccacgctggcttgtggttggcacgattaatgtctcacaacagtagctcgtgaaccgatccttaattgtcatgatcacgaccttcaaaaccatgtgctcacaacccaccattatcaagttttaattatcaattaattatcataacatgattaaccatcatgagctaccatttaatataatcataaataataatgtagtatgattcatcccattaatgagctaatgtagctaagcatggctaagcaattatatatatagcatttagctgaaccaaaccaatatataaggttcgagctaatcaatttattatccatagaaaaataaagtcatcttcggtcataattatttgggaaaggctcaccacccgatgacattcgaaaataatgcataagttgaaatgaaacaatagctttaaatgggttcaacatgctcaaagggttatttgggatctttgtgacttgccttgcaataatcggtcttcaattagtcttcttgaatttttctgatgcactcatgactcttcgaaacgatggataacgacaagctaacacgcaaaacaaaaaaaactaataaaaaccaaataaataatacataaaaagtaaacaaacatgtagatcatgattttagatgaatttagcaacttgaaccacttaattccaacttcatatgaattaattatgaattttcgaagtttaatcagtttttcacctaatatagaaaaccattacgatttaaatttaagaatttatgatgtcatgatgacatcactaacaggcatggctctggaccacacaaccgccggcgatggaggactcggccgggccaactgagggcatctacgtcatgaggacgacgagaggaactcaccggtggtgacggcgacgacaatcgatgacggaaaacggccggcgacgagcttcaaaaggcggcgacctcgggtcatcgatggcggcggtgctccggcgggaaacggcagcaatagagggggggcgggcttcttctcgcttctgcgatcccatgggtggcgacggcgaacgaaggcggcgatggacggcgacgagcggcacggctgaagacgcggcgacggatgattgcctcgggttgacggcgacgatgaagctccgatggtttgcagcggcggagaaggggtggacggtcttcggcttggcgctgcgatgccgaagacggcctcggggtgaaccagcaacgaccgcaacagtgaggaggatcggctggagatcaaaccgaggcggcgaactcggccttcacggtgatagcggcttccggcgggatttggcggagggaaaccggtggccggggtagagatcaaccttgcggagcggagggaagcggcggcactgatcgggaacggccgacgtgacgggaaaaggcggctggagatggtggccggagttggagagagaaggcgagcgtgcggaggcggctagggttagggaaaacttcgggtaacagggggaaaccgaagaagaggccgaggggctgctatttatagccggaagagggagagatcggctcgggaacggatggattcgatgaaggaagttaggatttatcccgagttcacccggataaaaaacgggccgaaattcatgggatagataacgaatttgatggggttttcttgggattagatagaggagatcgagaggaatccatttttgcaatcaatttcggaagggtagcaatggatgcaccggatttgatggaggaggcggcgcggcaacgcatggcacgggatgagatcggccggctagaggaggaggaagacggcactgtgcagagtgggccccaggtgccggagagaaagaaggaggagggacacaaatcagacttcggccaagggagagattgggccaagagcgagtgaggacttttcccaattcagcccgaaaaggaaaaagggacttttaattatttttccaattaaactaatcattgaaatgatctttgttaaaatacttccaatgctcaaataatttcaagaaaaatcctgaaaataattggacactcaaagtacttaacaattataatcagaccattcaatgactaatttaatatttaaataattgctaaaatgctatttgtattattaaaattaggagttgagctccgaaaaatccgagaaaattccagagagtataattaatcatggagaatttaataaaaattaaatccagccatgctttatatttaaaaaattttatttcccacatttaacttcacttgtaaattaattaatatttaatataaattctaagaataatttattaaataatttataaatcctgaaacgaaattcaggatgtgacacactggtgacagtgtcagtgcagtttagctctcggccaatcgtgttcagcatcaacgcacgaagcacgtcgaaatcgacttacactttgttcgcgagaggtcgccctttgtgatgttcgagtgttacatgttcccaccacttaccgctcccgcctgcgatttgacgccgccctcaggacccactgccaggtcgccgtcccctgtctcctcgccgtcgctccgtcctcaagatcggtgggagagcagcagacatgggggatctcgctcggtctcatcggcgcggggaagctcaccagcacgcagagcagagaagcttgccaatggggggagttgcaggtgtggaggtcctcgtcggtgggggtgtagtacgtgattcctgtgagaggtgagtagttgaacacaaaactcatcatgcagtccttgtcgctcttccacagagtacaacgtacgtggggtgctcgcgaacttccatgtccatctccacacctgtaatgccgagatcatgtgttctggagagtgcatatgaattctggattttagatccacacaacgacttgtacgtgtgccaagtcatggcgatcgttagtaatatgaaggtgtgtattcatcgaactattatgcatatgatctttaggtgataaaatattgattgaattgtctaccgttatctttcagaatccatactccagaaatcttacatatacacatatttgttgcatcaaacctaagctttcttttcatacatccctgaacaattcaacttcacaactgctctcgacataatctcattcagaatggtttttttttctcaaattagttggacatagcaaaatattgcttttcaagactgtaacacaaccaactagcagggatattcataaattttccccttctgttgggtgtttttttatagacatatataatgaaggcgtatataacaaagggagaagctgtttgagggtcttaaggacaatagctcaattgactaggaaattgatgtacaaatctctaccttgttttttgatttatagtttctttggtttcaaaaagtaaagtagctcatgacatgagaactttactagcagagaaatgggcttatatattattggaaagataaatttctccatcgatacttgctgccttgattgtgttgcgtgtgccagccctgtaggtggcaaatcattggagaatcagatgcagcttttagatgggcaaagtaaggccatggtcggtctgattaatctgtacagctttcaggcataggctcttgagataaaaaggtatcaaatttcaacttcttgatactcagtactcaagacatctgttaggagtagagctcagagaaaccctatttttagatcctgtaatcagtggcagagcttcgtggaggataaactgggttatggctcctccagcttcatgcaaatacactatattgagtatgttcatcttcatagacattgattaccatctttaacaggttagtttatgtagaaatcctacattatatttcatgttaatggccacttcttgttagtctatgaagctccgccattgtctgtaatgttgtttctgttaatggaaataggggtaatcttcaaaaaaagtctcatcttcgcactttcacattttttttgaaaaaaaaatatttctaaaataaattttttttaaaaaaaagaaatcctacattatatttcattgtataatatgctgatttagtgattttgagtagaatttcagggagtcaatgcaaaaacttgcatagtttggtcaacgccaccatcatgaagagttgcccaggcaagaagaactctggcaagctcatcatcacatgattcataattcgcactcaaaacatagaagttcaagacttcaggttattgtctcatctctacatctgattatcaaattagtttttttttcccatttttctatattttataaattccactacaaatgatcaatgaataacctcaggatttgacttctttttcaactgatctcttttttttttagcaaaacactgtagaggaagccccacagtaaacaatatattaaaaattaaaaaaaatatttacaacaagttcaaccaatgaatgaggactggtctctcaattacatttaactaggtgataccctgcgtgttgctgtgggatttgtaagaagtgatcatgatattttaagtgctgacaaatgctcaagcattacacaacaaagtaatcaattaggggtaggaacggtgcaaacaactctgaagaagggcaatataaatgttttgtacaaatatatacctgtagtctggtacgaataacgggagttcttcattgaaaaaagcagatctcagctcagcggtagtgcatttgtatatctagaagtagctatcaacttgtcaagtgtgaatgtgtgatttcctgaacatcttaatttcccacaattaatgaatctctaacaaaaaaaactgttgtatatttacctgttgtgcatttacctggttaagtggtgtgctgcttctgaactccttttaagtaccgttcaaaccctaatctagctaccaactggagtgattacttgattagtgaaggagcattgcggggttcataaaagtgtgagcagatagttacaaaccatggaggcaatggatattgtgtaattagcagatcatattcaagcctgaaattaaaaacatgtacaattgagtgtccaacataagaatgtgacttagcctatgattgtacactgaaatgtcacttagcctatgattggacactttctcattagctgaacatgtagctgaatattaggcatcagagtttgtatgtgggtaaacaacaactaaagaatacatcataattgatgacatgatccagaaaagtcaccttgtagggtggtaataacagtacttgataaaaataggcaaaacattatcaaaatggcacttagcctatgattggacactttatcattagctgaacatgtagctgaatattgggcatcagagcttgtatgtgggtaaacaacaactaaagaatacatcataattgatgacatgatccaagaaagtcaccctgtagggtggtaataacagtacttaatgaaaataggcaaaacattatcaaaatgtagaagtgtgatgaaatagtaaagttcatttgcaaaacgtagaagtgttttgtatggttagtaaaagtcccatgtaaattggtagcaagatattcacttagaaaaattgatattgcaagatagacaatattaaatgcaggttagtgggacacatttatagaatagcagaatatgcctgatgctgtacgctgctgagaattgcgttcatttattctttgattaaaagtgcttggtatgattgccactggcataatattagaagtgcttgatatgattgccactggcataatatggtatagtccgataataagaattaaacagagaataacgtattgcagttctgaaaatttgataaatcacctttgcattagaaaaaaaatatctcatcaaagaaaataaaactgaaaactgaaggtgaaatttagaggcaagtactataaaatccacaggaaagtaggaatgcatgcaagatgtagcatgaaggacctaactgtacatcggacaaaggatgaacagtgcaaagcctatacagcggaagaactaattgggaaatagtggagcttgaacgaaaccaatgaaccaaatctgctgacgctctgcacgtataaacatgatttagctcaaacaataccaaaccgatgcaataagctgatcaatggggcttagataaaagtagaagaaaagaacttgagaaaaaggaaacatgaagataaacatctcaagtcatacccaaacactgtgagaagacatctacggccaggaaccggatgcaggtcgaagaaatcgatatatgagaaaactcaagtgtgttgatggaattgataattgatttaattgccacagttgatgccttgcagttacctgaatttggggagataaccaaaggttttagagaagaggaaggggaggagaatcgtacaggacttggtggcgctgcaccatgcgtagtgaaggggatgcgcttcggctgctcggaggaaggaggcaattattcggctagacatgcaaaaatactgtaatatcgaaaggtcctgatttttagtgatctctaatccaagggctctatttggctgatgacatggaggcatgcggagcaagctttatagccagtgggtatcaactatataggaagaaaggatctatgaactaacaaagagagatcactttgcctacaggaagagattagagcaaagaataaggtggattacaggattagtatatacatggttctcattgtaaatcgtaagttcattcacatacttatacatgagaaatgagttttctaacttgattagcatatacaattttgtaacttcctttccatataccatcttaatgattttcatccaaaatctatttactgtacagtggaagcatgcagcaatattttttttggctattaactcatgtgatgaaaattccaattgtttaaatttgtcgatagtttgtaagcttcaggttgtaataatagaaagcccgtgtgctatggcaaggaaagaagtttcagttttatggactgttttgtatgcgctttgtgaaacttctttttttgttttatggatattttaaatatccatatttgatcgatttcctttggcatcaagtgaagccgagaagcaagcccgcagagatgttagtaattctttctagcctccaataaatttatagcaatataaaattaatttttaggataatttattacaataatgtatgtccttgcttggttatttggacttaagatattttaagatttgttttgtcaaggtatatatatcttttaattacgaggcaattgtgttcttgccccgtttcaagatgtaattgcgattttaccccttttttttaaggtttgtgattttacccatgttttttcaaattgaagcttcagtttgcccctactcggttaagtcctcttcacacggtgttaatttagtagtagaaagataggtgcgccctttgctttctttgtgaggatgcagtgtttttgccccgttgtgtcaatgcatccagcgatggatctgacatacatactggaactttaactttgagattatatggcacctccacacaaatcaattttttgccaattttttcaggaacatataagttgcatatatacaagaaggcgaccaattgtccaaacaaatcaatttattacccatcttttcatgagcaaagacattacacacaaaaaaaggaaaaagaaaggagaacccaagcaaaaaaaaaaaaatcccaaatccacgcgcaagcctgcccgccgcctctgcacttgcttgcctccagcagcactgatccacagccccggcgacggtcggccacccgtggaattcacacaactacttgaggtctcctaatcaaatgccgcccacgcagtcgtcgacggagtcgccgcacgcctccctgcgcattggcctcacggctgcctattgatgtaaaaacacgaggcatgtgagatctgcttaacttcagtgcatgtccaaaagcttgcctttaggttcgtgagtgtgccagttgatttgatcctgcaattaacaagagataaagacaaagaaaccgcagttaaatccataaacaatagccgatcggctagttgccgatgacatatcatttatctttgagccgatgtcatatgtagatcgatcggcaatcatgaataagtaagaaaggactaaatctactcgatcggctatagatattaacaatatataatcgttatgtcgatatatatttaaatcaagtgattgggatagatcggtcgccatgcctagacaatatgaatcacttggattgaaatatatactaacaacaagactatatatgttcatagcatagctgatcagatagatctagtatgtatcagctaatactccgataccactctatattaagatatcacagcaagcaaaatataccaaacaaaagcctaatatacttaaatgcagcaagatcttaacataaagggcagatttaacatgtcaatcgagcatataagataaaagtggttaaatcagataagattggctgaaaccccgatgctaccctaatcagcaaccaaaagcaggctagaaattgagattctaatcacgactcataagatcaaactcaactgatgcagctataagtatgaaaagaaggataatatctagacaatcaagctgttggatgttttatagagtgatagatatcctatataatctaagtcaacgttagtatttaacctgatcggctgccttctggcaacagacgttagccaattgaaggttagatagcgatattgccaaagattacataagatatatgataactcaatgaattatataaacaagattagagtatcataaagatggaagcactaatcccgagaacgtaagtcgtcataacaagttttacctatagttgaagatcgaaaccgatgcagctcaactcgaaaacaagaactcgtcgaaagggtggcgatgcgccgagattgtattgaacgtgtgttagattgattccatggggctcggggtctatttatacccgagattacaaaatatgtccatgttggacacgactcttatctctaacaaactctaagataccataagtccttgcggcagacttttgcctaaacatatctctaagaaaattacatgaaatatcctaattaatagatacaattgtcttttcaggactctacccatgcatggcaatcttcatgaagcacattaactcaacccgacaacgtatgccgtgtcatattgttggatttggctcaatcggctaaccttgtccaactcggactctgccaatcctggtcgtagccgattcgtactttagccgatccttgctctgtttccggaacgatttccatcttgcatcctactccgctcctatcttcatctccgatactcagattaccaaatttggttgttaacaccgccgcacctccgtgcaagctggaccgcgaggacatcgtgccgccctgcacgccgggcccgcgaggccgccacgccgctacgcctcctgcgtgctagccagcgaggccgccgcctcgcctcctgcgctctggctggcgaggccgccgcgtcactgccgccgcttgctcgccggccaccgcgcctccctgtgcatcgctgccgctgcttccttgcacgcactgccctcgatctagggtttttcgatcggggaaatgttgattctcacatgtgattgacttatttactgaaattaggggtacgttggtaattcacaaattaaaatataatttttccctttatttaattcgaaaattttgggcccacctaactaccgtcaaaaccaggggcagatggttgcttcatttcaaaatagtaggggcaaaatcacaaaccctaaaaagtaagggtaaaatcacaattgaactgaaaagtaagggcaagaatacaatttctaaattatttgatttgcattactaaatattaccgtagcgttagcacgggcacattacagatcttttatgtgttttagacggatatcgatttgccacggtgagaaagcaaattcccttggcctatttcaatggacaatacacattgtctcttaattttgagaaaactaactgttttattgactatatctctgaatctgaaaaaaatctcatcggttactgtttcctttataatgctacaatggaatggcaatcttacttattggatattggattccttgcctcactgaaattcaaagaaccgttgttgctgctcgtcagtgtagtcagacttttttttttgagaatattgataaaggatttgaaggtatgttttcagaacattatttacttgcatgatttttcatgtagagatcaactgtggtccactgctgtagaaacaacatgtgttgattaccagtctgttaactctggatatatttggtgttattatcctggacatggacaatttggttagtacaatcaaacaataatttcgtatatttctatggtaagaaggctgaaatgatattatattcgctctttgttcatgtctatctgttatatattgctgcttgtactctattatatttgctcttgctgttttatacagcgtcacctaccaaacaacaacgtttctattagctattatttctaatccaataactgtactatatagaactctattagctactatataaaactctctggacttcgtgccatggttgcttcctatttcaaattcatatgttatctacgcaaatgaccaatatacttgttgagaataaataggccattttataacatgagatgtgttgtttcagggataacttatgtgctagcagaaccagttgttcagcactgttagatttagccaatgaaaaaacctggcaagcaattacaaagctgtttcattggcaagcaattacaaagcttctttagtgtgagagaatacctgttgtttcaggtcttgagtgtaccctggcatatcttgagggggagagagctgtaaaaaggaactgctttggaagctggagtgtcatcatagaagtgttgttgaatcgaaggcaaaagaggaagctgcaagggtcttgatttggatgaaggacatctgagatgcactttaaatccaacttgatggaaaatatacagttcctcaacaggagagattctggcttgacgccaaaggggtggacaggacataaaaagccattgcaaaatctccttgttcagctgtatgtgaaatgttgacactgcctatttgaaatataaaggaatggttttgttgacgaaatgagtctgcctagacttatgtttttctttaaaatgccttggcagttagtttctgaagttagaaagaagattaggatcaggatcattgttgatttgtatgttcaacaatctcaatgaacaattccacattgcaattaacttattcttgttgtattaaccactggataccattggacaatatgcagtaagatgtagcaatcaaagtgtttaaaccttgagtgggttagtatcgatttgctgcgtgagtttgtaaactttgagctttgttttctcataaaatatgtcattagtagcaataatataacagtgccaaagtactttcaaacatgaatcagtatagtgagcagttctgaataagaactacatgtcaaatatccagtaggaagtcaacatgaatatccatataactggcaatatatttgggttgaggccaataaatcgagtttcatgctaggatcacttcgttgcaccaatatgtaagatcttgtttccacctaaagaatttatgaatggagacaaatgtatttgcttgattggatggtcaaattcaaaatcgtaagtattttcactagaatgtagtttagcaaaccggtgaactttgttagctttaaaacatttttatccccgttgcaatacacgagcacttaactagtattgtaaacactccgtgattaatccaatctagttgagtttctccatctcacattcaacaccctactcacgggctttctcgatgccaacaaacactaaaaccattcccgacgtcgttgacgccccgagctcacaaacactaaaccatcctctcctcgctgttctgctagctcaagaatagtaaaagaaattgattttaatctgcatcttgggttcttagttctcacaggttcttgcactgacggagcagcttggaatcaagccggacattgtgtacaacgaacagaaacaaccatcggtgtgcggcggagatttgtgaagaggggacgacagataaaggttcaatgccaaggccaacaagttatggcggttcatatgtactgacatacaacccattcttgaacgccgctggcggtagcgccgcgcgcgacgcccagtccgggagggcgccgccgccgccgcttgctcgtcgtcgcaccacaggattgggagggggccgctcacgcccatcgacctcctcatccatcgctgctaccgctggcctccatcccctcgcactgctaccgtcagcctcttccctcgccaccgaccctgccgcgctgctgccgctggcctccgcccctaccgcactctccgcccaacttgtcaagctcttaccactaatacatacatgatagatttcctcctttttttaatatgcagtatataactggaaccgcacgaaaaaatggggggaccggcgcgaaactgtcgaccacacgggaaaatgcatttttccgtgcgaacgtcttaacccaaccacacgggataattctcattatcccgtgcggtcaacttaagaagatcacacggaaaaatcatttttcgcgtgcgggctttttaagtggaccgcacggaaaaatactctctcttttctctctcacccatttcaaatttttcacactctctcttcttttttcctttttattttctctccttctttactctcctcgatctcctcccctcccctctctctgcctccttttctcctccccacccctctctctcctctctctcctctctctctgtctctctgcgcgcgccgccggctccgtgttggcggcaattaaatgccgattctataccgccaaattctgcataaagtacggataataaaacatccaacatagtgataggtgcttaatctcacatattccacaagtgttggtatatatttgtatttagatgataaactcagatgctgggaggaaaatcagactaaagtgaggataaatgtgtatccctgcaaggatgggttgtgaacttcatcaaaacatcagtaaatcgacccaaaataccgaagaatgaatagagaaggatcaggggagaacatgggctgaaggccaggccaggagggcccagcccaggttcggccaaaccccctggttcggccgaaccaccaccaccaccgttggatgtggggtttggcgtggacgtcccagatgcatccctaatgacggttggagggcacttcggacatttccccttcgccaaccgtcatacctacccctatataaggacatcatctcactcacttcaacacacacttccaagcttgagcttaattataagaggctctattgtactatattgtatactagaataggaagagagtagagtagaagaagtcagaagaattccggagttgtcggtaatcttctcctattttcttttattccgtttattactctaaatttaatataatattcttcttaagtaatttagatttatcttgtgagaattatctcatggttagtttctaaatagcatacgggattattgtctactataatcaactaaaatatagtgattgctttggtgagttataaacactaaagtagatagtaattgcttagatatagtgttcagacagttgttatccagtaattgctgcgtatcccacagtatgtttgaggtgggtgtagaggtggtgacagccctcgagatcacttaagtcctctctgtccgggtacgtagtagagcgccatctaggaacatcgggttgccagtgcctgaagtattgcatctatgaacagcgggttgctagtgcctgaagtattgcgttaggattaaaattaagttttccctggttggtgtccttgtatgaactggaggaagatctgaccacacacgttcccttggattctatacccttagaatactccgtatggagaagtgctacatcggtatatccgtgcgcttgcggaaacacttcgcgtgcacgcgcggcgggcgc

SEQ ID NO: 65421 - DNA, 712 bp, Oryza sativa
agtggcagaggcttacatcaacacctctatcggaaggtattgtacaggcttttggagattgtgcatgtaatgtatctgtgggggatgatctaaataaatggagcggtcacatgacgatatcttaaccgtcactgcatgtctaaagtgctcatgttttctgatatcatccaaacatattatctgccggcctatattaccgataaacataatgacatgactctggactatgggagaagacgtcatgtggacaaaagacattctaattgaatggaaatgaatgcggcacactgatatagtgaatgaaatgctgatcagactatacagccactatccttacaccgaaccgcatgcacaatcagtgcggagtgcctcatctattctcagccacttacttatacgcccatggaatatcacccaatcctttctacgcccatgagatacggtcgaactcttatataccattgggtgggcataagtatccataacatacccattccgttcgttgaccattagcaagaccgccagatattgatgcaatgactttattgaccttgcaatattgttaacagcatgcaaatgttttatgcagaagaaaatatggttgtgacaaccaatgaggactttattactaaacatctgtgatgatttgatggaaatcagacattatactatgagagcaggaaaagaactattgtcaaaatgagttgtgctt

SEQ ID NO: 65422 - DNA, 904 bp, Oryza sativa
caacatgctaaattatgttgcaacatgataaaaagaaaggttgtaaaatttctgctgaaaagaaagataaaaaatgggccattagtacagtaatagatgtacagtactaacaacacaaaataatgagtaaattttgaatgagaacaaataaagggactataaactgcatatgccattagcttggtttaattaaaagagaaagagaggagaacagttctactttttcaatatttttagagggcttctataggtaaccgtttggcataacctagggtcaaggaggctctgataccaacttgtcacgcccggaatttctatccaaaattccaaacgcttacatgtgtgtaaaccctcgtccaggaatcagccgaggcacacaataacaaattgataatagagtgcaatcattactctaattaataagcgaatataaagtcattacagaggtagatagttcctctcaaacaataaaaatccaagcagtggaaaaataagatgaacggcgcagacgactctatcccacaagcagcttgaccagggctacgcctaatccttcacaccttcagcatcactgtagaactcttcctttgatgaataattaaaaggtgagtatatgacatacccaacaagccacgcagcaaatatgcaaatgcagggaataacaaagaatggcataatatagtctcatttgcataaatggcatttaataaatactccagaatttaataaaattgcaaagtatttaattaaacaatattaatccaacgctatacaacatacccgttgcataggcccaaccattctgaacaaccaaacccggctgcacagttctacctccaaaccaggaatataccattctaaaccaggagctaaacaaattattatcatcgtcatttaatatggt

SEQ ID NO: 65423 - DNA, 6497 bp, Oryza sativa
caatgacttcaaagctttagtgtataagtttatgccaggtggggatttacataaattactatactcaaacggaggtgatggagatgctccacatcaaaaccacattacattggctcagagaataaacattatggtggatgtatcagatgcactggagtacctgcaccatagcaaccaaggaacaattgttcactgtgacctgaagcctagcaacatccttctagatgataacatggttgctcatgttggagactttggccttgcaagattcaaatttgattcgacaacatcatctctaagttatttgaactcaacctcctcccttgtaataaagggaaccattggttatattgctccaggtaactgttaactttaccttgttttgcattgctacatatttaatttattgtctgatatatgccaacttgtgaactcaactcttgtcatatgtaattttagaatgctcggatggtggtcaagtttcaactgcctcagatgtatacagctttggagttgttctcttggaaatatttattcggagaaggccaacagacgatatgtttatggatggattgagcattgcaaagtatacagctatcaacttccctgacaggatacttgagattgttgatcccaagctgcaacaagaattgatcccctgttctacagataaggaagatttggacccctgccaggaaaatccaatagcagttgaggagaaaggcctacattgtctacgctctatgctaaacattggactctgctgcaccaagccaacaccgggagaacgcatcagcatgcaagaggtggctgccaagttgcacagaatcaaagatgcatatctcagggaatactagggatctctcgtagcatcgtgtgcatcatctgtttaagtagttcggtacaacattgggtaaagaagtggccattgtcctactagaatgtgctgttccttgttacaacgcgcggcaagatgtttctgctctaatatactgtttgatttgtttttccttgatagagggtggcatgacatcttgcatctttcatacagagttctagagaaaaggcctttatccttcatacggagttcaccatattccggatattccggatcttatattggcttaacagtcccatatgtctaaaaaaacttgtacatttatgaggatttttaccgtccaaaggtacctggcggtaccaattctttaccgttggatccgagcaaatccaacggctggcagagattggtactgcggggtgtcagttctgtccctgatgtggtactgttgacggagtagatcacgactacggtatttgcatactatagggattattagtgccaaggcatacgcgagaatgagataaaaagagacaaatatttttatacaggttcgggtcctttaactgacaggtaatagccctactcctgttagccgaaaccggtgttgtttttattcatcagaatcacacaaatacagtacttgggataacctatctagctgtcgtcgacttggcggcatagaacaccaacatataattaatgacgcgatagcctttctcctcgaatacagacgagatcagagatggcgctagatccctcttgtcggcctttgtggcaccagattgggtatgtctagacttatctccgatgtcgatgtctggcggcgtgtattggtgtctatttcgactgaccatgtcccctctcctcctattggatcttgtatttacacccatagatgtccccttgttcaattagaactaagtagacaagtatggatacgaccggagtaatccttgtagtttccaacttgaactatgtttcttctttcttattcggaacatctttcgcatgcggggtctgatttcgtataagacttgatacatggtggacccaaccgagcttggttgtgtgcatgagcttggttggatacgagcttggttggttggttaaggatcatcaagtactagcacaagctagtttgcaaataacaaattaaataactaatatggagctaaataaataatactaaaataagacaacaatagcatggagtacttgctttcccttcacctagagcatctcaattgtccgcattaaagtcgccgcccgtcataagtgtattcactttttttcttgaagcaaatgacagcaggagatctgctggatatattagaagggggaaaagtacagggagagagtcaagagcaccctaaaaacagaggcactttcagagattacagacaaaataaaagcagctaaagaccgcactcaaaaccgtcaggtttggcgcacaagctgtatgaggtctatattttctttaaccagaaaagctacttgggtggcacttaggtaactttgttgaaaaaccctgcgattacgttcaagccacacctgccaccaagttaccagcaaagcccctatcaatttctttttctttctccttgcatcaaagaagcaatcttttcccaccaatctaaaatgcataagtgttgtgactgatttggcgcttgattgagatctagccagccacgaacctgattccaaacaagattagtgaaactgcattcttttgctaggtggtttgtgtcctcgaatgcatcagtgcagagactgcagatccaatcacatggccaatgtcgaatcaaaaagttttctgccgtgagaattttctggtgcagaattagccaaccaaagaaacgttgttttggttctgcttcagcttgccacaggggcttgaagctaatgttcgtagtagttccatggaactatgcctcataagcactcttcgctgtgtaatcaccatgttgggtccatttccaagtgatgttatccagagagttggtttgcaagacgatgtgttgcaattggctgcccagatgcaccaaatcgttaatttcagctaaagtagtgatcagtctcaaagaggtgagccagtgattgttttccagttcgagttgaacacagtttcctttcctttttgcaagtctgaaaatggacggcgctacgtctttgggggcacatccggacaaccaaaaatcatgccagaaagatgttttctttccatctccaagcgtaatcttagtacttgctctaaataaactcttatcaagctcatcacatggggtctccatattaatccaaggcttgttttcatctttccattcataccacagccatctgagtctcagagcccggcaaacttctctaaattgaggattcccaagcctcccaaagatcttggtttacagacggcagtccaatttaggagacaactacccccacttactttttcaggttcatcacccttccaaaggaaagctcttctaaaaggtcaatccttttataaagccatttgttttgttgaagaattgtgagatggtagattggggtcaaggacaaagtatttttaaccagaacttctctccctgccgaagtgaaaaagcggcctttccagccagggattcttgagcctactttatcaaccagtggctggagatcaactttccttagtttccttgtgtgcaatgggagtcccaaatatttacaggggaagtctgaaacttttccagggaatatattgaggcagtcttctaagtttattccactgcagcttatggataaatctcagttttgtccatgtttgtgtgtaggccgctaacctctacaaaagcatagagaatctcacgaagggttagcaaatcttctcgagttggcttcaagaaaagggccacatcatctgcataaagagaacatctgaatcgcctgtgtctttgaagacttgcaaggaggtcgtgatcttcggctttctcaaacaagatatggagtggctccatagcaagtatgaaaagcaagggggagagaggatctccctgtcgaagtcctcttgcatgattgatttatgtgccaggtgtgccattcaaaaggaccatcgaggaggaagttccaagcaggttagagatccaattgcaccatttttggctaaagccgaaattttccaggacttccaagagataggcccaattgacagtatcaaaggccttcaatatatccactttgaggaaaagagttggctttttggctccgtggaaatacttaatcatgttttgaacaaacaaaatgttgtcttgaattgctcttttcctaatgaaagcaatctgactttgggaaaccaaggctcctagtttgggagcaagtctgttagctaaaattttagctaaaatttttgcaaaactgtgcataagacttataggtcgataatcttcatctttagaggcatcggttttcttagggacgaggcaaatgttggcagagttgaggtcatgcagtctgaaggaacctaagtctccgaagaaggagaccgtgttcatgagatctgttttgataatatcccaagcctgcttaaagaattgccacttttaagatatggcaattaaggatttgccactcgctctctatgacatggggctctcgtgggcatccacatcgtcgagctccgcctttgctgccgtttgggtgaggagagaggagtttgagagaggagaggagaggagagaagaggacaaggagctgaggacttagaaatatcatgtggagctctgtatcctctcgcacctatttaaatgccataaccgattttcacatgcggacagcttaaaaagcccacctgcaaaaaaaaaagtgtattattgtagatagcatctttaagccgtctgcctatgaaaatagatttttctggtggccaaccattagaccactctttatatattttcgcaggctgataattgtagtaaaaaataatgtctgtatgtgaaaatatatgtgcctcactgtagaaaattatttttctagtagtagtgttagctgctatcttgctatctatctagtcccatgtgctatctattgtaaaccacggtgatggttgttatcaccgagatataaacagaggtgtggcccctgaaccgggcttgaacggttctgcagctctggttttcctatccccggctctgaaagttgcggcgccgggtgaagacagttgcagcaagctggatatggtacaggcatattgacttgactcgagaccctccgatcaacctaggtacagcagaaaaggacatgacagtcggacgtcttttgactgagcgctgaactgaaaagctgttgaaaccatacgaaatgaaattttctcgaaatttcggagtcaattggtgtggaaatttcttccacgtcgtctcggtcggtcgttccgccgaccgacttcttactccaacatcttgctctttccattattacgcatacgctttccaaatattttcctatagaactttttatagaatagctgaaaaatcgtattgaactatatttttattgttttaactaatatttaattaaccatgtgttaatttattatttttattttacacggggaagggttcccaacattaaggttgtgttctttcacatcagttcccaactcatctccctcgttttttccgtgtgtacgcttttcaaaccgtcaaacagtacgcattttgcaaaaagtttatatatgaatgttgctttagaaaatcatattaatccacttttcaagtttttatgctataatactttattaatcacgtgttaatctaccgttcccaacccctccaagacagcacagcctcacggcccgaataaattgcctcgatccatcaatacccaactatttaattttttttctttttttcagggaacccaactaataattggcgtcataacagaaacaattggcagctgttgacgagcgatgacgccctgcctgagtcagtcagtcaagattgaatgagcattataccaaggcctatctatctatataatcaaggaaccgcgtgtctgatcgaactcgcgtgccattctaatctggagattgctatttgctggtcgatcgatctgtatggctattgcgttgcttaccgcaggcacgcagtaaggttgggtttccatccacccttggccggcttcgagtgcccctgctatcgcgagctgtaactctgtaagcttcttctcggctctaagtctcatttgccataggaacatgtcgttttgtttgaagttacaaaaaaaaaagctttaaacaacagtgtctttttaaatctagactagctagttggatacacatactttgccacgaataaaaaaaatacattataatattatctaaaataaaaaaaatcatgaaacatgtttcccatctttttttttctatttggaatatccaccttagtttgattttgtatatggatatccactaatatttgattgttttcttcttaatattaataagttgaagggataatttgcatttttttaatgtgagtatgtatgtggcagattcactgttattaccactagatgctttgaaatgagtctaaacgttgggtgcataggtatagctagttttatttcaaagacaattgtgacatataatactcccttcatcccaaattaatacaacccgaat

SEQ ID NO: 65424 - DNA, 2509 bp, Oryza sativa
ccaagtttttgactgcgcgacagtccgcgagatcgtggagggaggtgttgtggacggagcaccacttgctggctgggcgctccctgctgggagtaccagcctctttctttttgtcgctcgcaggcctcccctttcgggtggcccgcggagcgccctcgacggcgaggacgtgaccctcgtcgccggaatggaccgaccttttcttcctcctcctgtcacgccgccctgtctgagcggcggatccgggggcggccgaagctgccacaccggaactgaaggggttccaggtccaggcctcctccttacgagccactcggtccgcgagctgaaaaagctctgcggtagtctggggctctttggaggcaatcttttcgagcatgcggttgtgccgcacaccccccctgaacgcgtagatcaccgcgtgtgcagggatgcaaggtatagtattgcggacttggcagaaacgctgaatgtacgagcgaagggattcatcatcccctcgctgtactgcgtgcaagtccgcttcttcacctgggcgtggataggtgccttgaaagttcatggtgaactgctggcacagatcctcccaggagtggaccgacgcgggtggcaggttcattagccaaccccgcgcctgtcccttcagggccatgggaaagaaattcgccttgaccctgtcgtctcccccagcggcctcgatcccggtcgtatagacctggagaaactcggtggggttgacgctcccatcatacttctcggtgatggtgggccggaaccttgggggccaacggacattccgaagactcgccacaaaggctctacagccaacaccaccaaccgggggcacggagggctgatcctcacgtccatgtcgaggtgacaccctggacgaagaggcaccctccgttgcgcggggagtacgccgatcactacgtcggcgctcaatgtcgaggcgggcatccggctcttcatgctgatcctcccgagtcggaggcgccgacgagggagtggtagccgaatggcgtgcagcggccgccgctcgccgcgctctccgtcttgacgacgcggaaccggtagtggcggcgccggaggtcttggtggtggcggaccgtccgccagcacccaggcgttgctgtgccgtcatgaccaagttggccacgtcgtccagccatcgctgggctggagactccgggtcagggacgacaggcgggtgacgtaggagcgcgccaacagcctgaagcgcgccttgaggcgtgctgcagtcgccgtagacgaggaggcgacgctccccatctcgccgttctcctgcaccacccgcgactggcgatgctgcggatttttcgactctctcgagcgcctccccccgcttgggactttggcgtggaggaggtgggggagtacgagctcgacggcgcgggtttggctccccgtcgtcgccgctcacactcggagagaggtcgtgcgcctttgcttgctcggccattaggctgaacaagggaaacttggtgcacacggaagagtatgagagctcagaaaacacacgctgagccccttacctggcgcgccagatgacggagctcgttgcccctcaccgggagactgcgcaagcccccctttgccggttcgaccaggggcttagggtgcaatcccaagctctctctctctctctgtatgtggaaagatcacccgcccgcaagacacacgagacacggcgatgtatacaggttcgggccgctgcgaagcgtaataccctactcctgtgtttttgtggatttgtgtatggaccagttacaaaggattaacttcctttcccctcagccttccaaaagggaaaagtcccctctctaaatgggcaaggtcctccttttatatctcaaggggataccacatgcacctttctctttccaaactggactgttctttttctctttaatgggcggagatcggtacggtttccatccgggagcccttctgatgggacagcccacacctacccccacctcccccgaagacagagatgacgcgggaccgtggctgtctgtcgatgacgcgaccagtgccagaccggtcattcttgtccaccacgcgtcagcttaacaacgtgcatgtttgcccttcttcgtgtaacaccttgcctgtaatggttaggatgaagcctggtataaatctgaccagggctaacgtgccatctctaagagataacacgctagctccggcttgagacgagtgcctagaggctttcgtcttgacgggatggggcaaggcgtgcgtcagaccgccagtcgccacctaacccgtgatctgaccggtctgtgactggtcacagaccggataaaggaacgcgctgtactgcgttgcatgcagcgtgacacgctttgaccagactgcaataaatgctgttaggtgagcacagctgtgctcacttatcccatatatgtggcgcagacttccttaaggggtcggggtgcctcggccctcggggccggggcaagcgcaacccgaccccccc

SEQ ID NO: 65425 - DNA, 2826 bp, Oryza sativa
agctatttgacaatgcacatgatggtcagacatgggtccgaagagatatagaaggaacaactgtcgataacatggtaactaattaaaggtgaggttatgaaggttgttctctgtctatctgtccattatcactgatttccttatatcgttgatatcctcacttggcgagctctttatttttatggcagtaattttggatggagatttactgggatcgaggcttcttcaccacaatagctttactgtgtcgttcgtagatttcattggattgtccaagtgattgagccagatggatgcattttttttatttgcatatatgctttgtgtaataatgttgtacattagttatatacagaattggtggttagatcttatttttcaatatataagatatcatattgtttatatgatgagaaaatggaatggccgactatattttttgcatctatctgtgttgtgttattctatttccatcttatacaaattcctcgagaaaactatttacattgtcaatggcacctaacgtgaataaataaataaaacagacttctccaatgtgaagtggacatagcctagtggtacttggctgtttctactgaattgaggactccagttcaaatactagcaaatgcatattttttttcatttcttctctagtggcgattcctaaaactttttaaattctgtctgctcagatttttttaaatttcttgaacttttttatttctaaattttaaaataaaccattcaaaaatatatttttagaatatgtggtttttcgctcgtcctaacataatttaaataactattaagaaaaaaaatatgttacgtccaaatttcacgcggtctatcctaatcgggtcgacaacgaaataacacgtggcttttttgtggtgctaacataatttaaataactattattttaagacaaaaaatatgttacgtctagatttaatccgcggtgtctggaccacaagtgttttttcggtagcgctaacataatttaaataactataattttaagacaaaaaaatatattacgtccggaatttattcggaatgtccggaccggattgacaatgaaaaaacaggtgattgtttggtagtgctaacataatttaaataactataattttaagacaaaaaattatgttacatccggaatttatccggtctgtccggaccgggtcgacaatgaaaaaataggtgattgtttggtcgtgctaacataatttaaataactatatttttaagaccaaaagtatattacgtctgtttttcatgaggtatgtccggaccaggtcgatgacgaaaaaacgcatgctttttcggtcgtgctaagataaattaaataatgattattttaggacaaaaaattgttacgtcttgatttcatccggtctgtccggaccagattgacaaaaaaaaacgttttttcggtcgtgctaagataaattgaataactactattttaagacaaaaatatgttctgggccgagtcaacaatgtaaaataaagtggttttttttcgtactaggataaattaactaactacttttttattaagacagcaatatgttacgtctggatttcatccagtctttctagaccgggtctacaatgaaaaaacacgtgatttttcggtcgtgctaagataaattaactaactactattttaagaaaacaatatgttacttttggattttatccggtctctcaggaccgagtcggcaacgacgcggtttgtattagtagaaaataatttttactagtgcatttatgaagttttataactagttcttattgatccgcacaaaaataaattagctgaactagattagataactggaggttaaatctgccctaaaaaaatcgagcttaaatttacttgatgtgaatttaacattttgtgtatttgcgcaaattattttgctctccctccattctttccctcttttttcagtcttattccaaatcattccctccgaaaaattgagcttaaatctactcagtcagaatttaacattatttttatctccgacagaacgtttgctctcgctccgttctttccctctttttttttttcagtctcacgttattttccaaatctttccttcgaaaaaaatgagcttaaattattttgctctccctccagtattttcggtctcaatattttttttctcacgtctttcgttgtcgcgccatttattccctccattttatccctccaagaaaatctaactgcccgtgaaaaactctatctcctctctctccattctccaacaaagagctcgtgggtgggttttcttctccaacgaaactctatcccctctcttcttctctctgcactgctcctcccctcaggcctaagccaggcaccaatctgaaggtaaggcaccatggtgatttgctggccagccgctccgcgtgtccacacctctcccaatctgtgttggctgccatcctctgcacctacgcctccccgccgaccaacaaccctgagtaggcgagctcccccacggccgctgagggccacgcggcgacgcctcatgcccggtggctgtgcgctgcaccgctagtgcggttttgcctccccagcgcctacgtttacaccgcgcgcgcagcccacggccctgccgccatgctcctgcatctccgcctcccttcctagttcctacacgtttcactgctcagctgtgttgccaaatcacactcgggcctaattccatttcagcactatactacattactaatttgatatatatgttctctgtatgcaggttttggatcagatgcagtgatcaatcctaggtgacagagcctatt

SEQ ID NO: 65426 - DNA, 3461 bp, Oryza sativa
gaatagagcctgctggttgtagttgtgatacttggatttgatgattcagaattgaaaaccctggttgtgcatgattccctggttgagttcttccattgacattattggccccttctggtgcagtggttaaaggcacctaatcaagtaaacatatagaagtcaaataccgagatgtctcaggttactagacctaaagaagtaacaccttattaccgaaaatgtagtgtttgtcatgccaccaggcgtcgcaagacctagggagccaaggatatcccgaacactctgcagataacaggtgggaggaaatcacatcaataaacatataaaggttctggtccccatttagacaggtacatataacactagaacaaagcatataccctagccaggtcatctatcatcccctcagaatgcatagcctctataatttcctagaagagagttaatgaaaaagaattcaaagaaaattaaagttaacctgtagttgttgctaagagttaagcagattggaaattttaagtatacgagacaaagcgatgttagaagcataccctggagatatctcctaacagtccatttccagcaacattaactgcacgtaaaaagattatcagacccatacccagcatattgctgtaatatacctaaaatcaggtacagaggaaatacactctggtaccacaaaaggtagtgccagtcaatataacccaagttgatttgttatgctctatctatatattgtaataactagaaacacagtaatgcttacataaatacagttaaataatggtgtttttagttcacaaattaaatgaaaaataaagcgaaggactgttcaagccttcatctacttagcctgaaatgcttacctagctattttttacaataactagcaataactatttttctgcccttcaaagggcaataatattttatccagtatgagcttgacacaattaatatatagaacagacacatggaaacatggtattgaagagtgaaaacgcacataaattgtttacgatactacgaaaacttgtgcagcacatggctctgaggactaataggtcataggcatatcaggtgcgttctatattgatagtatactcttcaaagcaacccccaacttaacttaccattagcatgggtgttttcatcagaagtaccagaagaatgttggccttcagcagctgcacgccgagcaaccaaatgcaatgtgtacccatcttccaaatcttgaggttgtcaaagatataactatcacaactgtcgtgtttacaaacgaaatatcacaagaaaaccgaaaatgataaattacatcatgtggtgatgaaaatcgttgatccaaggaacccctcattaccaccaacgatgcagttaaatactggtgttcaaccacctcaacttaacaaatatcatcaaggtctacaatgatttgaggttcttgcccatatttgcaaagaattaatgcttagatacttcaatttgacattttactactttattttgtctcattggaaggccattatgaaatcactaccaaagcaagcagccctaatcccaacaaaagcatcaggcactctactcttctagcagtaacgaaatcacccttactggcccaaaagagttgtgtatcttcccggcctatttataactaagcaactaaagatgggaaacaaaatgcaggtaaatagtgtatatagctcaagttctcaacagcaacaagcgaggtgagtctctagatggtttgattgtcttcaagcattcaaaagaagaagcatgaacaaaaaggatacgatattctgatagcaggtgatcgtcctttaagactcttcctctaaaaatcaaccgctgttggtccacaggaaccccggttgcctctactatcttctctttaaggaccagaacaggtacctaaaaatttttcagtgattagattgtctcaaaacaagtacatgggagaattcatcttgtcgttctaactataaggaactgacattctatagcatttctagtatctctcaagcaagcaacactcaacagacacacagagacataatagcaaactgtcaaggtggggcgaagcatacattcttcttaacacggagcttatgaacttgtgaatccagggttttgatgttgatctcaatggtagcctctggatcatcgccagcttttactgttgaactgctggccccgacagacgcatcttcagacatcctacagaacgaggaactgaatagtatcagatgctgcataaaccacaagctacaaaattcgaaattatgattcctagacatgttcagaattcttcatagtcaactcactccacgcctaagattacacagccagttaaacccctgcatttaagcacaagatctcaacagagttccggcagcaacaagtagagcgccttccatctacgaagaaaccagtaccctcattcctagcttaacattagagaaaattccataattttaggttctaggactccatcaagcatttaaaagcagattacgggagaccctaatcgttctgtcctcttatcagaagacgctccgtaccgcaaataaaatttttagcagctcagaatggctaggaccgatcccttccaaaaggagaacttcgcaagcaattacagcctcaaaatcatatcccttccccccttagctctgaaatgcgtcgccattgtcctctccgccaagtcgcgtatgcccccaataggatgaggcttcaattcccgaataattaaaaaaaaaaaaagaagaaaaagaaaagcagaagatcgagccatacgtggaatccggagagggcccgagccgccgaggccacaagtagagagtcggctgcgccccgcgcgaggcgagctgagctggcggcggcgttggggtgggggactagggttgctgggagcggaggggttggcaagcggcggatgaaccgggcgagaggcggcggcgaccggatcgggggccgatgcggcggttgctcctgcccgatggggggcagcgaggatttttccgtggcgatttttctttttccttttttgcgctttattagggttgcgagttgtgtgagaagtgagaactgagaagaggagggcgccgcagtgaaagaagaagaagaagaagaagaagagggggaggaggtgaggagggagggggcagtggggcacatgtccgggctgttccggaaagttccacggcggtttcgttcttggggatgctttgccttgcttatcactcgatccaataggagcagccaaatgccactcacgggagaaggctcaaaggctgattataattactttgttttttgtttaatgaaaaaaaccttaaaattagctccaaatttaaagttacgaatttatattttggttgataagtattagcataagcgaaaagataaggcctttcaaatttttttacatgcatcatttgttttatagaaatagatcacat

SEQ ID NO: 65427 - DNA, 50740 bp, Oryza sativa
cccgcgaccaccgatccggcggaggctttctctcgcctcgcaccaacgcctccacgctccacttccgcctcacccaccgcgagcacttcgcgctcaacgccaccgcttccgatgtgctcgcgcaccttctcgcccgggacaccgcgcgcgccgccctgcttgctgcacccaacaatgccacgcgcccgcgctgccgcggcggcttcgtggcgcccctgctgtccgacctgctgcaggggagcagggagctccagctccacgagcaccacaggcaccacgggcacgtccaccgcccgcccccatgcgtcgcgcccgtagccgccaccgtagtcgccttcgctcggccgtcgccgcgacgccgccgtccgccgcccgccctcgtgcacacctgtagacaaagagagattgaggggaagaggggaagagagagagagattgagaggaaagtaggaaagagagaggtgggagagtatgacagacgggtcccaccattttttattaaaaaaacgctggctgggatgccacgtgtacgccacgtagaccaaaaccactgcggattaggttgaggggggtaattcgtccagtttgtatagttgggggcgaagaatgtccggttttgtggttaggggtggtaattcggacgaccgcgatagttcagggggtaattcgtactttttctatttccaaatcatatttttcccacagtacaggaatgtaaaaactgatctaggtaggctgggaggagaagaggagggagtgggctggcccggaaggagggcaaaaagggaggaaggaagaagagggagaggaagaggacttcggccgggggtcgagggacagaggggaagactctgtgccagacttggcctaaatgaaggagatggattatttttaggtttttcttttttaatatgaactctgaaaattgtttttgttgcttaataaatatttctgacgctctgaaaattcaaataaaatttgagggctccttttagaccatggataatttaacaaaaatactccgggacacattcagatttttcatgtacgagttttgatgtttgtcaatttctttttgagttttaattaattctattattccttttggagaatgatttttaattgggatgaatttatcaagacgtgatagattctttgcatatttttagaataaaaatgtaaattttagacttgggtggcaagtgatatgcatatggtggtagttgcataccgataggggggagtgtttgtctgagtcaatttaggaccgaactacatgtcacccacttatgtatactgtactattcctccctccaaaaccgcgtagctagcccatccaacgagcggacccacttacacataccacttcacttatacttttgtgctcgcttggtgtaaaagggttaacccgggagtgatatggttggagggacaagcccttataagttggttcaactcttgctaaactagcaaggactaaacgtgctgtgtgtggcctagatctggcgcacgcggagtgacgtgaagtcgccatgctggtgtgttgaacacgttgtcccttgttggcatgtaagggaagtgtcccgacctagatgcttcctgggtggggtgaacatgaggcggaatttggaatacctagggacgtggttgtgccgtggggacgtggttgtgccgtgctcatcgggggtacccctgatctagctgaccccctggtgtactccggtgctggggtgtgttgaaaggaaggacgactgtgagatggttgtgctgcttcgtacccgcggcatgacgaggagggaccactgtgatccacgctggaatgtcggggtagtggtggtgatgccctacgggccgacggctgcaccacatctgccgcgctccgacaggagacacgacgaagtagtgcggcagcacgggcacggaagttgcgaaggatgctcgccacgtcgtcaggcctgacggctggaggtcttgacggttggaggtctcgtctctagtctttgcagcaaggtgtccgactcgacttgcacgtgctcaacaaattttgcatgttccacaaataagcaagacaattaaaattatgatatagttgcacatttattcaaagtattgaataagttgcacatttattacgaatattgaccaagttgcacatttataaaaaatacttaactagcacatttattaaaaatattgaactagttccacatttattagaaatactgaactagttgctcatattccgcatgttccacaagtaaacacataccattgagttgtaagctgatcgaggctgaggggcaaacgtgtcagtaatcgctgcctggtgggggacggtgctatctccttgtggcggaaaacacctccatcgtgtgacactgcggtatcaacgaaggtaggccccatagtaactcccatcgtctggaggtttctgaagcgccaaattatcaactgcgtgctcccactcttgtacagtcggctgaaccatggtcacaataacaagctcgtaggaaagcccgagcccctttcgggaatacctgcacagcaagaaatggacacatttattcaaaatcgtacgtacacatatttttgttaaaaattggattaaacaactgttatgtgtaccaacctctgaagactatcagccaaagcatgaccaactctgggagaaaagtcctgatacatgcccaactgtttaagaaccctttggacattgtgtggctcgacgtgcacgtccagcacgaggtgacaagtcgtcctccatagtgcttgatcccgcgtgcaaaggtccgcgagaccgtgcggtgcacgatcattgacatcgtgttgagtgtacggagtctaccgcacacggtcaggcgtaagctgatcaaagttagctacgaactgtgtgtacacacgacgcgtcgtcccgctaacccacttcggctgtaacaagaagatagtacttatgattagttatatcaggaaattattcaacttgtggtgaaccgtatataatgagaagacaaacgaattaaacaaaaattacctcacagtgtgtccacaaggatcccatagtgggacgattgtcgaggtcaccaaccccggacttgtacatctctcgcaattcgtagtttgcgtacgagtccagctgaggcctcccaatgtcgaagcgctcgtgcgcccacaacatgagtagcaacgggcatccagggagtgaatttgcttgctgttcctcaagcaagcatcacatagtccagcatatgtggccgcaagtaccgccgacccccaactgtactgtggaaactctgcgataggtaactctgcaatctgctccgcgtagtggatgaagtgcttgtccaccgagtcagtgtgagttcctgtgaacatcacccatccaaacaaccacaacaggtaagcgactaagtgccgtcgcacgatccagtcctcctgatcatcaggaaagacatcatgtcgaaactgattcaaccaactttttgtcggcccgtgcccatccatgagatcctccagtgcaacaggcagcacaccaccaaaattggccagaaggtcgtctgcccatccagcttgtaccattgttgggccaactgctggcccagctatcggcagacccaacagataagacacatcctgcaaagtgggcaccatctctccaactgtgaggtggaaagtgtgggtctcaagcctccatctatccacgagagcactcagaagcgccgcgtgaaggctcgaccaatcgtgcaaaggtcaacaagccagctgctctcaacctacaagaagagagagtgcaagttattaatacagggaaatgtcaaaatcttataaggttaaaacaatatattattacgcaccttggaacccaacgaggatcaatacgccaatattgatccggtcctcgcattttcagcacattgcagaaagttcctctactaagtcgtcgcgaccgatggttcctatcaatctccttgtcgatcagctgcacgtcatattgttcagccatacctgcatattgaaaaccatattagtacaatgttcatatggtaacagtaaattaaatgcatgacacataattcagatacataatttagataattaaattgcaacacatttattcaatttaaaattacaataccttcagataataaaagtgcagtatattgcaaattaaaactacaagccaacaacacgtagatttggatattaaaagtgcagtgcacagttcgaaaattaaattacaagcccattacaaatagattcggatattacaaaaaacaagcccacaacacattgattcggaagttaaaagtggaggattgttcaaattaaaaatacagacgcgctaaacataaatttgaagacaccaacttaaaagtacaagcccaccaaggctattagcgatctaaggattatttttcttcttcgactttccctttggaacgcgacgaacatcagctcctgcggcgtctttccctacattgtacatggcacaatctttacgggcatggttctccccacaaagaatgcaagctttcttacgacgagaacgatctttcgctttagcttcatccataaggttcttgatcctacgcgactggcgacaacctttagtatcaactaataaatgaatccagaacccaattggcttgccctggaggaggacgagtgaaatcgcacacggctcgccaaccacgcaattcacctcgccaagttgcctcccacgcttccttcataaagtacggagaaacaaaatggtttgcatcaacacctccttttgtggaagcgacaagaacatgagaacatggctggtgtaacagataaggcttgtgcaattgcatttgcaagcatgatactctggccacaacgtgcattccaatgtgatgtcagtagtcccaatgccgacaccactcttgtcacgaagtcgtatctcaaatagcaactctctattcccagcaggccacactctatgcattcctcccttcttgcttttctcatccatgtactgtgtaattgctgggctatacttaacactgggtttgctgaggttaagactagccatagaataccttttacagagatacttctgtgtacccctagtgatgccctcaaggatagcaacaagtggtagcggtcgtgtatttttttcataacccagttatacacttcagcaagattagttgttatcacactatacctcgatccatttgtatcgtacaataacgaccatttctcccttggctcaaattcaacccactccgtgaagcacttcgtggcccttccgcgcttcctgcaccgagtaatacttggtgcttcattaggaatgggttcaagtccctccggctcctcctgtctggcaactacgggctttttcctaacctcttccatgtgtgtagtggtcaaatgatcaagttgttcccatatagcatcaaactttctttgttgattctgcttgcataacttcttgaacaggtccatcaatctcttactcctaaattgcctgtaaaaattagccccaagatgtcgcatggaccatctgctatgcaaatctggccatggcacggactctgtcacatcttcttgaagcttctgtatcgtcgataacaaaccggcatgtcggtcatgcagaacacaaacatttggtctgttttgaacaacacacattttaatgtgccacaaaaaccatagccagcttgatgtgttctcgctttcaacaaatgcaaaagcaacaggaatgacatggctatccgcgtcgactccgatcacggttagaattgttcctctatacttgcttgtcgtgaaagtgccatcaacacagagcaaaggaatgcaatttctaaaggcctctatcatgcacccaaatgaccagaaagcccgacgaagaacattctctctattttcattcacctcgtggagaatagccatgtgtgtgcctgggtttcttgcctgcatcacctccaatagtgggggaagattgtgataagaatcctcataagttccaaacctcatctcaagtgctttctgttttgccctccaagccttgacatacgatatctcatatccgtactctttctctacgtcatgcattattgtgaaaggggacaaagatgtttttctaaccacctttgaatataccatttgtgccacaaataccgctgtcatgttcctatgtaccagatgagtattctccaacaaacacgtatgttgctcaaccctcgaagctacccataaagtgtcatgttgtggcttgtaaccatgcactctccaaggacatccagcctgtgtgcacttcacgtcgtacgtcgtcctatttgaaaccttcaccctgaactcacgcttctggtcaaatgcccacctcttcaccgcatcttgtaagtgacctttgtcatgaaacatctgcccaacttgcacctgcttactatcataacgccagtgggcatctaaaccatcgttaaccttcatacgactcatcgatatggtcgtccaatcatcgggtatgttggtttcgttgtcccacagtgttgtatcttctccttccactacaagcgcaatgtattcttcgttttccacttccatccgatccactaccgcctcattctcctttgctgcatcaacacgcataggcgaatctggttcttcatcgtccgagtcgtcggcctcacgattattgtcacgaacaatgacctctgcttgtgtattaccctctactacttcttcccccgaccttgctcagtccgccaaacattttcagcttgtgcaccttccaatggagtttcttccaccacggcatgacttgactcccccgatcgatcaacacatgttgtcttctgcaccactattgccaggctataccctttctcccttactttactaacaaacttcctccaactcccagttgacgcaacctccactactctccgctgccatccatgttgaccccttactggccacacggcatttatgacaaatttatcgagcactggatctaccccaaacatattatacaaccaccctaacacatcgttcaaacccatatgctccggtgcattcagactagtattatagaaggcatatacagtcaaatccactccgctatcacatatttgtataggagcatctccataatacagacgaatgggcatatcacctgacatcctgataaaacattataaattgtcttattatacggtactgaccgacacatatcttacccttacgtttaataatcatcatacccagttgtactaacctctacctatttaaacacatcaaacattaaatatatgtactaccatgtactaacttaactaatttcagcatacgactaatttaatatctctactcacatttcacaatgacaactgttaacgtatcatatgatatgtagtcacattggagaatgataaacaattaacaaatcacaagtcttcttctataagattaaaaaatcgtaatcctcatacttagggattacaaatttatacctcaatgtcgtcgcttcaagccgttgccttcactgccctccaggccggcgccgccctggccttgtctctggccgcccacaccctcccctcactccctccagcgcgcacggcgacagcactggcgactgcaatggtgacgatggcgatgtggtcctcctcaatcggtttagagaaagctaggttcgggctgccgatataaagggacctgtcgaatgcccattgttcgacaggggcggcggcgggaccagtcgaactccccgtattcgacaggccgcgcggcaccgggtggtgggcccagtcgaacaaccccggttcgataggccgtcctgtcaaatggctacagttcgatagggcccaatcgaaggctggatgttcgataagccccttgtcgttcctcccccattcgataggagcctatttttgcgatttccaacagatggccgctaattttgcgattttccataaaaataatattaattctcaaaaaaattccttcaaggcatggcaacatgtgttgaattgtgtcttctcggtacaattgtgcacatctggccagagtaaaactatttaaatagttgtgccctcggttatgggcgatcaaccagattcaccgtgattaatcacattctattaattaacttgacttaatgaattggtttagatcaggtagaatggttgggcctgttcaacatggtgtagcgttgttcagtggagatttaatagtgccttaattaatcaaccgttttactattttaaactataaaatgtttgcaatcgcctttatgcaactagccacaaacccctctttgttcccccttgcatgtctgcatcattggtgtggcttgctgaatatttgtactcaaccttgctattattcaccctttttcaaaagtgtagtgtttctgagttgaagacgaagttagaggaccaaggcttataccccagttgagttttgcctatggagtggagctaaagccccattaggatcgcctttgtccgttgttgctgttttttttctgtgtgaggactaagtgcctcttatgtaagtatttacagtttatttatatttggatctgtatatttacttgttgttttgtgtaccctagctgattcctggacagggacttaatacacaaaatagtctgaaaatttgggctaaatttctagatgtgacagttttaggctttgcagagtttgtacagatatccacatgatatgaacactctaatttgttttgtgctcgccaggcactgccatactcttcatggtgaatgtggtctagaggttataacaaggcttttacattgactaccgtctgaccttgcatgagcacgatgaattttcaatccctactaagtccagaacattagtgttgttaggacggttggcctatcgaacctgacaccgtggcgaagcaactcttcccatgaggcattcagcattgtattggacaaacttagacacccacgctgtgaggcggaacagtacactcatcccctcacagaaaacacacacttaggactagttcactcatcctaaaattcaacacacacatgggtagctcctctagatagcctacagttcactcgtggccactacctatactgcatcggtctccttaatgcaatgttagacaagtactcaacttaataggccaaggttaccccataaataacatatgtggatgtacggtatatgtgatatcccggcccaattagaatgaggcctgtgtggcccatgagagctgtgtttaaacaataacacgctttagtttcaaattatatgcatgtatcattactaactacgcgattatttgtttctccctcttatgcaaacagacgatgagtacggttcggcatcgacgtatcatggaatgcctacttactcccctcgcacagcattcgttgaggacttcttttccactgagcctcctcaaggggaactagggatggattactggcacgcagcacctcaggtgacacagccgacgcaggagatgggggccattcaggctcccaatgtgacaccacagcaggcagcaagagagaggcacccccctgataatttgacttatcccactgagcaggttaggcgtaggaagaaggggggacctagcaagcgtgcgaagggcactgatcgtccttgagttatctatttctgttaaaaattgagacatttatgttgtgtccgtactatttgtgaacaatttattattaacttagtaactatcagtactatttttgtcttttttttcataccctttccaatgacggagtacaaaagattcgcttcgaactttgcagcgcactatactacaataatgaaaatataaattcattcatccaaatattttaaccaaaaaataaatactaaaatttcccacaaaatattattaaaaaatattaattgtagaaaagttccagaaaaaaattcacaaaattcacaaataaaaattcagcctgaggacaagtcgaagaacagttgttcgacagggatcctatcgaaccaacgctattcgactgctacctgtcgaactgcccctgttcgacaaggcgccagtcgaactacccctcttctatcgcggtccacccgttcgataaggcgcctatcgaactgcacctattcgacaggaccccatttttgcgattttccacaggtggccactagttttgcgattttccataaaaataatattaattctcaaaaaaattctgccttgaagtaccacgatgatactgcaaagggggaaatggtaactccccctaaccaatcgcactacacacctcaggtttcaccccctccttaagccaagtcgggtaggcccctctcgtgcctaggtgaatccagaagcagcataggccgtctgtcgacctccaattttggaaatcggaaatcttctgtatttatcagtaccaatccctggatcagtagttggtacacacatacatagccaaatcacaacatatcatgaatgaattcaggctaagagagttaaatgcttacattagggcaaggcaggccaacaactatcagagaacaacagcggaagacaaaataatacaagggcccggttgacatgccacaagcaatcgactggggaacgagacctagaatggaaccgcactccgatcatcttgttaggtacgcaagcatactaacaagggcttctcttcaacactctgctaaaagatatatatagagcaacaatgagtacaaaagtactcaacaagccaccacacaaaatgcaataatgtacaggataatacaaggagtggctatggtttctttgcgtaaagctgagttttcaaatattgtttcacaaacctaagacctagcataaactgatcaagttttaattccattattcattaaacagcgatggttctgtccaccatctattgtgttcccaaggatagcttctcgccactggtcatcatggttttctggggtctaccacttctcgcctctcgagaagttgatccaccagcacaaaatcatcatgcatatcccatccatcattttaagaatttagagtctagccaagtgtaatacatatcccggtgctcaatatccgcgagcatggctattcgaatagattgatttactcacactgcagtggatgtacactttacccgtactcgtactccgcgacttgcccatcacataagcctatgtcccaacgaatgagacttgctacggcaaagcctttcaacaacctcactttggcagtacccgctccatgaactttagtcctcatgcactccaggcgtccaaggtttctagcagtgagaggagttctggcgctcgcgagggggaaagactcacacattcattaagttatagttaagtttaggtttgcacatgacagtcctaccgatggcgacaccattgtaggcacccgccccttgcggtcctaccaatggctgccccaccgtaggccctgcctcacacacaacaagaaaaccactatggcttgggtaccgcctccgctcggctatttactccgctaggtctatacccacacgagaagtacggttgtacaggggttgtttcatgcttaacttcatggctcggtccttaactaaccagggacggcactagccttttccggacaccacccaagtcctctagccgccccagtcgaaaacagttgtttagtttcatttttttcatttaacaaatcatgtcaccaatgttcatggcaatgtggcgctcatatctccacatgccgaatctcaactaccttccctaaggtagttgcccaagcatatagcatttaataaatatgagaatgcatgattctaaaatagcattactaagcttttgtcataattgactaaggactcatacgtaatcatgggtacaaggaaataatgagggaaataataatcaaaggcatggcataataacaagtaggatattcatcttgcatgcaattttatttataaacaaaacaatttcgcaattcggatcaacatgctaaagggatggggtgatgacttgcctgctcaggatagttcttattcttgatataatcttgatcaacgttcacctcctagaagctgcatatgttacctcacaactaattgatacaccaatactataatacgcgagagaaaccaatattcaaacaacaatcaaatatgcacaaacaaaatataattgttgaagacatacctaaggctgttggtactactcgcgtttgctaatggataatctcttaatcattcttattgtcatggcggcttatttaggagctaaccagtataatatgaatgaggtacatactactaatatgtggtttattctagctacagggttatgggagggttatagtcaaacaaataattacagtgtttcatttgtattattattttatcaatggagtcattattttaatcatgatcaggttttacttgtcactataaataaaaaaaggtaataattatccatgctatatatgttagatttgtgaggttaataatattatagttacagattatcttattgtataactttataactttataatgaacaatcctcagttgtggttaaactaaaattatgtgtggtcaagatttataactagcactagtatttagctaatatactggttcttcatttattacctagtttaatatatgcaacttgtagattatctaaaagggtatgtgtgtgcaacagtatattaacattgaaccatttactgaatataggcaatcgactataagctatatcatattggtgatctaatcacactagctctgttattatttctcaaaagcaagtcaacgattcatctatgagtattcatattttagttacaggatatgaggccaaatttgatttagataacctataagtcatgggtttaattatatggccatcgaatattaaataatactagaattttcctatacatccattcatttgagacattacttatatttaatttacatggttgctactgtgacaaaacatgctagaaacaaatattattacatctactctactgtataataccaattttatttattagcatattttcaagttgaccataatctaatcatttgatattaattatgtaataattataaatatattttattaaacagtgagttatataccattggaaagcttatgaatttagatgaatttaggttcaagtttcacttgaatcggagctaaaatgaataagttatgctagtttaaatattcaaatttgaataattgcgaaacagtactgttcatatccgatttattttaatccgaaacctatctacagctcagagtcacagacgtgtggggtcaggggtcttattatcttttctactgaattatttttgctaggggaaatatgggagtgggcccgacctgtcagcgacttggccaggagtcgtcttctaccttcgtcttattcttcctcccgaccgagcgggagcagcatgggaacacggcgcgcacgggaaggccggccgagggtgacccgacggcagccaggagaggcgcggaggagctccagcgatctcccgccggtgaccacgacgcgtggcgatgcggaggcgagcggcggctagggcaaaagggagagtttccgatcgaattggtgggcgtgggagtatctacggggtatggggatttcttttttctcgctagatggagaggggagctcccgggatagtctacccacgaggggcttgccggcggcggaacggcggtcgggccggcacggccataggcattaatagtacaaactggagccgacgctagctattagaggtacagagaatgctatggtctcgagggtttacccagggatggagagacagtgaagggcggcgacgcgtggtgcagtgcagacaaagcagaggtggctagcggtcggcgacacacgaaagtgttcgacgcgtgtttcccggcgtccagcggtcctcggcttccccaatggcaacggcggcagcacgacacccccgcccccccgccccccactccctccaacctccagctctggacggggagtcccgcaatatggtctttggtagcggtgagattacgcacacaaggtgttcgacgcaatgtattcgggaagaaagctgagaggaatggggatttttgttgggggcttagcttaggttgtaaggaaacggtgtggataagatcgccagcacattcccaggcgaaatagagctctaatggctatcggataagggcaaggaggtggatgacacggataaggtttgatctcctcctccattaaggttctatggctccatcatcatacctaaagcctaaagtctgtgcgttctagctctagctgtggtaggaggctccgttttacccagcggacataaggaggggcgccaaaacatcatgagatgtggataaggttttctcttctctctcacactcagggatttggggaatcaaatggccggtattaggtttgcaggcctcggagctaggggtgacgaagggcgaggtggcggccgttatccctcggcgtcgagaggcgacgcgcgatggcgacatcgatgacgccggcgctcgtggcggcatgggcggagcggcttccgcggctgaggtccatgtgcgagcgcggcatggcgcacggtctcgcggtggagtggcgcacggttaagtaaagacggacgcgtggtgggggctgggtcgctgggtgttcgactcactaggttcgagtcgaacacctggcgcgcaatgaataatgccatgctggaataaaaagagatttttagggttttggtttatttaaaaatcgagaaagatagctaattcaatttgtattttcaccagtgcatttgatcaacaatattaagtattcaaatgtgaatttggtccaaaattaatattgtccaatattttaaattttactatagcttttatgatttcctatataccttgtaggctctgatatttataaaaattaattaaaatattctaatgtgactactattaatacaatagctcattggttgaacttatttgtctagcaatgtattttacatggaaaagtttaatctattttattctagaggtaatttgagacttggtataatattgatctaagtatttaattagatactcccatccttcaatctttatatatagggataaatttattttatgtgaacaattattttatatgagtgaattttatgccatgagagatttgttgtaagttatagatattaatttaattatttcagtgaaacactcctatatatatagagtcattgtagtgacgactatttcgtggttacttagatgtcaggacactattcaatccgtaacttatagaaattaataagtgacttgtactttatttggctttgctatcatgtgcacaaatatttatgggatcgatagatagcgtattcttgcaaattgtacatctttaatttaatgtttcattgtgacaatttatagtttggcaagcaatagcaaccataacatccagcatgatgcaaaagttttaaaaagttcgaaattttagtgatttttattgtcgggaattttcagggtgttacaccgtcgcaaggcccatccatactccattacgtccacccttgcccgggtacgttagctaggaaaatctacgctacaaagtgcagctgttgcccacgctggcttgtgtaagcgcggtaattctattcttccagggtttcccccgaaccggtccttaattgccatgggtgcgactagcaaaaccatacacccagagctcgttgttaagccatattttagttagataattacgaccaataaaacatgaccatatgtctcgagctcatagctcatcaagatgctaatgcatatagtgtgattatcccataatgtgagctagtggtaattaaaaatggctaagcatataaagattctagcaagatcaacataagtgacacaagctagtcaaattatcacccaagcttgacaaaggagggatcacaagtaaacatggaacacgcgaggaaataggtagtcccataatcccatgtactcctaattagcaaaacgtgcaattttagttgcaaagagtaaaacatttgtaaattagcaaggagggctaccggtttgaggaagaactggggagtgaagctcattagctgcaaacttgagggggatcaatcaataaaacatcacgcaccaacagaaaagagaaggtgagaatttcccccatactaccaccacaaccacatcctctagtaaattaaacttaaaacaatccatcaccactgtgtagtttttccctagcaccttagttcagcttttaatagaaaagaaggagcggtagcaggctagcagcagataaaatggaggaggaaagaataggagcacttacctaggggatgattgctcggtgaagtcgagctccatggggcgctggtcatggcgtctgggtctagagctccatgcgtgaccctattctagccatgggggggtccacttcttggagctgtgggttggagagcatagagagaaggattaagaggggaggtcttgctggtagcctgggcattgaggtcgccgagagcaacatggtggtagcagcagcagtactagagtagtagagtgaggatttgagggaaaagatatccactgctaatggcaaatggaggaaggaagaaggggattagctagctgatgcttttacctgcaggagtgataagaggggagagacggggagaggtttctgcaggtgagagaatagagaagaaaggaaaatgtggactgattgctagatgtacattagtaggctacacagaacaccaacctgagcatagtgacccaattctgtagtccaagtatagtttgataaattatctagcacatcacaactggagtttcggtacaataaaaaggttacaaatttgtaagcacatttgtatttgtaaattattgtatttctattagtatagtttaattaaatctcgacgcatttgacggaatacaacaagggaactagaggcggagtctggtcagttgggagcgccagctatttttgatttgaactacgagaattcaggcaagcgaacctttgatcttgatgatttgaattattttgcataaaccttattttgcttcatgaaactgtcaccttgcataaaatagatttaccaaactataagtcggatatataaggatgatgatagatactgggaggggcagttgatggagaaactgatcaccttcggaccttccaacacttattagggtgtccacagatggggattgactggaaacgggaccctttacatatggctataatataaggactaaaatcactctcacatgcatatgtgtgctgtataaaaatcatgtcaaccatatccttgttgcaaggcgagcaacgctttgtatcttatcaagttcttacactccgcatggtgtgtaatgatagatagtgctaagatgggagaccctataaaccccatagaacattagtacttggatgggagatgatataaaccccatcaagatagtagcacgtggtggagtggagtgtaatgtgctgaaataagagaagagcatctagctatctattagtccattaaattttctataaacgcttctaaaccgccacgtggcgctcctacaaatgttcttatatcgccacgtggcaggtggacccaatattttataaatcattaaattatactaattttcaccactacatcttatctccaagaatgaaaatctgtacacgctccactttccgttcgcatatttatcacgtaatatatttgaaaagaaaaacagaacgtgcacatatatgtacatactctccctccctccctgtctgaccctcttcccttccgtctcttctctctcctaatttctacctctaacaaccatacattataaaaattaattatatattaaacttcctacaaacgcttttaaaccgccacgtagcgctcctacaaacgctcctatatcgccacgtggtaggtggacctaatattttataaaccattaaattatactaattttcaccattacatcttatctccaagaaagaaaatatgtacacgctccactttccgttcgcatattcatcacgtaatatatttgaaaagaaaaatagaacgtgcacatatatgtacgtactctccctccctccctctctgacctccacccttccgtctcttctctctcctattttctacctctaacaaccatacatagtataaaaattaattagttagctaaataatctattagtacatatgtttttatataaaaattataatatatatacccttaattttcggtgacaaacccagaaaaaaatattgggacatcacttggatatataccctttcttttcaatgtcaaaccaagaaaaatattattatgacactgcacatataaattatttaattattaattgatattattaattaatatggcatgaattagttaaaatcgaataatctaccttgaaggtgaatgtagttacgccactatatattttgtatagcaaccaaatagcaataagatattatagaaatgaacatatattttgacatctggaaccattcgacaaacatgaaccatgaataaattttcatataaaagaataatttatctagcggccacaaagaaacattaaagagtaaattgcatcgtcggtacacgaacttgtcaggtgggtgcaatatagtgcacaaacttgtaaaatgttcgttttggtgcatgaacttgcgtggtgcgtgcgggagaagtcaaaaaggacactatatgactaatcctattgatttaggggctgattaggatgctatgtaaacatatatatatatatatatatatatatgagaaggttgccactagacttacacctattcaataaaatatagaataggatttagtgatagtagaaaaagatttaaaatatcgagcactgatataagggttagaaacatataaaattcatcatttcaatgatgaaggataaagtagagactaaatttataaatattgcatgtcctatgcatacttgctacaggtatacacgtcgcatcctaatcaacgtcaacttcataaaattgacattgccaagttattttggtcctcattcgcacgaaccagacaagttcgtgtactgaaacgagcattttataagtttatatactaaattgcacccacctaacaagtttgtgtaccaccaatgcaatttactcaacattaaaataaatgaacatgtattatgtaatcttaaatcagtgattccacaaaatttcatagcgaaattagatcgacggtattaggataagaatttataaactcactggctaaaggagtaatttatctagggaccacactattacactttgcatataatccaaattaccgtacaaaattgtaaaacaatttaacaatatatgttgcttcatcatacattaattactttgtaagcacgcatagaaaaattggatatataatatgtaggtgaaaaagaactaacttaactttgactaacataacaattatgaaaaaaatattttacctttagtcagatgcaacaatatccaaataattatgtcttttgaaatatgcacaattgataagacaaattaaatcagttgatcctttacataagcgctctaaaatataatatatggtgccatttaatggacttacaggtccttttaacaaccagatgaatattgctttggcttccataccttctatatataaagataattttgtctattttatatgcgtaggctattgaaaatgtgaatactcctataataagtagtagtagagaagaagaagttatgtttgttattcgtacacatgcataaccaactttaaaatccatttagattttataacatacttattataaacacgctatactgacaactcagacaaaattgcagccatggaacacatataatgattaacttatttcgattttctatgtaccaagaaaaatcaaggtatatcaaatgttagcaaactatgatacgcatatatttatatgtattgtttcacatagggaatatcaataatctatgtaccatgataattttaagccactttgtcagttctacatattggcaataagaaaaaggtggtgtacgagatcgaaagtggataggtagaaagcaaaaggtttagacaagttcagaccctcttgacaaagaggtaatacccctactcctgtttcggcgattgaattcgtcgagtgttgtattgatctaacgatcttggctgtggttatgccttcaaaacaccccgtgtccttgtataggttggtgcaaggttagaagggtagaaacctaaccgaatccggcatcggtttccttatatattacataaccgtatatgagtaagacttatgagacttgccgtaggaaacaaggcaataataaatccccagtcctaattattacataattcctagactcgacccacctcctatcttcaatcgaatatccaagcgagtgggtatgtggtatccataatatccacacacttatccattatttttcattacactattacataaatgtttttttacatatgcggctaaaatgttaagccgcttgtattgatgccttagctgcctcaacctcagtggccacttttgcaaataacatttgtagtttacacgggtggagaaacctttattagttccggatggtaacccccttagtcccggttctcaaaccggaactaccaatccgggactaaagatcgctatcattagtcctgggtggaataaccgggactaaagatcgatctttagttaccggtaccaaccgagactaaagatcgatctacctttttttttatttgcatggccctgttgctgcatggtttatatatatatatatatgtgtgtgtgtgtgtgtgtgtgtgtgtacacatatgtatatatatatatacatgtatatatatacatgtatatataaatgtatgtatatatatatatatattacatatatacatgaataatatatatatgtatttatacatatttatatgtatgcaaatgcatatggatatgtgtacaaaatagacatatatgtatatattaaagcacttaacattttatgtgcatatatgaccaaaatatatatttacagtaaagtaaatgtgtacatatataaatatagacatgtattacaattcattatgtcctagctacgacttcgacgtagtcgttatctcagaagataacgtcttatgaattgtagatttgtcgtagtagaattcaccctcgggattaaggacttgttctttgatgaatcccatgagttgttcttgaaccgccgtgataaagtccttgtgtgtgaggttgtccctcatgtgaataacctatgaatgtatgaagttatattaattagtaaacaagaaatcgatacgtatgcaatgaaattttgaatggtttatttatacgtacatcgagctctcttgtggtgatgatttgagttgcaaagcagtggcaatactcacatacgtagtagccacacaagttagttccctcttcctgctttgcacactatatacatgacaaacgacgagagatttaatatacacttatatttgaattagagattcaatataaatttagatcatgtactcactggaaatttgaacctctggctaagtttttctttccaagtgccgcggaccaaatgacagaaccgataccaagccctacatggagtttaaagctacgatttgtactagcaatagcaaaattcataataataacactggaacatatgacattacctatctataagttcaaaaacctggtcaaaagtagactcatctttattcattgagtcatagacattaactctgcatgcctccaagtcgaagagtaaaaggacccagtggaatatgcaatttgtgttagatgatatatgaaacactgtacatgtatatgtacgggaatgaaatttgttcggtagacaataaaaactaacgctgtgttgtacggcagtagtatgaacgtcttgaaatgctgctccttgaggagatggacgagattttcctcagtggcctgtggatacttggtgaccatttcgacgtttacattccgagggtcgatgaatccagtatcgaaaaccccccgccgtcgggcccattgaatctccattttacaacaataaaggaattgttatttatggtgtacatatatacaaggagctaattaaaggaacgtaagaaatataactctcaacgatacgtacaaaatccatgcgctcagaagagagacgtcgacgacgtctagctggtatagttcgtagatatccttaaaattgatccagagaacatcttctccttgtaagaagtcggcgttcttgatcctcgctccgataatctccctaccgctggtgctcatctctatgtaccgttcatggaattggtacgtctgtgtcggtagggactgtagctgctcaggtgatgaggacacaactaagcttggatataaccatgactaccttatgtattaatcaaccaaaggtgcatatgctctacattagatttacttgttatatatttgaacaaacgttgcaacacaatgagtttcgtgtgtttttgtttgcagaggtacttgcttgggcgaaagaaaagagaccgagcgtaaggaatgcatggatgattgaagaagttgattggggaccaaaccaagaccttctccaagtccacttccatctcaccacatcacttttggtccatagaagataagagataaagttctacacgttttggattcggattcgggcctcctagcagcatcaacttcaaatggatctaggcgctgatctagaaggaatttcggggtccatgagtacttgttgaaaagcttatggagtctactttcagatggttttggtcctgcatcaaaattcctactgagctgccgggaatctgcaaaacaagccatgtatctcatccagtccgaatctgatttgggttttgggccttgtaattgtgtcgtgggcttagcccaagggggtgtgcgccctagtgcaaccctaggacgtccctaatcacatttattcagtagccgtcatcgtttagagttgggttttacttagattattctgttaagaacagtttcgtcgctagatcggtttgtggaaccccaaattcgagtgcttaatcattcatatgcaatttggttgcaatctatcttgttctttcttgtgttcttcgattcgcatgcagggattagccttctcggcgaggtcaaccgggtttcagcacggttgataaccagaggagacgtagtgctgcgattgcggggctcagtagcgtgttcgttcagaagccggatcgagttgtgtctcgactccgtccaaatcaattgtttatcaatacctatcggaagatcaggacctaacatccctcatcagtaggtatcagagcccggttgcccgttaggtaatttaaattcccataaccagaaaattgccacacaaaaatatttattctttacctagacaatttgaactgttgcattgttctattagattttgcttcgttgaattttagattgcatcgtcgtgtcgagtgctggtttagttttagatttaattttagttttgagtaatgcatctgttcatcactttggtccagggttcatcactcaagtgtgtgagttgtacgtcagttttgggtccattttttcatctcgttggttgttgccgggacattgaaaaattgaatcgtctcgtcatcgggtttccatttttgtgatttggagaaattttttatgagttgccgtactgtgcacgtgaggagagtactgcgcgcgtgaggagagactccggatcaaatccgatctatccgtgaccgtccatattttcctctttatagaagtgttaagtaacggatttgagatattttttataaaaacagaacatacatgacatgagcaatccatttttgagatgatccaattttagttttgcactttatgtttgagtccttgtaatatttatatttacatttgagtccctgttcgaggtcagtggtcagtttctgttgaaaacaaaaacacacgaaactcattgtgtagcaacgtttgttcaaatatataacaagtaaatctaatgtagaacatatgcacctttggttgattaatacataaggtagtcacggttatatccgagctagttgtgccctcatcatcaggcttgacaagcggtttaccgagttcgtactggtgtctcacttctgccttagggattggtgcgctttaagcaactgagccctagttagcccggtgtcagaaatgaatttttttattccaaattcttgcccggtcactaacaactcgacctcctggtttggttgctctccaagctgagggacttttttggactttccagaatgtgctttcctaagtgttcgctcatagtccgttagctttaaggcctccttgagtggtcccgacatcttctggaagaacttcttggcactcgggtctataggaatcttcttttttggactctgaggcttcaattgcctcttcacttattctgccacgtaagcgtcgagctcctcttgcgtgcaatcgtacggtggctccttgttcttggcagcgtcaactttcgccttcttcgttgcccttgtgcgggcaagcggtggagcttggtgagttcttgacttggaaggtgccggaggacatggcagaggagcctgaggagaagtcgatgcaggagcctgaggaggagacggtgcaggagcctgatcagtaggagacggtgcaggagcctgaggaggagatggtggagccggaggggatggtgcacgagacaccgcttgtcgcccagggaggatgatgtagcgcttgcgccatagtataatggcgtggcttgtgtcgcgtagatacgtcttaccgtctcctccagggtagtccaactcgagttcctcgtacgcggcttccaccagttcaacttcgaccctcgagtatcctgctggaatcagcctgcagtggtaagtccctgaagggtccgttgggatggtcattcccgacgtaaccttcacgtgatgagaggttatctattagtaatcaacctaagcagaaacttgcggaatgtacaagtccaaaaaaacataaaactacgggcataccttgattgataagttcttgaagggaatatgcagctcacatggtgtccgctgcgtgatctcatcaatggggcaagtggtttcgtcctgagtttgcacggcgtccatgctctgtgatcctacctgccccgttgaggcgcagctgctacgattgcctgaggggctgaccattacaggaggaatgtatggctgggcatcatggcaccgatgtgcggccatgcgttcatccaccttccttgccacctcctcttgcatgctgagctcgtagctcgataccctgtactcaagatctgcaatcttcgcctcggtatctctcttgctcctcatccgactcttgtacgtgtggatgtcctccttgaatccaatcttccaaggaaccacgcctttccctcgtgttcgtccaggatgctcgggagtctgcagggcgagtgacagctcgtccttatctctgttgggtcagaacgtgccctgacaagaggcttccactacatccgttagtcgactggcagcctcgcgtatctgatcgctgaacaccagggagccgtcaacagggttaagcgttccaccgtgagcatagtaccagaacttcgatcgatccagccatttagcggtggccggttcgacacccctctcaatcaagccggcctccatctcctcccacttcagcattgtgacgctatagccatctgaccccaagaggtgatggtacttcttggcggcattttctttgtttctgtccatcatcgcttgcccttgttgccctgtcttgtaagcgacgaactcgtcccaatgatcccttagcttcgggaatacgtcgaagttcggtgtcagccccttcaggatgtatttcttgtagagatctcccttgaagctctggaattgttctaccattttcttaagagtccactgtttcactatgttctccgtacccgcagggagcgtgaacgtctcgagcattgtgatccacatcgtatctttctctgattccgggacaaagctgtcataatccccgcgtgcccttgttctgcgccagtacaccttgctgacaggcacgttatccttcacaacccaaccgctgtgtcgtacaaaattcttggctgcttcagccggggcactaggtcgatcgtcttcgtccacctcagttatgatgtgccgaccctctatcttcttcgcggcacctcgttgtccgcgtgccctcttctgtccagcggaggattgacttccactagcctccgcctccttgttcccctcctcagtcccctctgcatcactctccacgttcccctcctcgttcaggtactggtttggatcctcgttcccctcttcttcgttccagtactggctgcttccctctgcgattgtatcgtatagtatatgtttgtcatcgcgatcagccatctgttcatacaagaaatatttgcagccgtttgttatttacgtatataatatttgattagaactctaataatcatatattaaaactctaataatcatatatgctaagtctaataatcatatatgctaactctaataatcatatattaaaactataataatcatatatgctaactctgataatcatatattaatactctaataatcatatatgctaactctgataatcttatattaaaacgataaatattaatacatgctaagtctaataatcatatatgctaagtctaatattcatatatgctaactctaataatcatatatgctaagtcgaataatcatatatgctaagtcgaataattaatcatatattaaaactctaataatcttatgtgaaaactctaataatcatatatgctaagtcgaataatcatatatgctaagtctaataattaatcatatattaaaactctaataatcttatatgaaaactataataatcatatatgctgagtgtaataaccgtatatgctaagtctaagtttctaatattaaaactctaataatcatatatgctaagtctaaataatcatatattaatactctaataatcatatatgctaactctaataatcatatattaatactctaataatcatatattaatactctaataatcatatattaaaattcgtaataatcatatattaatactctaataatcatatattaaaactctaataatcatatatgctaagtctaagtttcatatattaaaactctaatagtcatatatgctaagtctaaataatcatatattaaaactctaatactcttgtattaaaattctaataatcatatattaatactctaatactcatatataattacatcacttgcctgcgcaaattcctactagggctagctaccactttggcttaagggacgacgacgacgtctttcctacaacatggaaaaaaatgtgttagtctaaacacaaaggaacatattttgattagtgcgctgcatgattaaactaggacggaggggagtagaagtttaggttcatggattaatttgtgagacatgtaactttgcgttcattcgcgttttattcccgttcgttcgcggttcgttcacattcgttcgcgttcattcacgtttcgttcttgttcattcgcggtccgttcacattcgttcgtgtttcgttcccgttcgttcgtgtttcattcccgttcattcaaggttcgtttacattcgtttgcatttcattcccgttcgtacacgtttcgttcccgttcgttccagttcgttcacgtgtcgttcgcgttcggcagtggcggccacggcgtcggcaaaggcggcggtggcaaaggtggtggcgttgcacggcactggtggcgtggcacagcggcgtcgtcggcgttggcatcggcagtggctttggcacggcggcggtggcatggtgcggcggcggcggcggcgtcggcgtaggcgttggcatcagcggtggcgtggcgcggtggcggcggcggcggcgttggcgtcggcgtcgagagtggcggcggcgtcgggagcggcgcgaggacgacgacgacgagcgaggcggccggtttagagagagagagagagaaagattgagatcgcggagcctctcaccccaatgcggcggcggcgtcgacggcgacgacgacgacagcgagatgactgcggcgtcggagcaagggatgccctaggcgcggcggcgaaggtgatgcagctgagatcggagaaaaacatctaagtgttggtggagaagacgagtgcgccttgggcatatatataccccatgatctttagtcccggttagtgagaacaaccgggactaaagatatctttagtccctattcatgacaacaaccgggactaaagatcttatcttaacatctttagtcccggttgttcttacgaaccgggactaaagatatctttagtcggactaaagatatctttagtcccggttgttatcaccaaccgggccaaaagatcttttcccgctatttccaaattcttttttaacacggttagggttaagaaccgggactaaagataatagcattgcatattaaatttcattacatatgggtttctaaaatagtaaataatgcattaaaatgatttaaagtcacaaaattaatgacaaaaccttgaaaatatattgttgtctatagtaaattaagtggataatatataataagcacatgaatgatttaaaattgttaaaaattctaataatcatgtgtaaataccacatgtatgatttaaaattatcaaaaattctaataatcatatataactagcatatgcatgatttaaaattgttaaaaattctaataatcatatgtaaataccacatgcatgatttaaaatttttaacattctaataatcatatgtaaataccacatgaatgatttaaaattgttaaaagttctaataatcatatataataagcatatgcatgatttaaaacttttaaaaattctaattatcatatataactagcatatgcatgatttaaatttgttaaaaattctaataatcatacataattaacatataccatacaacaattgatttatatggatattcaatacatccaaaatagtttacatcgtgtacacaacaattacggcaatacattggcggtgacggttgaccacacgtagtttctcctcactattgtttcttccttgtgatcactaggtgagtaaggggtgtcttcatttgataggaggatgctagggtcaattgtcaccgtgaaagggggttgcccatcaaactgatcgtaatcctcgtcagtcttgtcctctacttcgacgatttttcttttgcctgggagaaccacgtggggctttggctcgtcaggccctttgcccttctttcctttgctagacatgtccttcatgtaaaaaacttgcgttacatcattggcaaggacaaaaggttagtccgacaaccttgttaaggtcaatcgttgtcatcccactgccatcaatcgttacgcctccaccagtcaacctaacccattggcaccggaacagagagaccttgagaggtcgatagtcaagttcccatatgtcctcgatggcaccgtaatacatgccagttgtaccatcgtgtcctatggcatctatacgaacaacactattctggttcgtgctcttcatgtcttgggctctcgtgtagaatgtatacccattgatcttatatccctagaatgtcgcgatcgagccagatggtcccctcgctaggaaggccagttgttggtcaatcgtctcgttacacatgagatgttgtcacagccacgcggggaaagtatcaatgtgataccgtgtaatccatgcatcggacttaccgatgtttctggcgcgaactagagccaagtgctcctcgacgtaaggagccaccaatgaagattgttgcagaaccatgaaatgggctttacggaataaattgttgtccaccgtcattattgatttccttccgagagtcccctttcccgtagtctcctttcatggcgtgattcaagcaccccgattgggcgaaggtcttcaataaattctacgcagaattcaatgaccttctctgttccataccccttggcgatgattgcctctagacgagcacggttacgaacatacttcttcagaacgcccatgtacctctcgaaaggaaacatgttgtgtaggtacacaggcctgagaataccaatctctttgacaaggtgacaaagcagatgcgtcattatattgaaaaatgaaggtggaaatatcaactcaaagctgacaagacattgcaccacatcattttgaagggcttctaatctatccagatcgatgaccttctgcgaaattgcgttcatgaaagcacatagctttgttattgttgcccggacattgtctggaaggataccccgaattataactagtagcagctatgtcatcaacacgtgacagtcatgagactttaggtttgtgaacttcttctccttcgtgcttattattcgctttatattcgtggagtatccagacggtaccttaatgctctctaagcattcaaacatactttccttctctgccttgctaagagtgtagctggctggactaaagtaatggcttcctttatcctttggttccgggtgaaggtcgccgcattgttccatatgcttcagatcattacgtgcttccagtgtatctttcgactttccatatacacccagaaagacaagcaggtttacgcaaaggttcttagtgaggagcatcacgtcgattgcatggcagacatccaagaattcccaataggttaagtcccaaaatatagagttctttttccacatcgccgcatgaccatcttcgctctctataggctggctgccaggcccctttccaaacactactttaagatctttcaccatagcaaacactgttttcccgctgcgatatttaggcttcgtacggtggtccgccttatgttcaaagtgcttgcttttcttccgtaccgggtggtttgtagcaaggaatcgatgatgacccatatacacaaccttcctacagtgcttaagatacgtactttcaattttatccatatagtgagtgcaagccttgtaccccttgttagattgcccggataggttgctaagtgcaggccaataattgatggttacgaacagcagcgatcgtaggttaaactcctcctgtttgtcttcgtcccacacggggacaccttctttcttccacaacagtttcagatcttcgaccagtggtcttagatacacattgatgtcgttaccaggttgcttggggccttgaataataatcagcatcattatgtacttcctcttcatgcatagccaagggtggaggttgtagatacacatcgtaacaggccaagtgctatggccgctgctcatctctccaaaaggattcatgccatccgtacttaaaccaaaccgtatgtttcgtgcgtcctttccaaagtctttaaatgttctgtcgatgttttgccactgcgaaccatcggcggggtgtctcagcatcccgtcctgttaacgttcttcagcgtgccaacgcatcattctagcattcccctttttcctgaacaaatgccttagccgtggtattatagggaaataccacatcaccttagcaggaattctcttcttcgttggctgcccgtcaacttcacctggatcatctcgtctaatcttgtatcgtagtgctttacaaacaaggcatgcttctaggttctcgtactcctcaccacgatataggatacaatcattcggacatgcgtgaatcttctgaacttccagtcctagagggcagactatcttcttagcctcgtacgttgtctcgggcaatttgtttccctccaaaaaaatgttcttgatgaatttcaataaatcgccaaatgccttgtcactaacaccatttgttgccttccattgcaagaactccaaagtggtatccaactttttgtgccccttctcgcaacctgggtacaacaacattctgtggtcctctaacatacactccaatttatgggcctccttttcactttcacagtcctccttggcgtcctgcaacatctgaccaagatcatccgcagcgtcgttatcgtcagcatccctgtccaccttgcccgtttgatttccttcaaattcagcgtactaagcccagtccggaatgttctcgtcttccacttcatcttcttccatttcaaccccttgctcaccatgggatgtccaacaattatagcttagcatgaaccccgactcaaacaagtggatctgaatagtcctgaatctagaatactccttctggttcttacacttattgcatggacaacaaataaaacccttatgcttgttagcttcggccactctcaaaaaataatgcacgccatcaataaactctttggaccgccggtcagcgtacatccattgccgatccatctacataaaatgaaaaaaaaaatcgtacataaataaattttcgtacaataatgacagtcatacaataatgataaaataattaaaaactctttcaacagttataaaataatgacatatcattattcatacaataattataaaataatccaacaaacaattcttatttattatttttgaagttttaaactaatattaatgttgtacttctttgaattttcaatttagtttgttttctattttttaagattaattttcattatattttaaactatgagttaaaaactctttcaacagttatacaataatgacatatcattattcatacaataatataaaataatccaacaaacaattcttatttattatttttgaagttttaaactaatattaatgttgtacttcttttaatttttaatttagtttgttttctattttttaagattaattttcattatattttaaactatgagaataaaactttcttaagtaaacaaacaaaattcctatatattcttcttccccacacaaattttctctctcatcaacttacaacaaagttttggagacaaaaaaaatatgtgaaacattgctcccaaagtaatataacaacaaaaaaaacattggaggatgaagttactaaccttctatacacctccaatttatatataatcaccaaaaaaatttcacaagaaattttggcatgacctcccctcttttttgaagaaattttgaagcttgctcgggctgaaggaggaagaagacatatataaaggggatctttagttccagttggtgttaccaaccgtctgaccgatcaaagatggtttctccactggtgttactcctggaacttattaatccacaagctaacatttaatgaattaactctcttagctacagaaaaagttcatttgacgttctaattatatttttcttatcttctttattttatgtttctcttcatatatacaagtcgtattttgctttgataaatgccaagagacaaaagctaataataaatccatcgagtcaataaactcatatccttgtacgtagtagctttataggtttctctacatcttgtatatatacacgccactagctcaaaatagtttaaattgttcctattaaatctacatgttaagacccaagtggactatatgtttttctctaaaatatcgtacaggtcctacgtatcatgaagaaacaatgtccaagatatgtatatttcttccgtctttactcattgacatgaatgcatacaacaaattgcatgcttatgaaccaattaaagtgatgactcgaatgttacaagtaaaatacattttgttagtaaaagtttctttgaggtttcttaagaaaaaggagacaatgagacaatggacgacattcaattaaaaaaagagaacatcttgcttttaatttaaacttaatttgttagacctgtttttctgcacaaattatacatgtgcccgcgcgaatgcacgggctaccttcctagttgtactctaaatattacaaatacgcgaccggtaatatatagattgaatatgggtacagtgatacaagcctgcgcagtgctcaattaaaccttgattcacgcctgtctcttggattagaggctacgggtgcctattgcggttctttctaactatacaagtgattagtagtttttcttataaattaaatatggactcttcttacaagatattttttaaaataataaattataatcgagaaatgatgacttgatatgatttatgaaatcgcatgccatacatccttgctaataatactgcttgctgagtacttgtactcacccttgctattaactatcctccaaacacttttgggcaagccacttttgggcaagccagtgagttaaatggtgggttggagggtcagtactatgccccttggtgtgatgaaaatcaaggggatgttgtttatgactatcacgtgtattatggaggatgggatgagttgatgtacgcaggggagtggtctagtagctatgtcagtgaacctgggatatcgaagcaggaactcccccgtctaaaaaaaagacaaaccataaattttcgtgtccaatatttgactcttcgtcttatattaaacttttttataattagtattttcattgatgttagatgataaacatgattaatactttatgcgtgacttgtctttttaattttttttatatttttttcaaataagacggacggtcaaacgttggacacagaaacccagggtttgtcttgttttgggaccgaaggagtaatgactaaagtactgctagctcctgcttagaacttgtattattaatgggtgaacttgtaaggccatgtttcagactttaaccctgcatggcatggtattgtaatgttatctgaaccttcgctatctctgatgtggatcattattcgcaaaagcgctactgtggcgaaacataattgatggactagtgacgtcattttggtaatgacggcgcgggtcgtcacaatattcttactctataggaccgaaatcttttgaaaaatattatttctgtaaaaatgtatttaaagccactcataagtcatcacggaagagagagcgggtggataaataaggaacgagagggagagagaggggagtatgataagtgggctctattttatttattttattttattagaaaaaatgctcgtgcattgcaacgggaaaggctattttaatcttatttttgttatatggtttagttaagatgaaattcactgtgttaaattcgtttggatatatatattgttagaaaatcatgatctgcaactaggagtctgatcttctcaaattagcatgcgaatttttttaaagagatttcttatacgatttcttctgtatttccaaaagcgaatgaacttaaaaaccaactcaaatatggatttgtatttccaaaaacgaacgaatttaaaaaccgacccatacacaaatggcgtaccaaagtaccgataaaaacatcttcaatttataatagtagagaagagatataagtagtagatagatagagaataacaaattaaaaccgactcaaacacggatgacgaaccgtaggagcatcttcaatttttataatagtagagatttgataaatgggatgccacgtgtacaccacgtcaacagatactatagtcaatattgctctggaattcaaattataccgtttttaatagtttaagatcatgatatcgggtattacgtactctctctgtcccaaaatataacaacttttagccatcaggatttatcccaaaatataacaatttctccagcaacattctctttccaaccaatcataacccaataagagcaaaatggaaaacttgtcgtgaaaaattttctccaaaaatttgaaatttttgagtatgttacaagcatttagctgttctcttcccaaccaaatacaaccctccaccattcacttttcccatatacctccactactcatcgaatcacaaccctccaccattcacttataccctattttcttaataaccgtatcccacttaaaaactttttatattctgcgacggagggagtattatagttgacaaaggtatattcagggagtcaaagtggacttatcactgcggctttgataaatccgaagtggactggaaaccgacaccgtgtgatccgtgggcgggcctggacttgttctccttgtcggattccagcccatataccacatcacaggcgcaggggcacagagcagggcgacccgtcgtataaaaccctaacgccgcctccaccagctctctcaccccagaattcccaaatccgcaacgcacgcacgacagccagagagagagagagagtcagaccgccgacacccgacgacatggccgtcgcctccgcgtgggccaaacccggctcgtgggccctcgccgccgaggagcaggacgacctgcccccgccgccgccgcccgttcccgccgccgacttcccctccctcgccaccgccgccaccaccaaggtccccaagaagaagaagccgcagcccgtcccgctcggcgagttcaacagcaccaagttcgtcgcccccgcctaccgcgggcccacccaagacgacctcctcagcctccccacaggcccccgcgagcgcaccgccgaggagctcgccaacgccacgcgcggcttcggggctcgctggggcggcgccggcgccggtggcccccgcggcgacgacgagccccgccgcggcggatctggcccccaggacttcggcccgtcgcgcgccgacgaggccgatgactggggcgccggcaagaagccgctcgagaggagggagcgcatgggagggtttggcgtggactcttcgatgtcgcgtgccgacgacgtcgatgactgggtctccaccaagagggcggcagcccccgcgcccatggagcggagggagcgtagcgtggcgttcggggccgactcgcattcccgcgctgatgattccgcgagctggatctccaacaagggctattctgcggcgccgccaccgccctccgacagccggaggggcggtccagtctggggtttcaacagggatggaggcccagacgccgactcttgggagaggaggagggaggaggtgagcggtggtggttcaagcggtggtgcccggccacgcctgaaccttcaaaagcggaccttgccactggctaatggcactgatggagaagggaaggaggacaaggaggaggagaagggagagatgcagcctaaaagcaggtcatcaaacccgtttggtgcagcccgccctcgcgaagtggttcttgctaccaagggagatgacgggaggaaggaggaggagaaggagaaagaggaggagaagctggagattcaaccaaggaccaggacttcaaacccgtttggggctgcccgcccacgtgaggaagtgcttgctgcgaagggtgaggactggaggaagattgatgagaagcttgaggccatgaagatgcgcgaggcaccaccacctgagaggaggtcctttgggaggagaggttcccctgttagaggagaggacaatgggagccgtccactgccagagagtcatgtcgagggagcttggaagaagcctgatgcagttcaggctgttggagaatccgaagatgggtctgataagcttaacacggctgaggctgcgagaaaatttgaagaagggtttgataactgaacttttatccttcttttattcaattggctaattcatcatcgattgctccctgttattgaattaatagttaattgatctctgttaggtactagtagtttttattgatctcagttattttttgtctgaggtatgctttctattgctagggtggaaaacaaatattgagcctgttactgtgtgctatctgcttttcagtatgtgtccctctagattcattgtcaagtgcatgtcctagcagattaccaattagtatgcagcgaagctttatttttactggcttcattaataaaataagttcctctcttactagtcaatttagcaacagttttattaagacaaattgcattcatataaacatagtggttggtatggtaatgtttgatttgattattgtttgtcttttgctgggaatgttttgtttgccagattttaagattatcattgcagtgaattgaagaacattgtttgcttgcttgatgtgatatttagacatgagccaaatacccgtgcattgtaacaatctagcataaatatatgatttcaaattgaatagttcacacttaattctaatacaaacgacgtgcaaatgatacagttatgcagagaagattgttcagataaaagaaaaatgaacacagttatgcatagtatggtggtggtgcaaactcatttccatcactgctagcttcttttacaatatactagtaaatatcaccctgtagttttggttcgttacatgttcttatggtctcaatatgacaaatgcttagccaatagccacttaggtagttggtgttgttctccatttgttccacaatctaaattacaaaaagtttcttgtctggtgtttatgctccttttcttttggcttcaaacttatgtacttgagtgctcaaattcgtgttgtgttgggttgcaatctaattctggagaatatgcgtctggtgtggcattgtactgaacaggaagggtcctgttcccatctgagttaacatcctgtgttcgcatacatctcttccttctaatgcatggaattataagcatacatcctgttttcaattctttgaaccatatagtttggtgatggtggatatcttgaatatggtatagtttggcataaaaaaaaacacagtaaggtacctacatatgtttttccaagcgattgacaatattgtggctgcgagtggcagatgtagatccaactatcagaatgaacaatgcaaccacaaccttataatagggaaatactgaaacagacatcatgacatgtttcttatgccttgcatgaatttttttttggttagtttatatgtgatgtagtagatcagccaccaggaagaaatttatcatagtaatttactataatttcattattgtgaatttatatgtttgtcatggtttgctttgtagaatgtgaattcggttaatatgattgttgtaattttagtaagtcacgtatgagttaatattcattgttattagctggtatggtttgtgcaccattagtgtgttcttgcttgtttctgattcatggacctcacatggaggaagtcttcgcaagcctgcaactgtacccctattgccttggccccttctagttcagtttaatttttgcatgtcatctcttattgaaagaaggaaaaattgtaaatatactttgcatttgtccacttaggttgaagaatcttgtttggcttatgtctcttattgaaagaaggaaaatgtaccatttttctaggttgataaagctgcgttgttagcattctctactatagggttattgttgttttcacaaagttcatgttgttcttccattgtcatatcacttgaatcatatttcagtgtttgtcttctttcatgttccctctatctgctgaacattatttcattgcaggtctgatgctaccaaagagactgctgcagcaaactaatctatgccggtacttgcgaacccaaggattgcagatctcttctgctaaatagcctttctattatttttttgctacttgtgtgctacagttgtaacactgagtcaattttgcgtccatgtttcttatcttttcttagcacctggtaatcgtgatttatggtattgagaattttgatctggaacttaggtcttaatcatagtgggtagtagctattcattctattgtgactgttagttgtcatgctatgttgacatggtgataatgtctcgaagaaagaaatagtgcttttttaaccttgttagctgtggagatgtggagtagcatttgtttagaattttgcatttacaatgcggctgaggtttgcgccagcaagtgtgaccgcacctatgatttctgcgctaccttgaatcacggtgaacgcttggctgaggtcctgttcgcgaaaagaattttttgtcacatcggatctttgaccgaatatctaagatatcagaaggggtttttggacacgaataaaaaaaattaatctcataactcgtatggaaaccgcgagacgaatttatgttttagcctaattaagctgtcattagcacttgtgtgttactatagtatttatggctaatcatggactaattaggtttgaaagatttgtctcgtgatttccatacaaactgtgcaattaatttttatttttatctatatttaatgcttcaagcatgtatcaaagattcgatacgatgtttttgagaaaaaaaaatttatggctaatcatggactaattaggtttgaaagatttgtctcgtgattttcatataaactgtgcagttaatttttatttttatctatatttaatgtttcaagcatgtatcaaagattcgattagatgtttttgattcgatacgatgtttttgagaaaaaaaaatttagtaactaaactaggcctcatttcgatgcctatggctatgtggcctgtttgacatgcatagccggtccaatgaatcactgcgaacgttcggctcatttggcttgttggaataaactagataaaacagccccctacgtatgtctgtaacatttgataaagcagccccctacgcatgtctgtaaaaaaaaaagttaagtggggtttcatgcggccttccatgatccactagtcgttctcatgctagattagcccctttgtttgacattcatatggattttacaatctgttgggaatgcataattttttattcaacgaagaccttcagttataccatcatttggctcgtacgttaaaccgatgctagcctagtgtctagggtcctccagtgtggtttgtaatatgagataccaaacctagtttgatgaacatctgcatgtgtctcttcatgatactcaaagtgacacatgcagatgtcctcgacctccctgccacacatgtagatgttcttttcccatatcatttttctaatctgccatcaaattcgcaaacaaaacaaagattgcattgctcatttttctcacgttggattggacacttttgtaagctgaaatttgtattatggagtttgttgttgttgttgcaaaagtcagctaaaggtaaacaactactccctccgtttaatattacaagacaatgatagaaagacttataatatgaaacggagaaagtaatcaaaaagcttctcctggtggagttgattgattgatgcctatttagatttcctccagtattctcaacgcagattccgcatagatgcgttgtctgaaaattgaaaaccacattacaggagcataaagttaaaacaaaatttagccaaaatttatagaattggagggagatagggaatgaaaggtttttctttcttggcgtacttctcttgggtgtgtctagggccagccggccagggcgattgtgtttcatgtatccatcccatggaaccttcttaaggccaacctgagcagcgatcatatccctcaccccatcaaagtattggaaaatgatgtgagcaattgtatattttattcatttattttaaatgaagagccaattcaattgcggtctctcctggcataatttgctgagggtccaagaaccaaacatcacacacaacaccccatgatgtcataagtcgaaacaattcaactgcaaaagaatgtctgacaaagcgttggatgtttagtttatacttcgtactcaaataaccaagacggccaaattaagcagatctgcacaattattttttgcatttcctcacttcttactgtcccaaaaagtgtcagtaaactctttgttgtatttgatagctattgggcatacaatgcagccaagctcaaaagcagcctgaaaaatcacagtgcagacaaatatgcaagccgtggttagtctggcaagaaagatgaccaaatatatcttatggaagaggatggctgattctattcgaccgtcttgtgtatgctttctggggtacccgatatacactgccagattgctactaccatatttggttactgctcaaaaagagtttaacgcgggtactctgatacagttttgtttgaagaaattgagtcttgaattttgtcttgtagaaactctgtacaacttaacaatttgaaatatcatttgtatgggcatatcacatatccatatatgattttttttcaacaaaaaggaaatgcttaccttcttgaacatgactgtataccgattgttaacgcaagttccttctgggaatatcataagaggattgttgtctggaagttggacatgctcttgtaggttgtagcctggtaatgaaatttcttcgagtaaaagtaagattaccaaatataggattgctaaggatagcatttcttacttttcttccaccatgttgaagcagaaggagcggctgcttgtccttggcgttggcgcgggtgtgtggttgggtgatgacgatctgctagccattgtcaataataacgaaattagggccctcctgtgtgtctcctggtagaaggcatcccatgcgcaccacctgaagtagtcaacaatgcagggaacttcttgttagagtggagccagaaggtcttaaggtaggacttggatatgacaactttgccggtgatggcggtgaaggggtcgaactccacggtgtcgatgacgagcacgtggtcgaaagatgtggtgtgcgtgtccgcgccgccccagcgccgctatcaacacagagctggagcgtgccagcgctctgaaggctagatcagaacgtgccctcgtttagcaggaggaaaacgacatacgcgtcaccgccaccaccatccattaaattcgcaccttggaggagaatttgaaagacttgggccctcttcactgcaagctctccacgtggtgtgctaaatttggattgtcgcacccgaatgcttgccctttgtgcgattaagatggggagacaatgcaacacatcttcatatcttatcttgtgtctctgcccgtcaagtatggttctctagtcctagaaaatatcagattgacgatggcagcacctcaaccttaggcaacctgtttttttagtgggtgatccaaggtagtcgagcattatactaaggagacaaagaaatgattaagttccttaatcagcctagtggcacaagaaatttaaaagtactggaataattgtgtgttcattaatatcacaccaacggcacagttgtcttgcaagcattagcaatagagtgttcgtattggctgatgccacataggtcgctttcttttgatggttagctgctcatgggaggtttttgtgtgtcacgtgttttttaatgtctttttcctagagagttccttttttgtggaccactctattgtacaaatttctgcttcttgaagcacaagcctctcgcattttcttgaaagaaaaaagaaatgttctagggtaggactagtgatccttgtattgtaaaagcataaaggaccgatgcaaacgacgacccccaatacagtcctatggaagaggcagtacaccatcatgcgcgccacattttgcagcaacatttgaatccgatcttccaatgcaaccatatagatcgatggcaatacacattgccagtatatcacgaagatccctcgtgcttcaaagtaaaaaaagatagatatatactggtttaccgcaccatatcttggtttcatttaacaatgacctatttattcttcattcagatccaacatgcacccgcatgttgaactatagtaaataaacgcatatgagaaacaaaacagtattttgtcctgagccactaaaattcttggcaacatttgctacagtacatttaaagtttgtggcctttgcggtgagacacctagagaacgtgtatcttctcgtggacactgtaaaaaatatggtaatcagctgctggacacccgcctcattattttattatttttggtggaaacggagagagaaacaatggttaaagataagtttgcccatgggcccacttgtcaatcacacatctggctttctacgttcctcttcttgctgctgggccgactcgccgcgtggacggaggacaaagaacgacgtgcccacgaggagggtgagggcattgtctctcgcggtggcgtcgggcaaccgactgcgtcgactggccttgaaggtgagggccccccatgggccgacagtgggacggatagagatgatcgggaggctcgactggcggaagatggcagcagcggcatgcgtcgggtcccccgtgggccgacagtgggacggatagagatgatcgggaggctcgactggcgaaagatggcagcagagcggcatgcgggaggctcgactggcgaaagatggcagcagcggcatgcgtcgatggtgggacagacggagtcgaccgggaggctcaattagcagaaggcggcagcagcagcatcctggggagggctcgaagcgacaaggggcatccacccctaggcacggagctctaggctggcatcgacggagtcagggtgtcggtggagacgaccctagggcgcgaaggacggtgattgcggcgggcagaggtggtgtactgctgatcgatggcagtggcagtgaggcgccgctagccttgacgtggtactcacgacggcatccaccgagaggctggccagtgacgaggagtccaagacacacggtgtggagggccacccgacaaggagggtgagggtgctgcttctcccgccgcctctctgccggtcgccgccccacccatcgtctaccccctccgccgcccactgttgcgctcacttgccaccactcggtcctctattgccagcagcctcccaagctcgctaagaaaagagaaggaaaagagaatataagcaggaagaatagtgtccaggggcatttcagtactttcaacactctttctctattttcaccaaaaataataaaataatacatcgagagtcctacaggtaattaccacattttttaatgttcacaagaagatatacgttttttagtgtctcacagcaaaggctacaaaatttaagtgtcctgtagcaaaatttgccaaaaatctttggataaaataaggtaccgacatcacagtacaataaaaaaaaataccgattctacagcaaactgtactgcgctatcaatccgaatcctgatacagccacacataacaagagaaaaatcttattacaattgcaggaaaacgagttaggcagagagattatcaaagaacttcatgtagtcatcaaatgactctccacgccgaatcttagcaatggacccatcatcttctacctgcattacaaataacagggcatattggatgggaaccaacaattataaacattgcataaagggagcattttgaaaacctatcaacaaatgatttcggatgaaaaatatataggtcagtttgtacccaatattcaggtggtcgcaacttcaagttgtaggttgaagccatgctcatgcagtaggctcctgcgtcatgaaccaccaaaccagctccctacaagcgcaatatgtttgtagggtaccaacaaggatatcaaaaagaaaacacaagatatggtcaaaccttatcaggtgttggaagttccctgtctttgccaaggaaatctgcagattcacaaactggtccaacaatatcgaatgttgctacttctgcatctggggaaggagaaaccagttcgatatgctgcaccatgtggatagagatgacaggtaaataacatgataaaacaacatagtacgaaataactgaatgtatatttcatgtttattttgaacatttgttggaaaaactgtatgcaagaaaaaaattgttggaaagatgttatttatatataggtcagatggagatgtaaagatcagagctaaacctgagaccaacgttacaatcatcatatatttatgaatggtgagcatcttatccaaacgaactcagctattatgaacaatggacaaaaccaacactctgcttgcaaccactatcagttgtatcactaaacaaacctggtatgctccatatagacttggtctgataagctctgccatgctgccatcaactacaatgaaattctttgtaccattagatttaacaccagtgaccctattgacgaagcagcaagtgttagctatgagggatctcccaggttcaatgatgagtgtaagatctcgtgacagaactaattctcgcacctacaaaaaatcacaggggcacatataagaatcacgccatatgccaaattttaacagtgcaaaaatccaaagtaggaagtgatctatttaaataaataatgtgcctacgaagatgagaatcggaaatataacatggatattgagctcacagtgttgatgaggtccataggtgtaggcaagactgcatccgtgtggtgataatctatgcccaggccaccgccaatattgagatattccagttcaaaaccttgtgctcgaatttcatcaacataattcaccataagacctgccgcatctctaaatatatcgacctagacaacaagaaaacaatatcatataccataccatgtagctcaaatgtattgtctaattatttgaacatggtctgaagaaaaaaaagttatttagcaaataagcataagcccacatctttaacaggggcttgtccctggataaacagaaacaaacacattaagtttgatgaagtttcaaagtcagcataataagtctttttgaatggacacactgctgcacagaaatagtatacacacaagaaaggaattatccctttctcctaatttcttcagtaagctttattcacataagctgcaagttcacaagcaatggagaatgggagaggagaggagagaagagcacgggttctttgatgctgtccatacccggtgctgcatccctgatttccattccccgaactgatcattatactacttgtcaagagaaaaacattacagcgtccaaaacacgaacacgatgctttccatcaccgttgctccacatccactgaaacaaaatcacgtcggacatgctcaccgatgtctcacccgatatcacatgcgagagccctcttctaagttaataagtcttccaattttaaatatttgtgatgaaccttagttcgttatgggataaacattacaaggtggacggctggaaatggatagactagagactatcagctgtacttaattctttaataatcaaccaatagtcagagattttaaaatttcagaggacttcatttagtcccagctgtactattgatttacaaggtggcacttagtttatctcagaggactgggactcagataaattcagctgtacttgcttgttaataatcaatcaatagtttcctgactatatagtgagcctcataacaaccactgctacattatgatgcaccgatacaacagaaaacagcatattcctgtaccagatatgtatccgagacaggagtacgcagtcaatacagtattgcagaaatattgatcatataatggcgaaacaaatcaaaactattagcaatgcttcctcgattcaaattagatgctcagatatgcagtcaagccaaccctcattcgaaagcccacagatggtagtctaacccaagaccactaacccttgttcgcacctgtgtgcgactgtgagtgctgttcccctcattctccacctccattatagcatcaccctgcctacatcaccttcagtgagcaacctgctcgcctcaactacaccatgtgtgcaggaggcttttctatgacaattgaaagttaacaaattggaaagatgtgtcttgatttaaatgtttcttatcaaacttaaaatgttttggataaaaaaaaaacttagggtgtgttcgttagtttggggttgggaacccatctccccacacggaaaacagaacagtccattagcgcgtgattaattaagtattagctatttttttaaatgaattaatttgatttttttaaacaactttcatatataaactttttgcaaaaaatgcaccatttattagtttgaaaagtgtgcgtgcggaaaatgagggaggggtgttgggaacctagaacaccgaacacaccttaaaatgttaacaaatttggtttcatgttaaatggtccccattttatcccattgaactgacacatcttagtttccagagagtgagacacagagggtaaaatgaaaagctggtccgttggagctaagagtctgacacctgcatgtggaggtactcatgcctgtgacttgaggcttgaaacattgaaaaaaacaaatcacttttttctaaaatggccagttcagaaacaagagcaaaaatattttgaacattcaatctagttccgcaaggtcagctatgccaaaaatctagttcatggtcattaacagatcacgtactatgttatttccataatgctttcagtactatacaattggatagaaggtaagtctcaaatttcaaaatgtagatgtttcagacattggcacagtaattaaggaagtcttaaaatgaccttgttgcccataatcatagcacattggaatgatatcttatttattcatgagatgtattcaatttacaaggggaatagaggaaaaaatgggacaggtacctaaaagtcatataacaatttacattttgaatcagagcagtgtggttcctataattcttagtgattgaaatgatctgttgttgccattcgcatacactaaaacaaatggcaacaataactttctaaataaactcaaatcaacaaaaaagcacatttttcagagcataatgcagcccaaaatgcaatttcttactagcaatttccaactgttacttaattgttctcaactagctagaagtatggattaatgttaatcatctgaatgccatattaacatgcttggatggatataacatcatatggaagctacggcgagacgaattattgtttgagcatgatgcataaaagcatgtccgctggctcagaagtacttacaagacattttagctcattgcacaaggattaatgtgtagaagaactccccttgcagctgtacaagaatgctgcagctgtacaagaatgcatgcagccatcacatgcttgcacaggaggggagaggaatattactaaccgagaaaaccctggcatatgctaacggttgatggttttggttaataggtttaagtttgtgcgaagtatttatcaaatggaaattccacccaaaattactttctcagaaaagcagaactattcttgaaaaagaatgtctaaaacgatatataatgaatgaagtggtaaccataaaaaggtacaactaatgcaaagcaagcagcatgttttttagtaaatttcacaagaccccaggtattggggcatccataacacaaaaccccagttattgtgatttgtttcagggaaccccatgtttcggggtaaaatgtttcaaaaaaccccatatttatgtaaaatactcatgtttcattattacatatgattttttttcataaattcacatttgttgactctcgtctagtttatttattttttctcaatttttcactgcacaaaaaaactcaacataatcataagtgataatgacataataattggttaagtatacacataaatgatcagaccacgatgaacaacgattattgaaaagcagctaacgtgtatatgtacttaaaaaatggcaactaatgtaaagaaatgcagcatgtcaggttttggggcactagcattataaaaccccacgttttgaggtttccttcactaaatcacaacttattcaaagagctcacagagtaaagcagggagaggcggagcaagttctacaatatagggctgtgactgcacaatggaagccgagtgcctggtaacagaggcaatgtgatcttaggatacaggaacctacgtttcgaggctccgagcctctgatttctggggttgtcttatcagctaacgggaacctaacaggatatgatggaactgagttttgtgatacatgccggcatgttgcaaaacatgggatttagtgaagaaaaccttactacctggggttttgttaaaatttacacttttttgtggcaaaaacagaaggcgagttgcctgtactgtatgacaaaatgtctgttgagcacaagatgctaaggtacaaaacaccaccacgaacaagctcaccataacaaatacctacttattacaactcaaagtttccaacaattataaccaaagaatagtacatcataattcatttacctttgtaatggtagatcccagatgacaatgaacacccaccagtgtgatatcatttgagtatgacttgatagagtctaagaaccattgtagtttctcattacggataccaaatttggaggttttgtttccagtcgcaacataaggatggacctgttgacagaaaaaaaagacaagcttgtaagaaataagcaatcttaagtttgctcctcaaaagaagattatcttgcttccagttcttaatacaattgacatgcctttttacaagtaaaaacaaagatactttcatacaattttaaatcaactgcattagtatcatcatacaaaagactatggaggaacaggtaacactatatgcacatacattattggcaaatttcgctacatgacatcgtgacttcgcggttttagct

SEQ ID NO: 65428 - DNA, 8265 bp, Oryza sativa
cacagatgggtctgaattgtttgaagatgtctgtattgtgccgctgaaagcctgaaactaaaccaatttccatgcagattcccgttcttccagctgccattctgaacaacatcgcatggaaaattgctaccaatttcagatatgtacactcccataaacaatcaaatatgtctatgtatatagtatacacaatacatgaactagtacatcaaaatatgaacaatcaatgagtagtgccccaattctctgtcctctatattagagtgtatttacacatagtataagcaaatatgtgtttttccaactgaaacactgaaaaagaacaaactacagcttggtggcggcagtggggcgtcgagtgccgacggcgcccagcggcggggttggcggcgcccggcggcggagtggtggcggcgcacggcggcgggggtggtggcggcgaacagcggcgggggtggtggcgctcacggccgtgctgagcgacgcctggagactggagggatcaatcgattgagagaggaggaaacatcttcctttgatctgacagtgggcccaggggcaaaacagtccacaatgcctgaaaagaaatacaaattgagttaagaaatgagaaatacataaaaactgagaaagtggtaccaaatagactaattagcaatcctaatgacatattatagatggcatgtggattgggtggtaaaaaagttgaggcacgcgaattggatggtatataatctaaattctccataaaaaagaatgctgattgtggtatcttgtaagtacttcactatacgatcttcaaagctgggtccaaattcttaatccaagtttcagccaaacttcattgcacatttgcataccagccgactatcattattgaagaaattaaccatatctctaacagataattacataatccagttttaatttagttcatgtcacttgcaagaggaactttacatgataatatagactgttgcctaagatttttcattgataattttttatgtaatctgcggtactctctgcccccccaaatggatctttcattttccacacacgaatgtacaaaccagaggtcccattaaaagcgtgttcaattaatcctcatgaggagggattggagaaaattgagggattaatttcacacctcaatagttatgtaataaataaatcatctccaaatctccctcgatcccttttggggattaaccaaaaaagtgaagtaagccaaaaaaagtaaatctaacaaacagaacatgtaatggtacagttaaaaggtaacgaaaacatcggcaaacgagaaaaaaaacaagtaaaacagatcgagcactacaccttaccaagaagctttaccaccagggacggggagacgtacgtacggcttcacacgaccaattgcgacggcagaactagggtcacccacgtttaatttgttggagtctcctgtccgcttgcgctacgtacggactctccctggctcctcacgtaagcccatctggcccaaccacggccttccaacctgcccctagctggctagctagggctgcgtgccaccgtgacctgacctagacggagacggccgggcccgggcgcgcgaggggacggcgacgaagctctcgttgggcgcacatggagattgaggacggctgcgccaaggttctccacgggaagaaggaagaagcgatcacgatcacgccccaagacgaccggtgcccagatggcgtcggcgggcaaaccggcggcgggggtcggcggctgcagcaaggaagccggagagagacgccgcgccgccaagaataataagcgccgccgcaccgagaaagcggaggacgccgacggcggctgcggcggtgacgaggatcaggtggtcacctccaaggcgatggaggcggtgtcagtgccggaggaggtactccgggccaagaagaagaacggcgaccggcgaggtcgcagcaaggaagccgaagagaggcgccgcgccaagaaagccgccgacaagaaaaggagagcagccgccaagaagctccgcaccgaggaagcagaggccggtcgtgatgacgacggggcaaaggaggcagaggagggtacaagtattcacttaaatagcatcaaattctgctgtctttactgcatacattgttgatttgccctgttctctaatctgtactgattcagttcaggatttctcagttttgtagcattagaaggctcacataataaacagtaccgaactttcagtggttaccgcatatcgcatctctctcgcaccgttgtttgctgcgttttctttaacctgcattaataactgtgctcacttactttttttttctactttcctccaggacgtccacctaattaatgcaggaatgattaaccatgttaattacagacaaacccatagtaatagacttcccctagtctatagtactaccaccacctgacaacacggaattcaaatagatctggacgctgatcaattcagaatacattttgggaccattgatgagtacttgttgaaatgtttatgaagcttagacctagtttagttcctaaaattttttcccaaaaacatcacattgaatctttagagacatgcatggagcattaaatataaattaaaaaaaaactaattgcacagttaggggggaaatcgcgagacgaatttttttttgaccctaattagtccatgattagccataagtactacagtaacccgcatatgctaatgatggaataattaggctcaaaagatccgtctcgcgatttccaggcgagttatgaaattagttttttcattcgtatccgaaaacccctttcgacatccgatgtgacacccaaaaattttctttttgcgaactaaacatgccattacttttcgatggatttggtctcatgtcgaaattcttcctaagctgtttagaattatcaaaacgagtcagttacctcatccactacgagtctcagttttgggtcttgtgtaattatgtcatgagctaaacccaggggaaatgtgccttggggctgttcgtaggacatccactcatatatactccctgcgtcctataatataagtgattttggttggatggaacatattatagtactacgaatctaccctgtcctgattcctagtactagaatatgtcatatccaaccaaaagcctttatattatgggacagagggagtattcgatagtcgttatcgtttaattaagaaccgggtttgtttatattattctgccaattgtagtttcgacgctagttcgatttgtggaacccaacttgtgagattcatcttatattcgcaatatattcagattgcatcttctactcttttgcttatgctttcaatttgcttgcaggagatgggttaattggattcataaaaagaaactaatagatgaaaaggagttggaagctgtcgaaacaagatttcagcaatactaaaaggggtggctatcaagctagaaaagtggatgggtttgaagacaaggaattttatacaggttcaggcttccttattcaagaagtaataccctactcctgtccggggatgattccgccgagtgtattattgatcgtatgatctgggagaaaatcgtgtcccgagagggacccggacccctccttatataggggaaggggtccgtattacaaaatacagtccatatccctaacggaatatgtgattacagataaaatacaatcgtaaccgactaggatcccgggtatttccttgacatacaagtttagaaactaacccgagtcctcataaagatattctatctatattcggtaccctgtacccaactagactataactgccgtgtagatatggggtatccataatctccacagtagcccccgagacctttgcagtcgatgaaatagccttctccgaacaaaaagcaataatccgagtgcttcaattcctcctgctctggtctgccgagtactaaaatcaaagactgtgaagggcgaaataaaacatggtgcatcgagtagatgcacctaattaggtgtagcccccgagtatgtggttagttaaaaaactaaacatgtagtcaagaaccgagtggttttacaaccaaacatcatatagcaaagcatgcgtggtattcaataaaacacccagccgactgcttcttagctttaatatatcgagaatagaaatatgaaaaggcccgagtgacaaacactcaaaagatccacaaatagacatattttacaagaatccgagtaagaaactcttaaaatgatccgccaaatatgataaaaaccatggtaattaaagaatctaatagcctaggctatgactcttaccacaatcaaaataagcatataacatgccaagagaatgactcctaataaactagtcatctcaaatcaacccaaacagcttttgcagcctaataaagcttacaaaaatagtataacacctttttgtcgggcacctttttatttgcatcataataattccaaagaattatctaaccgcgttaaaaaggattttagcagcatcgggtcacatcattgtgagcacaaattgccaaagcaaaaagcgcctaagtccctagggatcacaacgggccacgctggtaataatattgggctgaagtattgtacaggcccaggcccattagcactcccgataccctaacaaaacaccgaagtccaagcgacgcttcgtcttccccgccgagactctcgccatttccccattcctcgctacagtacaaaactgcgccgacgaagctagggttcatcaatccgccccaatccattctcaaaaatcccatgaaacttctccgagcgtccaccgcaccgattccccatccccctccagctatatctcggaccaaatcagaccattcagctcgcattcatggcggaagagagagaaagtttcgagagtcagtgggcgccctccgatgtggcggaggagaatctgaaagaaatggtggcgcacaacgttcttccagcgaaggagatcatcgggtggcgaccagcgttcggcgaagtgttcccgaccccggatacacacgaggtcgtggtattttctcacttcttttatggcggattttctcttccaacttcaagattcttccgaggaattctgaacttctatggaattagcctgcatcatttgaatccaaactccatagtgcatatcgccaattttattcatgcctgcgaagcttttctgggcattaggcctcattttgctttgttccgccgcatttacttcctcaagccccagccgaacaagagcaaaccatgcgttgttgggggcgctggtttccaactcagaggaacactaagccaaaagtatttctccatgcccttcaagacgtcaaacaaaggctagcacgcaaactagttttacgttcaaaatcttgaacccgcactccccgagtactcctgtctccctccggtctattaggacacatggaattcattgcctatgggagatgaagctgctcaggcagtggaattgatggagcgcatgataaagctgaaggaacaaggtttgcaaggagaacagatcactcggcacttcatcaaaagtcggttagctccaatcaaagagagatcccgcacggcttttgagtttgacggcaaacatgatccaaatcgtgaagatctagactctcttgactttaaggtcatgaaggaaagaatgtacaagatcttctcaaatgctatcgtcgtcagctattcacatctgctgccagttgtgccatacaatgcattcaaccctcctccaccggtatggattcaaacacttcaaccttcctcaaaatatgatcttgtcttcttgttgaatcagttgacagtggaagatattatgtctaggaatttgctttgatgaagtcggatcccccaatcgctcagcgccgatcaccccgccgtcaaattggtcaggggagcggggaaccaaagatccggtctgaagcccagtcgaatacctctaatccagtcggccagtcggattcccgcaagaggaagttagtgctgagtgacgacgaaggcgatgacgctaaaaagcctggagatagagaaacaaccagaaaactgccgaagcaagctattccaaagaagaaaacatccagtcgtcctatgccgaagatcaggaagtcttccaggtacaaatcatataacgatcttccttgtttcgatgctcacttatcatggaaacaacgctgacagtacaactcaaacttgtagaaaaccatctgacatagacccttctgggaaagactctgatccgactaacttggacacgagttcttccaaagaaaccgggccgactgctgaggatcatccgagtgacaatcagccggcaaccgataatgtaggatccggtgatcaacccctgactggaaaccagtcggtcgaagctgaagccggagttaatcaggagcccctgactagaaaccagtcggacacagggccaagccaagagattccagaagtcgaagcccaagcagacaaccctcgtggtcaagacgccagcaatgaccggagatctggatctccttcaaaggcatccgagtccactcgtcctcgtccagaaatcatcacaggtaaacactttgtctgaaatcactttgatctaactgactctatgtgattgttcgacctttttccatggatgcattaggaccaatgattggtgatgaagaggaaattctccggatacgggtggctgaagattcgcgccctcccattctggtcaagtggtgggatgacgatttgcaacctcaaggaattgtgataaactggcaaaaagaggacgaagaggtgtgcctactgaaaaaggcactcggccaggcgactcgcattgtaaacgtaagttccttgacgcctgacctcaaccatcttgttcgctatctagctcaaacgctaataaaactgttttgtagaggattcatcttaggaatgaagcgaaaaccgcgaccctagaaaaattagtccctcatcttggaacccttgaagctgtcagagatcagctacacgaggcaaaagagcttgccaagaaaaccgagcacgatctgtcgcgaccgagaaaaatacattttcccgaacgctagtgtattaatccccgtcccaggaaaagccggggtacaccacacaaacatgatacaaaagacacatctttattatatcgataatatttacattattacaaaggcatttaaggcctgacaatcaaaaataaacagcagcggactagcgggcctatggctccatcttcacaggcgctcaactggggtataagccaggactccacctaagacttcttctccaaagcttctcttactgaaggggggaaagattgagcaagaatgagtacaaccacagtactcagcaagccacaccggcagatgcatgattaatgcaagggggtacaaggggtaataatataggggttaagtttggtagaaaacagcatttaaaagtcacttagttgcccaaagccattttataaagacgatactagagttacacagtattattaatcaaggccatggacccacacgaatgtcgcgaccgagaaaattttgcattttcccgaacgctagtgtattaatccccgtcccaggaaaagccggggtacaccacacaaacatgatacaaaaggcacatctttattatatcgataatatttacattattacaaaggcacttaaggcctgacaatcaaaaataaacagcagcggactagcgggcctacggctccatcttcacaggcgctcaactggggtataagccaggactccacctaagacttcttctccaaagcttctcttactgaagggggggaaaagattgagcaagagtgagtacaaccacagtactcagcaagccacaccggcggatgcatgattaatgcaagggggtacaaggggtaatgatataggggttaagttttgcagaaaacagcatttaaaagtcacttagttgcccaaagccattttataaagatgatcctagagctacacagtattattaatcaaggtcgtgaacccacacgagcctgccttagcccaaggcctacgatgattcagaccgaactggcaacccgaccctgggtcccagctcgtcccaagccaacccaggccaaccattctacaatttagttgttaagcaaattttaagaattaaaacactaacttgggtacattgctcggcttgcccataaccgagggcgcggctattcgaatagattatactctgatcagaagtgtacatctttac

SEQ ID NO: 65429 - DNA, 13675 bp, Oryza sativa
agtgagagggggtggccggaggaggggaaaacgggcgcgggagtcccggccgccattaatggcgccggcaaggttaggggaggagtttccaaacgaatccagggagagagagagggaaaaatggggggaaagggggaggggatcccggggaataattcccccctattgattgcacgcggggcggacgggggcggcgggattcgcggcggcggcggcgctagggcgcgggcgaggcggcgggagcggcggaaggaaggggatgacgggtgggccccacccatcaccgagggaggcgggcgggcgggcccgtcagcggtgcgcgcgcggggaggaggccgaatgggccgcggggagaggagagggagggggaaggagatgggccgaggcggcccaagagggagaggggggaaaagggactttttagagcttttctttttataaaaccattttaactttgtttatttcctcttaattattatttgtgctctgaaaatttaagtaaaatttgagggctccttttagaccaaggagaatttaacaaaaattctccggaccacattcgaattcttctggcacgtattttagtgtttgccaatttcttttcgaattttaattaattctattattccttttagataatgatttttatttcgggatgaatttatcaggacgtgacaaatccaccccccttacaggaatctcgtccccgagattcgaggaggctagcaagaagataggttgggtggtcttctcttcttgtctgacttcttccgttgcatcttcttgaacgggcttgcccagcaaaacttccccactctgaactgcttggcttgatctcctcttgcagatggaatcttcttttcacctgacttgaaccagggtgcaccttttagctgactcagactaggttgcggtagtttaatgatgcttccatttccagaacttctcataattcatatctttggcgtcaacctcatacaggttacccacttcacgttatgcgtcgatatcagcttgtcattactaggataccatgcttgtcatcatgagaataccatacttgtcatttacttctaacttgccaccaactgcctcatattaactttcctgctctccgggtgctagctacttctgctattcgatgcaagggtcgataactttgcctttgaattatgtttctcaaccgaaccaacttctcccacttgacatgctttgacgtcttcccaaatggctttactgctggacttcttattgtttgatcgttatcctgccaaatctgaagcttcgttgtctgacctctgtagactatcttcgaacatatcacttggttcataactgggaatagctcccacgaacaagcagctcggattcactttctttacattcagtttatttcccactattctcttcatgttgtcattatttagcattcaacgtattcctttacaccttcgaccttgatgagttccttcccattggatcatctcccaagacatggcattgcctggtaaccggtgcctgcacttttcactccgtgtagcatctgataccgagttgaagatttcactccttgccttcatagaaacacttttacctaggtcatcttgcttactcacaatttttttttctctcaatgacaaggtgactgttgcagggcgattactgtgaggagtcttccttgtgtgatgcagagcatgtttctgattatcctttatcaatcaccgttcggcctacatctttccttctagagaacatcttggccaacctcttttatcaatcatctttcggcctatctctaacaggtggtactctttaatgtgggttgcagacacttctggtggcgatgaggtcctttggtctgctgcctttcagtgaaaccttgaagtgtttcgccaaaagctatactgactgtcattgcctttgacccgaaaaagacacatttgaaactcttagttcaaacaaatgtctctttggttaatcgcttgattttcttttccatcatcaggttggttattaactcaaggttaaaatatagttcctctgaaatgagaccctatgtctcctttgtcagtaaacaattatacacataatcccatatccacatcttccaaaagaatcctaatagaacttgtctgtattacatatttctcccttattacatgaatacaaggcactaccttaaacaaaaagggaagatgcttaacatcggtacattgtttctactatgggttatgattaacacgaggcctcacaggtatggcgtttgctccagtgaccacaaggcgagtgacttgtcttcttcttgcataatggccggagtgatgacgcaggttacgcttcggctgtggacaatctctggagaaatgacctggttctttgcagttgtaacaaatcaatgtcttctttactgagttgtccgtctgggaacgatcattctgacttggagttggaattggtggttggaaatccttgctaacattggcatcagtggtaccatatttgctatcaccattggagtctttctcagagtcaaaattgctagggttgtcattctgggtgccttcattgatactatcgtcgatatcttggtgaatgctgttgacattgcacgcttgatctaagtggtcatgaatggggcaagaaccatggttgttggtggtatcatcagcattagtattgctaatgttgttgtctgcgttgtgtccatcttcttggggtagtaactcttgatgcgcaacagaagatccggtgatctgaagtggctcagtgcgctgtctttggttaccacatggaaatactgggatgttgacaatccttctcttgtagttcgtcatccgattatgctcactttcgagttgcatggctttgtccacaagtttctcaaaatcttcataatcctctaggagtagttgcactgcaagctcatcttttaacccttggagaaacttctcttgtttgtcttcatccgtttccacatcttctggtgcatagtgagccaaacgatagaactcgtgcaggtactctgtgacggtcaaatctccttgcttccggtagcgaaactctcgttttcttagtgtgatcattcctgcgggaacatgtgatctcttgaatacagatgaaaactcgttccaggtgatggtatgtccttctggccgtgatgcttcgtagctatcccaccactctgaagccggtccaaccaactgatgtgttgcgaagccaacccgctcctggtcggtgcactgaatcaaccctagcttcttctcgactgtgcgcaaccaatcactggcttccataggatcgacggcaatggcaaaggttggaggctcagttttgagaaattctgataacttgcactgttgctggactgtaggtacttgaacgttggttgcccctgctgggttgttccaattctgtaatagttgaaaggctgttgccaacatgttggtttggttaaccacaatttggattagctctggtgaggttttgttgatgcttttctcattcccattggcttgggttcttgagtcatcggatccatcattcccatagcctttgttaccagtgttatccatctgtcacaaggtagaggttgagaggggaagcagacaaggaaagaatggaccagaactagggacaagaccttaaaggaactaactctttttgttgatgtgttgtttgttttgcttattctgcaggttgattaagcaaacaacctagcatggtcacatcacaacccaccgatgcaaaccacgcactacacacacaagcaaggaaacacacgactaacaacactatcctagaggacggcttaggttctgcgactggttctccaagatcttcactcctgcttcacagctggcttcattgcttccttcgcttcgctagcggaccctacggtcttccggaccttcggcgaacaattgacgacatcttcttcttcgcaaaactaaccatctagtactagctgaaatttgaagaaggaagaaagagtaaacattttgcaaatagcacaggggaaaggaggaaaaagggactttcgcaaatagtttcatttataaaatatgtccttaggttttatccacttggcttatcctacagtcgagatggctctgataccatcttgtcgcgaccgagaaaattttgcattttcccgaacgctagtgtattaatccccgtcccaggaaaagccggggtacaccacacaaacatgataaaaaaggcacatctttattatatcgataatatttacattattacaaaggcacttaaggcctgaaaatcaaaaataaacagcagcggactagcgggcctacggctccatcttcacaggcgctcaactggggtataagccaggactccacctaagacttcttctccaaagcatctcttactgaagggggggaaaagattgagcaagagtgagtacaaccacagtactcagcaagccacaccggcggatgcatgattaatgcaagggggtacaaggggtaatgatataggggttaagttttgcagaaaacagcatttaaaagtcacttagttgcccaaagccattttataaagacgatcctagagctacacagtattattaatcaaggtcgtgaacccacacgagcctgtcttagcccaaggcctacaacgattcagaccgaactggcaacccgaccctgggtcccagctcgtcccaagccaacccaggccaaccattctacattttagttgttaagcaaattttaagaattaaaacactgacttgggttcattgctcggcttgcccataaccgagggcgcggctattcgaatagattatactctgatcagaggtgtacatctgtacccacaagacacatcttcctcacgtgtaaccacgtgccacataccaccacggtatacggacggaagacatgacatagttcccaacccatcctagccataaacaagagtaccgacccaaccccacctacggccggcacccccgggacaggtaggcaggactgagcccccagcagcaggacaccaaccctgtgccatgacatctcgactaccgggccgcagctcgtgtagccttcatttgtcctagagatgtccatcgacccccgacttcgtccatctccatacgtgtgcttttgtttataaccagactgagccacaaactaagccttacccactagacatgtggaagtacggtagtgctttgcaacagaggcccgagcttagtccttatagtggccggggtgctacttcccacaactggcatgcacccaaaccccaccgaaaaaacaggttttaggggctttgaaagaggaagagaggggtatgtccaattccaccataagccaaccattccatagtatccaagagatatgaatattcccaaagtctaaagttataaaaaccacctaatgttgtcctattaaccagcgaagcatctacctaaagtcatactagtggtaccatgagtagagtgtccactagttggggttttgtttaatctagggtgaacaaggtaataataacaataacaataataataaggtcataacaaaggtaaataggcatggctagataaaacagtgataacgcgggaatttaaataaagcgataatgcaataatttaaagcaacataattttataagctgggattcaatatgttcaaggatgatgtgacttgccttgctcgcttttccaaacgtcggcttcaacttccacgaagagcggatcttccgaagctgcagcgtctacacgaccaacggaaaagaaaaggcttttactctaataaactccatataacaagcaggaacaaagcacaaaaatgggttcttgacttcttaaggaaaaattagagacttgaacggtccaattccgagttcaaatggccaagttatggccatttgaagtttatatgctctttaaatgaatatttgcgaatttcttcatttaaattttaatttaaaaaaaatggatttattgcgtcagccgaggggaggggcgcgcggaccgggtccacgggggtggggcccacgcggcagccccacggtccacggtggaccgggcgcacccgggctcacaccggccggcgccgggggtcccacgcgttagccgcacctaagggtgcgggcggctgacagccgggccccacgcggcagccgctcggtgcgcccgaaggcgaccacgccggcgcagcggcgggaggcggcgcgcccgcgcccctatggtcgccggcggaagccataggcacggcggagcggcggccgagagaggggagggaaggggggaaacgaagcggcggtccacggctcaccccgggtcgacggcgacgacggaaacggcgaccggagcggaggaaggcggcggcgcggctcgggtggacggggtcggcggtgctctggcggtcggcgagcgaaatagaggggtggacgaggtcggcgaggatgcggcgaagccgaaggaggcggccccgagggggaaggtggtccggggagacgacggcggcggaccggagctcggcggcgacggcggagagagagagcgacggcgcgagctcgattccgatggggagtgagggcggcgagtggcggaaacggtggagggaggcacggggagggtttatatagggttgggagtgagagggggtggccggaggaggggaaaacgggcgcgggagtcccggccgccattaatggcgccggcaaggttaggggaggagtttccaaacgaatccgagggagagagagagggaaaaatggggggaaagggggaggggatcccggggaataattcccccctattgattgcacgcggggcggacgggggcggcgggattcgcggcggcggcggcgctagggcgcgggcgaggcggcgggagcagcgggaggaaggggatgacgggtgggccccacccgtcagcgagggaggcgggcgggcccgcccgtcagcggcgcgcgcgcggggaggaggccgaatgggccgcgaggagaggagagggagggggaaggagatgggccgaggcggcccaagagggagaggggggaaaagggactttttagagcttttctttttataaaatcattttaactttgtttatttcttcttaattattatttgtgctctgaaaattcaagtaaaatttgagggctccttttagaccaaggagaatttaacaaaaattctccggaccacattcgaattcttctggcacgtattttagtgtttgccaatttcttttcgaattttaattaattctattattccttttagagaatgatttttatttcgggatgaatttatcacgacgtgacaacgaacctgccttaacccaaggcctacgatgattcagaccgaagtggcaacccgaccctaggtcccagcttgtcccaagccaacccaggccacccattccacattttagttgttaagcaggttttaaaaattaaaacactaacttggatacattgccaggcttgcccataaccaagggcgcggctattcgaatagattatactctgatcagaggtgtacatctttacccacaagacacatcttcctcacatgtaaccacgtgccacatagcaccacggtatacggacggaagacgtgacatagttcccaacccatcctagccataaacaagagtaccgaaccaaccccacctacggctggaacctctgggacaggcaggcaggattgagcccctagcagcaggacaccagccctgtgccatgacatctcgactaccgggccgcagctcgtgtagccttcatttgtcctcgagatgtccatcgacccccgacttcgtccatctccatccgtgtacttttgtttataaccagactaagccacaaactaagtcttacccactagacatgtggatgtacggtagtgctttgcaacagaggcccgagcttaatccttatagtacccgaggtacgactaacaaaacccaaccacgcacctcgagcccagcctaaaaccattttgggggttttgaatagagggggaggtgtgtgtccaattccaacataagccaaccattccatagtatccaagtgatatgagaattcccaaagtctaaagttataaaaccacctaatattgcctaattaatcagcgaagcatctacctaaattcatcctagtggaaccatgaatagagtacccactagttggggttttattttcctagggtgaacaaggtaataataacaatacaacaataataaggtcataacaaaggtaaataggcatggctaaataaaacagtgataacgcgggaatttaaataaagcgataatgcattaatttaaatcaaaataattttataaactgggattcaatatgctcaaggatgatgtgacttgccttgctcaaagagaacggtcttccgaaccttcggcgacgaccgcgaaccacgcttcgggaacctccagaacgacagaagctacgcgaagcacacaagcaaagctacaagcctataaagaagcaataactatacataaaaagaaagcacacggttctttaggttataacaaaaattaggagacttgaacatatcgattcggagctcgtatgaccaagacatggtcatccgaagtttaatgctgttatatggagatttgcggattattgtaattaggttttacaactataaaacatgtgtaagtgctagcctggaaaagacaggaaggctgcgctgttgacatgcggactccacatgtcaacctaagggaccgcggtagaccgagtacacagagacggtcgacgggtcgacggaagcagaccccgtgtgtcaaccgaggcgagtggccgacaaatggactccacaagacaccacgtgggctgtacacgtggaaaccacgcggctaccgagcgggcacactaacacggtcaccacacgcataagcaaacgactaccgacaccggtacacgggtaccggggtcgacaaccgcacaacgggcacgggcgacaccgaaaggacgaggacggggcaacgaaggagagatccttaccaccacgcgacgaggcgagggaacgacaacgacgaacgggcgcggcggagacggccgggaatgacggagacaaaaggcgaggggacgacttcggcagcgatccttggacgaaggcgagacgcagccagcacaacgcttggcgacacggaggcgaggacgaagacaatgacggggctgcggcacttgacggaacgaggacgacgaacgagaacggcttgacagagggacgaacaccacgatgaccgggaacgacgggaggacgacgacgaccggggccggcgaggaggcgacgtgggcagccggcggtagctgcacggagacgaggacggcgtggaacacgccgctgcgaatccgatgacagaggcggcgcaatgagacaacgagccggcgaggaggaacgatgacgacgacgacgaacaccggcggggttcggtcgaaggggaggcgaggccgagggcgaccttgccgctgcgatgccagaggtggagatggcgacgtcggccgacgcacgggcacggcggaagaggctgccgaaggcgacgtcgacgaggaggaaggagaggccggcgtgggcgacggcgttccggcgaaattcgggcgacgccgtggcctggccggggaagaggatggcgccgcggtgccggggaaggaggtgacgacgacagccaccgtacctgcgaggtggcacaggcggctggaggcggtggagtggtggcgacaccactagacgtcgacgaggacaccgttccagcgagcttcggtagaggggacggtgaggccggtgaaggggacggcgttgcagagccgagggaggtgacggcacggccggacggcgcgcaggcgaggcggtaggggtggctggaggcggccggcggcgtgggagagagaaggaggacggtggagagaggcggggcggccacgggagagcgcgggagggggctaaaactggagaacgtaccgagggggttccattttataggggaggagagggagccgggcatgggagagggcggaacggcgacgggaaacacggccggcagccatggaaggcggccgggaatggcgcggccgttccgggcgattgggggcgccattcaagggggaaaacgggagaaatcaaagaggaatcaatggggattaattccccctatttaattttggaatcccatgattaaatcgcacggatttgagggaggaaaggagctagggttcacgggagagagaggaggccatgcgggaggaggaagacgaccggcgcgtgggccccacgcggtcagcgcgcgtgcaacgcgcgcgcggcgcgcgtgagggggggcggctcgggaggctggcgcggctgggtggcgcggcttgggccgggcggccgacctaggaggagaggagggggaggtggcctcggggagagagggaggaggagggagtgggccgaggggaaggagaggaggcccaagagaaggagggagaggaggaaagggagaggaagagagggaggaagagaggactttggccgcgggccgagagagagagaggactttgggccagacttggcccaaagggaggagggggattatttttagctctttctttttaataaactttgttaattgtttttgttgcttaataattattttcggtgctctgaaaattcaagtaaaatttgagggctccttttagaccaaggagaatttaacaaaaattctctgggccacattcgaatttttcttgtatgtattttagtgtttgccaatttcttttcgaattttaattaattctattattccttttagggaatgatttttatttaggaatgaatttatcaggacgtgacacgatctaagggatcggatcgccctgctccaggagtctaacttcgaactgagtggctcatcaaaaggtacacacaaaatctgtccgactaacttgtgctgtcatctttgtaacttcaattaaccggagtcaatgtagtgcaagccgccaagatatctcaattggagaagcagattcagactctggaaagcgataaagcagagctggcaaggcagagggactcggctttgaaggacgttgaaggtaccatcaatcttctatatactgactcattaatatgaatctgttgatgcagactgcaagatcaagtcgcaggctcaattcgacgtcctggttggcaaaatcaaaaggcttgaaggggccagggatgaagttgctaacgctgctaccccactcgtccaagctatgttcttcaataacaacggtccgagtacattcgatgcttccgaaatctttgacaagctgagagttgctccggatacatatttcaagaacatcaaagaggccgggagtatgggagcgagtctggcgctagcaatgaccaagtccctttactcgaaaatcgacattgatgccattgacggctttgcagacgggacgagcgaagaagctgctcttgaccttatcaatgatgcgcagaaagccgccgacaagatagcggtcgatgtagtcgagaggttccaggacaccgatcttcgaccgactggtcctgataactctgatgatgaaaaaactgatactgattgatgtaatgtgataaaaatgattctaatgaaaatgatggaggcacaatttgtataatactgatgaatttatgctgtgctcagtgtttcatacttagcttctgatttcttaaaagcttttgtcaagccttattgagcctaaaacccgcaaaagctattaaaaactttcagtcctcatggactaagccaaaaaattaagcaaggcaatgataaatcgagtaagcaaattgaactaataaaaatcacactccattattattatgatagcccccgactgatgacttcaaggaaaagcttgatgttgtcagtcaaaatagggaaatacagaaacaaaactttaggcataaaaacgacgaagatgttcgatattccaagaattgtcgataggtgtaccgtcttcacgcttgagtcgataagaacctggccgagtaacttctgagattataaatggcccttcccataaaggagataacttgtgccgatcccgtatagtttgaatttttctcagaaccaggtcgccgactaagaaggctcgcgatcggacgttacgattatgataacgacgcaacccttgcaagtatcgggccgactgaattaaggctgcttcgcgggcctcttctagtcggtgtaggtcatccactcggtcttctccgtagcgctcttcatgaaaattgcgaaaatgcaaagattcaaattctacttcactaggcaacattgcttctgctccgtaaactaagaagaatggcgactggcccgtagcccgactgggggtggtgcgcaaggaccaaagtacagatagcagctgttccacccatttgtcggtataaggattcagtcggtcaaaaactcgtgcctttattccttggagtaccatcccgttggctcgttcaacttgtccattgctcataggatgcgctacggaggcataacaaattttgatgccgaagtcttcacaaaaatctttgaatactccgccggtgaattgagtaccattatcagtgatgatccaattaggtaccccgaaccgatgcacaatgttgatgaaaaaatctctagctttatctgccgtgattatgatgaccggtttggcttcaatccacttggagaatttgtcgatagccacaaagagatgtgtgtaaccgctgactgcctttttaaacgggccaaccatgtcaagcccccaaaccgcaaacggccaggacagcgggatggtttgcaactcttgggctggcagatgagtttgtctggcgaaaaattgacaaccttcgcatgtccgcacaattttgtcggcatcggacacagcagtaggccagaaaaaccttgccggtaagccttgccgacaatggtgcgtgcagcagcgtgattgccatagataccggaatgtatatccttcagcaattgtctcccttcttctgaagacacgcagcgttgcataattcctgatggacttttcttgtacagctcggcctcatgaataatataaagcctgctgcgcctggaaatctgctcggcttcgtctttatcttgagggagttcttgggaggtcagaaatcgtatgaggggctctctccagtcggcttcaaccatagctatgtcttgagtgtccgcggcctcagctgtttctctccttggtacggttggctcataaagatgttcgacgaacacgtcagaaggggctgcttcgcgtttggatccgaaatttgctaatctgtcggctgctttgttattgtgccgaagaacatgggtgagttcgagtccatcgaacttatcctccaacttgcgtacctcttgtcgataagcgatcatattgtcatcaagacaggaccactctttcataacttgattaacaactaactgtgaatctccgcaaactatcagacgcttgattcccaaagagattgcgatccgtagtccgtgaaggagcgcctcgtattctgccacgttgtgagatgcagagaaatgtatccatagcatgtagctcagtctttctccagttggggaaattaaaacaaccccggccctgtcaaagtgcatagtccaatactccactccatcttttcctcgggcgtgtcctcttggcactcggtccactcggcgac

SEQ ID NO: 65430 - DNA, 1663 bp, Oryza sativa
ctgatatggagcttggaagacgagtggaatttgactagcaaggtattgactaggatttggttgtgtactagtcgatgctagagttgagtagcataacgactaggtttggtatcttctctagccgatgtcgacgaatatcaacacggctagaggaataggaagtttgtgtaggtttagcgggatggaagtattactccgacaaccgtgagtggcggcggagcggctaggatcacacggagcccgaatttgggttttgccgggctttacaactaattgttcgacgtcggggccagtagaccatacggacgtccacatagaaggtgcaaagttctaaccgacggattttattggctaaagggtattttgaaaataaaaggaaatatttgaaaggcaaatataagtttaactcaaatatttattaaaatggtatttgaataaattaaggaaattcaaataaaatcttaaaatagaaaatttggcatcaaaatgtagattttgaatttagatgaatttaggtccaaatttcatcggaatcggatctacggtttaggagatatgggcttctaaagaataggatttgaattaaataggaaaaagtgaaatagtactgtacagggcccacctgtcagtctttcttttcctttttcttttctccttcttccttcttctcgtcttcctcctctgtcacagggagacgagagagggattttggacaatttgccattcatttcgatgtagcattcccaaatgccatcttctcaaataacttggacaatttaccccaggtccccacaaaccagctctcctatgccattttacactcaatttcgggtcccatggctgccacatcaccaaccaaggtggcaatggaacacgaaatgtccatcttgcccctgcccctcctcaactgtcatgtttgtaacataaaaattacacaaaattgccactgacactaaaattgaacagctggtctcgtaggagcaccgttaacacatcctagccaaaatcccttgttcatgacatcccaagttcccaacccaaattgcacaacctgatcaaatatatcagccatattgcaccaaaattttataaattgagaaaaccacaacccaaaataccagccacaccaaaataacaagtattgggtttcaaatagcataggtttcaaatattgttttctgcattcccacatagcacgtctagtagcaagcatggctggccttaacattgttctttgctgccattaaatacataaataaccccatctttcttgagtccagttttttgtaacaaagagaaaaagacaacatcaattcttctgttctttcttcgaagtcaatttcttcttggttggtggtagtggttgtgatggagctgcttcagtcatagccaaacgcctccttgtcaccggtccaggtgaatcttgtgagcatccttctccagcaacagttggtgttctagctactcttgttgtttgactgaagaagagaaggggaaaacagatttatctcatacctcgttggccgttgcagtgctgccgccggtgaatcgacagcgccaccgccgccgcaggagtgagaccagaatgggacgagtgaaaatgagagtggagagggatctgtggttgaggctgtgttatgaatgagaggggcaggggcaaggg

SEQ ID NO: 65431 - DNA, 4106 bp, Oryza sativa
tcgttagtatttttatgattaaaaaatttcatttggaaatagaaaaacttcatataagaaatttttgaacatggatacaaactttaactataaataaaacttcaacggaaaaacttccaatacgaaatattgagcatgagaaagttttgctataatttgagaaaccttttattttttagaaaacttcccattgtgttcagtgagctaatcttatgacttatgagacctatggagcggttggttatcctatgtgaagccacataacgagtgattatgcagaaggcaaaagaaaagccatgctgagttattacattaatatttctaggtaaaaattacacacataattatatcatatcgatctcacgtaaagggagaagttgtatcaggaaaattggttgtttaaccgatgatgatgaataatattaatgcgaaggttaaccttggcattcgttaccgtaagagactaatacaattagttggaggtaaggaaaggaataggatgtagctagagaaaattatagcttttagtccattacttttaagtaaatcaccactaaaatattagaatttttaattgtccagacatggtccaccttggtgggtctaatgcgcgaacgcgcgctagcatcgaacctagcgaacagaaaacgacaaaaagaaaaatagagccgcgcaaaaaaaattgttttcctgtttctcgttttcctttcacgcgatggtaaaagataatcttttcctttttatcgtttttctgttaggaggtttgatcagattggattatactttttttttgaaaaatatattagtatttttaggctgtgtttagttcacaccaaaattaaaagtttggttgaaattgaaacgatgtaacgaaaaagttgaaagtttgtgtatgtaggaaagttttgatatcatagaaaagttggaagtttaaagaattattttggaactaaaaacggcattagttttatatttctagtaaaatttatgcactaaactttttaattatagatttaatttgtatataaagtttgcatatacaaagtctacatatacaaagtttatatattcaaagtccatatatataaagtttacatatatgaagtctcactttatatagaaaagtttccccagaaattgtttgtatagaaaatttccgttaagaatatataaaaaatactatgtataacgaaaaaagaaatatgagaaataaacagaagtgaaggaaagaaatagaaatacctattacagaagaatcacgtaaaagatgcaacggattacataagagaatcacgtaaaagaagggaaaaaatgaaaacggaagaaaatgatgtgtcctcatgtttggcgtgtcccttctgactgattcgccggacacgaaacgttcgttttcgctccaccttcatcttctaataaccaaaaagcctgcattattcggtttgtcacccttcccatttccttcataccagtgatatgttcataccagtacttaccaattttagcgatcttgggcccagcccaccaacaaaagtacttatgatggcccagcagtagcctttttaggcccacacggcgatcgactcgcgtcttcgcctcactccgccgccacgtcaccggatcccccacgcctcgcttcccccaccgcgtatgccgccgccggcgaggagcccggccgccggcgtgcggaggcgaggcgcgctcctccccctcgctttcctcctcctcctcctcctcctgctgctgcacctgacctcctcgcctgcccgctcccccaactccccgctgctccgcggctccggcgacggggagccccggcagcgcgggccctgcgactacgcgtccggcgagtgggttcccgacgacgacgatcccgcggtgtccggcggcctgaggtacgaccagacgtgcagggagatcttcaaggggtggaactgcctcgccaacgggaagcgcaacggccgggagctgctccgatggcggtggaggccacgcgggtgcgagctccccaggctcgacccgctccgtttcctggagtgccacaggaacaccagcattggtccgtgctcgttcccatttcgtgtgttttttaccactgcagcttgttctatggtgactagaatagtagaacttgaggagggagttatgtgcaaggtaaatgtggcgctgcaatttacaagctagatgcagttcattctgtagcgaggatcatttgacattgccaatgaaggcatctttgtggagtgtagcaacgtgcattgtgcgtgccgcttttagcttggaaagatcagcatggaaggaacgtggtttccacctgattaatttgcaattcaaggtagtatattttgccatgcgtgaattgtatgtcaaatatatagaagacgtgtaaatttttacctgcaatcttgtagtttgattatgtggcggagcatgttcagttgttgaggctctcatacatgtaaagaatcttagttggacaagaagtctcgacttgctgttcatgatttatgtttaatggtttgttgcaggatttgtgggtgattcattgaaccggaatatgtttgtctcgttggtctgcatgcttaggggggcgagtggggaggttcgcaagtggcgtcctgcaggagcagaccggggtttcacattcctgcgctataacctcaccctcgcatcccacaggactaatcttttggtacgctatggtaggtaagaagtgtcatttgagtaataccaaattatagttctttggaagtatggtgtactccacatcatgcaattcccttttgtgttacaactgatttaattatataagtacaattctgtgcccagtagtacatatttttgttctgcagctttgggcatttgctatttggctttcagttttggactgtagctgttacttactagtagtattggaatgcttaccagtagccagtagtaaacttttctctggtctgttgacaacggttggtcttaatattttcattaatttttaaatatagtagactctgccgctttcttaatgtttttcactgcgtcatagtttttctttcatgaggttgtggctcatatattgctgaggttattactcaaacccgtataatgctgatgttgtaggtggtcagccagtccaaatgggggtcccctagaatttcttggatccaagcaaggctacagagtagacgttgatattcctgaccaaacatgggcagaggcaccaagcttccatgatgttcttattttcaacacagggcattggtatgtgaacatcaatcataagccagataacatttttttcacttagatgcccaattaagtagatcctgatccatgaatgttatttcatgtttgaaaactttgagtaaccagttaacagcagaaatttattacgttaatcttccttgtactgtagttccaatatttgccttctccctcaaacctcggatatctaactagatattatccaccaatcaagatttgtgttgctattgatctagcttattaactaatttttgccaggacatatagtaatttggaaatacgcctacctttaacaaacactttccaagtatgagaaattaagtctggaagcttctcttggatatgattggccaatgtttttgcaataatttttgtaagaaatgttacgaagacttgtaggtctataatcagcaggagtggcaggactggatattttttggaattaaaacaatgttggtagcgtccatacctttttgcaaatttaactgcattgtagaactcctgtaccattttggtgacatcattctcaatccattgccaagctgctctataaaacgccacatttagcccatctagtcctggagatgcatctcttcgcatttgtttgaggatctgaaaattttgctcctctgttggaacttccggtggctcaaaagtgtgttgcccttgctgatcttgagaggatgtgactccttaatctgtgtttgaagtctggaaaagatctaaataagagataaatgttgagcaatttcgtcaggatcagttgttagatgattattatgcatgacaattggtatcctgtttttccttccccttttttgagctgcttgctgaaagaaagctgtgtt

SEQ ID NO: 65432 - DNA, 2057 bp, Oryza sativa
tgctctcaaatgtgtcattattgtagtactagtactacctgtgctgctacactttcatctcaagaagaaaaggagaagggagaagaaaaaaaaatgttgttaccgcagctgtaacttgtatactgataaatacttcctgtctttgaccgggcagagagtactgccacggtctgctgctactgtgtaagggtattcctaactcaataactagatggtgtccatagtattaaataagttgttatctatgataaaaaataatgtggcaagtgaataaataagaaaaaaagaagaaaatcatgtgttgcatctacacaacatccaagacattatgtgagataagtaacattaaattaaagtaggaatagtggtgtttgcattggaagagtaatgtctagtactagtttttttgatgatgtggagttcatagaaaccatgtctagtgttatgggttgggactgccctaacgtactactacttaattccactaaacaaccaccattacttatgctaatctatacttgctggatttggatgggattttgcattccataagcataatgatgctaatcactgcctcagctcagctcagatggtggatctctgtattactgcaggtttgtagagcatgggtagagtaggggcctgtttagattcatttggaatggcaaaagttttggtggcaaaaattttggcattgcaaaagtactggttggtgtttagatgcatgttaaagttttgtcattctagtactaaagtgagagagaaaaagagagagggagtggtctcaaagcattttttggtacaatttgctagcaaataccaaatgccaaattgccaacttttactactaatgtttagatctaaaatggcaaaaagtgctataaaataacaaaacttttgctattttagaggatctaaacagggtctagatttgtttagtgaacacaggctgcgttgcacctggggtcctggggaggctctggcctctgggcgtttcggatttaattttctttgtttcttccgatacggtggggcccacctgcagcgcgtcgggaccgaggagatcccatcgtctcgtattcggaagtattcgtatggatcggagtaccctggagcttgcacacacaggtttgaaaatgtattacgtcctccatcgaaatatagaagtagtactccatcaatctaatatggaacttaacacattattttactatattaaggccgagtttagttccaaagtttttttttaaactttcaacttttccatcacatcaaaactttcctacacacacaaacttccaacttttctgtcacatcattccaatttcaataaaacttctaatttaaacgtgaactaaccacaccctaaatccggtactagatcgttatgctatgagacaaaggcaatactagtatggtttggaaataaaatgaaaattttcaaaaaggtcaaattttggccctctagctctaaactctcactccagtgggagcgggctcctatgagagttggggacaagctaaaaagtgtttgtctagcattcagctctagatctaaatagaaaaaaaaaagggaaaaaaagcaatccccaatctgaagccctaggttgccgtctccgtgtgtgctaccggctgtcggccgcgcgccatcgcccgccactggacacctcccatgcgccatccccacgtgcgccgtcggtcaccgcccgcatgccgtccccccaccaaccgtgcgccgcccgtggcctaccgcgcaccccaagccgtcgactatgccgcctgtgcgcctggccgggtgggagaggtgaggattatgggagggaaagagaggtgagaggtggggtagttcggtggcatttttatgtaaatatgttgaaaaattaaatggtagtgggtcttttagattggagtggaactgtgccgcagcaaaaatttagctccacccccgtattttattttttatgagtagcttagctaactccacttccaaaaacggaggatctgaactgtttggcacagctccggctccgggtaaattagagttaggaactagagct

SEQ ID NO: 65433 - DNA, 4164 bp, Oryza sativa
taacaaataacttaaaacaagtgatttaagtaactttgatgcagaaagtttctagagaaatcatactattaaaagcatggtacgaataattcgcaaataatcctggccccatcaaccaaaaagaaaggggcccaacattggatgagctgacatgctggaatgcaacgaaattcaatctttgtaaataatctgtaataaatatcttaatatttattaaaacagggaatgtttgatatctagcaaaataacaagccagcaattgtttcaacatggcattatgtggcatgtgggatgtgcccggcttcccctttttctctgaaatcttgcttttgtgataagccagcaagcagtgtgtgggctatgtatatatatacatgggaaattgagatgtgtttatgtctctatcaaatggttactgttcggccatgagagcaaaaaagcatgggcaagtgcccacactttggcgacacaaacagtgactgcacactggcactttgctgggtaaagaattaacagcatacttagtttggtacatgtaaagattcttagaacaatatgccagtttgaaccaaaaaaaaggccctcaggaatatcatgctttaagtagctagtaacagaaaattgactataacaaatcaacaagatttactcttttctatcttttggggacaaggtttgttgtattgaggtgacaaaaaaggagaaaattaccggaggaattagtttgtgcttttctctgaataatcacgcacattgacagtcatttagaaagtagtcggaattattgccatagctggtcttgatgattgatctgtcacctcattctgaagtttacatgtttgccgaattgacacttgcctagattcaagatccgacaaggaggtcttgccgatcaacaagaggatgctgaacaatgacattaggctggcaatatctgaaaattcagagttcacaagcaaaaaacgctgtaaactatgatcgaaacaagcaggtaatgccgacgttgtgacgcgtatcgtcatctgatccttgaacaaacttcatcagaaatattcttccagggccaaaccagacaatgacaactcttgatcaaagtaaaataggttgaaaccttcattcatatccattgttcttggtcagatggaaacatagaatcaagtgtacaccgaacaaagaagatgcagcgtaagtagcaaaagaggacagaagtagcaacatcagatcagcctgttgcgtgatttggatcgataaacaatgccaatcgctgctcctttgtaagcttaattgcgacttttgctgtatgaactgctcgattcagagttaaaattaggtcatgtcattatattttaagatctcactgatgaagagattaagcgtaacatgtagtcgagttttccttgttggctttgtcgtttgtattaacttcatgcacaaagatataagaattttgcactcggattaccgacgccgcgtacaacaaatgcgttttcacatgattgatgctgaatgttttcagacgaggacttcactgaattactgcaaaaattacaagttttggtatgaatgttggactacagaattgcgaaaactgcagatgctaccacctgaaattcgtacagaatataataaaatgctgcgaagtcagacaaggaaacctggagtagtaaaagaactgaacaaacatttcgtttctcaccttgataacgtgttttacaactctcacaagttccattcttcggaagtaaatcacattaatcaggtgtctgaatgttgtttatacaaaaaaatatgctcacatttgaatgctttagtttaaacagaattgccagcgagcaaaacactgagttgaccagtatgataacattttagccttgaccactgaagatatatgcaagagcttctttagaaatccatatttgcaagagcatcttcagaaatccttttgatgtggccatcgtcagaattcttttccaagaacacatcttcagaactctgactagactcatatataagtactacttttacaaaaggcaaagtcagatttgagaagtgggagcaaaaaaaccacggataaaaacacggcgcacggcgatggcaatgcgctttttcagctggaatttgtctgttccagcgtcgtctcatgcagaactgcggagaattcaaaccaagatgtttataaactccacatttgtacacactgctcctgtcctgacaatcagagaggcagcaaagtcatgggattagattagaatcattagatattgttgagattagaatcattagatgttgttgggcgaggcattcaagtcagtccaggcaggtaggacgacaccactgaaagaaatgcaggtgcagccatggggttcaactgactgaaacaccgcaagagacaaggacatcagaggacagatgggactgtgagtctgtgacattcagtgtgagctcgagaaagtcagtgtgagtttatttttttctgctcccgtttgtccaaaattttaagtaatcattgtatcaaagtttgtcaaagtagagaatatcggagtagataatgcagggaatagttgtattacaatttgataaagtgagattattctattctttctcattttgtattggtatatgtaggatggcttaaaaatgaacttatttgtgacaaagtgagtacttaagtgagcactgtttgtttggaggacaagcaggtcacaggaactgccatcaattagtagacgatcgatgaatagtgtttgattttgttttactaatactaatatgccagttttgtgaggggcaggattgggtgatgcatgtatagcgaggtggtcaggttagcctgggatgctgagaaactgcaacgtaacgttgcattcagtagcggtcaatgtcagctggcagctgctcgtttggtttggtcaggaaccaatgcgaacgccgtctgtcgcgtaaacataagtgaaatatgtcaacggcttggcttggcttggggtggtcctgtagagtcacgggctggcattcatccatgcgtgtcaggaactcagtggtcagtaggagtagtaactcggtgcagttgctgggtgcaggtgagtcaaaccggcggtgggtcagcgtaacagcagcagcctcattgtttgttggatcggcccgcgctgccggccgtggtttcggttactgttcgcgtcaccgggcaccgcacactatagcagctagtcacgcacgcacacgctttttcccacctccttttcggcgtcggccggccgctctttgcctcttttccccggacaagccacggccccgttgccacacgcggcgcggcgcggccaccgcgccacgacccctcggcgctcgctgcgactgcgaggcgaggctgcagcgagtagcgacgcgcggtggcggcagcaagcaaattggcaaatgcgcgtgcgggtgggcgccgggctcgccaggacgggacatcatacggcggagtcgcggtcgatcggtcacgtgggtcgatcggccgtcgcgtcgcgtctcgatcggcgacgacctttttgactcggaggggaaggggacatgctggccaaaccagctacagtggctagctgcgctaatgctggtcttgggcttggcagcctggctgctaggggtacgtgcagatcacaggctcaacagtgacgactcaggggtgttcagtttaaggggctgtaaagttttgacgtgtcatatagggtatcgtatatggtgttcggatactaataaaagaaaactaattacagaattcgtcagtaaaccgcgagatgaatttattaagcctaattaatccatcattagctaatgtttactgtatcaccgcattgttaaatcatgtagcaattaggcttaaaagattcgtctcgtaaattagtcgcaatctgtgtaattaattattttattaacctatatttaatacttcatgcaggtgtttaaacgttcgatataatttttgtgtgtgaactaaacaggcctcagttacttcctactacagtactactagtactagagcaagtgtcaagtaccctacgtggtgtcatggtgtgactagagacatgagcagcaattccgtttgtagcgtggtactagacattagcatgccggctacagtagctgttttgcacgctgcagcatggcacgcggcagtgtacagtaccc

SEQ ID NO: 65434 - DNA, 4968 bp, Oryza sativa
caaagctagagcttacacgttctacttcagacaatgcagcagcttttccatctcaaggaaatcatccatcaggtcaatctcaacatgattgtttacaacatctcttgagctggcactactgttcttgaactgatcaagttcggctatcagagccgaggcccatgaatcagaatttctcatttcactgtcaacagtcagcatacgctccccactgtcagactggctatcagtgagagattccatgcaagcattgttaggcgcaggcctagaatcattggccaaggaagttcttcgtgtcagatggcgcagcttacggcattctgcctcaacccttgcaatctttttcacactttccaaatgttgtttacttgctgtctctgctgcttcattgctcagatctctttccagtgacagtctcttcaagtccttggctagcgtgagcagctcgatcttcaggcccttgttttccttctctgcagcctgaagtttatcctgcagatcatgctggacagccacagtggcagcttctaatttagcggcttccagctgctgctttagctcataaatatggttctggagctcagacttgtgagaatccaattcttgagtcttcttagcaactgcatcacgaattttctcctcttgttcttccctagcttggcgaagctgcctgacacattctttgagagcatcatctaggtggttcacttgatcatccaaagaggcattcttctgagttgaagcttcgagtaacctcttcagggtactaacttcagcttcagcttgttcccaacctacaagtaagtcaaaaataaagttcaatatgaatttggttccatattggaataaataaaactatgattttcttgagaaggtacaactgaggagacagacgacacactcactccacacacactaacacgcatgtgcagacaaacagaattattggttgatactactattttaactttgccaaagaactatttgaatgagtttcctctttcttagttctattgatgtcctcacatataaaattaattttgaataatgaagggaagccacagactcaataaatgcatgggatcacaataatgcaaaatgtctaaaatcatagtgaaaagaaagattacctgcaacagcctcttctgcaacctttgtatgctgcttcaccaagtcatctttagcattgatagtcaaaagggctgaagcaagcttctcactcaaactcttcacagaatcttgcatatcttcatctttgacatttgtgaagacatctggctgtggtgactgacaatgctgtgtggaagaatcatctgacacagtttccaacactagcttttcatttaaagattttgctgttgcagttccttgagtctcattatctgtaattcttgagcaaattttaggtgattggctatgatttggggaagcaccattcggaataggcttttcgccctggttttgccagacacagaaaaaatgagagtattttccgcaagcacttacaaataatttcaaattttaaatagtctacagaaaaagtaagagatttaatgattgtaccggagaagcaattcctccctcctctctcatctccggtctctctttcagagaacttgattcagacaactagagtatgctctcaagccaccaaagtggaaatcaaacatgtgacctgttacataagaattaacttccttaacaatgagataccacaggattctgaaaaaaaatctatatgttacattctatcctctggaaaactgcaagtcaaaaacattcaacagagctatagagatcagcactatcaaaacattcaagttaaccatgcaaaactgagggggtaacagatgttaatggtggttctttctatatgcagtgtgctattctggaatataactatctaggaacaaaattgaggcataagcctttgaagcaaaactccagaaccatgtcagatagctattaatttattaatttgagaatcacttataacttcagcgagcaaatcgctcctcgacacagcaataaaagaacaagatattacatgacagttaagtgctacattcatttacaatttaaatattatgtccaaatgccactacttgcgtaacattatccttagtttgttaatccacaaattacaattgcacttcatccaggcacctaactacataaagaatgcatcaataccacatgaagcataataaaaccatttgtgacaaggttatgttgcttacgaagtagaacattaacccatgcttaactcaaagcccatttgtccctatcagggaaaaggggcccaataaagaacccgctagaagtcttgggaacctttatatcttgtttgatgcatttaaagattgtgtaaccatatgtttggaagtacttagtagtctcttacaaaatcatataatcaggacgaatcaagtacaaacctaactactcaagtctatttccaaatattaaaactggcatgctatattgctattggttactggatgtctgatttctacaaatttattcattgacaagcgtgtgacaaacgagtgaccctgtaatggctggcccaacagcaacagatcaaattgcaaatttgcatgtcataaatctgtccaaagcagaaaaaatgacatctcagctagagatgccaacaggcaacagcatccgttatgtttattaaaatcagaaatcccaactttggttcttaagaaaagtttgttccccaagtctaattcgcaaacacctaaactatcaccaaatcatgatgtttctagtacagaagtgcagatgaatagccaaacagaattcagaatttcttttctcaaaactgaattcaaaatttcttagatatggatcccattcagacagaatttaactattgaggtgaacctgatcaccggagtgcaatgacatcgaaccagggcattcaaacttgtgcctccagagtcaactcttggagatccatcttgcaaccaccggtcatcagacaatcaaagcatcaatagtgatcacttggtctaccagccaccatcaaaaagcatggtttggatcactgaagtctgaaacacaaaccaatggagagaaatctcatcaataaacatcacattgcatattactaatgggattccttaataatgtaatgttgtaaactgagcaacaggcagtaactacaatcgtcctagggaagtaaaagtaaaactttaaaacgttgcaattaccaaaatgtgagcaatgcacaggatccgattttccactgtaatatacaatgtctataacttaatgaacacttcaaaacaaagataccaaggaacacaaaatccaacaaggcattgagtacgattccagaaaccaagagaaaaataatatatgcttgctgcaaagcacggtaatatcaaagtttttttttttagcaaacgtaaaaagtacaaaccctatcctacccttttctaagacaaatctttgcatcaaacgaacacatcaaagatcaaaatgtggctagtaaatactcctaaaacttcaaaaccaaatctggcagcacctaaaaccctacaaaaatgcatgccaaagcagaagattttacccaactccgaggcctcaaaacgagccaagaaatcaaaatcacttcgcataacgcaaaaacaaaagagagagagaacaattaagaaaccaccaaaaacgaagagagcaccgcgcgtaaactggattgcagcgcaaatcaaaatctcccccctttcaatctttggaaaaactgcacccgcaatcaaatctcatcaaaatcaagtctacgacgggtggagtgcgcaagatacagagcaaaaaacctacaggaaagggaacaaagaagagagattcagaaaatcggcgcaggtgaaggggaaacagggagcaattaatacctctgagaacccccgaattaaacccgtcgcctggagaacagcaaaaccaccacaagaaccatgtgaacaccagaccaaagttcagtttttttttgtctttactgctactactattctatctctttccctttctcctagtagtttatttgggataaagatcagagggaagaacagccgcagattcacattgctcacctcgcccacaaaatcaatcacagatcgaagcgaacacacgcggagaaggatgagagagaagcaagcacaggaggtaaaaaagcaggaggttactgtaccagagcagcagcatcaccatgaatgacaccatgcccaagaaaggaggaggagggaaaaaggccactgcttttgacgagatgagagcctcgagtgcgtagaaatcgcagcaagaatccaaaaaccgcctccttttttgcttccttttttctctcttctcttcttcttcttcttcgcggttcgcctcctctctttcccgcccaggcagctcaaaccaggactcactttcagctgctggtgttcttgcctcccctcctctcctctcctcttctactgctcttcaatgtgtcattattgtagtactagtactacctgtgctgctaccactttcatctcaagaagaaaagggagaagggagaagaaaaaaaaatgttgttaccgcagctgttacttgtatactgataaatacttcctgtctttgaccgggcagagagtactgccacggtctgctgctactgtgtaagggtattcctaactcaataactagatggtgtccatagtattaaataagttgttatctatgataaaaaataatgtggcaagtgaataaataagaaaaaaagaagaaaatcatgtgttgcatctacacaacatccaagacattatgtgagataagtaacattaaattaaagtaggaatagtggtgtttgcattggaagagtaatgtctagtactagtttttttgatgatgtggagttcatagaaaccatgtctagtgttatgggttgggactgccctaacgtactactacttaattccactaaacaaccaccattat

SEQ ID NO: 65435 - DNA, 820 bp, Oryza sativa
agaatgtatcttgtccaattataggttactcccttcttctcaaattgatcatcatataagggcaagtactataataccccatatgttgtccctaagagtgccatattaattgagtgatgaggtggaggagagaagtgagaagagagataatgagccacccctaaatcaagatacaacctccacacaaattttaaaaaggatgtgagagtattagagatattggtatttgtgtactagaggtgatacattgtatgggttgactcttagtttatgagtgaataaaatatataaaattagaggtggtaggcacctctagcatagcacttgccctaagtttatgcaccaagactaaggataatttaaatcacatcaaacaagacaccatgcacatattctcccacaatgtatgcatccattaaaaccccatgccaattacaccatagcatgcacacattctcccatactgcattaattgtattctgatgaaatccatatcatgcagttatatgatgatcaatttgagaaattttggattttattacatgatgatcaatttgggaaggagggagtatacaactgtggagtacatcggaatccggtgttttgtgcgaacacaggattccaaattaggtgctcttgctgctgtccacaaaggtttgcaaatggatataagagcaggtataacggatgagagagaagagtagcggggatacagaggaaagagaagagtagcggacaacacggactccaagatacaatttgtgtatgacagatgaactaaatattaatagtgtaatatatgtttataggtaactattat

SEQ ID NO: 65436 - DNA, 2794 bp, Oryza sativa
aaaattgtgatgattactaatacaccatatctggacaaatgttcattctaaagggttgagaatgtcatatgcaagactgacaaatggaaaacaatatcttttttttttaactttttgataattcataaactaccatcctgctttttcatgcacagattgatctacacaagctcgtgaacacattgagcaacatgactcccccagggatatcttcggtgcggtcctcgaaactgctgcacaggcttatggtgaagatgagagtattgaggacatgcttgaagagcttgtcagtgacccagaacttacagatgtatgtttccaaaatccccccatccaaatttagaataagctctaatgattttcataggatgccatatagttgataccgtagggtgagattgtttagaaacatacattaggagattatgttatactaatatgtatacatatataaaaaggcaagagatcattttgtggtaaaataagtggtatatgcttcttatatgatcttttgtcaaaataaataaaaaatctgataggattttgcagtaccttgtttgcctttttttttctttttagaaaactttgtttgccttctgattaaccctaaactgctgcaaatatatgctaggactacctgaaacttctgctccaacaagttcgccagaggatacagtcggcatctcaatccgggaaccagtcttgagcaatcatggcaaagaaggtgatccagatatagaggtgattgcataggcaaggtggttgaaccatgcaggtattcactgcagagtttatattttataagttgaaaatggacagaacccagtgtttggtttggtggtcatgattaggcgcctccgtggatgtacatgtgccgtgttctctaattttggcctcagagatgatgtttacaccacccactgcacttgctttaaatgttttacagattttgttagtggtacatagctatcatcaagagctttagatttcgtggaatttatgtggtttgctgatctgtcggtaatttaaaatcgtttgtcgaggtggtgttttttgtttgtcatcttgggaatcatgccaggttgccttgcaaattcaggttttggaaatgggcaagaggacaggctatataggccgtccacagggttgtgcttcacttacactttgatacgctagataaaaggactcctggagcttgaggtaatacgctaaagcaaaggtcgctgccctcatgcgaataccagctacaggcacaaaggcaatgggcagtgaaatgagcacacaaaactctgctcatgagataagtggggcgatgccacagacattgcactacagcgagcaaaagggcctggttacgggagtatagtgagtttcgtgatgggcaaagagtacgatcgccaacaaacagcccagctctgtaacgatcgtagcccgtaacgtttacaccgcgtgtcaacaaacccatgttgcctcatgggccaacgcggatgcttagctactttagaactgtaaactgttggggatgcattggagtgggcaccaggtgttgtagagcaagtttaagggcatatgttcaggggagcttttagctgctgcagtttcttccagaattagaagctcctccaaacagttcagcttttggtccagattctgagaagttgtagaatccagaaaatgaactagaagccaaaagctaggaaaccaagcttttccaaattctcagaagctggctactaatcaactgcttcttataattttaagcttgagaatacgactaaggcaaagagccaggatcacttggttaaagcatggagacgttaactctaaattcttccaaatcaaagcaaatggtagaaagagaaaaaatcacatacagatccttcaaactccagatggctttgctgtaactaaagatcaaaaggaggaagaattgaagcgttacttcacacaaaaattaggagcctttgctctcagaaatcagagattaaacttggctgctctcaatctccctacgcttgatctctcagatctcgatgataacttcactgaagaagaactcaaaaatacaatctctgacttgcctttggaaaaatctcctggaccagatggatttattggagcctttttcaaacaagcatgggacataataaaaacagatctcattcaagctatttccttctttggagatatgggatgtgcaagactgcaagaactcaattcggcacatatctgcctcatccctaaaaaggcggatgcaacaaaagcggaggatttccggccaataagtctaatgcatagttttgcaaaaatagtagctaaattactagcaaacagacttacaccaaaattagatgagctagtttctcaaagtcaaagtgcattcattaggaaaagagcaatgcatgacaatgtcctgtttgtgcagaacatgatcaaatcgtttcacaggaaaaaaaagcctactcttttcctcaaagttgacatatcgaaggctttcgacacagttaattgggcatacttgctagaggtccttcaaatctttggctttggacataaatggtgcaactggatttccaacctactgggtactttctcttctgcggttcttcttaatggtatcccaggtcaggaaatagaccatgctagaggtcttcagcagggcgatcccctttcccccatgcttttcatccttgcaatggaaccccggcacaaattattcaagaaagcagaggatcttggccttctctctagtctgcaaagacagcggcgcttcagatgttctctctacgcagat

SEQ ID NO: 65437 - DNA, 631 bp, Oryza sativa
aaatgccgagaacatgccacagtaccttattattcttatggtatcatcaagttatcgtgacaagacatgttagccataaccttttaatttttcactgcatttccaattcaaaaaatgtgcgtggcatatattaactacaaatagttggtactggtttgaacacttggccttcctctgaattttttaccttccttttgtctgtctgcagtttgactgctgggatagccggtactggtttgaacacttctgttggattaccacctgcatcagttcttggtgctcctccagtcgctgcatctgtactgcctacagtgcctggtcttggttcagttcctggggtgtctcttccaattactacccaagccattgagacagccccacccagtgaatgcctattgcttaaaaatatgtttgatccatcccgggaggtttgttcttactactgcattctttttttttttgggttcaccaacagtccataccttttttaaaaaaaatctttactggtctggatcccttctggttggttgaataaaaactaattgaaacttactttatttgcagacggaccctgaatttgatttggatatcaaagatgatgttcaagaaaaatgctccaagtttggccaag

SEQ ID NO: 65438 - DNA, 13798 bp, Oryza sativa
ccgcgccaaccgccgccgccgtaagcttcgccgccacaagagctttcccggccgccgcctcgcgtcgccggaatcccaccggagcgcctctctcctcgcgagccggtgagttttttccctcccctccatctccggccggcaatggtagccgccgtggtcgtcgtctcctctcctaaccccctctccgctccctcccaggtgtcgccgccgcccgtccgcgcctcggcatcgtcggtcgtcaccgccacccttgttttccgcactggtcgccgccgcctctccggtgaggactccctctccctcccttttctccccttcccgcgtgcgccaccgcctttggccgtgccgccgcctttggccgtgccgccgctccggccgtccgccgccgcctttcgcgccgtccgccgccgcctccctccgccggtcgtcgccgtcggcagccgcgcgcgccgccgccggtcgccatggtcgccggtcggctttgaagccgaaccgagccaaccgggtgccgcccccctcttcccccttgagccactgcccgtggggcccacatgccggcgccccctccctctccccttgtgccgctgacatgcgggccccgcctgtcggcacagctcgcccaccctcactgacgtcaccccccctcactgacatcagccctgggtattattgcgcaataaaataattaaggacttttactttattagtaaaaacacagtttatcttctaaaattcataagtaattcactcgagctccgtttaagtccattcaagtctcagtaaattcataaaaatgcaaagaatctattaaaaatggttttgtttcctgtttcagtagtcttatagcatgttttgcttgtgtgctttgtttgtcgtgtagttttcggccgtttcgtcgatccgcggtttctcgaagacgttgctgaggtctcatcagtgtgagagcaaggcaagtcatgcattacaattgatcatattgtacccaatttacaaatatcccgcatttctattaaatgtcgcattcttttacaatgtcatgtgggatgggtcctattactcagccatttattgtttaccatatgccattgataacttgggtatcaaaatgattagatgttggtttaggaaatgcttagccatgcttagctcaactagtacacaaatggggatcacattattacatagactttggctatgagcatagttttggattggtgtcaccgcaatggtgttagttaattaaaatacactgaatggtgggctgtgggtgcatggttttgctggtcgcacccatgacagttaaggaccggttcacgggaaaccctgggagacttaccgtgcttaccacaagcgggagtgggtaactgcttgatctgaagtatagctcgaccctttcctaggcaccggtggcgagggtgggcgtgatggagttgggtcggccggggtgtccggttgtccagctgctggattcaccgcggcgcaagaggggaccgcccactgccttttgaggggtgggggtgaaaccttagcgtggtgtggatggttaggggagggtcttgtcacgatttccccctttgcagtatcatggtgatacttcggggcatggcgacatgtgtggaatcgtatcttgtgggtacagttgtacacctctagccagagtaaaactattcgaatagccgtgcccgcggttatgggtgatcaaccagattcatcgtgattagtctcacccctagtttagcttaatgaactggtgtagttcaggtggttggttgggcttgttgcaacgtggtgtagcgttggacagtgattggttaatattgattaattactacagctgttttactgctttcaactactgcttttaaatgctagctttgtgcaaaagaacccctagccttctttggttatatcctacatcatacctcctcttccggtatgacttgctgagtacagtgggtagtactcagtcttgctctcttttcccccacaccagagctgaaggtctttctagttggagctgtcttgttgaagttggttttgtcgctgccgtcaaggattgcctgtggagtggagtcgccccgctgctgaagtcaagcttcccggtttagctcgcttttatcttttccgctgcatttgtaatcttttctatttttgtaagacgtggatctgtatgtcaacaattgtcatttatgtaccctggctggtcctggacagggatttaatgcacattcagcttcgaaattctggttcgtgaatttctgggcgtgacaagttggtatcagagccgaccttgaccgtaggacaagccaactggaaacctaagagccctctgaacccctttttcatctgcatatgccttttgcacctggaattgtttcgggaaaatttggagttttgcctctttggtttgcgggaaaaatcttggtcgttcattcggatctgatttttttaaaaaattagctcagtctagagctttagaaaaattttagttggagtttattcgacagtcagtcgggaatctattgggggttatgcattaggtcgtgtctatgttcgatggggcaatgttatgcgcatcattttccatgcatccagtctatgcattaatttattgtttagttgcaattgtgtctttatctgggttcatgaaaaatgttctatgcataaaaatcatcatgttcagttatttgtttgagtcatttgttgcttcgtttaatttggattcgagcatgaattggttcttatcccttgtccatctttagatgtcagtcctatccctcgattgcaagcgccgctccgagcttcagagtcgccgcccttagctttattgtcttcctagttttgtttgcctgctagtttccgtgcataggtttgttgctggtggattagtcggcggtcgatatcatgtgtcagtggtatggttgcctcaattaggagttgtgtgcctctctttcagtgttttaatcacgattaagataattgcacttaaacttataggaaagattagtttctgagccccctgtttttcttccttttctcatatttctacctatccccctccagatggtgaagacaaggaatggttcccgtgactccaacaacgccagtggcagcaaagagcagatcagtggagcatgtgccaacgatgcacctaacagcagttcatccccactgcccgagaacctaacgattgctcaggtgttggacaatcaaactcagatgatgacgatgatgatgcaacagatgcaacagtaccatcaggtgttgcagcaggtgcagcagcaagcacaacagcagcagtagaaactgcagtttggtcttccaccacctcaatccaaactgttagaatttctccgtgtcaagccgcccactttctcaagtaccaccaacccaatcgaggccaacgactggcttcatgctattgagaagaagctgaaccttttgcaatgcaacgaccaagagaaggttgcttttgctacacaccagctgcaaggttccgcttctgtttggtgggacaactacgtggtgacccgtccagctgggacagaggttacttgggcagagttttgtcagagtttcaataaagcacaggttcccgagggaattgtggcacaaaagaagagagagttccattctctgcaacaaggaaccagaacagttatagagtatttgcacgagttcaaccgcctcgcgcgctacgctcctgaggacgtgcgcactaatgccgagaggcaggagaagtttttgtcgggtcttgatgatgaattgaccaaccagttgatctcccgagattatgaggactttcagaagttggtggacaaagctatccgtcaggaggagcagggtaacaaaatgaactgaaaaaggaaggcatctcagtttagaacttcccaggggaacagtcagaagcctcgcttcatgatgggacattagggtggaccttccaccatgattatccggcagcaccgtccctaccacccgggtagcttcggcaggatctaccattgtggcagtcacggcaacagcgagaagcacagcctcaacccgactccaagtccactaatgtttccagctcagtcagtttagccagctctgcctgctcagtcaaaacagcccgaggagttcgaaggaaagcccgaactctgcttcaattgtaacaaaccgggacacacggttggaaagtgcccgaagccaagacatgctggacccaagtttgtgcaggcccgtgtcaatcatgcgtctgcagaggaggcacagtcagcaccagaggtcatattgggcacatttcccgtcaactcgacaccggcagtaatattgtttgattctggtgcaactcattccttcatttccaagcgttttgctggtgcacatgggttatctttagtgaagcttaagatacctatgcgagttcatactcctggaggtggcatgaccacaactcactattgcccgtcagtgagagttgaaatccaagggttgatttttccagccaacctcattcttctcgaatctaaggatctagatgttattctgggaatggattggctaacaaggcacagaggagtgatcgattgcactagcctcaccatcaagttgaccaatgcgaagggagaagtggttaccttccagtctccagtgccacagaagccagggatcagtctgaaccaggctgctattgaagaacaagaggtagcagtggagaaaaccactaagaagttggaagatattcccatagttagagagtatccagaggttttttcggacgatctgacaacaatgccaccaaaaagggatatcgagttccggattgacttggtacctggaactgcaccgatccacaagaggccttatagaatgggagccaacgagttggtggaagtcaagaagcaagttgatgaacagttacagaagggatacattcgcccgagcacgttgccttggggtgctccagttatctttgtggaaaagaaagataaaaccaaaaggatgtgcgtcgactactgcgcactcaatgaggtcactattaagaacaagtatccgttgctaagaattgatgatctgtttgatcagttgaaaggagctactgtgttctctaagatagacctacgatcaggctatcaccagttgaggatccgcgaagaggatattccaaagacagcattcatcactcggtacgggttgttcgaatgcacagttatgtctttcggactcactaatgcacctgcttttttcatgaatttgatgaacaaggtgtttatggaatttctaaacaagtttgtcatggttttcattgatgacatacttatctactccaagttcgaggaagaacatgtgcagcatctccggctaatacttgaaaagttaaaagagcaccagctgtatgccaagttcagcaagtgtgacttctggcttaaggaagttcagtttctcggtcacatcgtgaatgctcaaggagtagctgtggatccagcaaatgtggagtcagttaccaaatggaccctaccaaggacagtcactcaggttcggagtttcttaggatttgcgggctattaccgccggttcattgagaacttctctaaaattgctaagccaatgacacagctattgaagaaggaagaaaagtttatctggtctgcagaatgcaataggagttttgaagaactcaaacgacggttggtgtctgcaccagtcttaatcctgcctgatcagacgaaagatttccaggtctattgtgatgcatctcgccaggggctaggatgtgtgttgatgcaggatggcaaagtggtttcttatgcttcacggcaattgcgtcctcatgaaggcaactacccgacgcatgatctggaattggccgcagtagttcatgctttaaagctttggcggcactatctcatcggtaaccgttgtgaggtatatacagatcaacaaaagtctaaagtacatcttcactcaacctgatttgaatctcagacagcgaagatggttggagctgatcaaggattatgatatgggaatacattatcatcccggcaaggctaatgtggttgcagatgccttgagcaggaagagctactgcaatgttgcatgggtagagcaactatgttgtgaggttcaacgcgatttggaacatctgaaccttggtatagttgagcacggattcgtggctactctagaggcacagcccacactggtggagcaggttcgcatagctcaagcaagtgatcctgaaatagcagagctcaaaaagaacatgagagttggaaaagcccgaggttttgttgaagatgaacaaggaacaatctagatggggagaagattgtgtgtacctgaaaacaaggagttaaaggacttgataatgacagaagctcagcaaactcagtattccattcatcctggcagtaccaagatgtaccaagacctcaaagaaaaattctggtgggtcagcatgagaagggaaatagctgaattcgtcgcactctgtgatgtttgccagcgagtaaaggcagaacaccaaaggccggcaggtttgctacagccacttcagattccagaatggaagtgggaagaaatcggaatggatttcattacgggtttgcccaggacatcatcggggcatgattctatttgggtagtcgttgatcgactcactaaagtggctcacttcattccggtgcatactacctactcagggaagaagttagcagagctttatttggcaagaatcatgtgtctacatggtgtacctaagaagatcgtgtctgatcgaggaagccaattcacctcaaagttctggcagaaattgcaagaagaattgggaacccgtctgaacttcagcactgcttaccatccacaaactgatggccagaccgagcgagttaatcaaatattggaggatatgttgagagcatgtgcccttgactttggtggagcatgggacaaaagcttgccgtatactgagttctcctacaacaacagttaccaggctagtctgcagatggcaccgtttgaagcactgtatggacggaggtgtcgtactccgctcttctaggatcagacaggggaacaccagttgtttggtacagaagttttaaatgaggcagaagagaaagtcagagctgtcagggaaagattgagaatcgcgcaatctcgacaaagaagctatgcagacaaccgccgaagggagctcgttttccaagcaggggattatgtgtatctccgtgtcactccgctcaggggagtacaccgcttccaaaccaaaggaaagttggcaccacgctttgtgggaccatatcggattttggaacgcaggggtgaagttgcttaccagcttgagcttccctccaacatgcttggcatccacaatgtgttccacgtctctcagttgaagaaatgtttgagagttcctgaggaacaggcaagtccggatcaaatcgaaatccaagaagacttgacgtatgcggagaagccgactcgtatcctcgaaaccagcgagagaaggactagaaacaaagtaatcagattctgcaaggttcagtggagtcatcactcagaagaagaggccacctgggaaagagaagatgagttgaaggccgcccatccgcacctcttcgccagctcttccgaatctcggggtcgagattccgtttaaggggggtaggtttgtcacgccctaaagtttccccctctccttgctttaaaaattggctaaataaattgctcgaagaaattatcttaattaacctagagctaaatccctaattaataaaggcatttaataattggaattggcaatgtgggattttccttgagttcaacatgtcacaatacattaacaggatttttagtggaattttcagagccttggaaataattttaaccaattaaaaatcaccaaagtgcaatttttaatcctaggaaaatcctttttctctttttcttttcttttccctctttttttctttgttgggccgtcggcccatccctctcccgcggcccctcctccttgtgggccggcccaagccgcccctccctcctctctcgggacgccgacaggtgggccccacctgtcggtcgtctcctacctccgggaaccgccgctgccgtcgaaaccgcccacgccgccgccgccgtttcccgccgttctccgagccccactccgcccgtgccgcgcgcccacgtcgctgccccactcctccgccctccccgtcgcacgcacgcacgaagtgggcaggattcattttgaatcccaccccactctctttctctcctctccacgtcgccggcggtttcagccatctccccggccacatccgcccctccctcgcccataaaaaccctcccccgagtcccctccctcgtttcccccatttgccgacctctcccacgcccacaaccgaccacgagccgtcacacccgagcttcgccgcttgccgccgccttcggccgcgcgccgccgccaccgttagcctttccgccaccgacctataccggccgccatcatcacgctacggaaggccaccggagcgcctgctgctactaccagcctgtaagtcttatcactgccttccatctccggctggcaatggtagcccccgtggtcgtcgtctacactcctaaccccctctccgctccctcccaggtgtcgccgccgctcgtccgcgcctcggcatcgtcggtcgtcatcgccacccttgttttccgcactggtcgccgccgcccctctggtgaggactccctctccctcccttttctccccttcccgcgtgcgccgccgcctttggccgtgccgccgcttcggccgtccgccgccgcctccctccgccggtcgtcgccgtcggcagccgcgcacgccaccgccggtcgccatggtctccgctcggctttgaagccgagctgagccaaccgggtgccacccccctcttcccccttgagccattgcccgtggggcccacatgccggcgcccctccctctccccttgtgccgctgacatgcgggccccgcctgtcggcgcagcccgcccccccctcactgacgtcagccctgggtattattgcgcaagaaaataattaaggactttttctttattagtaaaaacacagtttatcttctaaaattcataagtaattcacctgagctccgtttaagtccattcaagtctcagtaaattcataaaaatgcaaagaatccattaaaaatggttttgtttcctgtttcagtagtcttatagcatgttttgcttgtgtgctttgtttatcgcgtagttttcggccgtttcgtcgatctgcggtttctcgaagacgttgctgaggtctcatcagtgcgagagcaaggcaagtcatgcattataattgatcatattgtacccaatttacaaagcataaaattgcaatgtatgtttatgttggcaacttttttttgacaagaagaaaattacgatcgggacacctaaagctttgtggtgatatggagtcgtcaaccaccccgatctagcaaaagctaaatcaagatgggttttgtagaaaaaagctaaatcggctagcggagtagatttagagatcaaaatcagactctagaccgatttagatcgatatgaggataactacccgtctcgtgggcaaacggaaggtttacgggataaacctacaaaggggtattgcactctcgtagtgatcatgggcgaatcgataaagatggactaaactagggtaaagttgcaaacattgttgaaaagtaaagttaaaagaacgattcaatagattgtagggactgtggtctgttttgaatcgaacaggccttagcccttataaaggggttgggttgatctagcattctataggtcctcctccatgtctagaggaccacgtccaactaagggtagaaaacaatggaaactcaaaaaatacatttccaagcaaggaaatccgagacccgatgaaaatcagctcagactcggactctaccggtctggtcgaacacatgccaccagtcaaaccggccctacacgctggtcagaccagccccgtgaaggaaacccgacgccttccatattttggcagattccctatttcgactctaggtgccaaatttgagtgtaaaacacatgcccccactgcctttttgatgaacttatgactaaaagcatagaatatgtagaattagggcgataatctaattactggccatacgggattccaagtgcctagtaaatcgttctctttgttttttcctaacaaatcaacgatcttctaagaacgattcatactactcagtacagacattcccaactagatgattacccaaaaagcactttacacttaaaccctgacgataaaatgtcaagtccttaatcttgaaatgatttcactctaattataaactttggatatcctctcttttcatctttcaagtaccttccaaagtcttccaacatttatcagtcgttttatcattattattctattgtagttgatagttgttactattcaatagtacatggagagaatattactgcataactgaacttgttatattgagcgtccgctctcggggatgatacatagaggttatatgggtagagataaggaaggatctttcttagagatatgaagactatgatacaaatcaattctattccaatataattctaactaccatataatctaacagtgataaatgaagacaatagaaccaaccaaaccatgagatacacaaatatccctggacctcaatggccctaccctttcaccactttgtaccgccttcctctagtccctacgttgaccttagaaccactcgactttggctcgtgtccttatgttataatgtcaaacacatggttttataatgtttttagactggtttcataatgttatgcttactcaatagtatgttttatattttgcatagttaagctattgatattccaaaaatctaatatagtatttgttttcgattttgaagtgactctctctcatcatcttaatttggtgtcgggatatggtggatccaccgcttgggctcatcggcgttaattacaaataaccagtggaaatagaaatgatgaaaatattccaattgagattataaaatgagtgtgaaccaatttttatgattttattctttttaattagattattgtgggaaattatgtttttctaattaatgtggtaattttaagttttttttcatcctttcaattagtgtggcaacttctatgaggcctaccgatttgtacaaagaaagatttcacttgccaaaagaattggatttcctttgagataaacgttaattttcataaaaataattgatttccccatgcatctttctaaccagggatggacaaacatgggtgttgggggactcgagtccccctactccgttgcccattggatcaccattgataaaagaagagaggggaggggggaagaagagggagaggagaaagagtagggggctgaagaaggaagaaggagacgagtcctccctctaatcttatcctggatccaccccttttccaaccacattataattaaaacattagtatacatcactcgtatgctagtttgatcagcatacaattatattacaatataagatgtcggttagtacttcacaaccgacaaattactaggcacatcaaatgtgcaaaaagccaaacatggtatataacagtacatactcacactttgttggattcgataccatgttttcacctatatagtgttcactggagagggttatttagattaaaattaaatacaccatataattgatcagagcaaattcttagccttgtccaccaccacttccagagccacctcctattgcagaacttgttgatccaaccccactacctcctccgcttccgctactaccaatcacgctaccagaacccccgccgcctcccactgcattcccagcacggccaactccatttcctccaccaaatccacctccgctacttcccgcactttcacctccaccagcaccaccaccaccccctgtgcttatactcactccaccatgacctatatggacaccaacaccgccacctcctcctcctcctgcgtgcacgccaccaccgttaaccgcggcacctcctcccccaccaatccccacatccaccccaccatgacccacatctatgccaacacctccacctgccccaccacccacacttgcgccaccaccacgtgtagtgccggctccacctccaaagccaccgcctataccaattgatatgtcgtgacctccatggctaatactcacaccaaaaccccgcccacctcttgcgccatcgccacctttgatggagaaggccttgctatcattgagggtgtttttatcggaaaggaggagccgcgcgtgcgcaagagggagaagtgagaagcagcacaatagtataactgagatggccagtctgcagggtgtggaagtagccatggggaactgcctgtattattatgcaattgcacgtagctgatccaaggcactaccacggctatatatattcaggaaaagtgagactgaagtgagctgtgccgcacattagcccttgtcgagaaataaagagcaccacatggccaagaaaactgttcggtgtacttgtttagccttatgaatcaaagcttatgatatataaaaagagtaaaaacatgaaattttaaacatatatatatatatatatataccattatatttctgagattataatttcgttggccaatctccatcatattggtgaaattacaaaaaaaaaaatcccatgacaaattgacagtagattaaaaacagtaacaagggatgtacaaattaaagggtttagcttaaactttcataagctatgcacgctgggtagacttggcttataattcggttttgctacaaaaaataagtgtcaacatattctttttacctgatttcaattgttttttttcccaccatctggtgcaagtctgatggtatctccctcatctcatccctcttgatttatgtaggtttccatttttacttgtgtgttactctcctcttcgttataaatataagggattctgagatcgttaaacaatttaagccagataggaacacaattttgtacccctcaaaagacagtggataggttttgattagtgcaagaaacatgattaaagaaggttacccgtgcaattattgatatccatgagttaatatgtggtgtactacctagaatctcttatacgtgtgggcaaaatttggcggtagcgtgtgtgtattcgtaaggggtgtgtatgtgcgtacgtttatgagtgtttgcgtttgttttgtgtttcttatgaaaaaaaattcaaaccttagaatcttaatattatatttgtggatggagggagtaaaataaaagcaagcactcgattttccttttaaggaaagcgggcgatcgaccattttagtgacatttctcctgtatgcaatgagtactcgaaatattacgttgtaaaactggaatttagagagtaaatattgacaaatttgacattttttattagcattatatcaacatagatattgaatatagtagcatataaataagttccactggtggagaaaccatctttcgtcggtcggccgatttccacaatagtcccggatgcaataaaaaccggggctaaagatgatctttagtcccggttcaaaagggtaacgggcatatttgatctttagtcccggtttgtgttaccaaccgggactaaagatcatctttagtcccggttcgaatgctgtcaggacctgtcaggcccccccggatctttagtcccggttggt

SEQ ID NO: 65439 - DNA, 99047 bp, Oryza sativa
  unsure (1)..(99047): unsure at all n locations
aggtgtcccgatcgtaattttcttcttgtcaaaaaaaagttgccaacataaacatacattgcaattttatgctttgtaaattgggtacaatatgatcaattataatgcatgacttgccttgctctcgcactgatgagacctcagcaacgtcttcgagaaaccgcagatcgacgaaacggccgaaaactacgcgataaacaaagcacacaagcaaaacatgctataagactactgaaacaggaaacaaaaccatttttaatggattctttgcatttttatgaatttactgagacttgaatggacttaaacggagctcaggtgaattacttatgaattttagaagataaactgtgtttttactaataaagaaaaagtccttaattattttcttgcgcaataatacccagggctgacgtcagtgaggggggggcgggctgcgccgacaggcggggcccgcatgtcagcggcacaaggggagagggagggggcgccggcatgtgggccccacgggcaatggctcaagggggaagaggggggtggcacccggttggctcagctcggcttcaaagccgagcggagaccatggcgaccggcggtggcgtgcgcggctgccgaccgcgacgaccggcggagggaggcggcggcggacggccgaagcggcggcacggccaaaggcggcggcgcacgcgggaaggggagaaaagggagggagagggagtcctcaccggagaggcggcggcgaccagtgcggaaaacaagggtggcggtgacgaccgacgatgccgaggcgcggacgggcggcggcgacacctgggagggagcggagagggggttaggagaggagacgacgaccacggcggctaccattgccggccggagatggaggggagggaaaaaactcaccggctcgcgaggagagaggcgctccggtgggattccggcgacgcgaggcggcggccgggaaagctcttgtggcggcgaagctaacggcggcggcggtttggcgcggcggcgactctagcggcggcggcgcgcggccgaaggcggcggcaagcggcggagctcgggtgtgacggcgcgggcgcggtagagggcgtgggagaggacggcaaatgggggaaacgagggaggggactcgggggagggtttttatgggcgagggaggggcggacgtggccggggagatggccgaaaccgccggcaacgtggggaggagagagagagagtggggtgggattcaaaatgaatcccgcccacttcgtgcgtgcgtgcggacgggaagggcggaggagtggggcggcgacgtgggcgcgcagcacgggcggagtggggcgcggagaacggcgggaaacggcggcggcggcgtgggcggtttcgacggcagcggcggttcccggatgtaggagacgaccgacaggtggggcccacctgtcggcgtcccgagagaggagggaggggcggcttgggccggcccacaaggaggaggggccgcgggagagggatgggccgacggcccaacaaagaaaaaaagagggaaaagaaaagaaaaagagaaaaaggattttcctaggattaaaaattgcactttggtgatttttaattggttaaaattatttccaaggctctgaaaattccactaaaaatcctgttaatgtattgtgacatgttgaactcaaggaaaatcccacattgccaattccaattattaaatgcctttattaattagggatttagctctaggttaattaagataatttcttcgagcaatttatttagccaatttttaaagcaaggagagggggaaactttagggcgtgacaaacctaccccccttaaacggaatctcgaccccgagattcggaagagctggcgaagaggtgcggatgggcggccttcaactcatcttctctttcccaggtggcctcttcttctgagtgatgactccactgaaccttgcagaatctgattactttgtttctagtccttctctcgctggtttcgaggatacgagtcggcttctccgcatacgtcaagtcttcttggatttcgatttgatccggacttgcctgttcctcaggaactctcaaacatttcttcaactgagagacgtggaacacattgtggatgccaagcatgttggagggaagctcaagctggtaagcaacttcacccctgcgttccaaaatccgatatggtcccacaaagcgtggtgccaactttcctttggtttggaagcggtgtactcccctgagcggagtgacacggagatacacataatcccctgcttggaaaacgagctcccttcggcggttgtctgcatagcttctttgtcgagattgcgcgattctcaatctttccctgacagctctgactttctcttctgcctcatttaaaacttctgtaccaaacaactggtgttcccctgtctgatcctagaagagcggagtacgacacctccgtccatacagtgcttcaaacggtgccatctgcagactagcctggtaactgttgttgtaggagaactcagtatacggcaagcttttgtcccatgctccaccaaagtcaagggcacatgctctcaacatatcctccaatatttgattaactcgctcggtctggccatcagtttgtggatggtaagcagtgctgaagttcagacgggttcccaattcttcttgcaatttctgccagaactttgaggtgaattggcttcctcgatcagacacgatcttcttaggtacaccatgtagacacatgattcttgccaaataaagctctgctaacttcttccctgagtaggtagtatgcaccggaatgaagtgagccactttagtgagtcgatcaacgactacccaaatagaatcatgccccgatgatgtcctgggcaaacccgtaatgaaatccattccgatttcttcccacttccattctggaatctgaagtggctgtagcaaacctgccggcctttggtgttctgcctttactcgctggcaaacatcacagagtgcgacgaattcagctatttcccttctcatgctgacccaccagaatttttctttgaggtcttggtacatcttggtactgccaggatgaatggaatactgagtttgctgagcttctgtcattatcaagtcctttaactccttgttttcaggtacacacaatcttctccccatctagattgttccttgttcatcttcaacaaaacctcgggcttttccaactctcatgttctttttgagctctgctatttcaggatcacttgcttgagctatgcgaacctgctccaccagtgtgggctgtgcctctagagtagccacgaatccgtgctcaactataccaaggttcagatgttccaaatcgcgttgaacctcacaacatagttgctctacccatgcaacattgcagtagctcttcctgctcaaggcatctgcaaccacattagccttgccgggatgataatgtattcccatatcataatccttgatcagctccaaccatcttcgctgtctgagattcaaatcaggttgagtgaagatgtactttagacttttgttgatctgtatatacctcacaacggttaccgatgagatagtgccgccaaagctttaaagcatgaactactgcggccaattccagatcatgcgtcgggtagttgccttcatgaggacgcaattgccgtgaagcataagaaaccactttgccatcctgcatcaacacacatcctagcccctggcgagatgcatcacaatagacctggaaatctttcgtctgatcaggcaggattaagactggtgcagacaccaaccgtcgtttgagttcttcaaaactcctattgcattctgcagaccagataaacttttcttccttcttcaatagctgtgtcattggcttagcaattttagagaagttctcaatgaaccggcggtaatagcccgcaaatcctaagaaactccgaacctgagtgactgtccttggtagggtccatttggtaactgactccacatttgctggatccacagctactccttgagcattcacgatgtgaccgagaaactgaacttccttaagccagaagtcacacttgctgaacttggcatacagctggtgctcttttaacttttcaagtattagccggagatgctgcacatgttcttcctcgaacttggagtagataagtatgtcatcaatgaaaaccatgacaaacttgtttagaaattccataaacaccttgttcatcaaattcatgaaaaaagcaggtgcattagtgagtccgaaagacataactgtgcattcgaacaacccgtaccgagtgatgaatgctgtctttggaatatcctcttcgcggatcctcaactggtgatagcctgatcgtaggtctatcttagagaacacagtagctcctttcaactgatcaaacagatcatcaattcttagcaacggatacttgttcttaatagtgacctcattgagtgcgcagtagtcgacgcacatccttttggttttatctttcttttccacaaagataactggagcaccccaaggcaacgtgctcgggcgaatgtatcccttctgtaactgttcatcaacttgcttcttgacttccaccaactcgttggctcccattctataaggcctcttgtggatcggtgcagttccaggtaccaagtcaatccggaactcgatatccctttttggtggcattgttgtcagatcgtccgaaaaaacctctggatactctctaactatgggaatatcttccaacttcttagtggttttctccactgctacctcttgttcttcaatagcagcctggttcagactgatccctggcttctgtggcactggagactggaaggtaaccacttctcccttcgcattggtcaacttgatggtgaggctagtgcaatcgatcactcctctgtgccttgttagccaatccattcccagaataacatctagatccttagattcgagaagaatgaggttggctggaaaaatcaacccttggatttcaactctcactgacgggcaatagtgagttgtggtcatgccacctccaggagtatgaactcgcataggtatcttaagcttcactaaagataacccatgtgcaccagcaaaacgcttggaaatgaaggaatgagttgcaccagaatcaaacaatattactgccggtgtcgagttgacgggaaatgtgcccaatatgacctctggtgctgactgtgcctcctctgcagacgcatgattgacacgggcctgcacaaacttgggtccagcatgtcttggcttcgggcactttccaaccgtgtgtcccggtttgttacaattgaagcagagttcgggctttccttcgaactcctcgggctgttttgactgagcaggcagagctggctaaactgactgagctggaaacattagtggacttggagtcgggttgaggctgtgcttctcgctgttgccgtgactgccacaatggtagatcctgccgaagctacccgggtggtagggacggtgctgccggataatcatggtggaaggtccaccctaatgtcccatcatgaagcgaggcttctgactgttcccctgggaagttctaaactgagatgccttcctttttcagttcattttgttaccctgctcctcctgacggatagctttgtccaccaacttctgaaagtcctcataatctcgggagatcaactggttggtcaattcatcatcaagacccgacaaaaacttctcctgcctctcggcattagtgcgcacgtcctcaggagcgtagcgcgcgaggcggttgaactcgtgcaaatactctataactgttctggttccttgttgcagagaatggaactctctcttcttttgtgccacaattccctcgggaacctgtgctttattgaaactctgacaaaactctgcccaagtaacctctgtcccagctggacgggtcaccacgtagttgtcccaccaaacagaagcggaaccttgcagctggtgtgtagcaaaagcaaccttctcttggtcgttgcattgcaaaaggttcagcttcttctcaatagcatgaagccagtcgttggcctcgattgggttggtggtacttgagaaagtgggcggcttgacacggagaaattctaacagtttggattgaggtggtggaagaccaaactgcagtttctactgctgctgttgtgcttgctgctgcacctgctgcaacacctgatggtactgttgcatctgttgcatcatcatcgtcatcatctgagtttgattgtccaacacctgagcaatcgttaggttctcgggcagtggggatgaactgctgttaggtgcatcgttggcacatgctccactgatctgctctttgctgccactggcgttgttggagtcacgggaaccattccttgtcttcaccatctggagggggataggtagaaatatgagaaaaggaagaaaaacagggggctcagaaactaatctttcctataagtttaagtgcaattatcttaatcgtgattaaaacactgaaagagaggcacacaactcctaattgaggcaaccataccactgacacatgatatcgaccgccgactaatccaccagcaacaaacctatgcacggaaactagcaggcaaacaaaactaggaagacaataaagctaagggcggcgactctgaagctcggagcggcgcttgcaatcgagggataggactgacatctaaagatggacaagggataagaaccaattcatgctcgaatccaaattaaacgaagcaacaaatgactcaaacaaataactgaacatgatgatttttatgcatagaacatttttcatgaacccagataaagacacaattgcaactaaacaataaattaatgcatagactggatgcatggaaaatgatgcgcataacattgccccatcgaacatagacacgacctaatgcataacccccaatagattcccgactgactgtcgaataaactccaactaaaatttttctaaagctctagactgagctaattttttaaaaaaatcagatccgaatgaacgaccaagatttttcccgcaaaccaaagaggcaaaactccaaattttcccgaaacaattccaggtgcaaaaggcatatgcagatgaaaaaggggttcagagggctcttaggtttccagttggcttgtcctacggtcaaggtcggctctgataccaacttgtcacgcccagaaattcacgaaccagaatttcgaagctgaatgtgcattaaatccctgtccaggaccagccagggtacataaatgacaattgttgacatacagatccacgtcttacaaaaatagaaaagattacaaatgcagcggaaaagataaaagcgagctaaaccgggaagcttgacttcagcagcggggcgactccactccacaggcaatccttgacggcagcgacaaaaccaacttcaacaagacagctccaactagaaagaccttcagctctggtgtgggggaaaagagagcaagactgagtactacccactgtactcagcaagtcataccggaagaggaggtatgatgtaggatataaccaaagaaggctaggggttcttttgcacaaagctagcatttaaaagcagtagttgaaagcagtaaaacagctgtagtaattaatcaatattaaccaatcactgtccaacgctacaccacgttgcaacaagcccaaccaaccacctgaactacaccagttcattaagctaaactaggggtgagactaatcacgatgaatctggttgatcacccataaccgcgggcacggctattcgaatagttttactctggctagaggtgtacaactgtacccacaagatacgattccacacatgtcgccatgccccgaagtatcaccatgatactgcaaagggggaaatcgtgacaagaccctcccctaaccatccacaccacgctaaggtttcacccccacccctcaaaaggcagtgggcggtcccctcttgcgccgcggtgaatccagcagctggacaaccggacaccccggccgacccaactccatcacgcccaccctcgccaccggtgcctaggaaagggtcgagctatacttcagatcaagcagttacccactcccgcttgtggtaagcacggtaagtctcccagggtttcccgtgaaccggtccttaactgtcatgggtgcgaccagcaaaaccatgcacccacagcccaccattcagtgtattttaattaactaacaccattgcggtgacaccaatccaaaactatgctcatagccaaagtctatgtaataatgtgatccccatttgtgtactagttgagctaagcatggctaagcatttcctaaaccaacatctaatcattttgatacccaagttatcaatggcatatggtaaacaataaatggctgagtaataggacccatcccacatgacattgtaaaagaatgcgacatttaatagaaatgcgggatatttgtaaattgggtacaatatgatcaattgtaatgcatgacttgccttgctctcacactgatgagacctcagcaacgtcttcgagaaaccgcggatcgacgaaacggccgaaaactacacgacaaacaaagcacacaagcaaaacatgctataagactactgaaacaggaaacaaaaccatttttaatggattctttgcatttttatgaatttactgagacttgaatggacttaaacggagctcaggtgaattacttatgaattttagaagataaactgtgtttttactaataaagaaaaagtccttaattattttcttgcgcaataatacccagggctgacgtcagtgaggggggggcgggctgcgccgacaggcggggcccgcatgtcagcggcacaaggggagagggagggggcgccggcatgtgggccccacgggcaatggctcaagggggaagaggggggtggcacccggttggctcagctcggcttcaaagccgagcggagaccatggcgaccggcggtggcgtgcgcggctgccgacggcgacgaccggcggagggaggcggcggcggacggccgaagcggcggcacggccaaaggcggcggcgcacgcgggaaggggagaaaagggagggagagggagtcctcaccagaggggcggcggcgaccagtgcggaaaacaagggtggcgatgacgaccgacgatgccgaggcgcggacgagcggcggcgacacctgggagggagcggagagggggttaggagaggagacgacgaccacggcggctaccattgccagccggagatggaggggagggaaaaaactcaccggctcgcgaggggagaggcgctccggtgggattccggcgacgcgaggcggcggccgggaaagctcttgcggcggcgaagctaacggtggcggcggcgcgcggccgaaggcggcggcaagcggcgaagctcgggtgtgacggcgcgggcgcggttgggggcgtgggagaggacggcaaatgggggaaacgagggaggggactcgggggagggtttttatgggcgagggaaggggcggatgtggccggggagatggctgaaaccgccggcgacgtggagaggagagaaagagagtggggtgggattcaaaatgaatcctgcccacttcgtgcgtgcgggacgggaagggcggaggagtggggcagcgacgtgggcgcgcggcacgggcggagtggggctcggagaacggcgggaaacggcggcggcggcgtgggcggtttcgacggcagcggcggttcccggatgtaggagacgaccgacaggtagggcccacctgtcggcgtcccgagagaggagggaggggcggcttgggccggcccacaaggaggaggggccgcgggagagggatgggccgacagcccaacaaagaaaaaaagagggaaaagaaaagaaaaagagaaaaaggattttcctgggattaaaaattgcactttggtgatttttaattggttaaaattatttccaaggctctgaaaattccactaaaaatcctgttaatgtattgtgacatgttgaactcaaggaaaatcccacattgccaattccaattattaaatgcctttattaattaggaatttagctctaggttaattaagataatttcttcgagcaatttatttagccaatttttaaagcaaggagagggggaaacttcagggcgtgacaaaaaacaagagaaaatgaaaaggctctataaagattgtaaccaattaacaacagtttgcttgaggggatccttcattctgcagagatgcagaagaattttatttataaagagagacttccaagattgtaaggttggctacaaatttctgaagatgaggccatttcgttgttttcagatgtgccaagcagccacgaagaagatttctagaaagccaggctgattgaactgccatcttgtgtaagctgtcctttggtaaaattcaagattggcattccatgagattcccagaaactgccaacaagcagtgctaaatggacagttgaagaagagatgatatctggtttccctttggttagtgttgcacagtacacatgatagatcatcatcttctttggcacaatgcctcctatccaacatatctcttgtgttcagtctgtcctagaagaataaccaagcgaagacttttattttcattacacacttggtcttccaaatccagatcagagatctgggtgcttgaatggcagcaaaattaagtttatataatcgtttaggggtaaaacagctgttattccaaatgaaactccatgaatctcaccttccttgttccaagtgaaggtgggttagttcttcttgaaggttgagatactcacaataggcttgataagagagtggtaacatgaaagaatcctccaatggcctgggacacatagattgtaccaaatcatttttatatagagatgaagcataaaggtgatgatattgctgacatttgaattgatcattccacagatctgtccagaatagagctgtagtgcctgtccttatgttgcattttgcaatttctctaaaaacatcaaccagaacaataatgtctttcaaccaaaaagagtctttgtttgttagatgagggactttagttaccaggtaagacttagccacaagattaacccaagaaatatcagctgtagagtaaactttaacaagatgtttcatgagcaaggctgcattttggatttttagattaatcacacccaggccccccttttcttttggtgtacaaactttttcccatgaggccaaagattttctggtggaatcagggctatttcctctccaaagacaattctttcttgcagtatctatggccttgataacagtgacaggtaattgtagggagcacatgtaatatgtaggtattgatgataacacagagtttattaaagttagtctacccccttggggtaagaacattgagcttgttgtcagcattctttccactctatctaccaggggggcaaaatcaatcactcttggccttgtagttcctagggggagtcccagataagtgaaaggcagttttccaacaaaacatccagaagacctgcaattagatctgccttttcttcagagagattgaggggataaagactggattttgcataattaacttttaggccaatcgattgagcaaacatatttagtagtgccttgaagcaaaagatttccttttgtgaagcttttagcaggatcaaagtgtcatcagcatattggatgatggggaacccactgccatcattttcattgattggctttgaaattaatccaagattgaaagccctatttactgttctttgcaagagttcagcccctagaacaaaaagaagtggagataaaggatctccctgcctaactcctctcttgcagataaaagaaataccaggaaccccattcaacagaactgcagagcttgccgaggagaaaatcatttgcacccaattaagccacttttgtgggaacaccatgctgtgcatcacagataagatggttgtgtgttcaattgtatcaaaagctttttcaaagtctaacttgaggatgattatttctctttttgattgttggcattgatgaatatactcaaaagcccatgccaaacaatcctgaatggtcctccccttgatgaatccatattggttttcactaaccactttgagaatcacaccttgcaatctatcagccatcaatttggtaaggaacttaaggctcaaacccattagagaaattggcctgaaatcattaactgtttctggagaagtttttttttggcacaatggtgatgtaagaattattcagaatctgtaaatctgtagattcaacatgaaaatgagccgcaagtctgtagaagtcatgtgcaatgatgtgctagcgttttttcatgaaaaaaccattgaaaccatctgggccaggtgcattatctgctgggattatagcgatgagactatcaatctattgtgtgcaaaacatgtcaatcaagcactccaaatctgttctaggaacaaaaagctcattcaagttaaaatccattgttgggaagcaagagatacccatcctattcttgaaactctgatagaacagatttgccttttgatcatgcagataaactatctaaccattttgattcaaaatttgtgaaaccgtgtttattctgtacctttctgtggcaatagattggaaggacttggtgttttcttctcccagcatcatccatctattagtacatcgttttttccaatatattttcctgaattccagaagttttaagatacaatgtttaactacctccctgaaattccattcaattaaagaaatgcatctctcttcttccagaagatcaataaaatcaattactttattagagttactcaagagaagcacgattctggacaaatttttactccaaagcttcagtttcttcctcagaatttttaatttgtaggagatatattttgcaggatcatgaaaaccaggatctagcatccaaacttgctgaaccacctcaaaaaagccttgtgcttcaacccagaaattttcaaatctgaaaattggggacttaggaattttcgtatcaatctttactacacatggtacatggtcagagatattcctagttagagggagaacagttgtattggggaaggttaaagtccaggatgcagaggtgaaaacccaatcaagtctttctagcaaatgattttgttgcatattgctccaggtgaaccttctcccttttaaagggatttcaagcaaacccagggaactaataatctcattgaaaattaaaatatcattcatgttagctcccactttattcttgtcatagataaatctgtagaaattgaagtcccctagaaaaagccagttctgttgagcatcaatctggatatttttaaaccaggtcacaaaatctgatcttttggggccattacatggaccatacacacaagtcaaggaccatacttgggaggtgaatctagaagttaactccacagtcacagagaaagggttaacttctttgggtgacccattgaagactcttgaggcctaaacaataagaattccacctgatgcactcatggagggggcaaaagcaatagagccgaagcgcttgggggcaaatttcttgatgtcaaaaagctcaaagttttcctttttagtttcttgaaggcataagacctggcagccactgtcttcaattttctgcctagacagtaacttattttcagcattcatatccctcttgttccagcacaaaacattccaagatttaaaattactattcattatcacaccattgagggaggggcaaaagtaccaaggctagcacaactaaccgaaaaacaaaccaaaagccatacacacaagtcttggcagtctgacaggacaaatatctgataaaataactttgacagtaaacaaattacagaccccttgagcatgataaaaggaaaacacaggtctgtcaataaaactgagtcttctgtcattatttatcctccatgtttggcctggttatcttctgtcttcttttgcccccccccctaggctggattctgccacctcctcaggagagagcccgcacatgtctacccccatcttttgtatgaccaaaagtgaacaatcaggtggagaggagtcagagttcatatcactataagaagtttcattgaaatcagactcctgcaaactgctatcaataaagagttttgaaatacctgcaaattccttaagctttttagcaaacctgccccttggcttcccaatacccattcttggatccatctgcaaatctttggttgccttgtcttgcagtagcctagagctttgtcttctgtaaggactgtaaagaatggtcttcccatctttcttctttataggtgccttggggggaagcagggcaacaagggccacattgattgggctagagtggggcattacactgattggtagaacatcctcaatcaccctttccggcagaggaggagaaatggacttgaaaggttgtaaagcccattcagattcatgttggcccactgagggagaggaatcaattccttggcaggaccaaagttgagaagggattggccattctcaaagcagcagggataggcttgtcctggatcaaaatctgcatgatgccctttgctttacagagaaagtcaatcttgtctaatatgcctttcattggataaaagtaggggtgccttggagcttcattcctagcaattctgttcagccgagctaagaattcctgtacttgtgggtccaagataggatcctggactgtttccttcctggctgatgagagaggtgtggctatctgctgaggcaaaataagctgaccagggttttcttcaatctgacccattggatggtcttggccccaggcatcttcttgctgttcatttgcagcctgttgttgctgcactgcttcgtcccaacctccagctccctggtttccagggttgccaaactgccagacattaccatcatcaggatcctcatcaactgcatcatcagggcccggctgcggaccagcagggggaagatcctcttcagtggggaaattaatcaaatccccttctagcatgaaaaccaagattgtccaagattcccccccccccacacccccagcgccaagaggatcaaagagaacaatctttctcggaacagaatcctggtccctgttctttgccctaacaaaaacccttcccaatattctatctgcatccgcctaaaaggttaactaaccaaaagaggcaactaccaggtgcacatgatggcgatcattgaaatcgagtggaaaatctagaaacatgaaccaaccctctctatggaagttagccgccctccaattaaacctttgtcatgattaacaaaagtaaccaagtgaaccccatcatagaactcaggcggggagaggaccagagcatccctattcatagcagacctcatctggaagaaaccttctgcaaacgggtgccggaagctgttacgaacctcatagtgtagcttatcttgtatgaagttggcaatgagggcccgatgatgatcccagtcctgctccagggggattggctcaacaatggccacacagaagtcttcatggttccgagcagggcgctgcgggacagtgaggtcaacccgcgggatgcagaagtcacccccaacttgcacaacgtgaccctgccttaggaagcgctgcggattagggttaagattggcaattgggggcagagggaagctttcggtgggaagcactgtgtgtttgggagaagaagggtttcgggaggaagaaggtgagatttccggagcattagttttggccttccaaacagcagtagtctatttctttgaaatatacccaatattgtgaaactagtgagagttgaatgaaaacaggctcatgtaattctctactaaatctgtttttgctttcaatgtttcacttgaagggcatctttgtttgttttcaacgaattgtttatttctcgtcattcagttagttagaagatgctaacagttctacgcttgtggaattgtgctttctgtatagccgcttattaatacgagttgtttcttttcaattagtaataaagcataatagctcttctagctagcagcctagcaccataacaattgtacggtactacagaatttgcatttcatataattgcattttacactgcgggcaacaccaacaaagtttccacaacaaggtccacatgtgcaaggaattataattgtcaaaaagtaatgttatataaatatatgtagtacttcctcaaatattctacaggaaactgccacatcaaagtagtcgaacgcggtatacattcactactacagaacttgacatcgtgaacagtctatccgtgtcagggccttacgaaccgtcacatccctatctgaccagattaaacaacgacacataaacacccttgcagacaatttccataggcctttaggctgggcccatcactaatgacactcataagtgacggggagaggttatcgcccaacaaagataatcattgacgggccacaacctaacgccatcaccgatgagtgtcatcgttggcgagcccaacaataggcccgacaaagatatatgttaaactctgtcaccgatgagtacggttttttgcgatccctagttattgactgttatcgatattacacactataaataccccaaccaattcgtggaatggttatcccaaccaaacgtactggtcacatttgtggtgagacgtgtaggtgggcaaattttgccttttttaaaaaaaaagaaaaacagaaaatatagaaaaagtctactaatgtatggaaaaaataaatcatccctacaaattttgtaatacatgtcatttaaaaatcatatctaatatttgttcacttttgtagccatggaccgatattagatgtacgaaattgatcgacatagcaaagagtatagaagtggcattgcaaattttataaacgtggcggagaagaggaaaagaaggaacaatgatgacatgacttgtgatgacacgacttgtccatgtccagattgcaaaaatgagaagatgttgatagcagagtagatatatactgtcatatgatacgtcaaggattcgtgaagggctacacatgttggacgaagcatgcagagcaagaatcaatcaatattgcagatgcagcgagtagtggtcaaaatcagaaagaagatgaagctgacatgtttgttccttctctgttgggcggtgaaatggttgatgtcaatcacgatcttctacaagcaatattgcatgatgttgaggagtcagctcgatgggctgtcgtgccttcgggccgacccggcacggctcgagtcttattgggttgtgcctggaccgtgtgtgcagcctgtgggctggcacggcaccacccgaaatgtaggtcgggtcgtgccgccctgactgacctcggcccaagcacggccgtgcctggccgtaccgggccgggcggcccatttggccatctatataccgtggcgcgtgttttataaattattatgggtgaatagctaaagtggtctccaagtttcatctgagactcagtttagtccttgatatttcaatctatccatattagcccttatccttgaacttatccttgaacctacttagaagccacatggctaaacataactaataactctcttgataaatgacacttataccccctcattcacatgtataaaagaaaaaattgcatgcaatgaatttttttatagataatgtatagtaatttacataaaacgaaaataagttatgtacttgcaagtgtatacgatagccattgcttaagtttcatgtgcacatgttgaaataatataaaatacatctgcaatgttgtttattcatcttggttttctcttttctattgtatagttgtatacaaatgaagggcaaaagggatattttgcaatagaaattttgactagaaatagccatatggcatattaagtggatccaaggacgattttaagccaaaacaaatacttagaggacttatgtggacaaaatgaaacctggaggaccaaattaagccttcgtgaaatttgagagactaaattagctattcgcccaatttttattaggatgcttacttatttcctacaagggagacgtgttggttcatgactaaatagtattttgttggagaaaatgtgcaactttggtgcacatgacgataattgatcaatttctaccaattatagtttgctataaggcaaaatctaaaccgagaggcttctcggtttagtgttaaccagcgacgaacgaattgtgagaagaagtactgctacatgtgctgacgtccatacttgtttttcctcttagacatgcatgtctttttcttccttcttataaagttttctctcaaattacttatccgatctacaatccaattgcaccattatgttcgttacagttaaatcttcacaacaagatcttacatgattatattacaatgaaaaaatatttatatttgtaaattacttttattatattcgtaagttacttttatcatatatatatataagttacttttatatttgactaagttacttcttagacatataaaagtaaattcaataaagtctaaaaggtatttacatgtattataaaagtatcttaaaacaaaatgaaagtaactttgtcacgacattagaagacattaaagttctttctttttgttataagttacttctataatatatgtaaattacttttaagctttattaaatttacttttatatgccgaagaagtaatttagtgaaatctaaaagtaatttagatttattataaaagtaatttatattttttttattaaaatataatcatgtgagatcttattataaagatttaattgttacgaatacaacggtgtaatcggatcgaagatcggatgagtagtttaagagaaaattttatttgaagtataggtagatagagtctcttataggtgaagtggtagctggtttaaacaaaccaggtaccactagttgtgtagtcacgtccttgctataaatatacgggcttgtttgcagaaactatggaaataaatgcaagagaaattctaatcaattataggagatttatgttggaatcataggagattcggccattcaacctaccatcactcgcgaactcagagaaggatggaaacgatgaatggtaatgggccaatagctcttacctctttgctgcagtttcgatctaaggacctatttagtttatttagtttctacgcagaaacttttcaccctatcaaatcgaatatttgatatatgcatggagtattaaatatagaaaaactaattacacagattacgtgtaaattacgaaacgaatcttttaaacctaattgtgtcatgatttgacaatattgtgctacaataaatatttgctaatggcgagttaattaggtttaataaatttagagacgaaatctataatttattttgttattactctatgtttaatacttcaaatatgtgtccgtatatccaatataacacgccaaaatttttcaccctgctgctctagacacagcctaaatcattcttttttttcgcactccctcctcgtcatgataccgcctcgctgtaacacatgtagtactaaatcatctttttcgatgaattgggaaacggcttctagtggtcaccattgacttgctagttaacagtgggacccacttgtcaataacttttttgcttacctctccccggtctccaaccctctctccccctcttcctcttctctcacctttcagcaacaatggcgcagcagtagtggcctggatggcggcggcagcggcggcggcgccggacaacggcgcggtggggtgcctggcgtcggcggtggagggcccgataacgtgaatggcaatgggccaacacccctgacctctgctctgctgcagtttcgatctagttctttttctttttccgcgcatctcgctcctcgccgtctcgctgccgccgccgatgccggtccgcgttttctccgtcccttccattgccgccgttcctctcggccgcgcctctgcttgtggtgccacgttctccagcgccgatgcggcggctgtctgcagatacgccagccgtttggtcaggcacagcaatctccggcggcaaaggttcttggtgatctgccctacggattgttcaggttctcactgtttccctgttgttatctgttactactaccattttaccgcattattgtatattcccctgattcgttaatctagggaagaggtagtagaactggaacacaattcaattcaacgtgctgaaatgcaccgtcagagctgatgccatttctagtcaatgctaacggttcagttctgatgcattttcgatttatgaaactctcaactgttttaccctacatagcccccttgtggtagcttctagcaaacctctcaaaattgtcctaagggtcttcagggtttttaggtagtatttgtttcagttatttacccaactttgctatcctatataaaagagaaaaatctacctaccaccagcattctggcttgcactgctcacccaacccccttccactccctcagcacgaccggtaatagaggcataaccataattaaacatccaaaggatatatcttgattacagataagctagggagcaaaatggattgtataggagtttgtatgacagataacatactcgagatatttatcgaaggaaacctacaaaaagaaggggattatatatttctcaggtcagacaactagttagaatgttagatatatataattgaagttcattttcatatcagaaaaggccatatttttagttttacagaatgcatcatttcttgcaatgtacaacactacttacaacatttattcaaggggaaagctcttttccttgcactaagagggcatacttaaattatacattttgagaaatagtattcataaaataagacatgagacaaataatattgtggtagtagaaattaataataccagaaagaatattagagcccatgccaagggattatattgtatgtttaatggcaaggacattatgagcaaattatcacttactacatacagatccattcaaaacattatgctctaaagtatagcagaaataaaagtgaaacatatcctctgcaaattgcatggctatactaagaattacagcggatttagtgtagaacagctcaaaacagaccatgaaacttcatctaaaaaaagtaagtatgaagtttcaaatatcttaggtaattttccttcccaagcacctttggcaaaccaacgaagagcaccggtgatgagtaccctagttttggtcatctttttgtcggcgctagtagcatactttagttcttattattgcattccaatgcaaagtaaccaataatgtacttgtatgtatgttccaaatcttccattgaacaactgtacatgtatatataggctgcagttgtataacttcggctacaccaagtaattcaacaagtttgtgtgtgtgtgtgtgtatgtctcagatagcaaccagaagaagttatgtatatatgctcccagctcaatcgacagcacagcaaaactcaactatacaacttacaacaataagtagtaaccgaagaggatcttgttgtagaagatggcaaatcatatcttagcagctgaaaagagttaaaccatccacccatgcatcaaatcaatctcaaatgatgagaagataattgaaggcttcgaaaaagccaatcatcaaccatgcaaataaacccttctaggatcacgccaaattaatttccacaggcatggaactgaccatgatagctccccagcggcccagcccccgtcctttcttcttgggcaataaatcaactgtaataaccatccccttggctcaagatagcagcagcaccattcctctgcttgtcttgattcacagagatgagagatgcacattggtccaacttgatcagaaagtttgattttattaccatataaaacagctggtcacatgaaacacattttgtaaggttgatccgaatagaccatcaagtttcaaatctctcaactgttttttcttccaaagcttttgctgcatagttggcagcaacattgggaaggtaacccacaagattaactgaatgtcatctggagtgtaccttttcccgttgccgttgcactcgtccatgccatgataaattgtatccctgtaggaattcagaaaggaatcaatttcttcctcggatccatctctcttgcaccaggaaaatttccttaacagactagtaccttgcagtttgcctccccaatcaagctttcgcaaagcattgatgatttcgtctttctctgttgatttatcacaaggtagcacaaacatgatgaatgcatacatccacaggaaaaatgcttctctgttccttagagggactagagaagcatgtgtacagataagatactccaaatccatactaataaccttgtccccagtgttcattaagtttaggagatgcatcacgtcttcaggtatatcctccttgtgttgtccaaacactatttccataattattttgccagcatccttgtagtttttagataccaaagagtcgttcttgtcatcaagttcgcttcctcttaattgcactatcccatcttctctgataaaaacatttgattcatcaaaattccgtggacacttcccccttttgtgcaggaaatatagctctttaagtagtgctctgatgacaaatttggcttcctcagtcatgaggcgatataccctttgacgcgttggaccaacaagcataactggtgtatgcttgatatattcgataagtggcttaaattccagatcacgtatgtactccgcataactgacatgatgtgtgtttctgttttggtacaaaagaagcaatggtcaaatagatatcaagagtttgcagaaaacacatacgaattgaacatatagtaaaattttagaagcataggagtagaaattacagtaggaaagggaaatgatggacgttactgttactcttcattactaatatgaaaaattgacaaagagttgcattttatacatactagtctgtccaatcgttatgcacgtaaagaatttctattgtgactgattgtttagattagagctaggactgcatgtattcttcatcaaaaaatccaggccaaactcaaataaattggacaaataaaaacaaatatcaagtgaataatcaacttatcacagtttattaagtatttccgaatctagcaattgaagttgacctagtatggacattttttatgaatacagaatatgttcacccctatatctaggatttttttttctttaaaaaacttctaaacaacaaaatataatttggagcacttatgctatgtgcacaagatatgccccattccactattagtaaatttaataaatctttcacgttaaatttccctgcatgcaaacaccacttggtttgtaatatatagaacatggggaatagctcaacttggtcaatcattattgccaaattaagtgaaattgtagaagaatcaatggacataattaagcatcagtacaaaattaggactgtaaaaggtggcaccaaacttctctctattacacggaggatgtgcacacgcgcacaccgcacatgtttgtttaagtgcccctttagcacagtatgtaacacaagcttaacaaatggagccaaaggattgaggcattgaacatacttgtgagagaattttacttttgattagaagccacatctagaggatttttagttatagctagctacacaagcagctctggcttaaaagctgttataagaagagctctatcattatctcattaaatctttgtgtaattgtggaaccagggcttgaaccacatcaacgtgctttccttatgaccaaattgactgtaataaaacatccaaatctattgccatgacataatcgagaggatattactataggtaattttggatgttacaatatatagtgaacgagctgtaaagaaaagggtgaaggagttaccgaaacgggaacacgactcctctctttgtgggcaatgaatcaacaccaatgtcattcttgttcgtgtcttgattcgccgatataggcattgatccaacctaaaaggaaaaattgttgcttttgttgcaatttgaaacagctgaaggatccatgatcacaccaaactccttgtccatgttggatccaaatagactatcaagttgcaaatcttccaactgtttgttttcccaaagctcttcttgcatccttggcagcaacattgggaaggtaatcaacaggattagttgaatgtcatctggagtgtaccttatcctttcctcaccgtatttgtccgtgccatgaacaattgcattcctgtaggacttcagaaagtcagtgatttcctttttgtagcacatatctttctcccgcctgaacaattttttgaggagattatcccctttcagtttcttgtgccaataagatttgtatggcatatcccctgctggtttgtcacaaggtagcataaacatgatgtgtctatacatccacaggaaaaatgtttccctgttccttagagggacaagagaagcatgtgtacagatgagatactccaactccatactaatagccttattaggattgttcatcaagtttaggagatgcttcacatctttaggtatatcatccttgtgttgttgcaacactatttccacaattattttgtgagcatcctggtagttttcaaataccttggagtcgctcttgtcatcaagattacattctcttatttctgctatcccatcttctctgataaagacatttgattcatcaaaatgctgtgggcactttcccattttgtggaggaaatacagctctatgagaagtgctctactgacaagcttggctttttcagtcatgatgttgtccataattggttcagcctccttatattgggtgagtggtttgaattcctcatcgtgcatgtacttctcgtaactgatttgatgcattttgctgttcaagtaaacaaaaaaaagtagcacaggtcaattagtttcaagaagcattggatactaatgacaatattaaaagaatgaattgatgaacaatacaattactcttcactaccaagcaatgaactcagtggacatattgagacatcacgtactaaataatggatcaggttaaaattagaggttgaagaaaacagtcgacagaggtccataaatatgccacttactatctgtctatctccatcccgaaaagcatataattctggctagatgcatagccaacttacaattttttttttaacggagctagtactctctccttttcaaattgatcatcatatatatttatgcacgaagactaaggataatttaaatcatatcaatcaagacatcatgcacatattttccgacaatgcatgtatcgattaaaacaccatgtcaatcacaccttagcatgtacacattctctcatgctacattaattgtattctgatgaaatctgtatccattcggttatatgataattaatttaagaaattttgaattccattatatgatgatcgatttggaaggagtaagtaatacacaccttacacatataagccatggataaatttgtccatcgatatggacatcaaatcaatattttagtctctattgggtagggtcaagtccctataactgtaccaccatgtgaagaaacctctcactgacaagattgacttggtgtggcaaagcatccaaatgcattgccacattatataatcgagaaccccacatagataattcgctaaggcattattcggtttggaggggattaaaggagaataatttcacactataataggtgtgggataaatccctttcaatcctttcattttggggattaaccgaacaaggcctacaagaggaaatttaggatggcactgtacgggactcggatcctcttcattgctgttgctactgcagagaagcatgttttgtgcattagctcaaatctaggccgttcatccaaaagaaatggctgtgatttcttcttgcttcaatctcttccatacttccacttctcttgtgacatatacattagctctgcctcctatgctcatggtcatcagttcatatctatgctcatggtcatctcgctcatggtcatcttgttgtgacggacctcccttgcctttgttggcttaataacttacccgtctattccaaacatctacttgtggaaaaatttctaagcggtaacttctttattttccgttagcacgcttcccgaacagttaaaccgtatgttatatgaaaaatatttctatataaaagtttatagtaaattaaataattaaaaatagtcatgtccgaaggagcgattgagattagtattttagtgacacgtaaaacgagacaagtcattaacgcataatcaattaactactccccgtttcatattataagtcactaaccaaacttgttaagtttgacaaagtttacagaaaaaacaataatatttttaacacaaaacaaatatattattaacatataataaatgatagttttaatgtcactaatttagtgttatagatgttgctaaatattattataaacttttgataacgagaaacatactcatagagaacgaaaaagttacagttagaaatcactctctagaactcagttattaccgtgagtacagtgatgtgcaaccccatgacatcatttttaagatcaccacaatagagtatgaacagataaatttgatagaatgaagccatgaagacataaagtgtgaacagacaattgatttgatggttgagagcagaaagagctagagttttgctagaagtacgcaaccgtccttgcttggatggatggctcggatttgagctaatgcacaaaaatgctcctctgcagtagcaacagcaatgcagaggatccgagtcccactgtacggtgggcaagattgatgcattgcattagtttgacttacatacaagaagcatgatgtaccaaaataggatgtgcaaaacaggatcaaccactacattcagttagaaatataaacagcattacgcatccgttctaagaaacagacacacaattaatgaatgttcgaaagcaacaattgcacctctggattttcttccatatattttttttccattacaacgaagccacacacataagggtgcatcaagttctcataaacagtatcactcatccgttctagtacatgcgtatgcttgtgagtcttatacttttttatatacataatcaaacacaccatacatatgtttatttattttagaaaagatgaatcaatatgcctgagaaaatcataaatcgcacacacacatatatgcatcacgccacgtttgattcatggagctatgcaccttgaagcccgtaacaaacttcatctaaatcagtgatcagtgttacaaaaaggtggctaactcccgatctgtgtccgaaaagcaacaattcgacctatcagtcgaccccatctgtcgctcctagcgggaaaataggaaaaaaaataaatgaaaaaaaaaaacggatgctgaagccgacagattggctaagcatttcgaagagatcttcccaaaaacggaaggattcgtactaaaaaggcccacccacccgaaagcacacaaagggcggtggatcggtcgtccgatcaaaactcatcataggatttattaaagctggaaaaaaattaagcaagatgtcgtgtaaaaaattaagcacaacctcttgaagagcggaagaggccacacacgagctggccggcggtaaaactccggcggaagaggttggacttaccggagagaaatcacggcggtgcacgtaccggagggttttggcggcggcggccactcttgtagggagtactacgcatgtgtggtacggaatgtctctgtcacgtacagtggccgtcgctccatctgacagcagtggctacgctggtttgccgtgggcccaatctcaggccctacccgaatctattttccacgtggttgctcctagaggtgacaggtgggtgggacctgagagctaacggggcacgacgtggctgccgcaacagcaaaagtagagcacataattaatacaattgagccaacataagctacttcctccgtccaaaaatatatcgatgtgatatatcccaattctacgaatctagaaaaaaataataggtatatcacatatatccagaaaaaattgaccatggagaagaagatcaaagtggagtggccgccgagagcatacgatgaggaccatctgccgctggccggtggcatcaaagtaattggaagagcccccgtcgctgctaaccggtggcggtggagccgggcggaaattgaggagggatatgccccggcgagaaagctaggctagccttccccgccagagtcgaccaggacgccgatggcgcccaagagcgtcgcagctagctggtaccgcgcgccaccacttctactgctcccggcgccagcgtcgatagactccggcgggcggaaaggctgagcaaattgagaaacggagaagctcgatcgatttgccgccgccatgtgacacagctccggattgacttggggtcgacgacctctctctctctctcccttgacgaccacgatgcttttgctcttgcaatggatgccgctacactatcatcgtctcgttgacatcctcttctactgatccagagcaggtatacctaaacgtatttatttttaatgactcgatcgtaataatgtatagctgacctgaccctttcaaagtcgtctccgtatttgtaactacgacgcaattctctgtagctacattcctcgaatagtctcacaacgcgcacctatgcatgtactcacctttatgaacgcagatacatacatcgtatcgctacgagttttcgaaatttttttcgaaagattaaatcgacatatctaaaaattaacgaaatcaagctaacttaattcgtggaataaaatttccttttaaggaagaagaaggtgcattgttttttcagcaggaagaaggtgcattattgttcccggcacatgattgacgggacggtacgtagtttttgaattatcttgccatgaaacaaacaagcatgtatggacttggtaatatatacggtatatcgatcatcctagtttacgtttcacaacgtaagatgttttttgttttgaatatattcatgcatggattcttacatatacttcatatatgtgtgttcaaattaatatgcatgttagtgaatctaggggagggacatagaaatcaaaacatcttattgtgtatacgtgtgagagagagtatttatcaagaattttcccaactaatgctgtacagatgatttcttttggatttttgtttgattcaccattcacgttatgacctaactcaatttttttcagaaagagggcgtcctggaatatttaaaaatttttaaaaggacgatgccataatgtttgggtgtttgaatgtaccaacagcctaaataatccataaactgttggcccactaaccggctcgttttctcattatccaaacatcacgcgacccaattgagtagaatttatttggaataaattcacttaaggtctctctatttgtcaccgagtttagaattcacccttgaaccataataccatgttttggctcatgtggcgtttacgtgacattggcgtggcacttaaagttagagaaaatcatagaacccacgtatcagtaagagtcggtttaaaaataaaagagaatacctaactaacacattaatagattaactaggtaactagtaattaattaagtagaattattatttcaattagcatcattagaaataattaattaatcgctaattagtacgattaatctgctctgtgagaccgtggtggtatctcgcaccgggttcatattctctaccatagtaactatctttatacacactgacatgtgagacaataaaaatgtaggacccatatattagtagtaaatgtaatagtagtgatagtcaacacattatagtaaggatcctcaagcggctgccagctgacagctttcaaactcatcatcatcactccccaaatttaaaaggagtccgtcacaactctcctgctctgccgccgctgcagtttagatctcgaaattttttcccccttctcgctcattcgctcttgctcctcctggctgatgctgccgccgccgccgccgcgcagcaaaatgcccgccggacggcatcgccgccgcttccttcctccacctccgttataccatccatccccgctgcagtctacgaagtaaggatggcggtggcggccgtcgctgttggtcagccgcagcggtctcaggtagccaagttcttggtgacgtaagagttaagacttggcgccgttctatttgttctacattaccttattacatcgcccttctgtatttttttgctttcggtatttttgtgtcatagattattactacccatagtattgatgcatttctgttaaaatggaagagtgcaatatgaagactttgccaggataactacgctgtatctggttggtatttgcaaaacatggcaactagttattgacaaagaatcatctggccacatactatgaaaaactcgttgtcaaagctgaacaatctacattgtttctacctgttaaaaactgttctcatatcataagttcataacctgatgtcttgactagtgtcttcaaatgtcaccaatttactcaaattaaaagaacgatacccaggtagaagcgcattccaaattctaagagttctcacttcacactttaattttacactttatgactactagtattagtttcagatctgcaaccaattcactgcattttttttccagagtagcagtatcgacataatcaagttcaagtagcagagcaacattttagtagcagctcagagtaataggggcctgtttggcacagctccagctccacccctcctgaagctggagctcagccaaacagtttcagctccaccaaaactgggagtggagttgggtggagctctctcacaaaatgtactagagttgtggagctgagtttaggcagctccacaactccactccagactcaactcctggagttatatttaggagttggagctgtaccaaacaggctgcagggaagccggtgaattcagatcgttagcttcgccggattgaggttggggagtgcggatcagctgaatgcaggcgtcgtctcccagccgagaaaatcaagacaagggaaaggtgaagaagaccggggatggtggtcttcttgggttttgggggaattgcacatagaatattagaatgatatagaattagggaggtgaggtgacatactgtaggtgtttattggtgtagttgctacaatgcgaatttgcgaggtcacacggcacctctccgttcctccctgcatcagaacaatcatggccattcattatgtgatctaacggctccgaacgatcaatatagtataagcaatagtagtagtcagaaaagttttttcgtcgcggtacatttgctacagagtcatggcaatctttagccgtttgttcctgatcttgtggtatgggcgtctccgtcggcgtttgcggcagcaatagctatctgaaggaatctttttactcttaaaaattgtttgcaatacaaaattgctctgattgtggaccaaatgactagccagataaagatgacggacccttatcggtgaaccgtgatgcaagacagtgacacgtaattaagactggttcccataagacttttggcggcgctcccgtggacggtgcatctcgttcgttaatcttatttgttccaatccagtggaagtgcacccgttagctccctgcttcctgcacacatggcgtgtgtgtgagagaactgagaaccttgtacctcatggcaataccctggaggcctggaactggcaagttgccttttaattccaaaacaaaaacaaaataagagaggaaaagaaaaaggaaaaacaatgacatactttggttagcttatcttggacaagtcttctttaaaaaatctctcggacaagtgaatattattaatgtatgtactatctccaaatagtatcctagtacgaggttagatataatctagtattataaatttagatatgcttccctatgcagatttatagtactagattttttgtgtatagtatactaaagggtgaatagtcaaagtagtcctccaagttttatctaaggctcagtttagttcttgatgtttcaatctatctatattagtcctttaaattttcattttagttcaaactcattcttaaaccaacaactctcttgataaatgacacttataccctcatcattcacatatataagagaaaattgcatgcttgatttttttatagataatgcatagtaaattatgtaaaatgaaaacaaattatgtactagcaagtgtatatgatagcaattgcttaagttttatgtgcacatgttgaaataatgggaagtacatctgcaatgttgtttattcatcttggttttctcttttctatctagtacatagctaaatacaaattaagggcaaaagggatattttctaatagagatattgactacaaatagccatatggcatattaaatggacccaaggataattttaaaccaaaacaaatatttagaggagttatgtggacaaaatgaaacgtgaaggaccaaattgagccttcgatgaaacttgaaggactaaattagctattcaccctatactaaactaaattgatataattttgaaatggatgaagtcataactaattatttcctcttaaccctatcttgcaacgtaaatatacgcttcagtctcttttttatatacatggaaacagggcaacaactgtctcacacggtcactctcaggcttcccaacttttccgtatactctctccatatcaaaataaaccaacctagctataaaaaaatagaatttagtacaacgaattctgacaggtttttgtccagtttcattataccaagttatatcccatgtaacctagttggtttatttaaacttgtcacacctaacctagttggtttattttagaatggaggaagtaattgtaaggcatgatgctgaagtcatatacggtgagcccttatggatggaagttttgttttaaaaaaaaatggagaaattcaatccaaagaaataattcctacatgagtataggattataggattgcttcaaagataattcaaatgataacgaaaaaatcctccatattttgcaggaattctagcaaggggtcgaacctcattgtttcaaacttctttgagatttccaaggcactgtctctcaatctctctacattcttattaggaaaaaaatctaacaataatacaattaaaatagctttcacccattgtaacgcacgggcattttttctatttaatccaaaagaatgtgggactattcaatagccgccgctgttgccgcagacagccaagaagagccggagccatggccgaattttttggggactttgtgaagggagaaggtttgccggaggagggagaggaaggtagcaagccactggcgacgaagtcgagctagcgatggcggcgatgtggttgtcgacttctcggggaaacgatgggattgggccaatccagtggatacccatgggttgaatctaatctggaaccaaacttttgcagccaaaaccaaacaatccaaaccatttcccatctccatccaaaccagtccagtccatcaggtgcaccaacccatttccacccgcccaaagctaacccacactgaaatccaacccactatatccatttattagcaggcttactcgtgtagcagattagctcatgcaaacgctcagtcgaacggagccttagcgcaaactgactacatgagaattgagattaagccgcgcaaacatagcagatacttgaaatttatttaccagcatacatacaacagcactgcgctggcgctgattgcttcactataatagaagcattcgagagacctgacatgttccaacctctcttacgggagaaagaaaagaaatagtagaaccactagacatggaacagcagatcattacagagaaatgatcatatttatgattcttctatctccattttctgctcttgttcatcttgacagctttcagctcctgcattcaccacagccttgcgatacttctgattataccgcaggattactaccgaaatgaaagctgcagataaagaaatagatccatgttagtctcatatttaaattagaaaggcatgttgtgcatatctgctaaggctgttcagatcataatgaaaacttaaaaaacgaataatttgctacgctgtatgaaacacaagaaaaaccgatcacccaaataaaacacatatatgctacattatacattgcatatcagctcaatctatctattatattattaaaacagccttgaaaggaggcaccacgttcgcggtagaaaaagagaaatatctacaccgttagatcgtggtgggtccaaattataacggtgtagatcaattcataacttatatagttatgaaatagaatttgtattcaactaggaaaaggatattccatctctctgtattggttagcagcatatgcatttacgtatattggagtcctgatagtatttccgtatggtgtccgatttgggaaagaaaaaataaagaagtttgcatgcacagcagaactggaaaggtacatgcgggcataactacacatgtataatcacatattactaccagtaacatagcatttgttgccaagtgttaatttactgtgtattaaagaagacattacgttcgttcattgtgtaggctagaaattctcacatcaattaatcagagaaaaaatattttaatcgttacatcatgatgggtttagataataacaacatatattgactgatatagctgtatgtaaaatataattgtatctgtataaatagagttaagagttgtatatgaaatctaagcttatagaaaaagaaaaagttgtatacgaaattaaaatatacttttatatgaaccgtaaaggagtagggtggtccagaaaactatgaaatagaaccctaatgacgattaggtttgatttttagaatcccaataatataaataggagggatggcgagtgggccataaaggagtagggtcgtgatagttgataggacttttatagagtaaaaaagggaccgcaacgatgatcaggttcattttttaactaacaatgataatagggggagcgggcaggatcgggtcataaagatgtaaggtggccacatttgatgggatctctagaaactaaaaaacgaaatccgatgagacaataaactctaaaactctattgtccgatttttaaaggtcgcagggaagatgaatataagccgtggcgggctgagcaacaagtaaagggggtgtcagttgtgtgactttataaaactataaaattaaaaacccggtgatgataaagtttgattttgaaaatcctacaacaatgagatgatgatataataaattttataaaaatcatgtgtaaaaatttaaataattttttagagaaaaataaatatttttctatggatgctagccgcgcaattgcgcgggccaccctactagttatcttcaaagcatgagttttttatcaaataatagcaactcttcattgcagctcatgttgatttcaagtggtgcaagtaaaagagaaagtacaagtaggaggctattatttttctccaaaccagacagtttttcatcacaatttagaggcaacaccaaatacttccaaagaaaatattttttgtatcacgcacaatgcattacctacttatagaaatcaatggtctcaatattccattatgtttctcactatgggttcttgggttggtttatatgatctttaagttaggcttccaaacacaacactcctgctttgctactcttattgtatagcccaagtataatctttgcaacaggatacatgctggtggccggtctgagacagtcaacatataaagaagaaccatctttctacttgaaatttttcagtaggttcctagccagttcataaaaatggtctccttacagatgtgaccaaacactgtatcgaaaatacttttaccagtacctagtggatacataacatttttcatgaaaagtacaatggttataaagttattccaacagtataaaccatatcagcatagatacctgcaatgatgcgggtcttcacactgaacatgttccagcacattgtcactgctgtacccgcaacgagtttcttgcggggacaagacttccatgcttctagagcccgatctctcaaaatttcaactaaaaagaggaggaaatttagcctagcgccctgaacaattgacatatagcacggagaaggttaactcaatagaaacaagtaaatcatacctctcttatgaatttggcttgaatagcagctataaagctttgggagtgtaaagctggtgaaaaaccctgcaaagttccattaaacacaacaagcttcagcagagcagtcaccctaaacattgatattcttctttgtgtatacaatcgtacctgtggccagaagtctccatactgtaaccagactaccgtatttagcaccaaacagaagagcaggtaatacctaagattcggcaacaatagacttctgtattactcaggggaccgtttgtgtgccaaaagaatgtcatcaaattcggtacatgcttactttgagagtcatcgatggttcaccagagaagatcacttgtgcagttgatatcatggagtttgcaactggcaacacggctcgtgcagcacgaagcacatcatcttcagtcaatctgaagctccttcccctctctacctgctgcctgctgcagatgagaactcagattgattgccttgattgaaatgggtttacaaacagattgccactggctcatactgtcatacctctgaggaatggaatctttgaagaaggctaagcccaagaccatcacacccaagtgacaaagcgccgagattgggctgcagatcatcacccgaaagccgaaactcagtaacagtacatgatcaaaagaacgaaatgaactgcaaagcaggaaatccaggtagaaggggatcagattgcgcaaacctgaaggtgatctcccttgaaaaggagcaggagaagaagaacatggatcccaacccaaaccagagtgccgatttcgccacattcttccacatcaccaagtcgacgatcctttcccagagatcttcccacccagactgctcgagggcatcagcacctgcgccacaaatcgagatccgattagacacgaactcgaggaggcaattccccatacacaacgagagcaagagcaaaagagagcatctggagcagtgattttctcgaggcaaaaattagccccaaaccaataagaaccaacaagagatggcttcgctaacctcgtatcgcatcggtgctagccagcaccaacgccatgctcgtatcctccttatccgccgccgccgttgccaccttgtccgcggccgcaggcgcggccttggtcgccgccgcccgggtggacttcctcctgcgtgccctccgcgcggcgtcgtcctccacctcgatctccttctccagcctccgcctcgccctccgcccgttcctcggcgacgccaccgcgggcgccgcgcactgctccgcggccacgcgccgcctccgcctcggcggcgtccccgccgccggcgccgccaccatctccaggctctcgtccaacccagccccgcgatgccgcgaccagttgcggcgcgccgacccgggcggcggggacatcaggaggagctcctgcagcgagcaccccgacagctgcagcggcgacggcatgggcgacgacctctgcgcccccgcccccgccgcggacttccgcggcggcgtcgcgacctcctccaccgccgcagcagcagcagcagaaggggagtggtggtacggcggcgcggggagcctcgcgggcggcgccggcgacgaggcgtggtcgtggtcgtggtccatggccatggccgccatgtgttcgtcgatttgcctcgccgcgtgctttggtcggcgttggatttggaaggtgtatttggcgtattggagaaggttgggttggggtttaaggaggtgggaaagcgagagcgggtgggggagatttttatggggcccacgtgtcagtgtgcgtacgtgcgggaatatagccgttggggaaacgggacacggccacacggcaagcggtggtgcttttccaggtgtcagaatgaattgcggtgatgtggatgacaggtggggtcatgtggaggactgaggagtgggtccggcaagtcggtgagggggagtttgaaccgtttcggagggtggaagggtggttggtgaggaactgatgaggatcgttaactcacactctcacagtgtggagtggttgaaggaaataaagctcgatagaggaattaagaatggtactactaggcctcctttttattagcatatttttcactctgttaaactgtgcatttcatacagtgcatttcatacgtaaatttatatagaaattactataaaatattatataaatatgttttcaagattaaaaaaatttaaatttaattaattaatcatgtgttgattgtatttttgttttatgcacccatacttaatcttcatttttagcactatcgaatagcctaaattctcaattcgttttcccatttgctatttagcctcacatcgttttgctctatggctaataaggcgtaaattaagcaaggcaattataaataatttatgagtaaaacttacatatttatatttgtatgatttataagagctaatgttaaaaacaaactacactaaaacttaaaatcaagtttaaaatttaaatttggcaatagctgatagaccaataaacaaatgacataggtgtcaaataaagttgattgccgatgtctattatacattaagtgaaatgtttgttttagagcaggtatagtagttagtgaaggaataagttcaccagaggtcactcaatataacagcgagagtttttttgaggtcccttaactacaaaatcaaaaatgttcacttctaaactcactcaaaccgtgcaagggagatcccatggcagtatttatgtccggttttactgacgtgtcattctagttagaaaaattaaaaaaataaatatacagggcccacatgtaagcgatggtgtaggccccataactctcctttcttgcttttccttttctcttctcttctctccttctctctagcaggcacggcggcagactcggcgtgaggcggccggcatcgaagcaggggcggcggtagcgggagagggggagagacggccggcgcgatggcgagctcggcggcggagagtagcggcgcgcggcgcggcggcgagggagaggagcggcaggagaggggtcgccgtcggtagcagctggccgcggcgcagcgcgccttctgcctgccgctcacggggcacgtccttgccgccgcggggaccgggaacaccacgcggaggcaggtgctgcaggcgctcggctgcggcaggggcagcgcggccgacgtggccaacgtgggggctgcggctggcggcgtccgtggcggggagcgccgcgggcgacgagatggccgtccgcgccgcgtccgacggcggcgccgtgcgcgtgtagaaccgggtgatggaggagtggcgccgtgcgctcttcgtcgccgcgcgggagaggcccggcaggcgcgacggcggcgtggctgtcttctccgcgctcaccggcgacctgcgccatcgtttccgcgtcgcgcacgaccgtcacgtcaggtccttcacccccggggcgctcgccttcgacaaccggtgcaaggcgacaaccggtcctggtcggcctcgagcagctgcgcgacctctcgacgcatctaccgcacctgtacctccttgcggttcctcagcagcttgatccgcgccagcgccatccgcagcgccgtcttgctgcggcatccacgagacaaaaaagaaaagaaaagaaacactgttagcccttgcaagcacgcgccgtctccgcgcacacaaacgcgcgcggagagttagcgaggacgagatgatcttgggcaggcaggcaggcaggcgggcaaactgaccacttgtcgggcttgaagcccatgtgcaagacgccggacagcttcaccttgctcctgtgcatctccgcgcgctcggtgacgccgacaagctccagtggctcgacggcacgggcacgctcatggcggcgaccatgttcccacggacagactccttcgtcagcctgctgttcatgcgaaaaacacatactagtatgagagatctgcttaactctagtgcaggtcctaaatcttgctttcgggttcaaaaacgtgccagttgatttgattctgcaatcaacaagaaagaaaaacaagaaaacaaggttaaatcaataaacgatagccaatcggctaaaggctgatgacatatcgttaattattgagccaacgttattggcattagatcggcaatgaagaattaaacaaaataaagttaaatctgctcgatcggctgtagatatcaataatatataatctacttctagaagtatatttaagccaaatgattgggatagatcggacagcaagccgagacagtataaatcacttatgcttaaaagtactttaagacgaagatcatatatatatttataacatagccgatgaaacagatttaacacgtatcgactagtactccaataccactctatattaggatattaaaagcagatagactataccagacaataggcctaatatattttaatgcaataaaatcttaatataaagggcagatttagcatattgagtagtcatgtagagagcaaagtagctaaatcaggtaagatcggctgaaactccgatactatctctattgataattataaaacaagttagaattatagctatagatattacttagtaggtcgaactcgatgcagcattaagcatagggacaaatataatatctacacaagttgatgaaaacctctgcgagatggtaaatatcaatgttgctgtctaaccccatcagcggccttctaaccgtagatgttaaccgatttagtgttagacaacgatattgatagaaattatatagcatatacgataactcgacgatttacataaccaagattagagtgtcataaagatgtaagcactaatcccaagaacgcaagccgccatgacaagttttacctcttgttgaagatcgaaatcgatgcagctcaacccaaaagcaagaactcgttgaaacaataaaaataaaaaagggtggcgatacaccgaaagtgttattgaactgtcattgttaattacatgggatcgggttatatttatacccgagatatatgacagttccttgccggacacgactcttatctccaacaaaatttaagatacgaacaaattgtaggatcgagatgtcgactagaggggagtgaataggcgattttaaaactaaatggcacctaatcaaaactaacctaagttgctaggcttggtgagggttaagtctaactaagcaactaagttatgttttgcaaacctagggtgatagtggctcaattaattctctaggaaagtaaatcacactcctatgtcaaagttttgcaatcctagggtgatatgatctcaagtatgtctttaggaatataaattacacaaatataaatgcgacaatcaaataagacaaggagacaagagatccctccacaaattggttgttgttctaatttaaacgaaggcccggtttagatggcaaaaatttttgttttggggtgttacatcggatatacggacacatatatttgaagtattaaatgttgcctaataacaaaacaaattacagattccgccagtaaaccgcgagatgaatttattaagcctaattaatccgtcattagcaaatatttactgtaacaccacattgttaaatcatggcgcaattaggcttaaaagattcgtctcgcaatttacacgcaaactgtgtaattgatttttttctacatttaatactccatgcatgtgtccaaatattcaatgtgatgggtgaaaagtatttgttttggaaacaaaacagggtcgaagtttcagcttgtttctagtttccacttaggcctagttttttttctcaactccaaacttcaaatttataatagttaatttataatagtatatttaacatatactctactgctatatagttaaatattagaatgtttaatcatcaaccactataaattcatatagtttaacaccataaaatttttattttttccactatgataaatacttttataatatataatccacatcttgttaaattatagggatatccaaaaattaagagtaaatttcacaaaaactaaatgtacttttaccaaactatcacaaaactacaaatttaagatgaaatatcataaaaatataggtttaggaataaaatgatgacaaattacatgttctgcatgactacaccaagttaagtacaaaactacaatatttataactctaacataatagcagtgacatgaattcaactgtaaaatatacagttttgtaataacttgagtattaaatctacagttttatgatacttggccttatatatgtagttttatgataaatcttgtgttaaatatgtagttttacgatattttgatctaagtacttatagttttttgtgaaatttactcaaaaactaacttctaaagatagacacaatgaaaaaaaaacccataagtaactaatttgaattggtttgctcaaatcagatgcacatgcgcacacacccatttagtcctacacaaatgtgtcgtatacaggctgacgtattcaaatcaactgtaaccaagaatgacttacagttatagattacagcatttcccgacaattaatacattacaaatacaagataggtttgagttcacctgccggaagaatacgatatacatgtttgacaaggtaaatgatcatcttggtcacagcaacagattattaagaacaacatttgggtgccccaacgcgtagttgccgatgcaccacaataatgaaatatctcaacacctttgtgcttaggtttccagtttgccatgcctctggcagaaagattttatcctttcaaaggcatccacaagagatggtatatcgatggcgaaagtgatgcgaacccaattcttcaatcctaatgcactccctgtaaaatatttttttttctcctgagaaatactcatgtgcattggggcagaattgagtagccaagaacaagaaaaggcgtgccatctggacaaattaaactccttttcacgctgtgtcttatcttaacctttattttcggtaatacgcaaaaggtttgtgtatcgttgcattaagagaaataaagttcagtacaaataaatacaacagaggtaaatgttagcctaattcttgcaagtttcttaacctttatttgtgttgcctttccatgtaaggttgtagaatatacctactagtgtactacacattatcattaggaaattggtgaatggtgaaattgcattctaactaacattgtttagtatacttacactatatgttaaagcaatgacaaaatggctgagatataataggaaggcatgccatatgataatcaagttcaagacaatgtttgaaacgcaaaggctgctatgaaaaaaaaaacaatgcaactgtgtctcgcaatttaccatgatgtctctgttataataatggaagaagcataatgaaactaatcagatgctcaattcgtttcgcattagggtcctcttgtggagttgttgctaacaatatgactccattgcagacattaatgtgtagttgttccagtgtatttccactatgtatccataaaattcttaaaacaggttgacacgttgagtggctgtagtacagtatttctgtgcacatagtggattttgatttatattgctaaatggaagtaataatggtcgtcctgtttttttaccatacaagaggttgaacatttatggaatttgtacctggcaaaactatcacagactcctcttttgccaacctgcagcagaagtccatatcatcatggaagccatccaagtaagagagatccaattttacctgaaaaataaaggatagacatgaattagatgatgattgagattaggatacaaaactgagccagttcatccagagcatgttagcctgtactttttcttaccatcacaaacattgatccctctggcttgtgtggacatgtaatgcccttgatgtcctttattttatcataacataaatccgctgcattccttaattgatcgagaattttgttgaagtaatcttcttttgtgttggctataatttgagggattgctccctgtgaataagaatattagaatgtaacacactttctgaaaaattatgttgccatgcatgtgcatgcttgttagagagtttgtgtccagaaaaagaggaatatgtctgtaaatcatattgccataaatgatggatgtgaaaataagaaaggcacatatacctgaacaaacgttgcaggatcagttgagatgttaatatagttctcaattgattggttaacctgtcatgaaacattttagataagaaatccaattgccagtgcaatataattattatcctttttttgtgaggaatataatgacaaaatatccccttcaaaatgtaattgaatgcacatgcagcaactaaaaagaaaaggaagggaaagatctgggtagcatacaaaaatactatcagccaccgcaaaatggtgcactaacacattattctagattctatgctaccaacgcaaattaaccaagtatttctaagaagaaattatcaggctagacaaatgtaaaaaacctagccaggtgtgcttatttgctaaactgttttggagcctggaatcaaagaggcatcaaattcatctgcacttctgcagtttacccttaggcagaatgtgcagctttgttaggcaaatttacgagcacaatacaacttcgcgaaccaatagtgaacctagtcatggatcaaaacaagatatgcattggatgttggaacacagatcgagagttaaccttggcttcctttaaaatgccatttggatcacatgttgctatccaaccaagtcgccaaccaggtacaagccatctttttgaaatagatcccaaggtgatcactgggacggtcttcccaaaaacaccaataggtataaaaggattattcccaaatgccaaatggtcatatacctcatcagcaattatcagcaaaccaagtttcctggcggtctcggcaatctgtttgttaaaagcacataaatggcaaattgcatcacacaacaaaatacccagtaccttacttgtccaagaaatatactcacttttgccaaatgatcatacgaatacacgcttccacaagggttactgggattgatcacgacaattgcaacagtgttctcatcagcaatagcttgcacaccctctaggtctacctcccagcctctctctggaatgagatcgaaatgtcgaacctctagattgctgaatgtagtccgtgattcatacaatggaaagccgggtttgggaagtaagatgttggatccgggctgagccaaaacagagatcatgacttcgatcgcttggacacatccggaggtcaggtaaatatcatttgccgaaagctcataaggaagatctcgagataggtattctgcaatagcactaaagtttaaacaagtaaatatgagagatacacaccattcaagattgaaatctttgggaaaatatcatgcagtattgacaagcaggaattttaaaaaactggtattgcaagtaagagaagctaaaatattttacagatgagcgcctgacttagtactttttttacaagaaatgcacagagaattcttttatttagttaagaacaatatgaccatcaccacaagaaaataagagagaaggatatgaacatgcattcctaagttggtaaattgtactactatatggataagaaacaattagaacactgcagatccttttctttttcctttgaaattttctgaaatattgttccacactctaaacatgccgatttacattttgttagttatttagtgcaacaaaacatcaacaaattcccctttctttcctcatcaaaatgttaggagtcaaagcatatctacatccatagaaaagagataagaatgacaaaaatggaatcctattcctccatttgcttttagtaaaaatattattattataaaaaggaatcaaatttccagctccatattgaaccattctccattaaatttacctcgcaggtaaatttcaaagtttccagcttggaaggtttgaggccctgtttggtatcccagcaacttgtcaaaagtaccttttgtttttttcctattcttgaaatagcatctccctatgtactcgaatatttgtccaagtcaagaaagcaccggtaaggcaccagacaaaataaatgctcaatcggccagaaattgtttggtgccaggggaaccagggaatccggtgaatacactgtgatgccgggtttgaaaattccaaaataaatcatggatgtatcataaatttaatttgacagtcaccataaacattgaagaactgtttccttttctatttttttcttcttaccggaaacaagaggtgaaaaaaatatgtaattacaacttcgtcgtgcaaccagtatgtgaatgaggagtaccaaacatatcttccatggaaaaaagaattcaaactagaaccacaaaataattaaagagagaagaaaacaggaaccaaataacataagctaaaacatcaaagagttttctaacaaaagagctaaaacatcaaactacacatactttatgcagttaaatttgttgaaaatactaaaaaaaatccaagtatgcaaaatgttgcccataaaaatattcaaatctgtttttctgatcagtcacatactagaacataagcagagcacagtgtggcaagggggggggggggggggggggcagctcaccggcgcgccgagaggacgccgacggttagggagtagccgttgtgcgccccggagcggagcgcgtcgacgacggcgtcctcggcggcgggcgcggtgcggtagcaggcggacgcggtggggtcgccgttgccaagccgcaggacggggcgcggcccgccggcggcggcggcgtcgacggaggagttgacgcggttgagcaccgcgcggatgctcgtgaggccggcggccgccaggggcccgccctgcgacgacggccgggagaagcgccaccgcggcgtggcctccgccccgtcgtccccgcggcgcttgccgccaccgacaccctccattgttagctcgatcggatgccgctcttcgagcggtttatccaaatttgttcgtttcgaaggtgaacaaaaatggaaatatattctccccatatatcggcggtgctgtaccctgtactgtactggctgtgcatcgtcacagatgtcacaataattatggtgatatagtatttttaataggaagaggtagaacatcacgtatcacgtgaacgatttgtttaacattattggttctaaaatatactccatctgttcaaaaaataagcaatttatattttgtatcggtactgcttgtccggttgttatatccagtatccacaactctcatttatttaaggcatggtttatattcaaacttttttctttaaactttcaactttttcatcacatcgaactttcctacacacataaactttcaatttttctgtcacattattctaatttcttcaaacttctaattttgacgtggaactaaacacagcctaactttttctcttattacaccaaccaccctcatactcagccatgcatttctaagttccaacgaaggctctgattagattccaattttcttctttaaatttctaactttttcgtcacatcgaactttcctacacacataaacttccaacttttctgtcacattgttccaatttcttcaaacttcctattttggcgtaaaactaaacacacctgaaatggagtagtatttcgtagtcctgtcttggtccacaaatgcatatactgtatgctctctttcgttccataatgtcatctagtgtccatagcattaaatacattgtcacataagtaaaaaattctactccctccttcccaaattgatcattatgtaatagaattcaaaatttctaaattaatcatcatacaactgcatggatacggatttcatcagaatataattaatgtagtatagtatgtgaaaatgtatgtatgctagggtgtaattggtatgggattttaattgatgcatgcattgtgggagaaatgtgtgcatggtgtctttattgatgcgatttaaattgtccttggtcttggtgcataaacttatatttgggaaggaggaagtatgtggcaagagagttaacgaggagatatgtaaaaagatgaagaaatcatttctcatgcaagaaactatctctacacaagaaccaataatgaaaataataaggggatagatagataaaaggagagagaagagaggtgattggatgagaatttaattgaacacaccatccattgaatacatagtttctacacagtgtctatatgatatggcaagtatagaaactacttcatagtttttggattatggatagcccaatgtacgagaccgttaattttttatcccaaaatatataaaatttagtataaatatataaaactaaaagttaagattatattttctttgatgataaaacaagtcagaaccaaataaatagtatttatatatttattttgaataaaacaaatgatcaaatattataaaacaattcaacacatcatacattttgagacggagggagtatgtacccaaactttaacaacacattatatgattgaaatatgttaaaagcttagtataactattttttttcaaaatatgataattgaagagttaattctagtgaaaattgaatcctatagaatacctcattctatggaagtcccaaccttatagaaagtttgatttgagtctttatcctttctaaaattgttgtgtttttttctacggtacaattaaacggttattctgtaatttttttcttttttaataatcttttttagtacttgcattcttataaaaattctgtgttttctttagttctctgttttaatcctatatctatacttcctataaagttataacccactaattctaaaacttaacatgcaaccatgccacatcatcatccactagcaataattatatattcaacctcatacaagcaatatcatctacaatctatttaattctacaaatcaacatgcgtccaaacatattcaatcatcatctctcacatcatttccataatatttttataaatatatgtatcatttttcggtagcgctattccgagcgctagagcgcggaatatatatatatatttgggaataggcgaggggcgcatctttgtattaagaaggaataaataaaaaacacgaaagggacaagattcaggaggggggaggaggaagaaaataaaagcctaatctcccaacgaatgtggcgaccttccacccgacataagggtcgccatggccggtatcgcggctctagccaaccgccaaaggtccgcttcgcccgtcatgtccatagcaatttccgcccatgtcctgctcttttggttgaagacctgattgtttctttttttccaaatcgtccacgccaccaaagttgcaatggtgtcgaaccctcgacgatgttccttggccattcttttgcgactgtcacacagccaggagtgaaaggaatgctcattgagaggcagacactcagaatgaccaatagctgaaagagcaatccaccatagctggaatattgttccgagcaccgcacatcacgcccagagtccgcaaaaactggtgtttgtttgcccacgttctatctgtctagattagttctatttaaatttggggtaaatcaattatagatccgtaaaatcggtggtcggttgaaaataattgttgtaattggtttatctctgtttccaatcaaggagctgaaagagcaatccaccatagctggaatattgttccaagcaccgcacaccacgcccagagtccgcaaaaactggtgtttgtttgcccacgttctatctgtctagattagttctatttaaatttggggtaaatcaattatagatccgtaaaatcggtggtcggttgaaaataatcgttgtaattggtttatctctgtttccaatcaaggtagttacgatatggtgtgcaacaaactgagaccaaatcttgtagtaatcgaattaacatcacgcccagagtccgcaaaaactggtgtttgtttgcccacgttctatctgtctagattagttctatttaaatttggggtaaatcaattatagatccgtaaaatcggtggtcggttgaaaataatcattgtaattggtttatctttgtttccaatcgaggtagttatgatatggtgtgtaacaaactgagaccaaatcttgtagtaatcgaattactgtcgatgtaaataaaaattgatggtgcatgtgcctgtagtaattagattaacgacaaccatgattagtgaaatcttgtagtaatcgagttactgtcgacataaatgaaaaatgatggtgcacgtgcttgtatgtaacgtctcgcctctcccagaccgggctcgcttacatctggccgctttcataggtcatagattgccatcacagaccaacacaagccttttctgcacactttgtcgagaccggcttccggaaaagaagttgcaacttattgatatgagtattctattaatcctattaagccctaggctgggatgtcacaccctcacccccttaagagagatcgacgcccctgtcgatcaacccaggccaggaacgtcccctcttggccacgtccatgtgtccaatgccagcgcatgtgccatgctgtgtgatcacagaccaacacaagcctttcctcttggccacgtccatgtgtccaatgccagcgcatgtgccatgctgtgtgaccactccgggtccacaccagccatgcataccatgccgctttcataggtcatagactgccatcacagaccaacacaagccttttctgcacactttgtcctcactcatgcgctttcataggtcatagactgccatcacagaccaacacaagccttttctgcacactttgtcctcactcatgcgcaatcaggaagaatttcctgatcggtcacccatcccgaaattgctccaagctaagcacgcttaacctcagagttctttcgagatcggcttccggaaaagaagttgcaacttgttgatatgagtattctatttatcctattaagccttaggctgggatgtcacattgtagtagttggattatgaacaagattggttgatcaaatcttgtagtattcgtattactgtcgatgtaaatgaaaattgatggtgcattaacttgtagtaattgcattattgctagccttggttgatgatttcttatagtgagtgcatcaataaggagggagttactggggcctaattagtttatcccaaataatacgtgaataaactttttacttattcattgaatcactccattcaaaatcacaggacaaaaaataaagattttacatgcacatcatagtaaaagcacaagaacaaaaattttacacacaaacacagcaatacacgcaatcgccagttccttgtgacggctgaatggagtttctgtccgggggggctaatgggcgatcgatcgccagggcgatcgcccagcgatcggatctgcccccctgcccctataggcctcccacttctccccttcctcatccccttcttctcttcctactacagtacaccacaaaaattttttaaagaaacaaaagttagaaaatttatgtatagaaatattatatataaaaaatttgaattcaaattcaaatttgaattcaaattcaaatttgaatcgggtatgtaaacttttgacttataaactttggatctataaactttaggtgtataaactttagatgtatagaaatactatatatagaaaatatttgaattcaaattcaaatttgaataggatataattcaaattcaaatttgaaacatgtatataaactttaggtctataaactttaggagtataaactttagatgtatagaaatactatatataaaaaaatatttgaattcaaattcaaatctgaattggatatataaacttttgacttataaacttttggtctctaaactttagatgtgtaaactttaggtgtataaactttagatgtataaatttactaaaataggaaagtaatgcggtgccaaaaaaggaaactaggtggaggggtggagggggggtgaatctgatcgccctgggcgagcgagggcgatcgctcacccagtagcatttccggtttctgtcctgctagagagagctagcaagaagacaaagcggcggagatgcaggctggagccaaggcagcaccaagtctagccgctgcgacctcggtaggagccggatccggcgacggagccaaagatggaggtcgttgttgctgttgtcaccgcctcactgtcataaactggggaatgacagaggtgatgaaacaaatcacagtttcttgccgatgttaccaaatcgattaaccatcacaaacaggatctccgccatgcaagggagaatagagaagcacgccaaaatgagtgctcaacccaatcgaagtcagactgcatacaatcaagaaggataaagaatttaattaatcatagattatatacaattcttgcaagaaataaagaatctcattaggaattgttgagagaactcaccgtcctcatgacgtccacctcgtttgccatgggccagacgtctcttcagcatcgatctgaagcagatgttgctgcagtgaggcctgaagcagtgccttcgcctcaagcgtcgccggccaccgttcaccggccaccgccatcaactgccacggtgtcgtcgtcctcctccatggtgcgtcgccgatctgtgggctgggatggtggatcgattgagatctggaaaaaaaggaaaaaaaatgaagtgggggcgagaggggttggttgggtacgggcaaaatagaatatataccagaagtagagaggttgtttttatcggagtaaatcatttactccgataatggtgggagcacgatgcgggacgtggggtgggatcgaaagggaagttgtttttattatcgaagtaaatcgtttactctgataacggtaggagtgggatgaagggacgtggggtgggatcgtaaccagggaagttgtttttatcaaagtaaatcgtttactccgataacggtgggagcgggatgatgaaatgtggggtgaggtgggcctggctgatacacgtttggcgcttggaatataggagcgtgcagtgctcccaatagtagttctaatcttttttataatatttaacataaacttatcaatatgttccacattgaagtgcgagattcatttgtttgttttatgctaaaaactgtaagacctgatatttcatttgttttccttttacccttggcttgattgtaaaaaaaaatatatattgaaaagtactaagtaatccccgtagcaagacgctgggaatcacttagttttaaaggaggcctaactgttatacaatgggatcggaatagtactatacaattaaaattttggagtctaatttacttaatcacttaatttttctcctaaacatgatcatcgatctggtgcttaatgcaaaattttgatataactgaccttcttgtgaagccattgaagccgttcaatcggttttgcttgttgttcttcctttctcttttcttattcttcgtctactttgcttgttgttgttattcctttctcttttcttattcttattctttgtctgctttgaatagcatcttagccggggcagagatgtcggcttctctgttgacaaaaagaaaacttgtagagatcacctcatgaaccccttctagcatcgagtcgatcgggcgacttagggtgtgttcggctgtccaactgagtggttgtgcagtgctgctgctgcaataattatggtagaaattgtatgtttgctactgtggttgttggctgccatcctgtcacaccaaacaggcccttaaattagtgttttaaaatcaagacttctggtgtcttcaggagcggcgcggtgcacccgtcatcgtcggtgcatcccttgtcaaagccttccatccattttccgatcatcgttgtttgcttcctctcctactgcctcacatctgccgctgctgctatgtagccactcccgctttccgcggcctcaggacgctggcatgcttcaatgcctcgcaagggaacgaggcaaccgatcatgctgggatatcgggagttcgggactagggattggcctccggtagcccgacaagtgccttatccagtccctctcactcttctctgcgtagcgtgagtgctggagaaaacatgggaaacagtagcagcatgcatgggtagcttttgaatgtggatttggataaatatctatatctatactaatataaaaagaagttgcccccctccaatgctacaggccaaatcatcccccaatcatctttgtcctcagccgtccgatctgttgatccaacagcgaaatcaccgattccgccatcccaccaccacacaaatccaccgcgctatctacgcccccacgctctccccgcgcgatgactccgccgccgcgcctcctcgcgctgctcagatgcgcgctgcgcctcccgacgcttcctccctccaggccgccgtcgtcatcgcgcggtcccgacccctccagtatcccccccatcccgcctcctcctccaccgcgtcgccgatggttccatgtcgtcgtcgtcgtcgcgcggtcccggccagctgtccaccgcgccgtcacagatccagccatccctcataccggactcccccatcccgacggccccatcccagcggcgaggaggcgccgtcgcgcgggagatgactggtggggagagtgaagagggagaggcggatggcaaccatccctctgtcacgctcgctctccaatcccccttcacagtcgagccctgcgtcgtcgccttcccccgccgatgccaccacatcaaggcacctcacgcatggagctctttccccgaagccggatgcaatggccggtccctcgctaaggcgcccagcagatccggccagttgcctcagcaacagagagtccacggacctctccgctgctctgtaagaggatctggactcttctgccaacgaggccactgtctgatccaccatcgtaggggattctttccgttccctaaatgcaccacatatcttcccctccggaaattatttttttcaaatgaaattgatagaataccaatggctgttgtaacaaggtaatttgccctcaacctttagcttttcaaattagaatcaatttaattacttctttgtttacgcgcatcattttaccctaaagactgatgcttgcactgatgtaccatgttgtcatgggggatgatctagacgtgaggactgacaagccatctcttgatatgtttcttgctgagatgaggaggttcgaggtattgccatgtaagtgctctcacctataatgttctttatactaaacacaatattataattttacctggcacaagtgcattgcatgttgttcgggtcaatttggaaccagtatttcaagctccttcttctgtagcagcagttaaaaattgctggaatgtgacttcgctcctcctcgctcctgtgtactgccgccacgccgccgcatcctcgccggagccactttcttctccatccaccgccggagccgaggtccatcttacagtttaattcctcactgaatgttgactatccctgccaatccatcacacgattccctctgaatgctaatccattcaattaatttcctgcactggtaatatctctcccatagtggggaatcatgtgtcttttgtacaaattacataggttattaaactggattctccatttcactttagaagttgattttcttgctttcttggctatatttcctgtcatcacatcttacatttacaagtaggaacgaaatgatggccgactaccttcttgatcactgcgatgtgccccttcgcttcaaggatatgcataaatccaaggtgattctcatcttccaaatctttatctcgatatttcccctaggaataaaagattccaaacccatattcacctatttacagtgagcattaggatcattttatagaaaaagatatcgaggtgatctagaagttattatacattaggtctgctgcttcattataatagatcatatgtgtatttctgaatatatcttctttgtttggtttttcccagtccggcactctgctactattctaggtaccggactacaacctgtaatattattttgcggtgtactgattgggtggttagatttcaaaagcaatttcaaattatctgtcctgtccaataactattgccagattacccaggtgccatgtacaatactatttttttttaaaaaaaagtggcactgaggaagtttgagaaccagtatgtactcctaccaatgaatatcacatcatggtgtttcaggttttgtttaagtttggaaagaaaatatacataatttgtggcaaataatgttcagatttgcagattaacatgctaccaaggtcaaaactgtatgtaatacatgcaagtgtcagattttttttgttcccctactttactaaaactgtaaattaggtttataacgtgtttctgatatataacaataagagaaatcatgatatcaaaaagtatctgttaatgctataaggcatctgaatatattggcttacttctattgtttataatacaggttgacattgtggccaactggagattttggtaaaatcctatcatgtttcaccatggcatttcactgtttggcgcacggtatttaggagctatttgtatagtaaatgctggagtattgaagtaaattatatgttcagcttattaactgcattgcgataagctttgatctagatccggtttcaattttcatttgtgtggtcgcatcctttaatttatatagcttcataagagtatactccgaagtacatgccgttttatgtatttttatgccttcatattctgattgtctaatggctctaaaacaacagacgggtggcctcatcaggcgaattgctccctatgcaacctgacatttcaagatgacacccaacctttttgttcaatgtgctttcacaaacaggatttggagattgctcaggagctaggtgaatgttggctttccgcttcccagtgacctcaatgtagacttggctgattggcagatggcttcaaggagaagcttcagagattatctcagaaaagtttttggtacactcttcttcttcagagattgtctcagcaagttgtatggttgtgcagctctttggtgacatcaaagaagaaatcacaatctggagggaggcaggcttcatggtaggcgaaaaacgattggcattattccttttgtagttttttctctcccgctctttgtaaccggttttgacaacttcgtgtggacgcttagtttgtaacaccatctcataatcttaatgaatttgcttagcctactcttgggccagtctggctaaaataaatgtaatcagagttacactttatttgttggaaacataacttgtaaaataaaactaatcatttttatcctaacaaaaggctgctcaatgctgcaataatttctgttgaaaaaggaagtggcaaaacaacatgtcttttgctactttgttctgtctgtttttcttgaagaattctctaattttattgtgattagtcttttgaaaaggctatattaaagaatttcttattttgttttggttctttctatatgcacaaattaatagctctataaattcaatagttgaagagaagcaatgttcagaaaagttgaatatgcacttgatatatatgtgttaataaattacctttcaaagtatgtgtactttctaatttttaaatgtgactatatattttcttgatatatattatgacaaacgtgctttgcacgtgcatgataactagtaagcacgaatcttaaagataaatcttatggccttgcagcaagtcactttattcgaaaatcaacgggatgaaataacttgactctcatggcatcgggaagctactcagctaagtcggcgtacatgatgcaatttgagggcacaaaggcgaagcctttcaagcgcattgtttgggaaccttgggcaccgcccaaatgtaagttctttgcatggctaatactgcaaaacgaagtatggagagcagatagacttcaaaggcgtggcatggcaaaccagccgctatgccctctgtgtgggacaacgctggaaacgtcgttacacctcctagcaaagtgacggctttccatcaggatttggaaggaaatggagcgctagacatgctatgatctgcatctataggattggcaagagtatgacacagcggtgcagtggtgggagggattcgtttcaattcctggaataccgaagaagcccctaaaaacgttgatcatcatggtttcatggatactatcgaacgaaaaaaacgcaaggatcttccggaatacggcgcaaacgcccacagctctgatccaggccatcaaagatggagctgcactttggtatagggcaggcgcccgatgcctaactgagtttgtaccgtcgggagagtaagccttttccctttcctttttgtgcactatcactttctttaagcaagccttgtacataaaggtgggagggattcgtttcaattcctagaataccgaagaagcccctaaaaacgttgatcatcatggtttcatggatactatagatcgaacgaaagaaacgcaaggatcttccggaatatgacgcaaacgcccacagctctgatccaggccatcaaagatggagctgcgtatagggcaggcgctcgatgcctgactgagtttgtaccgtcgggagagtaagccttctccctttcctttttgccggctgtcactttctttaagcaacccttgtacataaattgaggccatgccctcctctattaatacataaggcaaagtctcttgcctttccttcagaagaaaaagaaaaatctggttgacaaatcaaaataaaacaaccgacggttgtgcagcaagtccattttttttaattacgattgggtttttctttactaattaaacttactttcccatgaatttcattgaagttcacatagaagtttcagtgttggattttatagtccagaactttttcttgaaaaaaaaaattgtagccgtaaagcatttaaaaaaataagcccgaaaataatactagaaaagaaagaatataaatgcaaaaatgccaagcacatgttgtcatgtgcccttccaagcagactatcctgtatataccatataacaatacaaggattgtttgctaaccacccatatcaggtggtgccccgtatccgtggagggcaccttataacgacgtaataaacttgcaatgctaacgatatggtacaaatcagattataccgggaccacaatatgtttaccgctaactccgtatccaaatttgggcctgcacagggttgtcggcccactagaagctacctccgtatgcaaaggcccaccgagaggaagcgagatggcggagatccgatggtcagcacggtggacgcgtcatcatcatcagaaatttggtgccccaagctgaacacagtgtccaaaaaaatgttgactatctggactgatcaactggcaacaaagtttatcacaaatatatatatgcatgagccatattcatatgaaaaatgcaatgcctcgtgaacttaaatttgatttcgaatatataataactaataagatacacaagttcctcgattgaggaatttgacgacataatgtgtgctgatttaagtgtccaacttgattcaactttattctcacatgatgccggttctacacatccatgagtacggatgctgaaagcctgaaactattcacgagctagctggcttccttgattttaccatgcctcttgcagaaacacttggttctctctagaccatcctctagtaattgtggatcaaccgcgaaggttatccggagccaattcttcatccctaatccactccctgcagtgaattacatttacactgttttattcatcttccattatctgaaaatacatactagtcgcggcaaaattcagacagagtaaaatggtcaggtcattcctgacactgaaatgcgttcagtgacagaaacacaaccatcagatgatctacagaaacatatccataatttaccaaaaccagtaaattaaactgatgttctaattactgtaattacctgggcagatgaccacggattcctccttggccagcttgctgcagaagtcgacgtcgtcctctatgccatctagggaagacaggtccagcttcgccatgacgaacatggagccctccggcttgtgagggcaggtgatgcagtcgatctccttgagcttctcgtagcatatctccgccgccttcttcaccaccccaagggcattggtgaagaacgcatcgtccgtcttcgcgaggatgtcgggcaatgctccctgctcgatcgatcatttccatggcgtcatcgtcacagctaattaattgatcttcagagaagcgaagatgcgcgacaactgaatttggatgtgtactgacctgaacaaatgttacgggatctaccgagatggctcggtagtcaatgactgagtcgatgatctgtggagacagagaaatgatccatgaggtagttgatcaagtttttcaaatcaattgcattttggtcagtgttttaaatagcgggctaagatatttagtggttgaacttctcaagcagctataggtaggttctatttgtgggttggggggggggggggagcaactagtgagaatctgaagaagctcctagcttctggattctttaactatagcttctcgatcagaatctgagtaaaaatatgtattttttaggagcttctggtagctagagattttaggagaagctgtagctgccaaaagctctcccaaacaatagtggactaaatgaggctatagtagctaaattgtatatgagagtaaatagctactccctccgttttaggttataagacgttttgattttggtcaaagtcaaactgctttaagtgtgactaagtttgaagaaaaaaataataacatttttagcccaagataaatttattatgaaaatatattcaattattgatttaatgaaactaatttggtattataaatattactatatttgtctataagtttagtcaaactttaaatagtttaactttgaccaaagtcaaatcgtcttataatctgaaacggagggagtagatccttctcaaacagttataaccagggatttagggcatgtttggttggttatttaagcgccctcaacttaacaagtgtggcggacgatttaagcgccacacattcaatgaagaaacatgcggtagagtagttcatcgctgttgaattttgtgcggtagtctcaggtgcaataaacaaacaaacagtgggctaactatctgtggcacgcctaacttgaagtgcggcaagaggaggcaaccatccaattaacaggcccttaaaaccatgattctggctaattgagaaatttagacagcaagcaaattaagcaccttcttgttcctgaggattccgttgggatcggtggcggcgatccagccgaggcgccagccgggcaccatccaccgcttggagatgccgcccagcgtcatcaccggcgccacgtcgccgaacacccccatcggcacgaacggcttgctcccgaacgcgaagtggtcgtacacctcgtcgctgatcaccattatccccagcttcctcgccgtctctgcgatctagtacgtacagatattaatccggttatgtattacgatttgtcatcatcgccgatccgaattgatttgatcagatgtattaatcaatcaaaaccttggcgaggtggtcgcgggagtagacgcagccgcaggggttgttggggttgacgatgaccatggcgacggtgttggcgtcggcgagggcctcgacgccggcgaggtcgacctcccactcgctgtcggggaggaggtcgaagtggcggaactcgaggccgctcagggcggcgcgcgacgcgtacagcgggtagccgggccgcgggagcagcacgttggcgcccggcgacgcgagcacggacatcatgatctcgacggcgtggttgcagccggcggtgagcaccacgtccgccggcgagacggcgtaggggagctcccgcgacaggtgcgccgccaccgcgctgcacatattcaatcaaagctagccatgaggacgatatcgacttctctttagagttcaaaccaatttcatctcttcctgtcacgaaagaatttcttgaaccgaaactcaaaaaacaaacaaatatttgcccttataatatgagatgcaggtaacggatatttctccttttcaaggcagccacaaaattgagcccataaccgtcggtactaattcatgaaatatattctattagtatgagatttatgcgtttgaaaatcaccttatagtatgtagacaaagtgctaattcctaccgaaatatattctattacttctgaaattggaaggtgacctggaaaaattcttaaaaatcatgaatttcagatgcctttgttacgatgccagtctaaaaagaaaatctcaaaatcccctcaatccgcacatggttatctgaaaattagtggggtggcatgaagtcggcatcgcatcatcgctcagatcggaaatcaaatcagaagctagcatctctggagtcttgacactgaaatactactatttctggactgattgattggaatctcattagttaattaccgactgatcgatcactagtcaccacgccctatatcttttattgccagtggctggtcaatgggaaataattgaagagtcttatttatgttattttttgtccgcatattgatttgatagtactatttgtagttgagcattttctaggttgtccacagggctatgttactactctgcagctgtgttcttgggtgagcgttggaaaccctcacctcccgcacagaaaacagcgcaatggatttgtgcacgataaattaagtattagctaaaaaaatattaaaaaatgggttagtatgctttttaaaagcgactttcctatagaattttttttaaaaaattacaccatttaataatttaagaagcatgcgcgtggaaaaaaaatagaggatgggaacaagcagcgccgaacagtgtagacagtttgagaaggggtagagaatattagaaagatactgtatgattaattgagtattaattattttagatttcaaaaatagattaatgtgtttatttaaagcaactttcctagagaaaatttttataaaaaacacaccgtttagtagttcgggaagtgtgcacgcggtaaacaagagaaatcttctctctattaccggctgccgaacgcaggtgcctgtacatcactgttttaaaaataataatatagccaactacttactatatagatatttatagtttatctctcagcttactcatatagtgattaacttttcactataaatatatggcccacctatctttcccacatattttattggttcctttgcctaagctggctgtaaaattacagcccgcttctcatctctctcctctcctctctcatccacttcagcattcagttttcttatagcgctctataagaaaacgatttgtgtcagagctttgttcttgtcttagggtgcttttatattccctacatttcgcttatacaacttcattgtttggtgctttcttttattctatacgtttttcgaaaactttttatattgatgtttctttttagaaaaatcaaataaacatatttttaagtttgtaatagttaatactcaattaatcatgcatcaaaagtttatcttgttttgtgcgtcgtcataaagctaagttgaacctcacatttgaactaggccttaattgaagatactctatttatttcatattataagacgttttagcctctcttttttttttgtctaaactaacattcatatgaatttagggcctgtttactttgatgccaaaaaaaaccttaccaaattaatgccaaaattttggtatagttgacaaaattttggtaagaatttcttatatagttaccaaaatttggcagcaaactaaatgtagctattttttttgacaacttcatcaaaatttggtaaggttgaaaatggcatcaaagtgaacaggcccttagaaatatatctgaagcacataaatagatccatggatgattgtatttaaaactaaaatggcttacaatgtgaaatagagaaagtacttatttgcacatggaggataattagcacttcatgttccagttggaatgattcaagaggagatagaaagataggtatagagaggtagtttgagttgttggaatgtttttatttagagaataaaatacactcctaaaatcaggctgattgagtagtgacttctttagtctaaaatattatcttctgatgaaaaccatagaaaagattgatttcattgaagaaatattatcgtatataaaattatatgatatgcgattttttctataataaattaaatcaaacattaattatgtagctagctagtgtctactcctctgtcataaaatttagctatttctctttttttttcatgtgattaattgagttcggccttgaaattctgtaaaaatatatgtacaatgtaccctatgctaaagtgtgtgctaatttatatatataaatttgaatatttggccaaaattcaccacgcgtattcacatttttcacacgatatttcatccaagaaaaacgtatgatctgtcatccacttttgcacgcgacgacgtacctgcacgccggggcgattcctacggcgggggagtagtagttgtacttgccggaggcggcagcggcggcgacggcgtccgtggcggcgggcgcggcgcggaagcacgcgaacgcggaggggtcgccgtgggcgagtggcgccacgggccgcgcgtcgccgctcccgtcgaggcagcggtaaatccgtgtcacggccgcgcggatgctctgcgaccccgccaccgccagcgccgggttcgccgcgccgaaccgccaccccgccgtctcgccttcgccgccggcgccgccgctctccatggtggtggagcagagcaggggagaagaccagaagagggtggtgtgcgtacagcgcgtgtcacaatctgtttcaattctttgtagtttttgtaagtagggatcaaatttgacccatattgnnnnnnnnnnnnnnnnnnnnnnnnnnnnnnaatcttgttgggggcgatcatgtccttgatcaatttaataatacactacttgtcaattaactgattctatgattaacttatggtgttagagcatattcttcagcacaaaatttacatgggcaatgctccgagtgctggtatgaccatgatgcttcagattgacgtgtcatgtgtgccaacgtgccattaacacaagcaatgtgtattttttaaaggtaatgtattctaaaattacatttagcctctacgtctaaacacgtgcatagagaaaagaaacaagaaaattaagacgatacgaacgtatcgacctgcattacaataatgtcattttaagggaagtggagagtttcatttcacggttaccaagagtgtcatgtcatctaatgagatttgaattgatgaatgaaataagatctctaacatagaatttcattttgcaatttcgtaggttcatcataacatttaatagcaatacatgggattggatgagattaaactttttatctctctttataattatattgtcatgtcaccaaatctgctaatatggtactccctccgtttcaagttataagacgttttaactttgatcaaagtcaaactgcttaaactttgatcaagtttataggaaaaagtaataacattttcaactcaagacaaatttattatgaaaatatatttaattattgatttgacgaaactaatttagtattattaatattactatatttgtctgcaaacttagtcaaatttaaaatagtttaactttgaccaaagtcaaaacgtattgtaacctgaaacggaaggagtatgctatttattgagaatagaactcctgtatgaaactactattgggattggcctaagttgctatcttataacaccttttagaacgaactgtcattaaccaacctaactattagtgcgttatttttctccacacatttttatcacctactccctccataaaacaaataaaataaattcaaatcctggttatgaaactggataagtatttgttcaggttcatagcgaggatttaattcttcctgtgatggaaggtataatttattatatttttgttacagtgattttcggagattcgtttcactcaatgttaatcaacattgagtggtagtacgaactaagcactggaaccttccgttttagcaagttccagtggtaacttatcaaatctgataatagaagcagtgatatgcaatttctcttagaatatctggttctccaaacaacctagattcttacccaatctctaagaatctatagttatataaaaaataaactagaaatcagaaactgtattgctaccaaccaactacatcttagaatcttaacctattccaaataaaaccgtagattaaaaagggcacaacaaaccaacaatttgatagaagcatggctatgtgttaattaacaagagcatggcaaaccaacaatttaaaccaagtatttgcagggataagaattgttaagtggcaaccgagcaagagcatggcaaaccaaccatttgaactaagtgcttcagtgatagggaaggggaaatgtaatgctcattatccaagcaaattttactgaaacacgactccaatacaacggtcttgctttcgtattcgttacgcgtaaaattttcgagttcgacttctaaacagttttagttcgtaccactagtacagaaaagatttttccatacaggcattttgatttctctgtgcggttatccggcaccctgtagccggctgtctgcgaaaattaatattttcgcgtgcgggtgggtcgaccgcacgggataatcgattatcccatacggttgtgttatactgcccgcacggaccaaaaaaaccaaaaataaaaaacaaaaggaaaaatcgctcgagcgccaccgcctcgctccaaaaaaaccaaaaataaaaaaaggaaaaatcgctcgagcgccaccgcctcgccgctccccgccgcgcccggccaccccggcgttgccggccgagttgccgtcgtcctcctccgcttcgccttcctcctcgaccaccgtgactagcttggcaccgagcgtggccatgccggacaggaaagacgccaccgacaggaaagacgccaccgagccggtggagcgtctgatggtggtggtggccgcggcttggtggagaacgtagttggcgacgagcggggtgggagcgttgaggagccccaggccgccgccgcgcccggccgccgccgcctcggcctggccgccgctgttacgctcggcagccgtctcgcccaggatgccgccgcgcccaggccaccgcctcgcctagccgccaccttggcccggctgcctcgcccagccgccgccgtcgcgcccggcccccgcctcgcccaggggagggggaggaggaggggaatctggccggggaggagggtgggaagccgaccggttgaggggttgagaagaggttgagaagagataaggtagagagagagaggtgggagccggttgagaagagataaggtagagagccggttaggtgggagtggttgagggagaataaaagggaaaaaggaggagagagataggaaaaaattgaagtgggtgagagggaaaggagggaggaatatcccgtgcggttgggataggacgtccgcacgggaaaatcgatttttcccatgcggacgacaccccagcgccggttccctatttttccgtgtggttccacttacagaccgcatggaaaaaaaagggggggcgtccaggaaaatcaatcgtgtagtagtgtactaacaaattagataaattatgctataggtcatcgtgactttatggttttagctatagggcaccacgcggagtgactttggggaagatactcttaaaagttagatattcgctggtagacaccgcacccattaaaataataatttttagtttaagagaagagagaaatcacgtgaaaactctgaaatgcccttgggcccatatgtcagatctgtaatctctctatctctatctctttctcatgtgcctctatctctttctcaagcacacgcgcatgagaagaggaagaagaaggggaaaacgaggcctcgtgtgcttgagaaagagatgatatagagagattacaaatctgacatgcgggcccaagagcatttcagaactttcacgcgatttccctctactctttaacgggaaattattattttaataggtgcagtgtccaccggtaaatatccaacttttgagagtgctcccccaaaagtcacttcgcgcgttgtcctatagctaaaaccacaaagtcacgatgtactgtagcaaaatttgccaacaaattaataaggtgatacgatactttgctactggttcttgcttggttgctatgtaccatttttgtgaaaatagtcaacttttaacttccttaaatatatttttgatctgtatatttttgatctggtttatatcttagatggtgtttagtaaggctccaattcctggatttaactcaagagctgagaataaagtggagttatgaagcaacctaaacacaactccacttctttaatttattttgcaagagcacttcaaccaactatacttttattttgggtggagatgaaactgtttggctggactccaactccaaaaaaccagatataacgactattctaacttttaaaaccggtgcaaaccggatataacgacaaggaataagttcactggaggtcccttaatttaacagcgagattttttaaggccccttaaccacaaaaccagaaatcttcacccctaaactatacaaaaccgttcatcggaggtccctcggcagtatttttgcccggttttactaacgtggcatcctagtcagcaatttttttttaaaagtacttgggcccacatgtcagctgcatattctcttttctcttctcttctttggagaggcgggcagatgcgggtgcggcgaccggcggcggtgcgggcgtggcggggcgtgggaaagaagcaggagaagaggagaggaggcgggcccggagcgggcgcggtaggcggcgagcggcgcggagcgagctgcgagttgccactcaggtcgagcttgagtagctgcgtgaggtcgccaatcggccaatggcggatggaaccacgacggagctcaacatcacgtcggcgaacatgttgccgttgaggaatatctcagccaaggtgttgcagttggtcaggttgtccaagaactcccaggcgccgccatcatcggtcggcgtacggctccgacgagatggacgccccgctcctgtgaagcctcccctccctggggcgggggctcctctcatcgtctcccacgcccgcgcggatgctctccgcggcaacgtccgacgccctcgtcaagatcaagccaggcgagataagcatggtctccggcatccccaaggagcacctccgccgcaaagtgcttctttggacttactctgatttatgtagtgtcgatagattcgctagccctcgcagatccgtgtgggaatcgctcgagatgtcttggtttggtgggttcctttggttgttactcgggttagggatagagcctggaggtgtcgagtcgtgaacttgttggaattaatagatgggctaaggctcattcgaagattaattctttggaaaatcacaaaagcccacctcatgggatggcatgcatgtggagtttagtaccaccttgcttattctaggagagggggacctccttaaaagggaggatgccctcctagccacttaaagcatgtgtggtggagagaagaggggaaacacacgcgcgcgctcgctggcctggcctggcagggcaggcggcgcacgtgcacgacgtacgcgtcgaatggtccgcaaaattggctcctcacccttgtgcagatgcagcctccttttgcagttttgttttgctgcgggattcggatttgttttgttttggaaacattccaaaaaatccggtgtgtgaaaacggcatggaatccggataggttacgcgtgacttatccggttcggtttacgcggacgccctgatcaggcgatctatctctatataaaccgagccgctgccttcacgcaacacacgcgaaatcaatctagggtttgcctcctactctgtactgcgccgtcgctcgtagactactccatcccgctcgccggcgtgcaccggcaatcgggagagcaggtctccggaacctctgccttcgatgtcctgcaccgggagaaggtagcaataaggtttttgggaagcgcttcgcgcgactgctccctgttcgttcgcgacggctcgtcttcctcttcgctcgcgtgcttcgcgccttcgtagacgctcgcaactgcgagtagttcctgccgagcaaccggtctttccgccacctcggtatgtgttcaacatgttgcgcatatttgatctgttcaggttttactgcttagtttacatgtgtagatctaatgatgcgttcaatctagtttacatctgcaatgtcatgatttatttatggaataaattaaatcattatgtgcttataatttcaacaatccaaaaaccttattataggcgctgtgattttactatggctggttttgccgatgcactgaggccggataaattcaccggtgtgcactttaagagatggtagatcagggtcactctgtggctgacggctatgaaatgcttctgggtgagtattggcaaacctgaaggaattcttactgctgatcagcagaagcaattcgaggaagccactctttgtgggatgcattcttagcgttcttgacgatcgtctggtcgaggtgtatatgcatatgaccgacgctaaggagttgtgggatgcactgaatactaaattcggtgctactgatgctagcaatgatctgtatatcatggagcagtttcatgactacaagatggctgacaaccgttctgtagttgaacaggctcatgagatacaaaccatggctaaggaacttgaactccttaagtgtgtcttacccgacaaatttgtggctgggtgcattattgcgaaactacctccatcatggagaagtttcggtactgcactcaaacacaagagataggaatactccgttgaggggttgatagcgtctcttgatgttgaggagaaagctcgggaaaaagacgccgcgtctaagggcgatggtgggcagtctagtgccaatgttgtgcataaggcccagaacaagagcaaggggaaatacaaagctcaacagaccaccaacttcaagaagcagaagaagaacaacaatcctaaccaggatgagaggacttgctttgtgtgtgggcaacctggtcatctggctaggaagtgtccacagtgcaaggggatgaaggcacctgcagggcagacttctaagtctgctaatgtgaccattggcaacactggagatgggagcgggtatggtaatttacctactgttttttcagttaatcagtctactaattggtgggttgatactggggccaatgtacatgtttgtgctgacatctcattgttttcttcttattaggtcgcacggggttccaccgtcctaatggggaatgggtcacatgcttctgttcatggtgttggcacggtagatctgaagtttacttcgggaaagatcgtgcagctgaagaacgtgcagcatgtcccttctatcgacaggaatcttgttagtggctcccgtctaactagagacaaatttaagttggtttttgagtctaataaagtagtcgtgtctaaacatggatattttaatggtaaaggttatgagtgtggaggcctgttccgcttttccctttctgatttctgcaataagtctgtgaaccatatttgtggcagtgtggatgatgaggctaatgtttggcactcacgtttatgtcatattaattttggcttgatgtctcggctttccagcatgtgtttaattcctaagttttccattgtcaaaggttctaagtgccataggtgtgtgcaatcgaagcaacctcgcaagcctcacaaggctgccgaggagagaaacttggcaccaatagaactcctacattcagatctttgtgaaatgaatggggtgttgacgaagggtgaaaaacgatatttcatgacgttgattgatgatgctactagattttgctatgtgtacttgttgaaaacgaaagacgaggctctagactattttaaaatttataaggcagaagttgaaaatcaacttgacagaaagataaaaaggcttaggtctgatcgtggtggagagtttttctcgaatgagtttgacttattttgtgaggaacatggcatcatacatgagaggacgcctccctattctcccgagtctaatgggattgctgaaaagaagaaccgcacactgactgacttggtgaatgccatgttggacaccgcgggactacctaaggcatggtggagggaggcattgttgacctcaaatcatgtgttaaacagagttcctaacagaaataaggacaaaacaccatatgagatatggattgggagaaaaccatcactttcttatttgcgtacatgggggtgcttggcgaaagtcaatgtactaataacgaagaagtgcaaacttggacctaagattgtggactgtgtctttctgggatatgctcatcatagcattgcctatagatttttaatagttaaatccgaggtaccggacatgcatgttggtacaattatggagtctcgtgatgctaccttctttgagagctttttcccaatgaaggatacacatagtggttcgaggcaaccctctgaaataattcccagttcaatcacaccaccagaacaaactgaacatacacatgaacatgtctctgaggaggatgtcagtgaagctcctcgaaggagtaagagacaaaggacggctaagtcatttggtgatgatttcactgtgtacctcgtggatgacactcctaagtcaatttcagaagcatatgcatctcctgatgcagactactcgaaggaggctgtccatagtgaaatggattccattatcgctaacgggacttgggaggtgacagagcgaccctataggtgtaaacctgtggggtgcaagtgggtgttcaagaagaagcttaggcttgacggtactattgaaaagtataaggctcggcttgttgctaagggctatactcaaaaagaaggcgaagatttctttgacacttactcacctgttgctagattgaccacaattcgtgtgctactttccctagcagcctcacatggtcttctcgttcatcaaatggacttctcgttcatcaaatggacgttaagacagcttttcttaatggagagctggatgaggagatctatatggatcaatctgatgggtttgtagttgaaggtcaagaaggcaaagtgtgcaaattgttgaagtctttgtatggtctgaaacaagctcctaagcaatggcatgagaaatttgacaaaacattgacatctgcaggctttgcagtcaatgaggcagataaatgtgtgtactatcgccatggtgggggtgagggagttattttgtgcttgtatgttgacgacatactgatatttggaacaaaccttgaggtgataaatgaggttaaatcattcttgtctcaaaattttgatatgaaggatttgggagtagctgatgttatcttaaacattaagctaattagaggtgagaatgggattacactcttgcagtctccggaacctctgccttcgacgtcctgcaccgggagaaggcggcaataaggtttttgggaagcgcttcgcgcgactgctccctgttcgttcgcgacggctcgccttcctcttcgctcgcatgcttcgcgccttcgtcgacgctcgcaaccgcgagtagttcctgccgagcaaccggtctttccgtcacctcggtacgtgttcaacatattgcgcatatttgatctgttcatgttttactgcttaatttacatgtgtagatctaatgatgcgttcaatctagtttacatctgcaatgtcatgatttatttatagaataaattaaattattatgtgcttataatttcaacagaactcgtggtacagactaaagtgctatcgctagttgacgttcgaatcgtggagtagatagaaatgcgaattcggtgatgaagttttacacttgtatggtttgaactgcgtttagaacttgggaggaatgtgctggtccacgtgcgcccacgtcgatcggctgggagctccccacagaacacgttgttcgcgagtgcgagaccttgcaacgacgtcatgttgaagaaactcggcgggatctctccggtgaggctgttctgcgacaaggctaacatgcggagcgccgggaggtgtgacaagccgtcggggatggaacttcccagaaggttctggtcgaactcgagctgcacgatcttcgtgaggttcgccagcgatggcgggaagtggccggagagcgagttgtggctgagctggagcaccgtgagattcggcaacgcgtcaagccaccgtggaatgccgccgacgatcgaggttgttgtttttgaggtacgcgacgtcgagggcggtgcaattgtggagcgcgtcaggtatctcgccggcgaacgcgttgtcgcataggctgagtgtaacgcctcgattttcgttcgggtttaaaaaatcatttaataatgcattttctagaaattaaataaaagttaaaccaatttaatcaagtggaattatggagggaattaaaatttcctttaaaaatcattggccgggaatattctgtaatattctttgtgccctaatgtactctctagaattttccgtgagttttcggagctcaagaaataattttaaaagcaccaagttcattttaaccaactaaataaaaagaaaaacaattaaaatcccccttcctctctttgggccattttcggcccaactcttccttctctcccgcggcccgcgcgccccttttctctccctctcgggccggcctcctccctcggcccgctcggctctctctccctgaagtctgctttacctccctcacccgttttcccatctctctctccccaacaggtgggacccgaggccccacctgtcatcttcttccccaacctcccgtcgccccaactgccgccatggccgccggtttcaccccacgacgccgcggctcccgcgctccaccccgccccacgagcgcgtgaaatcgatcccctccacctcctccacctttccccccactctccccgcgaaaatcggcgccggttaacccctccaccactccacgtcggcgccccacttcgccggccgattccgccacgtccggcctcgatcccgccttcctgagcccacaaaaagcacccccgtgctcccctcgtccatttccccttgtttcccgggcccggcactctctccctcgctctccccacgccgctcccgcgcgccgccacactccggcgaactccggccgccgtttcccgtcgctagggtcgccgccgcactgctccgccgccagcgctggctttgccacctcaagggcacgctcagccgccgtttcttcctccccttccaccacgcgaaccacctctccaccgtgctccctctctccatcggtccccggcgtgctccggccacctctagccgccgccctagccactgccgcgccgcgccgtttgcgccgccggcttctccgtgcctcgccgcaccccggcctccgctccgtttccctatttaatcgccgcaaccacccttccacagtgcatcccaagccacctccaccctacgccgccgggccgccgttccgccttcgtcccgaggagcgccgacgccgagctcccccgcttttccccgcccctcgtcgtcgcgtccttggtgagctcctcctctccctccttgcctccctcctctgtctcccgtgcgtgctgccgcgccggtggccgccgccggcgaccaccgggccgtgcgtcgccgccgttaggtcggccggccggcttgtcgccgccccgctcgcctaggccgcccggatccccttgccgcgccgcgccgccgctttcccgcgtgcgtcggccgtcgccgcaggaggccgcgccgccgtgagccgttgctcggccgggccggcctaagctgtgcccgtgctcagccgcgccaccccgtggccgcccgatcagctcgggctgatctgggccgtcggttcccgtggaccggcagtggaccaccccgtggtcccagttcacggtggaccactcccttgcccgctgtcatgtggggcccgcttgtcggcgccgctgccctttgatgacgccagcaggagccttttcctttgataaaataattaacaattgcacaataattcgttaataattctagaaattcatttaaatggctcaaaacttctaaaattcatatctaattcattcaaactccgaattgagccattcaacttgcaaaattcatctaaaattgagctctacatgtttgtttactttttatgtactgtttccttggtttttattagagtttttcctcgttttgcgtgcctgcgtgtagaatccgtcatttcggaagatcacggtcgcaaggataagagttcggaagattgtttgaagaagcaaggcaagtcacacattccccttgagcatgttgattccaatttataaatgttttactgtttgcaaataaatatgcatattttgctaattacatggggtcagggttttacctatctgctcgcttgtgccatatttacttgatatatgtcctttgtcaacattgggtaataaatcgactagctcatgttacttatgtgacctagctagaactatatgcttagccatgcttaattaccactagctcagttgatgggataattaccgtattagaccttttagtatcagaatgagctgcgtgctcgagacatctggccatgcttcatggtcgtaattatccaactaaaatgcgactgaatggtgggctgtgggtgcatggttttgctggtcgcacccatggcagttaaggacggctgggcaacggctgggcttgtagtgtagctttcctctagtcgacgcatccaggcaagggtgggcgtgatggagcggggcgggccctgcgacggcctctgtcgcttccggattcacctaggcacgagaggggactgcccgttgcccgatggggatgggggtgaaacctgaggtgtggtgtgcttggctagagtgggttatgcgaagggtcctgtcacggcctctttccggtatgtcgtggtggcatgtcggcgcacggaaacgtgtcgtggggctgtgtcatgtgggtacagttgtacacctctgatcagagtaaagttattcgaatagccgtgcccgcggttatgggcggtcgaccagattcaccgtgattagtcccatcttaataaatcgacccaatacactgtagttcaggtgggttggttgggcctgttcaacgtggtgtagcgttgatcagtggagatttaatgttactttaattactcaacagttttactgttttgctcaataaaatgttttacaaccgcctttatgcaaatagccacaaaccatccttgtatccccttgcacatctgcatcgttagtgtggcttgctgagtacggtggttatactcagtcttgcttttattctcccttttcagaagtgttgtgtttctgagctgaagatggagttagaggaccaagtctcagaccccagttgagttttgcctgtggagtggagctgaagccccgctaggatcgcctttttccgctgctgtcgttctgtttcggtgtgaggactaagtgcctcttccgtaagtattttacgctttatttacatttagaactgtatattacttgtcgttttgtgtaccctggctggtcctggacagggatttaatacgaaaaatagtctgaaaatttgggttaaatttctgggcgtgacactgagataccacatccgccggagccagccgaggccatcggcgatgctcccggagaaggcgttggaggtgaggttgatgagtagctcgagctacgtgaggttggcgacggccggtgagagctcaccggcgaggcggctcatggacacgtccagcgacgtgacacgccccgctgcccacttctctgcccgcggccgcgctcgcgcccgcctccactccgctgccgcgctcgccctccactgctccgcctgccgccgcctccctcgctgaagaaaaggagagaggagagaaaagagaagagaagaaaaagaaaaagagaagaaaaaaatgtacagctgacatgtaggctccacatactttttaaaaatttatttgctgactaggatgccacgtcagcgaaaccacccatatatactgcttagggaccttgagtgaacggttttgtatagtttaggggtggagatttctggttttgtggttaagggacctcaaaaatctcgctgttaagtggagggacctccggtgaacttattcctcacgacaatgatagtactgagagtgatatttgctaggtccaaaggccagaagcagcgtagctagctatagtacttggtagcttgggcccatgtatgtaacttgggcctggacttctttcgtcccgagccttctaatccagcccaagagtaaatgacagtaagcaacggcagcaaaaagtacactacctgagtaaacggataaggaaaacaatgtacctgcacgcctccgcgattccggcggccggcgcgtagctgttgtgcgcgccggaggcggcggcggcgacgacggcgcccgtggccgccggcgccgcgcggaagcacgcgaacgcggcggggtcgccgtgtccgagcggcgccacggaccgcgcgtcgcccctgtcgaggcaggcgtacacccggtacaccagcgcgcggatgctctgcgacctcgccgcctccatcgccgggttcgccgccccgaaccgccacgccgccgccgacgcgtcgccgccgccgttctccatgagcacacctacagcgagcgatgcgtgctgcttgtgagagtagtgcgagtgtttggctaaggaatgggaggtgtggcagcgaccaaagccgtgtgcaatgcggacagggagccgtgtcgctacagcttgatggatgatttgatttgatcgcgtcgcatcagcgtgcggtgacagtgagtattcttggaagtatctgctttgttatgttatgacaatgatctgtaccaaattcaacagtcaagattagtaatcgtgctgctcctacaatacctaggacgcaccaacgatttttctctttctcgtaccgtgaaaagaacactgtcgggtacagaaagtactgtcacagacgctacttcatctctttcatataaaatctgacacatcataatactataaattataagtgcaagtaggtcacctgtgaacccacttatagcttaaaataagcgagttcacgtgttagtttagcctataagtgagttttcacagatagccgcttgcacccttactatgaatctagacatatctttggccctgtttagttccatgggctaatgtttagccctcacctttagcctcaaattagccctcaaggatccaaacaagtaggctaattttgagctaatgtgaattagccccttcaagaggtgctaagagcatatccaacagcctctctatcccactctcagccaaattctagccattctagccaaaaagggtactccaacagcctctccaaccggatggctaagccatccggctggccaaaaccctctctccactagccaaatttagccactctatttggctggccaatggtgggtcccacacagccaaactcttccatagctccatccccacacgggcaaccagggagaggcacgggaggagcacgaacagaggacgagcacggcgaccgccggccttcgatcgccaccgcatggcccgccagccgcctccgctcgccgtctccgcgcggcggcgccacccgccgcctccgctcgacgcggccgccggtctccgcgcggttccggtgccgcccgccgccccgcgcggcgccgcgcgccgcctcggctcgccgcggccgccggcctccgcgcggcgccgccgcccgccgcctccgccctccgtggcctccggcctccgcgcggcgccgccgcccgccacctctgcgtgccgcggcggccggcctccgcgcggctccgtgcagcaccatgcccgccgcctccgcccgctgcggccgccggcctccgcacgacgctgcccgccgcggcccctgaggctcggcgtcgtcgcccctgaggctcggcgccgtcgccgctcgttgttctccgccggagaggatgcagtacagctggagggaggaagtagtactagagaatgggttggaagaggaggaagaatagtaatagagactgacatgtgggtcccatttgtaatagacttgtaatagagagggtagatggagaggctgttgaagtgaacaactagtttgactagccaaatcagatagagagttggctatgcgggtgtttggagagttcgatttggagaggctgttggagatgctctaatggggctaattttgtgtggggaccattaaaaagcagccctctctcaccttctctctcctctctctccatcttttagccttaaattagcccatggatccaaacatgccattctaggctaatgtttagcctactaattcatgactaaacattagctcttaaaattagccctgggctaatcttccaaacatggcctttgtctagattcatgatactagtgtcacagttagtacagttagtactagttttgttttctctaagacgtaggaagtacaaaaagtgcaaagcacttctagggacaagattcagaggggtagaatatcgcctataaggcatcaccacttatctctatcaactcacaaataaacgctcattggctcattgctatagtacctatagggcctatttggggagtttaaaattctgagaaacaggtggttggtagccagcttttaagaatctgaaaaagctgggttttcgagcttatggcttctagttcattttctgtactctacaactgcagcagctagaagctcccctaaacatgcccataatgcaggtagtaagattttatgaagtgctacggatgtccaaaagtataataaggagttttagaattgaacacgtatgagtattaagaaaattggtggaattaaataggagaagattgtgattggttgagaagagcaggtaggtaaggaatttgaatagcttaatgttgtgattggttgataagagaatgtagatggagaggttgttatatttgtttgaatatgtgccgaatatactagtcctatttagttacagttggacttgaagttgtaataggtggtagggggtggagttagagtcggactctgtaacccaaatctctcttaaatggagggggggcaccataatctaaccatggcgactacaatgtagcgtagacacgtagggagatgatgacggcgaggccatggactcgtagcagctaggagctatgttggttgggaggagcggccataatcagagccccggggatgtaggcttcggctgaacctcgttaacaaatatcgtgtgttcttatgtcgtcatctggatgccttgggtgatcatatgactgaaacgatcgggatggttagtcgttgttccgctatatcgactaacttttataacaatagtttggaacaaatattaagactaaaaattattatattttagaacaggggagtaaaagacactcctacgttagggaatgtgaaatagcacggtcggttgttggctacaagcttatgtgcactgtaaattggcggcccgggtactaaatccataacgaaaagatatcgtcaaacaaaggagtaaattttaatttgtattgtgtatatagactaacgttacgtacaaatagacctaggctttaggctgtgttgttttgaggttaggaacacgtaaaatggagcgatgaattggagcataattaattaaggattagttaaagaatttaaaataaattaatacgatatttaaaatcaactttttatataacttttttttaaaaaaatataatttagcagttaaaaagtatgcacgtgaaatataaggaagtaaaagttaggagtatgtagtataaaacgcaccattaagccacttttcaacttaatgtcacgtattttataattttagaagtatccactcctgtttatgcatcttctatccatccatattagaagaattatccataagtacaatgtactcgttaaaataaaatagtgcatgactaatgactactggggttatatagtagtagtagaacacaatatatgtatagatggttgaccgaggaagcttaccaaccgtcaatgattataatttgttcaaacttagaatgggctatgggcatttgaggtggcttgacaatgttttctttacgaagtataaaaatgaaatcttcactgaacatgtgtttacattgtcgtcgtgggctatgggcatttgaggtggctttaatgatcatcgaacacttatcaaagacaacagtaacaagctcgttctagctagatcattggaggaggatgtgaaatctacaaaacaacatgagaatgttaaaacatagtaaaatgtattaaaatggattaaaccctaaaatttagggctctatatggtcgaacacatcacacctgcccatgtatatgttccatgcatgtcatctaaaagtggtgtaattgttactccctctatccataaaatttcaaaccctagcttcccaaggtaaaattaaggaggaagacaaacgaccaaactatccctaattaataaaaaagttgtattgatgggtatgtgaggggtatttaaaagataaaatttttcttgatttgcgaaccgatggtaggttagtactccctccgtcccaaaaaagataaaccctgggtttccgtgtccaacgtttgactgtctgttttatatgaaatttttttataatcagtatttttattgatgttatgtgataaaacatgattaatactttatgtatgacttatctttttaatttttttcataattttttcaaataagatggacggtcaaaagttggacacggaaacccagggtttgtctttttttgggacggagggagtagatagaagttggtttattttggaatataataatttaaacctataatttgatttacagaaaacttagacaacggtatcctgttggaacaggatacccttctatgagacattacttgatacctgatacctgttgtggtatcagttgcatggtactcgatacttgtgatacctgttacccagtacctgtgatacctaggacctgatacctgtgatactcgtgcaagagaatagttaatatatctatcccgttgcaacgtgatcccgttttgtagcagccctcttttatttattttgaaacagagggagtagagtataaacagacactcaatgggaaggtgaacccatgatttgcacgtaagggctcatttgaatcgtaggattgagaaaacgtaggaataggaaaacgtaggattttaatcgtagtgtaaaacagaggattacaaaacgcaggacaaaacacaggaatgaccgttcgattgaaccgcagtaattggattggatgagagatatagactcaaaagaaagttaccaagaggttgaagctcttgctaaattttctccaaaatccctataggattgttcattccatagaaatttcaaaggattagatatgattcaatcttttgtttcaaagggcttcataggaaattttcctataggattgaaatactaaaaaattcccatgtttttcctccaaattaaaggggccctaaacaagatcaagagctttattactccacctgtggctccgtcccaaattatagggcgccccctttttaaggaaaatcaaatttggtatcttttgactaataaccatactacctatatatatactaagtataatgcatgttatatcattatattcatattttgaagtaatttcatgtgatgctaattttatatttgttgggattatagaatgaaataaaatactggtcaaaatatattatatattattgaagaccacataaaaatatagcgcttataatttggaatagacagtattttttaacatcacatctagccactgttgccatcgcctcaacaccctagcacgcttcccctggcttaggccaggcctgccacaccggacacttccccctcccctctcctcttcctcctcaagcttgttgccatgttgttttcccaatctctaataacttccgtagcgctggagacaccatcatcaccgacaccgacaccatcatcacctttgacccctctcatttcccttgccttcgcctccgacaccggactaacatggtcctccatctccgtggcttcagctacagcgctgccatttcacaatcaacccattcatgtttaccacttaccactaattatgtccatctctttgaagcttagaaggtgtttggatcctttagttgtaggactaaaattagtcctaggactaaatccatacctgtttgaatgtagagactaaaaaaactaaaggtcaataattgcactatataaagaccatgttaacccctaacaccatgtaaagagaggattgtgcatggggcagtgagtagaaagaagcaactttaatccctataagctcctttcatagggactaatggactaatgcacttttaatcccttttagtcatccatgtttaagactttagggactaaaggggattaaagtgaaggggctaaagttttagtccctccaaccaaacaggctcttagggaaaccaaagtcccatcgaatatcatcgtttaccaacttaaaaaaaaagcattagagcaagtttaagattgagttcaatggtgccttttcccaagctcaccttacttgtttttcgcgcgtatgcttccaaaatattaaatggtgcattttttttattttttaagttgctttaaaacaatcttagagcatctacaacaacatggctatttttgcctctccaaatatcctatttagcaaattgccaaaaaattagagagccaaaattgagtttcactccaacggtctctccagttcaatctccaatttaacggtgggtcccatatgtcagtcacactttttctttgtgatctttttcatccacttctttctcgtcttctcctcttttctctgcattgcaatggcgcggggggtggagacgatggacgccggcggtagcagtgcgagtggcggaggccgaccggaacggtggggcggtggagacagtctctctcttcccttcttttattttctttcctcttctcattttcttcccctcctctcactcttgattcccctttctccttctctcctaccgactccgggagggagccggcgctaggcggcgatgggcgcggcgatggcggctggatcagggcggcggtcagcgcggcgacggtggagggcggtgaggtggaggaggcacagagcgagggggcgccggaaggagttgatgtgggccgacggttggcggaggcggccatggcacgacgacggcgacggcgtggtggcgacccggccggacggggacagagtgaggaggcagcttccggggcctgcgattggtgctagggagggaggcggcctcgtgggcggcgctcggcctggtgcggcggcggcccggagtaggatgaagtcggcgtcgacgacagcttcggtggccttcggccaagggaaggcggaggcggtgggtggcgaagaccggagagagcggagcggcggaccggaggaccggcggtgccgctgtgagtgatgacgactgacggtgcggcggcaccaccagatcccccgaggccgatgcaaaaggagaaggggatgtggcggcggcggtggaggagatggcggtggacgacggaagggacggcggcaggcggcaacagggatggcgccggcgccagtggcgcgctcgcgagtgtagagagagaatataagaggagatggggaaaaatgcgtggggcccacgatttggaaaggcaactctggctagccaaagttggccagcgtagggaggagtttagccagtcagatggcttggccagccgtttagcaagtctgttggagccccttttttttcctcaaaattgccaaaatttaacttggagagtgagattgccactatgttggagatgctcttaccaatccatttttaaagcttttaagctaatacttaattaatcatgtgccaatgagctagttcgttttccgtgtcagaggggaccttcgcaatcgaacacaacctaataatatagccaactacaaactaaaaaaaatgacacatatactgtcatctaataacctacttatacagaaatatatactacattattaatatctagcccacctcttatacatacaaatacttcctccatccaaatacttcctccatcccacagtaggtattttgaccggatgagatatatctgtaatatgaatgtacacaacccataccagaatatatcttattcgatcaaaatcctttatattttgggataaaatgagtatataatgtattggagctcgtggcagcccttttttcctctctaataacatactctcagttccaaaataaagtacggacatgacatatcttagtaatacgatttggacaaccattcacatacatataggatataggatatatataggatgtggtatatcctagtactgtacatgaatatgagcggtatatttagattgatagtatataatatatcacatttcatacttccttcgtcccaatatataggaatctagtatcggatttgacatattataggattatgaatctggacagtttcatgtccagattcgtagttttaggatatatcaaatccgattctaaattgctactccctccgtcccataatataagggattttgactttttacttgcactgtttgaccattcatattattaaaaaaaatttggaattattatttattttatttgtgacttactttattatccaaattattttaagtacaaattttcgttttttatatttacgcaaattttggaacaagacgagtggtcaaatagtgtaagcaaaaaatcaaaatcctttatattataggacggagggagtatatattacgacggaggagtattagatttattcggcagtacaggatgagaactaatccctcctgcaagcaaaatagagcggtctattagcacatgattaattaaatattagtatttattttttttaaaaagaatcaatataattttttacagcaactttcatatagaaattattttgaaaaacactagtttaaaaaacgtgcgcgtgaaaagtaagcgccaaactcagcctattgcagtcggaagaggtaaagtcgtcactgatgtacgggccccacttccgttcattgcaagtcgctcccagcgcacgaccgtcctgtcgtctcctaccctcgttccggtcaggggaatccccattctctgcacaggctcccgaccacgaaaagatcgctgaccccgaccttgacccgcgccgtcgcgtcgccttcggaatccaagaacgatgctcgccgccgtcccggatcgacctccattgatccgcaaacgccgcgtccgccccccgccctccaagctcgagcctcgcagccatcgacctcgatccgcttcgcgctctgtcggaggcgcatcttggttcttccatggcgaccccccatcggccatacatggcggcaagctagctcccgtctcaatccgtagctttcccctccttgagcctggactactcctttgattcttttgttcttttttgcttcactagctaattgtctgattgtacttctcttcttgcacaggcgtggatttgcagatgtcgcggttcacagggcaattctgctggttatcctacaagtaatcatctactcttctcttcttgatgatttctgcaataaacaatagtctgattctagaagacagacagagctatcctgttgccgtcgagacttttaactctgattattgacttgcggttctcttcacctcttgtttactttgctggattaaattactaggttactctatatgtttgagaaaattgcgtggatgacacgtggaagctgagtgtgatccactgggactgaccacttcatttgttgataaactaaccccttgatagtaatggcattgactaataatacactagtttactctgacttgtagttttctttcttgtttaaggtttgctggctagcaaggataaggttgagcggaacagaatatggtgttctactatgccctctacgtgtttgagaaaatgacagtatgatgaatgcaagtgtgaacaatccaaataacccactgatcccttgaaaaccaggaccatgaaaggagtaaattaagccaacgggtggatagtccattgataaaccgcctgcccaaggtaagtctgtcagacatggtgtcttcactgacattgtcacacaggccagctaggaggaagagttccagctcccttccagttccaggacgttgttccaggtatccatcatgtgcttcttgatctcataccaaactatttggatgcttcacgctgttcaggtcatcatgctgctaagtttctcttgttgaattgatcgattccggccattgcttaccaggaaaggggcatgccagcatggggctgctattagtttctatttgttttgcatggtgtgtggtgtttgtttagtcgatggggatgtgtagatatcatttatcaaaaagaaggctaactgtgttgttctacttgacagcactgttgaattacacctgagtgtaaagaagatcgacaaagatggcagttgtagcaggggcgatgactgccctcattgccaagttgactaccctgctgatggaccaatacaagctgcagaacagtgcgaggggcgacatcatatttattaaagccgagcttgagagcattcaggctgcccttgagaagttgtttgaggtgcaggtaactgatcgccaggttaagatttgggagagggatgtgagagagcagtcgtacgacatggaggatatcatcgacaatttcatggttcatgtcgaaacccatttgctagccaagccacatgaactcaaaggattcatgaagggaagtttgagcttgttgagaagagcaatggttcgctatcgtgttgctaccgacatcaaacgtatcaggaggcttgtcaatgagacgagtgcacgccgtgataggtataaggttggtactattgttgctgctgccaagactgagaccgcaattgatccccgtttaattggtatctatggagaggctactaaacttattggcataagtggacctaaggaagaattgaccaagctgctgatggattccaagggcaactcaaagaataaactgaaagtgatctccatcgttggagttggtggtttaggcaagacaactcttgctaatgtcatttatcaacagcttagaggacaattcgagtgtcatgcttttgtttcagtatccttaaagcctgatctaaagaaggtcctgagcagcatactccgtcaattcagtgaacaaggttatgcttggacagaaacatggtgtgctcaggaaatcatcaacaaaatcagagatgaaattaaggaaaagaggtataactaaccaaatacatgcttaagatcattgggaacatatcctgtgtacacaagccatcacgtgtacacactgtacaccaactaacaaatgtcaccaaaaaatctagaaaatttcatacatgtactttcaatagtattacacctacaagtacaaattcattatattttagccgtaaccaaaaaaatgtgacagttttaaggttataattctgtcagaattttgtttcttgttgttgctctctgtagaatgaatttgaagatgggactttacacgtaaatgtaatactattaaaagtacacatatgaattttcttagatttttctggtgatatttgttagttgttatgtacatgtgagtgcttgtgtacataagatatgctcccaggatcatcccatgctatgtgtaagcattttagcttgaagtacagctagaatttggagctagtagggatagtaaaatacatgcacagactgctaggtgaattaacaatgaaattaatccttttatctaataaaccaagttcaatgggctggcaaagtaatattctagcttagggtgctaggtgtgataacaacgggaagttcaaggggctatgaaagagaaatgtgaattcagggtgttcgataagacaggcaaaagcttagaggtctaaaatacagttcttttctttcggaaaactaaaaccaagatagcaaaattactagtttgatcaatttggattcaggcaacttctattctttgaacttctcacaaaactgcaaccctgtcatatcctaggaaatttttgcatgttggtccaaatattattgactctactctgtttgataccattaggctgctaatgggccgcgtcagcatcaaattggctgcaaatttttatttatttatttagaagtcattccctatcttcgaaaaagcaaatacatgctacataagttcaggaagtagtagccagacctaaaggttaggtaaataaaatgttcacatctaacatgattgaaactgagttcatgaaaccctatacttgtgggactgaactcatgagactgaacatgtagggaaactatagcttctggagatcctgtctttcctctccctcaccttctgtccaatgccagtactcgtggttctcagagcagagccttttgtgctgttgaatacttcatctgttacttgcctttgaaaggatccaattaattggttttcagtttcaatttaactcatgtcttgtgctaatgttatcacaaaaccacaggtacttgattgtaattgatgatatatgggagaaatcagcatgggaatgcatcgagtgtgctttaatagaaaatgaccgtggaagcagaataatcacaacaagcagagtgcttgatgctgccacgccatgctcttctgaggttgatcataccgtttacaagctgcagccactttctagtgataactcaaagaaattgttctacaaaaggatattctactgtgaagatggttgtccattggaactgaaggatatatctgaaaaaactttaagaaagtgtgagggagtcccgttagccataatcaccataggcagtttattggccatgagaccacaaaatttataccaatgggatagggtacacaatttaattggttctggacttgagaaaagccatcatgtggagaatatgcggcacatattgtctattagttattatgatttgccagcccatttaagagcttgcttcctatatctaagtatatatccagaggattacaatatacagaaagatcaactgatacgcagatggatttctgaagggtttatacttggagaagatatggatactttgcatgaaggaggtaaatacttcaatgagctaataaatagaagcatgattcaaccagcatacatcgacagtcatggaagggtgcatgcttgtcgtgttcatgatatggtgcttgatcttatcacatcattgtcaaatgaaacaaattttgtgacatcattaggtggtcagcagcccacatatcatccaaacagggctcgccggttatgccttcaaaacagcatatatgaccatacgatacgacaggagaaaatgaagtggccccgcgtgaggtcactaatcgtattccctcatgctaccaacttgttgccatccctttcgagattccgtattttgcgcgtactggatttagaaggttgtcaagacttgaagaatcaccaaattgagggtatcagtgatttgtttcatttgaggtctctagtactgaaggatacaaatattggtagtctccccaaaaagattggcaacctaagttgtttacatacactggacataaggcacactatcataactgaacttccatcaacagtcgttcatctaagaagactggtgcgcctactaattgatgcatcggtgaagttacctgatggaattgggaaaatggaatgcttacaggaaatatcactggttggtattagcaagtctccaaactttttgaaggagctagggagtttgacagaactaagaatactccagatttcagagagtactggtgcgtggcatgatagttatgagaatactttgattgattctttgtgcaacctgcacaaaatctgtgacctgtacatccatggctgtaaactgtccacagagttcatatcaaatataagatgctctccgcgatatctccgatatctttcatgtggccaattatccatattgccaaggtggatcaattcatccttattgtccctctccaccatagatttgatacttaatgtactccgacaggatgatcttcgtagtcttggtgccttacaatctctatgttgtctccgtcttaatgtgttcaaaattgaaccagaaaggttggttgttggcactgagcatgcaaagttccactggctagctgagttttcgtttaccactaatgccatggggcttatatttagccaatattctatgccaaggcttgaaaaccttgagctagcttttaatgttcgagagacaaagtattttgatattggcttggagcacctgtcctctcttaaggatgtcactgcaagaattgattgcagggattccagtatttttgaggtgcaaaatgcagatgctgccattcggaggattgcatatatgaactccaaccaacctaaggttcatgtgatcaggcattatgaacacatgttaatggatgaggtgaagatccagaaggaaacggaggaggaaaaggaggtactttctaaatgactaattaatggaaggcgtagtaacttgtaatacatgaagtttacatataaatttctgaatcatagggtcactttttaaattcatcgaaacaaaactgcaaaactttgtttttcttttttcttttttattatatctttatgtcttctttgcagatattggaaaataggattggtccatggggtggaaatggtggggtcacttgtgacatcaaggttgcacccaaacgcttggaaagcattactatttgtagcggcataatcatcgatgcacttgcattttcttacttggacaaagatggagagcgacacacgactagtttatggggtggtcttggtggtagtgttcaactggtgagttgatcattattattttttattttctttgcaaaacaaatatggcatttatttctttcttcctggatcgaatccagtaaaatgagcaacacaaatacaactcaattacattgcaagaattcagaggtaatggaccttaatttcctcgcagattgatcttgatgaaagagagtttcttatggaggttattggaactgtgggtccattcaatgtgttatctgaggctataacatcacttacacttgtgaccaatgtacgtagctatgggccttttggacaaccacagggtactcctttccgtactccacggaagaaaaacagttgtatcgtgggattctttgggcgttcaggaacatatcttgatgcagttggggtctattttcaccctatgtagatctcagcaaagcgcgaaatcctttaaccaaacttgtagtttatattcacattgtgtcgaatattttcttttgtttctttacatttcctgatattatggtcggactactcgtatttcaattcttgtgatctgttttcctttcacctgtttttttttctcagttgttcaaataacatcaaaagttgttttagcttcatatgtagtgcgctgcagtaaaatgatcacgtcattatggacagtgactcctgttttttttcttagttgttcaaataacatcaaaagttgttttagcttcatatgtagtgcgctgcagtaaaatgatcacgtcattatggacagtgactcctgtttttttttcttagttgttcaaataacatcaaaagttgttttagcttcatgtgtagtgcgctgcagtaaaatgatcacgtcagtatggacagtgactcctgtttttttttcttagttgttcaaataacatcaaaagttgttttagcttcatatgtagtgcgctgcagtaaaatgatcacgtcattatggacagtgactcctgctggaattctcaatatggttcaccatgtggaggtgtggttaggagtgtaaagaaaaaactcgggctcgtgaactcagctagaaagccaaacaagctgagccaagcatcctttttagctcttcgttgaaatgagctgtgcccgagctagcttgcgagccaattgtttggctcgtgaccctaggtcattatgtacttatatggattattttttagtggagttattatttgtcaacttgtaatttattatctagattttaaagaattgaatatatgaattagttttaagtacatgttgttgatttattctttgcttttcttaatgattacaaattatatatgaagagacgagccaaaccaagcctattatgttgtgagcctttgcaagcttggctcggctcatttccacccctaggcgtggtcaagaaagaggattttttgttttgattggtaccaatcaacaacatgatgtctatacaaagattagcttgaaaccgaaattccagcttatctctatcttaagatataaatgcacatctgcgaattgaacgaaccattttccgagcacaagtcatgtaagcttaacttttgttacagtagattgatgtaatatgtatttgaacaatccaacaaaataagaacaagtccaacaagttccacttagactaccagtagtccaaatgaaaactgaccatatcagtttgactccgcttgtactgttggtttgactgcaacatcctctgtactagaactatttgcagcaaggcttgcagttctccccaacgcccataagaatcatgaattagtttagggttttcggaagtggcttaccgtgcgagagatcgtcacctcatgcataggggcatttctcttcttttatatggcgccgtgggctgaaaatctccttcgtcgacattgccttgtgattggatatgtagtctatgtagcagtgccttcgaagatgctacactacttgctaaagactgcattttcacaaacatagtctgaaaccttgtttctagctagttaggctacaaccaatcccctggcagctgctcagcaattctatttcagattggtgggagtctttaacctccacactacaaggaaaagaaagaaacaaaatgatcggtgcccttctgactacatggtgtcagtggcggatctagaaatatttgtgagcccgggcaaatctaattaacaacgccaacggatatataataaatcccatataacttactatgtaccatacaacattttttttatcgtattgtaatttagaagaaaacgatggttgtgtttttgtaggctatgggacttagtaatttattatcttgaaaagcaaaaaaaaatataatgggtgctagaaaatttactttgccttcaggttgcatacgtctaatagcttgcactcaagtaatgggtaaaacgatctactagtaaacaatcatggtgcttttggttactctagatgattgtgtatgtaacatctattaacagattattataacatacttatattgcttcatgctggctgctgcatgctgtggctaagcaccgtgagttagaactaatctaatgatgcatgcgacgctggagcccgggcaattgcccgggcttgccgggccctagctccgccgctgcatggtgtgatgtttggctatagcgtaatcaaagaattttcaatcagaagtcgcaaagtgaaacccaagtagcattcctaataaaggaaaatatagacctaatagcacattctaggcccacctaatggctagcgcttccttaagttgtgttccttgctcccttgtaatcccctaaagagtcactctttagccggttgtcttttcttcttttgctgattgtaccaattggcaaactttatttcttctaatatatccagcaaatctcttgctgattgcagtttcaaaaataatggtgctgtgagactcgagggcgatacaacaacaataaaaaaactggagcacctatgatcatgacacgagtttgtcaagatgtatgtgtggccatgggtggacctcgtcaatggatgagttagtctcagttggcctgaaatcaacaaacaaaatcaaatagttttttttctagtataacggattcgagtcactcaattaattcttgcaatgacggaaaggggaaacatttcgaattcaatgtttggatttaattccaaccaggtttcaaaagataatctgttcattgcagctcatatgaatagtaattaaagaaagacatatctggagtactggagctcacattagacctatggagcattggatcaagaataaattttcagcaatgcttaattcttgaccttggcaaatctcagtaaaattattagtcaataataatagtatatccttccgcattccgctgtcaaaagaacaaaaaaaaaatcttccccacaagaataaaaacatatcaacctcaattttccagatcatgcaaaacatgatcaacaaaactcaaattattttcctgcaacagttcaacattatcatcaaaatatattaaattctacagaagaatttaaaccaacacccaacatgtcacaaagaagtatcaatacaagagtgcttctccaatttattttatttttagatgttcaaagcaacgaaagcataaagtgattcttttgcatgacctttccttattccctagctgcaattcacatgaggatagtttatcatttcagtgccttgtagcaaccaggttggtttaaaccctcggcatgtgaccttgaactggaggaggtagtcctcccatttttccactcctcactttgaccaacagttcttggagccattgctgcattgtagggtcatcctgcatttgtagtaaaacaaatttatattcagagttgattgcaattatcagcctagtctaatagtacttcagttggatgatacatactacctcaaaatataataaattctggttgtatatcttgtccatccaggtacatagctaaaaattattataatttggggatggaagtagtagtaatttttagtgaaaatgtatatctacaatacacaactcaccttagtaagattgttgaatgtcccatctataagtgtggtaggaaggcaagtctgcagtgcctccaagcccctggaacattgcagaggaggtagatcgaaatggcattgctggctttagaagtttgaaaaaatgaagataattctgcaaaatgaaagtgaggaaacaaacctaggattgtctgtgatcctaaggtaacagtggataatgtgcttcaacaaccttggggagggcttgtcatccattgaggtcaccatgcctgctaaggcagtccccacagcgaagaaccgatcagcagtagcgcaaatgtaaccaagcccagcgtcatccaagacaatcttttcaataataaaagttgccacctgcatatataggtgagtaaatcagtgaatggatgcaatttctaataagtttaccagaatggaatcaaagtgtatgtcactgaaaacacacatataaaaatgcaaatatatatatgatatacttaccatagatatatacatgattaatacataggtaacaaaaagaaaatggcaatatctagattgttagattggtacaattatatcaatcaatgaattgctacaaagtattccaaaacagcaagacccaaagtatacaaagaatcactatatatcaataaatgaattgctacaaattatactttgagctgatgctagctgaaaataaaaatgtgctcctatcaaactttacataggaaagaatactaaaagacaattaattaaaggtgatgttattttaggagaggattgatatggctggttacttacagtttttgaaagctcactgcctaccgccatggcatgcaggcagagaggaacaaattcatattgcagtagaaaattgatgacttctgtaccttcagcctgcatgtatcacaagtaaaag

SEQ ID NO: 65440 - DNA, 8600 bp, Oryza sativa
catgattgatgattttgaaggatattatgatgagcgcttatactggagacagaatgatgaacaacagaatgctgatcagagggtatctgcacagtgttcattagcacctgtctcccatctccaccaacaagaaggctggcagcattcttcgtttgaacatcaacatcatgaaaaccaaaacttccttgtaagtcttgtgctcttcaagtcagttcgtgtgcaagtcatattctcactatatttctgtgttacaggaaatggaggtcagggttagaagtgaaatggcacaggtccatcatgaaatatatgaactacggaagttggtggaaagttgtattgcatcccaagtaaagatccagcactccattaaagaggagatgtgcagtgcacttcgcgaagcaggtgagttgtgatggaagttttataaatttgtcattcctatctacaaaccgcaacaaccaaaatgttgtccagactccagaatatgcatgaaacggaagagcctcattttcatattctaatatggaatctacgaccctataacgcaatccctagccttttcagaactgaggcttcctatagaagattgcactgaagacaaaatgaactgtgagggcaagtgagctagtaggttgcctttaatggacagtcaaatgagatctggagaaaaagaacacagttggttatggagtgactattggaaatagttactctagtcttggaacttgaaagcaaaactatgcgccatctttttgctcaaatctgggcctgaccaactctctaaactaatactatataattgttatttgttaggctttctgtggcacctttaggctgctttatggaattgacagatttttgcggtgtgccatgctgttgttttttttaaaaaagattaaaataccatgtgaactttggtgtgttctttttcactactgccactttgcaccttattgagtgcttaattttacctcatctgtaatcattgatgcacactttttacacttcaacatccattttttttctgatgccattattttcaacagggttgatgccaagccaacccgacacaccagcaaaaaggggaagctgctgcatctgccatcagacgcaagttgactctctactttacaggtaatgatttgcatggctagattatgttctttgactcacttcacatcttatgtctcacaatttaacaagaaacgatgatacggctcgcaatcttgctaagtgtgttatcatctttcattcaggtgtggacatatgtgcacctgtttcaattgcgccgatcagctgaaatcgagcaacaggagttgcccaatctgccaatctcctattgaggatgttgttcgagcgcatatgaatttttgaggtttaggtcttaggaggaagaagagctgccactctatagctttagatgtggagtttgtgaagccctggttttgaggaggcttcttgaatcaccttcattaacaaccaaaagtatacgagctagcgtttcttgagaaatgtaaatatgttttgtgcaagcgcaatgtgtactaagtactgacagaaaggaacaaacgaaatatctaatccaaatgctgatcttgtttctgatcatttttcttgctttcctttgtttcttttaagttctgtattgaacatgtttgtagccttcagttctgataatgggcttgtcttgttttctgttgataactggtgaaagcaaagttgctacatttggagagtggcacgaggaaaacaaagtaatatttaatattcaaaatggagaacaaatcaaaaacattccaggtttagactaccaaactagtatgtatgagcgtgcaatttgctggccaatttgttaaacaaatcaatcacactagttaaatgttagcacgtagactgctttgcagctcacgctcacgggaataatttgtttatgattaaataaatcaaaatgaaagctacctctctcagaacggaagttcttctgtgaaactaataaacatgcaaatctgagaacaaattacagtaaattatctataaattcaacataattaatcttggtaaaccgattactaactgcagaatatatatattttctgaggtaacagcacgctcctgtgacgtgctctgagattaacttcaagtatgcggtgaagtcctcctaacgctcgccggcgaggacgcttacgacggccggcgtcgatgtcggcgatgaccctgacgtcacatagaatctcacatggcgccccgagatgcggtctggcccgtccgtcgacatcttccccaccgacggccgcgccgccgccgccgccgcgcggcgcacgcccttcttgagcacgctctttcttatgccgtcgctgtcgaacatgaacgcggcgtgcaccggcaggtctgcctcgtcgtcgccgtcgcatcccaggatgagctccagcggcaggtcgaagtacgacgagccggcctcgccgtcgagggcgaggccggagcgggacgacgttgagcacgagccgcagtcgaaccgctcgagcgacatggccagcgacatggtgctcgcccgcgccgtgcctgggtcggactccacgccgccgccgccgccgccgccacggaacgttgccggtgacgacggcaacgacgatgcgcgcgccgcggcggtgggtggtgaaggcttggccgtcctcctggtgccgagccctgggaggtagaggcagcacgtgaacggcgccgccccgccgccgcgtttccacttgcggcggccgctcttgccgcgcgcgtccgcggcggcgtagcccgtcgagtcctcggcgccgtcgcccgcaccgatgagaggcacgtcgctgccccaccgctgcggcgcgctcgccttccgctccgaggacgacaggatcacatcgaactcgtcgtcgtccagctccgcctccgcggcgccggcgcaggacctgctcctcgagatcgccgtcctgggcggcgccatcacgtccgacgacgcgacgcgcgcagcaggcgcggccgccacgaccgccaggtgcgcgtcccacctggtgggaggcgcgtcccaggcagacacccgccgcggcgacgtcggcacgctggcgctggcgccggcgagtaccagagccgggcccgggcgcgcgtgcggcgcgtggtggtggtggtggtcgacggagacggaagggatgggcagtggcccgtcgatgtcgaggcgggagaactgccggagcgagaaagggtcgacggcgatctgcctctcctcgggctcctcctcctcgccggcgttggtcacttggaatcggaacacggtgtttcgcgccatggtcgcgagttgaactggccaagagcctaagtaagactcaaggaaggagaagaggctattaggatttggagcgaaactaatcaactgagggcgattcgattagtttgatgacaacaaggaactagcttgagacgctagccagcagctgtcagtatcaagatcaagagtggcgacatgaacgcacgtatagagatgtgtggttgcgttcgtgctctccatcactggacagtttctaacaagtaacaggtctacgtgggtctgcctatatgaaattcgatagaaaaacaccttgtaaatcttacaaattctaaactatgagattgttttaagatttgtgcacgatacctctaaccctaatccctcctccctctctccattccaccgtcggcgctgccactcgcgagtcacgagctcgcgcgcgcacaatgttccctcgccaggccgatcggaaggagtcaatggttccggctatagctagccataagacttgaggcctgacgacccggcccacggtacaacattttggcccgccccaagcacggcccggtccgccgggagttaggcccgtgccggcctggcccggccgccgggccgtgcctgggcccctccaccggcacgttgggccagcccggcacgaccgggccggcacggcacgatgggccggtaggccaggcccgacaaaaaaagaacagggagcaaaaatagacatattatatgccacggtccaaataatagggatgtaaaatagacttattgtagctacatatgtgccacagcccaatgaggagggaggaaaaatagacttatttttcaaaaggcatgatgggccactcgtgccttcgagccagcccagcacggcccgactgctggtgggccgtgcctgggccagcacggcatggcctagtgtgttggtcgggccgtgctgacccgacagattttggtccgagcacggccgtgccgggccagggcgggccgtacaaatggccaactatagttctggctaggccccttggccagcctcctctccctttctcctttctctttcctgaaccagcgatagtgagtgttcccgcattaattaccgtcttcctcatctttgatggctcctcgccaccggatttgccatcaccagctgctgtctcctaaccacaagctctaatctttcaccaccaccaacgccgatcaaccgctctcctctatcctcgtgactccagcgttgttgctggcaccttgctgcccgcccatgttcaccgtgcagcgccgaacttccaccttccacggtcatccttctaagcctcgtgatctcccctctgccccctacccccatcctatatccactccgaacataagactctaaaccctaacttgtcaggccgtcgcaggttgccggaggagaacgggtgtccggagcacgattcacgacacgaatttgcatgattttggcactaattttctaccaatatgtagccatttagtagcaatttcgatttttaagtgatttttttaaccatctccgggctgttgcattttatccagtgacgacgactcgacaggctaatttcgatgttgtcagtgtctccaccaagtccttagggcttaggtgtttatttcataagtaacaatactaacatcattgcttgtagggtaagtatatatataccaccagacaaaggagataattaaggaactgacacagtaaggtagtttacttggactcataaacaacactaacagtagacaacgctggcaggagttttcgtaacatcccagaacaatgcataaatcaggtgaacacaaaatatgcacacattcatagagcatacattagaggaattaattactccggatcagtagctgatcaagcaagctcatccaaataaatcaagccaagtaagtttgtctatttttacctcaggatcagccaagataaaccaagccaaacaaatcggcaaagtaacgcacatactctgaatctgaatcaaacaactaatagcaagtacaatttacatgaaactgaatagcgtcgtgccaaaatcagcctatgtaggatatgcttcatttcacgcattcagttagatactgacaaagtgagataattattgaactctagagtcaagtccactagtctttccaattaagctgcaacggcctgattctctatcatattagagagaattccatataagctacagagaataacatggctatatgtcattggtttaaatttgcacactcatgccactactgtgttgactgtgtattgactgttaattctaagtacacaggtatatttacccctttgagttgcacatgcagatgtaccaattggttaatatggcaactatttgaaggtgattgacatatacatgcatatttgtagcattttagtattcatctagctattgaatgcagcatattatttttgcagtcacatgttttttagccactaccatcacacatttttaagtcaaactcatgaaacatgcagttcaacaatgaaagcctaaacatgtagtaaaacattgaggtctccaaaaaactacatggtcttttcataaaaaggttaaaatgacatcacatagttcatcagcactatcacagggcaaaatttccatagtaggaccacacatggtgcatcagcactcagtataccacaactcatcaaagtgcatactgaccatattaccaaaatgcaaatgcaaaattactgctatcagtgcatactaaccatagtaccaaggtgcaaatgaactgagcagtgtaaaaccagtgtgtacctagagatcacagcaccaaaatatctgagcacattataattctcaactaatctactcagaatcacagtagagtcaacgaatcgaaccaactactcagaatcgcagttcgaatcgaaccaactactcgcagaatcactcgcaggaatcatatagtcaacgaatcactcgcaggagagtcgcaaggacagattgaggttcattgtgtcgtcaaatatggatacatggatacatgggtcacacctccaggtgtcggccggatctgggcgatgcttgtgcgatcaacgaccgcggagatcacggtccctctttgcccatcccttcttacccttgtgcctcttgtcctcggcctccttctgagctttggccctctcatcccggattttcttctcggccgctgcctgagccttggcgcacaacctggtatgcacctttatgaagcgcacccgtattcgccggccttgagcatcccgcacggacaggtccagaagagcatcgtgtgatcttccaaggccatcccgcctccgccgccgccttactcccgctcgctcgctcgccccccgccgccgccgccgccgccgccttacgcccgctcgctcaccgccgccgctctcggggatttctgatttcgctagggcgatccgatctgatcggacgcgtggagcagacggatgggtgccggcgtacgtgggcttcctgggcttcctgatagtggcctagtgggagtgcgaatgcatctgctccatgggccagaatatgtgggcttactgggccgcctgactgtggcttagtgggagtgctagttggccagcgtatgtgggctactgctgtttaggcctaagtacgtgggtttcctggacgaataagtttattctatgtccctttacttgacagcgagttgggttttcgccctcgaaccaaaataccagatacaaatgtcctttaattgtcaaaactggtacatatgaggttcctcggcgtggcattggaagccaaatatgaaaattaatttttttgaaaaaaatgtgggacccatatgtcagtaaggcaaaagaaaaaagtagtgggacccacatgtaggtgggtctcaccttccctctatctccacgacgagcgcacgcgtagaaccggagaaggagaagggcgacggctagcggctggcggccatcgggcagtagagcaagagaagtagatacatcagtttggaaattatggcttgaaaacctttcgtagcagttttttttttctgattccttccttatgtaaatagaacttgcatatattgacctaagtagcccaatgtgcaacttaggttatatatgtggcctaaagtgaaatttactctctttttatttgcatgcgaaagggtgtgcgcaaccctggcacgtgtgtgcgtcgatctaggttgaagacgacagccttggatatgatggagagtatcagctccattatcgtacatgcacgagactgtttccaggaggttgaagacggcaatctatacgagttgagcctgcagttcctgtggactggatcgaacaaaggcaggctgagcggaggaaggtagcggactaggcagggctgaaaaaaaaatgatgtaatgggcttttggatcaaaactaaggaaggagtaaaatttatcgtgcgatcaattttacccggtgcaacgcacgggcattttactaggaatactaataataataatctaattgtcccctttttcatcacaaatcgcatatgcatatgcatgtattaaatttcttttcgttgttccacattcattaaacaatcaactctggaggaaaaacccacgttctgtccaaatcaaagaacccgatgcttcgtgtaaacggcctcctagtaccggatttcaagtcccacacgtccggtgtgtcgacgaaatacatcgtgtcctctaaaacctcgccgtgtgcgggagcaggcatggacttgttgaagagttcactgaggaagattgcttggccacctagaccgccgccggtgaccggaacccatgtgccggcgtccatgtcggccttagagacatccacgctgcgggtgtggtcggcgtccttgacgaaggccgcgattaaacactcccgtctcaccatgagcaaccggccagacgactccaggaggtgccagctaccgttaactgcgtagtcgtccccctctaactcgtactttgtagtcttccaaatgagatcctcaccggtgaggtactgccactgatggccgacgtcgtcgatgccatcatcaccgacgggctcaatttcgctatcgttctcgctgtctccctcttggtttaatgactcatcatggtcgttggtcgatgcgtcaccgtcattgtcttgtgcgtcgccgtcgtcgtcgtcttcatcgtcgctccacctaaacgcgtcgattacgccatcagggcttctcggttgtctgatgatgcgctcgacgctggtgacggtgggcttgccgtctttgtcgtcggcgaggtcgacggcgaagaggtcctcggcttttgtaattagata

SEQ ID NO: 65441 - DNA, 521 bp, Oryza sativa
tcctcctgccaccgtggcgcacgcgaaccgacgtggcaggaggaggctggcgccgccccaaggaggagggcgccagcatggctggcagccgccgcctccattcctgtttctctgtatggagttgcaacggtgtcatttttattttattttttcggatgttttttcacactcaggatcacgatacaaccaaccacaaaaaaaatttaaactcgaactaccacttagctaagtttgaaaatatctagcataccacttagtctactttgcaccttcactaaaattagaccataactcctttagtaaaaccctttgatcagcatgttaaacataatgcactctaccactatatgaaattacttaatctaattcaaaatataaccatatgaaatgacatatataagttaaacagtacgtagagatgcaattttttatttttatttcatttttttgatatttttttcacacttaggagaacataggaaccaaccgtataaaaaataaactcaaacagacaaaatatg

SEQ ID NO: 65442 - DNA, 503 bp, Oryza sativa
  unsure (1)..(503): unsure at all n locations
cccgcgaattttcggagcccaagtaacattatcaatacaaagttcatttaatcaattaaaataaaaagaaaaccaatttaaattccccttctttcccttgggccggtttcggcccaagtctgctttgcctccccgcggcctgggcgccctccctctctctaaggccggccgccccgtcccttctcccctcgggcctccggcccagatcgcctccctctcgaagttttttttgcgtcccccaaccgacctcctctctctccctctggccgacaggtgggacccgagaccccacctgtcagctcttcctcctacctccggccaaccgccatggctgccgttgccgcccacgattgccgccgaatccggccaccttctccactccgcacgcccgcacccggccgtgggactctgccgccccacgtnctcctcattcccccacctctcccgcaaaatccggccgccactttcccacgtcggcgccacctccatccatcggccattgc

SEQ ID NO: 65443 - DNA, 709 bp, Oryza sativa
attgactgggttcgttcgacataaacagtacaataggagcagactgtagtagaaatcgatgaagtccgtagtttgcagggtttaccggacaccgaaccgccacgtttacgtacgtgtcacatggttacggcgattacggcagtgtgttttcgaagcatatcgaacggacgattgcaccaagcattgacaacgagatggtactgtaattgacaatttgacatcgtttgcatggacgagttccgtggtgttcccatcgagcagctgcatccctgaattcaattggacgtcagggagaaattttttttttttgaaatggattggcttgcaagcaagtcgacaccgaggaaatggactaccgagcgatcgaaagatattcatcacaccccatcctgttgaagagtactatggttttgttcagttcattgattgcgaagaaaaatgccttaccatgtatttattggtaaagttaaaatttggcaattataaaagtttagtaggatcaagatgtgaaggtggtgtttagttggacatcttaatttgatatattattgtgagtagaagtttctaaaaatactaaatgttggtagatattgaaaagattgtgatggtaaaatgttgtttaatttgttaccttaccaatttttttagaacagttaccttaccaatttgatatggttgattatagcaacaaactgaacacaccctatat

SEQ ID NO: 65444 - DNA, 507 bp, Oryza sativa
ctaccgaaacggacaaaatatgccatctattaaaataggcataactttctcatacggactcggaatcaggcaaataatatatgcacggacatctatagaaaaagttacatccgattctcccccgctttgccgggttcgacgatattaaaacctccaaattccgcttgcaagattgtgttttcgaggaaagaagtttttcggtggagctttggaaaattccacatgccacatatttcgtccgtttgagtttattttttacatggttggttcctgtgaggtcctaagtgtgaaaaaaatatcaacaaaataaaataaaaataaaaaagttgcacatctctctcctctgcactagttcggaaagagaggagaggagaggaaaaattatacatgtcacatattacgtccatttaagttcaatttttctatggttggttcttgtgtgtccctaagcgtgaaaaaaatatcaaacaaataaaacaaaaataaaaaatttcggggggggggggg

SEQ ID NO: 65445 - DNA, 3123 bp, Oryza sativa
agggaccaggaaattaatcttgtttttgtagcaccagccaatagcactgccgcatgtataagacacctatctgtgccactacctgaccaagtgacagccatctgattaattaaatgcaacagtaatcgatcaaaagctctggttacggaggaaatcgacacggactcgacgtcagccaactggagacgacgtacaaaatattcacgcaaaaacatcttaaacttttataatagtagatagatatgccaaaccaaattattatagtcattatatcatcttgctacaataactttcactatcccaaaatatggaatccatcgttctcgaacctcagcgaatcacctatatcaatccggtacgtcatcgtggttatttgctcgaatttcgtcaaattctactgaatctatagatccctggcccatctatgtccaccaaattctattgaattttaccgatttccatcccatcaatttcacctgtaaacccggcagcaaggtacaggttggatcctgaattttcagagaaaatgactgcatatttatcctgattaattgtcggcaggtcaaaatttgtgttgtctttttgtgaatggatgaattgatttggagcaatcttccacagacatgctgatcgcagacacatcaatttcagcctaagccattgaccatggggttcatgcatgcacatggagatcttttgcacttttgttgtttgttggcttttgcctagatatattctgaatagaactttccattactcatttaatgatctgtcctccatatgcataaacaaaagagtttgtcctgattaaatctaattgcattctaaaccccacaggcaccagataactctcaatctttagatagatctcatatgcatgcatcatattgatattcttttcatgtacttgtttttatggaacctctagtgcctaaccttattatatatcaatcagttcagatccagccacacgcaaaaagttggccaatcttttggccacttgctaattagcagcaaatgcagcttgtagctccatgtgttgaacactccaacaaccatagtagccggattcggctcccctatcttgagagatgtatatgaacagttagtctcaacctaatgcatggaattcggccataatcagggctccaaagtactctacaaaagctatttcccagtcaaaaaggttccaaagtgaaataggcagtcgtgacttgtgactctgtgaggggccgttcgaaaggcaggagtaattttggtgaaatatatatctgcaatagttatggtaatttaattctatcgcagatatatatcttcgcatgcggacgcccgccccgcctgcgaagatcggcgatcttcacagtcgtttgcttacaggcggacggccgcctcacctgcgaagacacatttccaccaccggcggtaatgcattttctagccgtgatatatcacccacgagaaaagagaaccttgcgtagacaactaaaagaaattctaaatgtgctttacgtgaatgtttgaattcctttcagtttgtataaaatgacaatttaatattggaatcttgagagttcaccagtataatccggccgaacatgcatattgatgaagaaagggcttgaatgaacattattgtagctctgaaaattaagtaaatgaattgtaacaataatattgtatatcaattataaaacacaagggaaaatggagagctagcttttaatatgtccactgacatgtaagagcaaaagctgctgagaatcttctaattaaatttctaattcctgcaactatagatttctataatcaaggtgaaaacttagactatttacgagaacttgagattgagattttagaagaagttacaggcttacagctatcaaaaactcatcaaattgagacatagtcttgtatgttatttctatccatttgtcatatcattttctttttttttgaaaaagaaatatcagcaaatatctactactcctactttaaagggtcgtcatccatccgctcctttccatgttgtgcaaagaaaaaatatccgttgggcctagtgcttggtctatacttgtatatcccagtatataagcccagtatatatatccatccttagtaatataggtctatcgtaatacacatttatgtaacctcttcttattttgtctagtttctttcctaggtagtctactgttgtctctctgtcgacggatgatacccgtagaccggatgaatagggtattgagatgcgttggtacgaggatctacacaatacgacatgaagcaaacaagaagacaaagattatattggttcagacccctcataaggtaattgctttaattcagtttatatgagattgatatggaaaaccacataatacaacgagaacagacgaatccgacgctaccagcgagatcctcgtcgagatgatttgacgagatctctcgatgagtatgcttcgcgccctccgatttgttgactatggtgggcgtatgggcgataaaatttgatgatctgaacccctcagaggtgtgccttttataccgtgagtcacattagtctctaaatagaactcggagacaattgacacacacaatataatataaacccgattctctctgagtagaactctattattcacctatccgtgaagatgatttttatagtattttgtaaatttccttatcatatactgacggagcgtggggctcctcaccaggagaccgcgcaggcccccctttgccggttcggccgggggcgctaagtgaggttcttcgccctcgatctgaggaacgtccgcgagagaggaagtgcacaagacacgggcgacgtagacaggttcgggccgctgagaagcgtaacaccctactcctgtgttctggtggatctgtgcgtgaaggaatacagagagctggagagcgagccagagttcagggtctagcacccattcccttttttctcctccctccagcgcccccctctcctaggcctgggcctcctttttatctggtcaggggtcaccacaagggcctctcgctacctaagaaaggaaacatgctttttacaatgagggctaatctacagtcggaagtgacctctgacaagcagagcacacgtcttct

SEQ ID NO: 65446 - DNA, 663 bp, Oryza sativa
atttgcgtgttcattggtgagtttgtagtgaatattgaagaaatctgttgatcaaaagattttatgtttatgttgtaaaatggaaataaaaaaatgtgttctatttctttactattattttaataaaaacaagtgaacgaggtggttttttaaaatgcgaatactaagatttgaaaaacgtgtcttgcatactagtatgttctataagggactctcattgtaatgaagtattgatagggactctaatcaggcctcctataaatcgttattgatttgtcaaaatatctctggaaaagaattactactacctgccggcgatcacaacaccgatttggacaggttttattgtttgagcacgacgcgaaatctaacaaaagctgctccacacgaacactgcttgtagaaaatgacgataaattcacaggctcacagtgcagtggcccatctctttggacggagagggccaccggagacaggaaggcagaaagaaaaaatggcgataggatggcataggtcacagagcctggcgtctgcagggctcgggctgcacgtcctcctctgctcgtcgttgctgctcaacgccgtcttcatcgcgcaccaattcctcggggcctcaccgccggcaacgccggagcggatcggcgacgggctgagctgggcact

SEQ ID NO: 65447 - DNA, 702 bp, Oryza sativa
tgatggccgatgctaattgcgagtaggatggatactggaaatagcggatgaaatgtgagaacaataattcctcggagacttcagaaaagcatcgcaattcattacataaattccccgatgtacttggtgctcatcctagtcaaaagctaaagattccagaagtgctctcttcctcaaatgagaattggtcctcaacctctgcatcggtgaaggtaagagctctctgcaactttttgggacagaaaacctcaacatcggaagtgtacacagctgtcacagggcggtgatcggatagcctgatatcaactgtcctgtaggcctgcagcctcattcccttgccaaaggaaagaattcggtcacacctacaaagttaaacaatatttttttttgttagcacgcatcgctcatcgcaacttagagatttcctcatacacaacctcaattcttacaatacctcttattaaatagtagtaatgaggtgattaatcgtgagttatgaggaccaattctttcctcttacacaatacctcttacaatacctcttacaccttcatgagttatgaggtgattaatcgtgtaaacaacgaggaaaaatgttactacctccgtcccattctaggttgtttagcatgtattagggttagaaaaaaaatactacaatacctcttattaaatagtagtaatgtataggtggatctgaga

SEQ ID NO: 65448 - DNA, 20153 bp, Oryza sativa
cccccccccccccccccgagggggtcaggccacgtgggtgaccgcagctacccaagcctctagtcacgatacccccggccccatgtcaccgacagtagcccccggcgttatgccagggcgatcgcccctctcgagggaagcgctcgggcgtgacgccactccttagatccggtgacaggtggggccggtccctacaggcgggcagaaacccagcggtcgcaaatcgcgcgcatcggcaagggaaaaccgaccgacaacaatgagcggcttctttaagaccgctacattactcgagcagcgcgcgaatcgggacgagccggttcgtttcgcctggagacatgatgatggcgcttttcacggttggcgagcgtagttaatgcgtgcacaatctgccccatctcaaccgccacggccgcacatctgccgcgtgcgctgcaaacgggcgagtggggttagtggaggcgtggacgcgagaaacgagggggcgcggtagtgggcgcgggaagcgaggagccgggcatagcgttggcaagggtgtaaagacgccgaggaagggattcgtttctttcctcttcgccactcttccccttgccttcgccacttgtgctctaactcttcgtttcctgtgccctgcccttgccgcactcgctcgctctcaagctcctcctccgccggcgtcatggcacggggctccgcaccgctcgacggtagcgtgctgccgccttcccgcatcgtgagcgagaggcaggccgggctgccgcgccgattcatgccggaatctgccaccggcagggaggtggtcgcgctgggcgagggacgcccggcgccacactacctggggcggtccgtcttcttcctccctttcgcaatggcggggctggtcccgccattctctatttttttcatggatattctggagttttatgatctccagatctctatttttttctctacctgttggccattttcgtgcacctgtgcgagatgtttattggggtgcgcccatctctccggctgttccggtggttcttcaccgtacaggcggtgtcgccgccgacggtagtcggtggctgctacttctagccgtgggggcaggtgctgaaccgctacattccctgcgtcctccgcaaaaagtgggacgactggaagagcgattggttctacacccccctcgccgacgaagcgcgcctccgacttccgagccagcccccggcgcaggcctccagctggcgggcgacggtagatctgggagacggctacgacgccgttcttgaccgcctggcgggtctgcgatcccaggggctcacgggggccagggtgttcggtgactaccttcgtcgctgggtcgcgccgctccagcggcgcgcccggggcgcctgggagtacaccgggcccgaggactacgtgaggacccaccaggggcgcaaatgggactgggaccctgaggacttcaggacggtggtccaacagatgctgaatctcagctccgtggaggcatccctcatcccccaaggggtcctccccctctgctgcaatccagagcgcgccaagatcctggccatcatgcaggtggtcagggcgtcgggggagcgggccccccgaggccacgatggcgcgggcgggagccgcaggggggaacaatctaccccgggtgggggtcgtgcttctgggccccgcgacgggggcccggggggcatccgccctgccgacgcccgggggaagaggaagcaggagggtacccctcccccatctcctccccgagggggcggggcggtgcgtgccagcagcaggcgcccggagggtgctgtgccgacgccgcagcccgagggggagcgaaagaagaaacggccccgcaagatgggggggaccgagccatgccgggggagcctcatcttgcccccgaggtggtcgtttagccgacctccccgcaggttcgtccccgcgcccaccgcggccgtattcattctcccaaggcgagttttcactcacccgtttctttttgtcttctggtttttcttctgcctcagcgagatcccgtcgccccccccccccccgccattccaagtccagccggtctgaggccgaggagacggcgaccgcggaggcccggaggcgggaagctgaccggcgagaagccgcggaccgcctccgggaagccgaggaggctgcccaggaggccgtccgggttcgccaggctgaggaggccgctcgggaggaggctaggctccgccgggccggggagtccgtccgggaggcagaggcggcgcgcgcacgccaggcggcctgccaaacccccgacccgactccgcccgagacgacgccgacttccgaggccacccacgacgaggccgcgggcgcgccgctcgggcccgacctctcgggcgacgcttgggacgagccagcttcgggggacgcccccgagtccggcacgtcgatcggcgggccgagccgcgcggcacccacaccgaggcggctctcccctctgccttccgctgccccactgagcgcggagcccttcctgcaggccttggccgccgcgaacagcacggtgctggacgggttaagtgcccagatggaggccctgcaggcggagcgggcggagctcaacgcggcgtgggcgcgcgtcgaggaggggcggcgctcggtggaggccatggtggaggcgggccgcaaggcacaccgccggcacgcctctcagctcgaggcccgtcgtagggacctggcggagatcgccagggaggtggaggaggagcgggagactgccctcatcgccactgccgtgctcgacgaggcgcgggacgacctccgcctccaatacgggagcctggcggcggagctagaggagaagctggacgccgcccggggagtccttgacgccgccgctgcccgggaacagcgggcggcggagaacgaggcggcgtcccggcagcgcgaagaggcccttgaggctcgcgccacagcgctggaggagcgcgcccgcgccctggacgcgaaggagagaaacctggcggaccgcgaggccgccgtcgccaaccgggaggcaacactggcggcgcacgaggccgcctgcgccgaagaggagtcctcactccgcctccgcgaggacgcgctcaccgagcgggggcgaactctcgaagaggccgaggccgcggcgcagcgactggcggacagcctgttcctccgcgaggcagcgcgggaggagcaggcgcgccgcaatctggaaggcgcccacgccgagagggccgcactggatcagcgggccgctgagctcgaggcacgggcgaaggagctggacgcgagagcgcacagcggcggggcggccgcgggccacggcgacctagccgcccgcctcgcagccgccgaacacaccatcgccgagctgcagggcgcgctggactcgtccgccggggaggtcgaggccctccgcttggcgagcgaggtagggcccggcatgcttcgggacgccgtctcccatctagaccgcgccgggcggcaggcgagcctctggggcgggcggtacacgaagtacgccgccaaccagggggggcctcgcccagcgcctctcagagatggccggggccctcgagcggctccctgaggagctcgaggagacgatcaagtcatcctcgagggacctcgcccggggggcggtggagctcgtactggccagctaccaggccagggaccctgacttctccccgtgggcagcgctggaagagttccctcccggaaccgaggacggcgcgcgcgcgcaggtccgggacgccgccgaccacatcgtccacagcttcgagggtacggcccctcggctcgcgttctccctcgactccgacgaggagggcggtgacgatggtgcggacgacagcgacgacgaggccggcgacccgggcgcgtcggagtgagcccccaggcccccgccaatcttaatgacttttccttcttcttccgaggccttcgggccccctttttgtatagactgatttaatctgcaatcaagtaaagagaaaatttctgcgtcagttctgtttgttgtgtgtataagacgaggatggtctgtgccgcggtccttatgtgtcttggcttgaacaagggctcgtgcccaggtcccagcctcaaacggcgcgggtcggggctagtgcctggggagatcctcgtgtcgagactggccaggccgggagcgcggtgaccgagggttatggatgacccgattgtgggcctttgccgattcccccccggagttcaccgcgccccggggcacggctcggttctgggccccgtttggcgattttagccggcccgggccgccgagggtagggtcgagcacgagcgtactaattcaagccaagattcttcaaaaggaaacgatggcacagacacagtcctcaggaaatcgaaaatgcttttattgaaatacggaagagaaaaaggataagtatatgcatgtggtagcccccggccaaccctgcacgcccgggggggggggtgcggggttggcccgagcccgagacatgacacccgacccctactaggggtagaagcgatgaaggtgttcgatgttccacgggttaggcagctctgtgccttcacccgtggccagccgaacggagcccggccgggggacgccgatcactcgatacggacccttccacattggtgagagcttgctcagtccagcacgcgtttggacgcggcgtaggacgaggtcgtcgacgcagagtgatcgggcccggacgtggcgctgatggtagcgccgcaggctctgctggtagcgcgcggctcggagggccgcgcgccgccttcgctcttccaaatagtcaaggtcgtctcggcgaaactgatcttgatcagcctcgcaatacatggtgacccgaggggacctcagggtgagctcagatgggaggaccgcctccgcgccgtagacgaggaagaaaggcgtttccccggttgctcggcttggcgtggtttggttcgcccagagcaccgctggcagctcctcgatccacgagtcgctgtgcttcttgaggatgttgaaggtcttagttttgaggcccttgaggatttccgcgttggcgcgctccacttggccattgcttctggggtgggcgggggaggcgaagcagagcttgatgcccatgtcttcgcagtagtcaccgaagagctcagtagtgaactgggtgccgttatccgtaatgatacggttgggcaccccaaaccgagcagtgatgcccctgatgaatttaagcgcggagtgcttatcgatcttgatgaccggataagcctcgggccacttagtgaacttgtcgacagcgacatacagatactcgaacccgcccggggcccgcctgaacggacccaggatatcgagcccccagacagcaaacggccacgaaagaggtatggtctgcagggcctgggccggccgatgggtttgcctggcgtgaaactggcacgccctgcaccgccggaccaggtcgaccgcatcgttgagagccgtcggccaatagaaaccctggcgaaaggccttgccaaccaaggtgcgtgaggcggagtgggctccgcactcgccttcatggacatcggcgagaagctcgacgccttgttcccgaggaatgcacttcaggaggactccattagccgcgcgccgatagagggtcccttccaccagcgcgtagcgcttggagatgcgccggacgcattcactcccttcgcggtcctcgggtagagtcttatctgcgaggtacacctggatctcagtgatccaagcaatcaatctaggggagctgggagcgctcccctcgggtcccgaggcctggactccgacgggcctcgggggccgttcaggcgcgtccgtttcccctagggggtcaggtcgcgccgacggctgggcaagcctttcttcaaaggcgcccggtggggtctgggctcgcgaggaagcgagccttgagagttcgtcggcgaccgcgttatcccgtctgggcacgtgccgaagttctatcccgtcgaaatggcgctccatacgccgcacctggggcacgtaagcgtccatctgcgggtcagagcaccggtactccttacagacctggttaacgaccaactgggagtcacctaacaccaggaggcggcggatccctagtccagctgccactctgagtcccgcaaggagtccctcgtactccgccatattgttggtcgcccgaaagtcgaggcggaccaggtatctgaggacgtctccgctcggcgaggtcaacgtgacccccgcaccggcgccctaaagagacagggagccgtcgaactgcatcacccagtaggcggtgtgaggcagctgcgaggggcccgagctggcctcgggggcggagacgggctcgggagctggggtccactccgccacaaagtcggcgagggcctggctcttgatcgcgtggcgtggttcaaagcgcaaatcgaattcagagagttcgattgcccatctcaccacccgtccagtaccctctcggttatgcaagatttggccgagggggtaagacgtaaccaccgtgacccgatgcgcctggaaataatggcgcaacttcctcgaagccatcagaatagcgtaaagcatcttctgggcctgagggtatcgggtcttggcgtcccggagggcctcgctaacgaagtatacaggccgctgcacctttcggcggggccaatcctcttcgccaggggccgcatctccagggcgctcttcgaccgagaggccacgcggggcacactcggcttctgtgccgatgacctcggggtcagagggcgacaggcgcggccttcccgcagtggccccggggccatcctgggggtcaggggcgcctggcaccgtcggacaagcaggcggagggccagctccgaccgtcgggggccttgggccgccgttcggctcgggggcctctcctccctgctctctcccgggtcgagtcgacacagggtagggatgcgcggagtgagggttgtcctcgtcgcgctccacgaccaacgccgcgctgaccacctgcggggttgccgccaggtagagtagcaacggctcatctggctccggggcgaccaggactgggggagaactgaggtacgccttcaactgagtgaaggcccgctcagcctcctccgtccaggtaaacggtccggagcgtttgaggagcttaaataggggtagcgccttctctcccagcctcgatatgaaccgacttagggcggccatgcagccggtgacgcactgcacatccgtaagcttgctgggggggcgcatccgctctatagctcgtatcttctcggggttggcctcgatgcctcgggcagagaccaagaacccgagaagcttgcccgcaggcacgccgaacacgcacttatcggggttcagctttatgcgggcggagcggagactttcgaaagttttcgctagatccgagagtaaggtctcttggttgcgcgtcttcacaaccaagtcatcaacataggcctcaacattgcgtcctatctggctacccaaagaaattcgagtagtacgctgaaaagtaggacctgcgttctttaacccgaaaggcatcgtcgtataacaataagttcctatgggagtaatgaatgcagttttttcctcatcctccctagccatgcgaatctgatgataaccagagtatgcatctagaaaacacaaaaggtcgcaccccgcggtggagtcgacaatctgatctatgcgtggcagggggtaagggtccttaggacatgccttgttaaggtcggtgtagtcgatgcacatccgaagcttgccgttggccttgggaacgacgaccgggttcgccagccactccggatggatgacctcacggatgaatccggcctccagaagtcgcgccacctcctcgcggatgaaggcttgatgttccggggcctgccgccgcactttctgccggaccggccttgcgcccggccgcacggcgagacggtgctcaatcacctccctggggaccccaggcatgtctgccggtctccaggcgaagacgtcggcgtttgctcgcaggaaggagacgagcgcgtcttcctatttgtcgtccagaagaccaccgattcgtgtggtcttggacgggccgtcgcccagggcaacctccttgaccgggacctcgtcgcacgtgaccatccgctgccttggggcggccgggacggaggtgctgagcctctcgtcgccacccgcgggcttggacgccgcggcgaggtggtccgcgcgctgctccatacaagcaagctcgactttgaggtcgccatggacggtgatggggccaccggggcccggcatcttcatctggagataggcgtagtggaccgccgccatgaacttcaccaacgcgggcctccccaggaccgcgttgtagggcagactgaggtccgccacatcgaagtccacccgctccgtgcggaagttggcggaaccaccgaaggtgaccgggaggtcgatatgacccagcggccaggcgtgccccggcgtcacaccgatgatcggctgggacggccggagcaccatccccggggccttgatggcctcaaaggctgtgggggaaaggatgttgagggctgcacccccgtctatgaggacacgccccaacttcacattgcaaacggtgggggaaaccaccatcgcgatctgtcctccccgggtaacgcacggcgggtggtcggtctggtcgaaggtgagggcaacctccgaccaccgcgcccgccgcgtcgcctcatgggtaggggccgcggccagaagctctcgcttcatggccttgaggctccggcgagaagcgtgagcgcacgctcccccatcgacggtggcgacggtggcctcaggctcctggaaccccaggtcatcgtcgccatcgtcgatgtcctcggcggtggccttctgcttggcctcacctcgccggttgctggcgggagccgccggggttttgccctcacggcgctcctgcctcttctcctcctcccacttcctcgtccgctcagccaaacttttgaccgcgcggcagtccgcgaggtcgtggagggaggtgttgtgcacggtacaccacttgccggtcgggcgctccctgctgggagcgccggcctccttctttttgtcgctcgcaggcctcccctttcggggggcccgcgaagcgccctcgacggcgaggacgtgaccctcgtcgtcgaaacgggccgaccccttcttcctcctcctgtcccgccgccctgaccgagcggcggtcccgggggcggccggagctgccacaccagaaccggaggagttccaggtccaggcctcctcctttcgagccacacggtccgcgagctcaaaaagctgcgcggtggtctggggctccttggaggcgatcttctcgagcatgcggttgtgccgcgcgccccccctaaacgcgtagatcaccgcgtgtgcggggatgcacggtatggtgttgcggacttgacagaaccgctgaatgtacgagcgaagagactcatcgtcccttcgctgtaccgcatgcaagtccgcttcttcgcctgggcgcggatatatgccctggaagttcatggtgaactgctggcacaaatcctcccaagagtggaccgacgcgggtggcaagttcattagccaaccccgcgcctgacccttcagggccatggggaagaaattcgccatgaccctgtcgtcacccccggcggcctcgatcccggtcgtgtagatctggagaaactcggcggggttgacgcttccgtcgtattttttggtgatggtgggccggaaccttgggggccaacggacgttccgaaagctcgccacaaaggctcgacagccggcaccgccaaccgggggcacggggggccggcccccgtgcccggacgcatgagcgcgccctggggcgtgccgccatcgccgtagacgaggtggcgacgcgccccgtctcgccgtcctcccccgtcgcccgcgggcggcgaagtcgcggttccttcgacctccccgagcgcctccccccgcccaagatttcggcgagagggggacggtggggtgcgagcccgacggcgcgggttccgctccccgtcgtcaccgctagcgttcggagagaggctgtgcgccactgcccgttcggccattaagctgagcgggagaagcttggcgcacacgaaagaggacgagggcttagaaagacatgcgcgccccctacctggcgcgccagatgacggagcgtggggctcctcaccgggagaccgcgcaggcccccctttgccggttcggccgggggcgctaagtgaggttcttcgccctcgatctgaggaacgtccgcgagagaggaagtgcacaagacacgggcgacgtagacaggttcgggccgctgagaagcgtaacaccctactcctgtgttctggtggatctgtgcgtgaaggaatacagagagctggagagcgagccagagttcagggtctagcacccattcccttttttctcctccctccagcgtccccccctctcctaggcctgggcctcctttttatctggtcaggggtcaccacaagggcctcttgctacctaagaaaggaaacatgctttttacaatgagggctagtctacagtcggaagtgacctctgacaagcagagcacacgtctcctgcccccctcgccagctttcccggtggacgcccatttcaaccttcattcaatggccagcgacttccttgccatgcttgcgctgaagcctggaatggatctgaccgggactgacataccaactccaggagttagcacgccggctccggctagggacgagagccaggaagctctcatcgtttcgacgggacggggcgaggcgtgtgacaggccgcctgttgccacctaacccacgatctgaccggtctgtgaccggtcacacgccgcgaccggtcacggaccggataagcgtgcgccgcgccgcattaaatgcggcgtggcgcgctcgtccaacctgttataaatgcggttaggtgagccccgctgtgctcacctaactcacacacgtggcgccaaaaccacagggggtcggggcgtcgcagccctcggggccgaaacgggggcgccccagccctcggggccgaaacgggagcggcccgacccctcggggagacagagggaggggtggccacgtcaccctcgggcccgaccccccccccccagggggtcaggccacgtgggtgaccgcagctacccaagcctctagtcacgatacccccggccccatgtcaccgacatatacggaaatatattttgccatgaaggtatgttgtattagtatatcctataagttgtaggacaggaggtatgacttatctataaccataacactctcatctatgaacccatgacatagaaggtcgtagtagtaaaataattattttttaaatatattaatgagtaaggttatacatagacactttgtacttataatacaacaaaaaaaaaatcaaaggtggtgtaatctgcaaataccgcaatagaataagccgcgtttttttttccaagaccgaagtagcactgtagcgtaccaacgtgccaacgcaaaaaaaaaaaaaaaagaagctatccaagatccaccgggccaccaatccaaaaataaagcctgacatcataataataattcagaaatcataataatattatcatatcccttcgctttccgattatttgttgtttccatgattaaaatataacaacccagccggccggggcggcagaacggatgtcgttgtaaggtagcattcgttgctagcgcgatcgaggatgatgaggccgatccatccatgcagctgctgtgctagctagctctgctactactagctttagcttaagcttagctagcgtcgtcgttggctgggtggctgtggctggctggggccactgtatgctcagcggcgcgagggcgaaatggcgaaaaggttggcatccgatcgagagatcgatggatggatggatgggtaggccgggtccctttctgttgcgaggttcgccggcaggttgcgggctggggacctcctcgcggcacgcgacgtgcctccccacccccggcaccctacctgctttgcgggaggaggctaaaatgcaatgcaaccgatcgatgccactctgatctcctagtgaccgggaatatatgggcttcgccccccagctaattttcttgattggctaccggtagctctgtttctagatggccctaagcaacggatgcagatgaggattaagaaacgcgatttggagggaaagaacatttctaagaagaaattgtgagtatgttggggattgaaaccagacatatcttgccactgcaatatcaagtacatctcaagatgaggattaagggcacatgaaacatgaaagtcattggtgtacgattaattaagttgcaattattataaaccggaaaatacatttatttggtattttttaacaacttcaatacagaaagttttcacaccatttaacaatttgacattttagtagaatttgtatcgtcccaatcaaaagactggggcctaaatgcccccaccgccgttactagcagtagcaatggaaaacattgtgtactccctccatccaaaagtctaaccctatttcttttggcattaaggctaaggagtaattaattctttcacaatgtgataaaatcaatgaacatgcaaccaatgcaataagtaataaaatgactttttaggttccaattaataatttaatttagcacatagtaactacaaattgaacttagacttttggaaaaaaaccaaaaaataaaaaaccctcgtagttttccagatccggccacccctccccgccggagttgaggtcgagggcggccatgcctatctgttaacgaccaaatttgttttttcgcagcaacactatcctggaaggcactgccgctgccggatccagtgaagtagtatggggagtcggtgtaggggtcgagcctgtcgggggaggcgtgtgaatcggactgcgacatgaagtccctcgtgccggagctgtcgccgttcatctccgccccggattgatgcggctggcaagatcggcgaaggcgaaagctgccgtgagcggctgcggtgagcgaaatcggcggtggcggaggcgggcgtgaacagcgtcggtggagtaggaggcgggcaagatggggaaattttgggggtgaaatgagagagagcgagcgtgcgagggaagagagagagagagcgagggtaagagagagagcgcatgaccgaccgggggcaatgcgcgtcccaaagcactttttggtgaaatttgctagtccagactgccaaatgacaaatgcaaagttgccaacttttggaactagtgtttagatccatattaccaaaaagtggtttaaaatggcaaaagttttgccattttgaaggatctaaacggccctaagttttagacttttggaaggagggagcatctcttaagagcaactccaacaatctagctatcaggtttggatcggtaaaaaaaacaaaatgagtcaaaaccggggtccaacacactcggtatctcgctccgctcatgatcctgttcaacatccgtcgcccctcgtcctgcatatttgcagtggccatcccgctcgcaatcgcctctctcccgcgcacgcgctcgtttcccgcccgcgcgctcctgcccaatcggtcccgccgcctcgccctcccgccgtgctacgccgtcgcacctgtcccgccgtcccgcgccctcgccgtcccgtgccgtcgtcggtcccgccgtctagtgcccccgctcttccgccatcgcgccgctctggccccggccttcgtctcgccatgtggaggccgccgcatcgtgcttcaacggcggctaaggacttggatcaggatgctcatcgcccggaaggggacttggattagtcgggtattggatcgatgcgccattgggtggttcctccaacaggcgtcgatggttggaaggcacaaggtctgttcatcggtgagcaagtcaccgatgaggaggtctgcacaggtgagactcactatctacgtctgtcaaaccctttgctgttagttggatgactggatcataggaagttgctcgttctgtattctacctgaggattttgggattgcattcatgttggctgtaggtttctggaaataaaattgttgtctttcttcgcacctgaccagagtagctacttgttagcacaatacatttgaatgaaagattcatctagatcaaattgcttcttctttgcaagtaaataaacaggacctaccctaagtcccgttttgctctaaatcttccatcctgcattcacatcacaataattttcacaaaataagatagtttacaattgcaagagagtaggtaaattaaaaggataatactctgttatttacattgctgcaaatgtccacattgcatataattttattcagctcgatagtagttacattactttagatgcaactgcttccagtataattgtaggctcctttttatagcccctatacatcccgtgccatgcagtaggacaattcttccagctccaatgcatacaatctatggaacctagcataccaggaaatcctctgctcgctccaattgtaagtaacctagcagtatcctgttcattaggcttcctcatgtactctggtccaaaaacctcaacaactgctgcaacaaactttctcaaagcttctagagcggtgctctcaccaatacgaatgtactcgtccaaagcatcagctggtactccataagccaacatacagaaagccgctactaccttctgcagacaagataatccgagcacaccggctgcattcctcttctgcttaaaataatcgtcatgttcctcaacagctttcattatgcgaagaaatacatgtatcctcatccgaaacctatatcatgatgcaattaaattaaattagaaatactataaaacacgacacataaaaattacataaacattatagagaacatgcgaacctgcgtctaaagatgtttggtccaaacgttggattatctgagaaatagtctttgtaaagaagattgtgccacaatagtctatcccgatgcactacctcatgtccatgaacagatccaattcgacccggattatttactgattcctcaatgatcatttgcgcagcaccaaaaaatagatcatgctcctcatccgacgaagagggatcaatcaattcgttcattacgaactcattaaattcatcatcggactccataccctgcacgcaagactgatcaatttctactgatgttaattgaattcacacaagactgcagtaccaatcttcctctacatggcgatagtgtacgcacctgttggatgagtggtcggcggcggcgtgatgacgcaacaaggaggcgcgcggcgtgcataaacgatctgccgacggcgacgcggtgcaacgagaggcagcgacgtgcagaaggaagcagccggctgtgaacgacgtccaagcgatggccggaaaccagcggcggcggcggagaaacgagaagtcatggagtcaaccggtccggaagaacgggagccgtgacgtggacccttttgaatatggagagtcaatatttagctaggctgttggttttacccctcttgttgggatcttttttcctttttacagacctctttactctctaaacttagctaatcatatacataatctcttggagttgctcttagggtctgttttgctaggttctaaatcctgaatccgtatccggtgaagctagagcagaccaaacgttacttaattctcaactttaggagtaaatcgatctgctctagaaaatatataggaatggtggggttaccttttttcatctccataacttcaaatccactacagatttagagctctatcaaattggctcttaattattacttgtcttgtgaaataaggttaaagttgattatcgaatatttgctattagttcgtcacaagatttatgcagacatacatttcaaacaccgatttcactttccttttctctatccccctctagctcgggactagcggtggaaagcagaatttttaactagagtcttattaacattaacacgtctcatcaagtgatagttatggggagacaggggcggaggcagccctaggcttgcttccaatatcatgtataaattatgttaaatcaccatgtaagtttagagagaaatcaacaactcattagttgagccctaggttagccctactctttagtaatttctggcttcgccactgtggggagatgattagataggacacataaatctacatgtcaatgattatcactgcatggacaacgttgtagagtaccctcaataattctccatctctatatggatggacttaacactaactcccttctttgccatgttgagctctcctctttcacagctaccatgatgttcttgctcgtctcctcctcgatgcctataccgccaacctttcttatcgaagccatctatctagcctcattcgtcgacgtctggtcctacttatctacctgctggtaaagactcactactacaaaacatcaaatagatgccgacactataggagccaaaagtggtaaaaccggtacgtataatacctttcccgccaacacgcccgccaacccaccaaaatagcaagaaccggcatctttatctcctaataggaaaccggtacattttacccctgacagaaatagatgccggttttaaattaaatctggcatcttttagttggcatgggggccaccttggactcggcaactttgtggacaaaagaaatatatgccggttttcagtcaaaactgacacccatcttaagccgagccgatccgggcgagccggatccactcctttttcgcccatccttatccaattctctctctccctctccatcccgtctccaccgcccctcccctctctcttcttcttccttctctccttctctcttcctctccacatttccttcacctctcctcctccattcaccacggcggcagcatggcggggctctcccctccgccaaatccggtgggacgggaggtgctggtccggcggcggcgtgctccctaggtcagatctggcgggaggggagacggcgacccggtgacggtccgtggctagagacggcgggaggcggcgggacggaggtggcctgcaccggatctggaggtgcggcgtcggctggaggtgagacaacatcagtggtcggcggatccatctctccccctccctccctctttgtgatttgttggagatgcgttcttgttcatgtgagagtccatttgttgctatgagaattgatgtgagattttgtgtcgttcttgttcatctgttgatgtggaatctattcatcatttgtttctttgttcatgtgggagttaatcggctagagtcggctcgagctcgagccggcttatgtttttttgctcgttgattacatattggtgtcggtttttaaaatgacagtggtgccggtgcactaatcagtgacgcctccatggtgccggttaggaaaaccagcatctaagggggttaccaaccggcaccgaagttcttttctgtagtagtgactcctaaaatattttgttatgctttttttcccttcccttttgtcggtctcctcaggatgttaatacgtaatgttaacattccacactactatacgtatattttaagaataatgttttaaaaacttgtatatattctacgaatcttccacgtaatttataccgacaaattccatcaagttgccgttttccgttcctttccacatccctcataattctctcgctgatctcacctgctaataatcaagaacatgcacggacggcgacatgagccctgtacggttttcctgctccccaaaaaaccgtgatggacctcatgttactctgtaccaagaccctccatgttctctcatttcatttcatttgcacacgcccacaccactcatctgtttgttcctctcgtcgatcttgttgttgggaatttatctttcgagtcttgaccccaagtggctggacatgcatgcaaaagatcattcaattaattgccaccgtgtcctatgctgctgtaatcaagcgcagctcgatccctgctgcccaactgttcagcgagatggcgaaatggcagtgtgtgactggcacgtccatggaatcatggattaacacctccagagagaaatctcatggcccaaacgacatatttctaaatgaaaagcattatgtgaataaaatttttatacacgtgttcttagcgatatgaaagtgaagtctgaaaataaaattactactcgctttattttaaaactaagaaggtagcccgcgcagatgcgcgggcaatttatttattgtttacaaatttaattggtaaattttgagataaatctaatggtttagaaatttgaagatttttttcctaagagagtaggaaaggaaagaggagatgaggagagtacgtccgtaccagggaagggtgtggagaaggtgagagcacgtactttttttatttgatctaatagttaaaaataggcaaaattgattatatagcatcgaaagttcacgtttttggttttatagcattgaaagataccggttcactttaatagcacccaaagtttaccctgttcccatttctagcacttccgtcaatttttccgtccgtcttgatcgttattgacccagctacgcacacaatataatgtttctacccctcattgacatgcattctacttgtacttgtgaggggtagaaacgtcatatcgtgtgtgtggatggatcaagacggacggaaaacgatcgagaattgatggaagtgataaaaatgggaacatggtgaactttgggtgctattaaagtgaatcggtatctttcggtgctataaaaccaaaaacgtgaactttcgatgctatataaccaatttttccttaaaaatattggacccaccaatttaaaagaaaatcaatggaaagattttagagtgtcacttggcttaatccaaacaaattaaaattaaatcagatttacttgaaattaattattatatatttgcccaagatgtggtgatgtatttagaaccgcaatataaattttataagacacaaatattttatttaattaaagaaatataacgggatcacaaattgattatataatctaaaataatttaaaagatgaacgtttagagatagttgatttgatattttttatttatattatagaactagtttatatttgcacatatttgtggagtaatatatttttatatggtaaaaagttatattttaaagacaattgattttgttttgacggtaatatgtattatcgattttaatttattttgaatcttaaattgttggtttaattatgatagagcaaaagttagattagatatgatatgtgtagcttaaaataactgtggttgtttctccttatcatagctactaaaaaatatagagagaagtggagggggcagaaagtgttgtgcgtatctaatggtgagggtgaggtggaggggactttgtttttctatttttttctaaatcatttaggtcaaaaaccaattatcatgtattttgttttttagaaaatcttttttaattttaaagtcatcgtaatgacttaaaaaggtaatcttagatacacagatttaagctggatgatttaactggagattgcttggttcgaattagctacgtaatatcatggtaaagccatgtaaactgatttaattagctgtatatgttatattaccgttaatttccttccacaaatcatgtataataactaatttaattagctatgtataatcttcttgttaatctcctagcttccatatatatattgccgtgcatataataaatatagctatgattagtagtaacacaatatgacagctaattaatctcaacttctaacaaccatagttactaatccttccggcaaaccatacatacgtacaggagaaaggcagatctaattcattggtataaaataaagggtccaccaatttaagtgaaaatcaacggtaggtaaagatctaatctaacggtataaaataatgggtctaccaatttaagtgaaaatcgacggtgagattatattgtgccacatggcggcctagaagcatttgta

SEQ ID NO: 65449 - DNA, 720 bp, Oryza sativa
tatagtctgaaaggcagcgaagaaaaagcccctggttgcgtgtttgtttgctcgacaaactagaggccgcttgtggggctagtagtgccgtcgtggtttcattgtgtatgtatacctaaatatatgttacataatgatcttgctttcgtcgactcgagagtcgagacagtgcctccatttagtccatattgtactatgcttacatgactgccctgttgaagaaatagcctatacagctgcactgttattttggttgttgatactacctgataataatatggcgtgtaccaaagctttaacgtggccatgttcagcagttcaggtcatcttcgttgctctctggtgcagacgagctacgaggtatgagctgcctgatgttggtgatacctgacgaaaaatccgtccgaacggctgtgatggatatcagcttttgctgcctcttcctcctgactttgtttcatcggctcatcgccatttcgcctttcgtcaatctctaaccctctctcctttctccttccccacgctgggctgcgaagaggaagatcgatgacgcgtggaattccatgacgcgtcgcttgtgagcccggaacgagatctcaatacccgtttatgacggcccatataagtggaacgggattgccgctaacaagcggcccatatgtgttggtggaacacgacgtgcggcccaagtccggaggtggaatcagatggacgtggtcc

SEQ ID NO: 65450 - DNA, 652 bp, Oryza sativa
ttctccaggttctattctcaacaactgaagttatttgttttgtacatgtatcattatttcttattgatcgacattattcttttttggcatggaatggtggaattgttttaactttcttattagctaggattcttcaaactgtctcgattaatgcaggaagccaggaacagtcatatttatatgctaaggcttatatgattatcgtgccacattgtcacaatcatttttgaacagattatgtaagacatagcaccagtttttgtatttaatacatgacatcaaataggtcatgtataacaatatgtgtttgaacactttcactcactttaatattatccatccatagttccaggtagtttgccatgttaaacgtggacgacaaagataaaggcatttttctatcgtgctagataaattgcataaaaaactgcacaaatgggatgaagtgttatagttcatggtgtactgcaaattgaaccaaagtgcaccatggttcatttaatgcttaagcttctatgtccatattttttttctcaattatataaaaatatttgaatattcattagtggtcccttattgttgcagtatgtttttccatactaatgcatacatgtttattttgtttatacctttacttacaatatgtgcaaga

SEQ ID NO: 65451 - DNA, 583 bp, Oryza sativa
cgtttgtcaggttgctgtacgcgtcggcggtgggctggaccgtccggctgctgcccgccccctccatctcctcctcgtagtcgtcaccgccgacctctccgaccacgccgagtaccagttcgagaccagatcgacaacgacgacagttcccgagtgctcggagccccatgaagatcttggcggcgatggcccgccgccgccgctcccgcctcttgttgttctccctctccttccacgtcggcttcctccccgccgccgcggccgccgccccggacgtcatacccaccacctccgttcttccctcacctggtctcctctcctctcctctctccacttggtgaggccgatggcgaggccgccgccgccgcttcagctcccgcggtcgccgccgctctggcccccgaccgccgccactccagcttcagtcgcccgtgctccctgcggccagccgaaggggagagaagagagagaaagaaagagagaagggaggaagaggggaggaagaagaaaggcagagagaggatgacatgtggggtccacatgtcagtgagccccacaattttttgtgtgtgaatgactaatg

SEQ ID NO: 65452 - DNA, 541 bp, Oryza sativa
attctacatgtcacatattttgtctgtttgagtttattttttatacagttggttcctatgttctcctaagtgtgaaaaaaatatcaaaaaaatgaaataaaaataaaaaattgcatctctacgtactgtttaacttatatatgtcatttcatatggttatattttgaattagattaagtaatttcatatagtggtagagtgcattatgtttaacatgctgatcaaagggttttactaaaggagttatggtctaattttagtgaaggtgcaaagtagactaagtggtatgctagatattttcaaacttagctaagtggtagttcgagtttaaattttttttgtggttggttgtatcgcgatcctgagtgtgaaaaaacatccgaaaaaataaaataaaaatgacaccgttgcaactccatacagagaaacaggaatggaggcggcggcgccagccatgctggcgccctacttcttggggcggagccagcctcctcctgccacgtaggttcgcgtgcgccacggtggcaggaggacggcgcca

SEQ ID NO: 65453 - DNA, 620 bp, Oryza sativa
gcaagttggatgctttaatcataataacttcaccaggcataaacatggtagactgttctcatgtgctacctatttgcgtcaatcttagcagattgacataactggctaatacctcatgcccatgccttttagtactctcttcattttctgcaactttataaatcacggcattgagcaatgttctgagatctttagaagtcatatagaattaccttcggtgaaatcccctttttcagaaagaaaggaagcacacgtgtatctgttgattaattttagatgttatacatatgctgattaatcactcatgttctttgttggaaggatgcaggttgttttgcaagtgaatgttggtgttaacaaaatggaagctccagtgctagaagttcttcaatttgagaaatcttcatcaagcaattatataaccaagaatctggtcaatggactttctagtggtgatgaggatccatgtcaggagctgctaagctggctgctccctttggatcgcacacttcctccgcgatccttatcaacttctactctcaatcctagtgcatcacacaagcaatcttattctggttctgggtctcaaattttttcattaaggcacttcagaagctatt

SEQ ID NO: 65454 - DNA, 17189 bp, Oryza sativa
tttaaagattagattatggtgataaatgaagtagcaggacagagagagactagaggattttcacaaataaaaaaggatttttatttcgaaaatattgctaaggcttgggatctaaagctcgttctagggtcaagggggctctgataccaacttgtcacgaccagaaataacccaacgggcgttccttacgtgcgtgcattattccttgtcccaggaggcaaggtacaccaaaagttgatacaattcagagtttaacaagcggaagcgtaaatagttaatttattacatgggcggcgaaggcccagcacacaagaagacgaacgaaaaacagcggaagactagggcgacgaccacaggcgcttgacggcaggcacgagctagacaccaaagccttcatcttccaggggctcctcttctgggtttgggaaaaattgagcaagactgagtacaaccaccgtactcaacaagacacacccacaagtgcagaataaatgcaagagagtacaagggagccataatatagggggttagggtttgcagtaaatagcactaaaagacacttagttgctcaaagctattttgtaaacacggtcctagagctatacaatattattaatcaagaccgtaaacccacacgaacctgccttaacccaaggcctatgatgattcagaccgaactggcaacccgaccctgggtcccagctcatcccaatccaacccaggccaaccattccacattttagttgttaagcaggttttaagaattaaaaacactaacttgggtacattgctcagcttgcccataaccgagggcgcggctattcgaatagattatactctgatcagaggtgtacaactttacccacaagacacatcttcctcacgtgtaaccacatgccacataccaccatggtatacggacggaagacgtgacatagtttccaacccatcctagccatagacaagagtaccgacctaaccccacctacggccggaacccccgggacaggtaggcaggactgagcctctagcagtaggacaccggccctgtgccatgacatctcgactaccgggccgcagctcatgtagccttcatttgtcctagagatgtccatcgacccccgacttcgtccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttgagggttttgaatagagaggaggtgtgaatccaattccacaatgatccaacaattccatagtgtccaggtgatgagaatattcccaaagtctagagttgtaaaaccacctaatgttgcctaattaaccagcgaagcatctacctaaaatcatactagtggtaccatgagtagagtgtccactagttggggtttggtttaatctagggtgaacaaggtaataataacaataacaataataaggtcataacaaaggtaaataggcatggctagataaaacagtgataacgcgggaatttaagtaaagcgataatgcaataatttaaatcaaaataattttataaactgggattcaatatgctcaaggatgatgtgacttgccttgctcagagacaacggccttccgaaccttcggcgacgaccgcgaaccacgcttcgggaacctcaggaacgacagaagctacgcgaagcacacaagcaaagctacaaacctataaagaagcaataacaatacataaaaagaaagcacagggttctttaggttataacaaacgttaagagacttgaacgggtcgattcggagcttgtatgaccaagacatggttatccgaaatttaatgctgttatatggtgatttgcggattattgtaattatgttttacaactataaaacatgagcaagcgctagcctggaaaagacaggaaggctgcgccgttgacatgcggaccccacatgtcaacctaaaggaccacggtagaccgagtacacagagacggtccacgggtcgacggaagcggaccccgtgtgtcaactgaggcgagtggccgacaaacggactccactagacaccacgagggctgcacacgagcaaaccacgcggctaccgagcgcgcacacaaacacggtcaccacacgcacaagcgaacgactaccgacaccggtacacgggtaccggggtcgacaaccacacaacgggtacggggcgacaccgaaaggacgaggacggggcagcgagagaagagattcttaccaccacccgacgaggcgagggaacgacaacaacgaacgggcgcggcggagacggccgggaacgacggagacgaaaggcgaggggacgacttcggcggcgatccttggacgaaggcgagacgcggccggcccaacgcttgacgacgcggagccgaggacgaagacgacgacggggctgcagcggctcacttgacagaatgcggacgatgaacgcgaacggcttgacggagggacgaacgccacgacgatgaggatgacgaccgggaccggcgaggaggcaacgagggcagccggcggcagcttcatggagacgaggatggcgcggaacacgccgctgcgatgacgacgatggtggcggcgcagcgagacgacgagccggcgaggacgaacgaccgaccggaggagtcgtcgacgaggacgaacggagacgacgataacgaacaccggcggggttcggatggaggggaggcgaggccgagggcaaccttgacgctgtgatgccggaggtggagatggcgacgtcggccggcgcacgggcacagcggaagaggctgccgaaggcgacgtcgacaaggaggaaggagaggccggcgcgggcgacggcggtctccggacgaatcagagggtaggccggggtggaggtcgacgcggcgacgctgagggaggagacggcgcggccgacccacacctgagcggcacggcaggggcggctagaggcagtgggtggcggcaatgccaccggttgccggcggggacacgcctccggtggtttccccgtgaaacggaggtctgaccgggggagaggaggcggctgcgaggccgaacgcggcgacggcgcgaccggacggtgctcgggcgaggagggagaggcggctggaggccggttggcgccggagcgagagaaggagaaggcggggaaaggtggagaggccacgggagagcgcgggagggggctaagacgatagaacggagcgaggagattccgttttataggggaggagagggagccggccacgggagaggcggggaacggcggcggaattcatggccggcggccatggaaggtggccggggttggcgcgggcgttcccgacgattgggggctcgaatcaagggggaaattggggggaattgaagaggaaggaaaggggattaattccccctaattaatttggaatgagccggcttgaatggggcggatttggaggaggaacgtctctaggtttgcacgggagagagaagaggccgtgcgggaggaaggagacgaccgaggtgggacccacgcggcaaggcgcgcggtcagcgcgcgtgcggcgctcgtgcgcacgcggctagggcaggagggcgctgcggctcgggcaggggcattgcttgggccaggcggccggcccaggaggagaggagggagtggcggcctgggagagagagggaggaggagggagctgggccgagggggggaggggaagggcggcccaagagagagggagggaggctttgggccagacttggcccaaagggaggagggggatttatttttagtttttctttttagtaaactttgttaattgttgttgttgcttaagaaatattttcggtgctctgaaaattcaagtaaaatttgagggctcattttagaccaaggagaatttaacgaaaattctctaggccacattcgaatttttcttgtacgtattttagtgtttgccaatttcttttcgaattttaattaattatattattccttttagaaaatgatttttatttggggatgaatttattaggacgtgacataccacaaccatgagtacacaccgatccatcaaacaataaagtccatggcactatttcaaccgagccgactaagtcatcacgatgttccacaataaaatcagctattgcttgtccttaatcgccttcggcgactcatacagaagatcaaactcggttaaggaaaatatccactttccaacccttccttttaatttttgagccgatagcatgtacttgacaacgtcggccttgcatataacactacactcgttggacagtagataatgcctcaaccttggacacgaaaaatacaaacacacgcataacttctccacaggggaatatctagtttcagcatctaagagccgacgactgagatagaatacaacgcgttccttcccttccaacgcctgaatcaaagactgagccgattgacttctcaccggccgataaattcaacctaaacggtattcctttctgtggaggaatcaaaacaggaggagagctaagatattccttaatattatccaaagccttttgctgctctgccccccaagtaaactgctgatcggctttcaatctcaacaatggtgtaaaaggttctaaccttctagacaaattagaaataaaccttctaacaaaatttatcttgccgatcatctcttgtaattctgtcttattctctggaggctgaatcttcttaatcgcattaacactcctttgagttacctcgatccccctctcatgaacaagaaatcccaaaaactggccagtcgatacaccaaaagcacattttgtcaaattcatcttcaggccatattttctggttctctcgaaaaccttcctcaaattagctatatggtcctctatttctttagacttaacaaccacatcattaatgtagacttcaaccaaccagccgattagatcatgatatatgtaattcatggctctttgatatgtagctccagcactcttcaagccgtaagtcatgacaacccattcaaataagccgattgcaccaggacacctaaaagctgtcttatgaatgtcttcttcggctataaaaatttgattgtatcctgcgtttccgtacataaaactcaaaatcttatgtcccgaagcagcatccactagttgatcggctattggcattgggtattcatctttcggggtggccttattcaaatttcggaaatcaatgcataccctgaccttgccgtttttcttgataacaggaactatactagaaacccactcagcatatcggcaaggacgaataaaaccagcatcatataatcttttaatctcagccttgaccggttcaagcatgtcggccttgcatctcctcggaggttgttgatgtggcctgacccttggtttgataggtagccgatgttcaacaatcgatcggctgaatccaggcatctcataatattcccaagcgaagcaatctctaaactcttttaagagctctatcagcttggttctaaacactggagataagttcttactaataaatgtcggccttagccgatcgcctggacctatgtctacttcttccaaatcatcggccgacatgaaaccttgatcttgcttgttatcgagatcatctaccgtgttcttagtgtagagatttgaaccctccacgatgccctcaaaataatagcttgggttctccatcttcaattggctgtatatcagaatcggacacttttagaaaatccccatcccagacttttccagatatacaatcaaggccatccatctcccaaagagctaaatcggcactggcaacattaactgacctgtcggctggcacgatctctattttgtcgccttgccactgaatcaaacattgatgcatagttgaaggaatgcaacaattggcgtgaatccaatcccttccaagcaacaagctgtaagaacctttcccatcgatgacaaaaaatatggcaggaatagtcttactgccgactgtcagctccacatttagaacacctttggttttggatagattgccaccaaaatctttgagcaccatgtttgtcttgatgagatcctcggcatttctacccaacttcctgaatgtagcatagggcatcaaatttaccgtggccccaccattaaccatcatttagacatcggcttcccattgacgtagccatttatatacaatggtttaagatgccgattctctgtcccctcgggtttctcgaacactgcctgttctggtgacagaaccaacttagccgattcctcttccacctcatcgacatcagcttgatcgatcccgaatttggctggcagggtaaagaccatgttaaccggtgccgtcacaacactcttcccttttgccaacctctttgcctcatcggctgcaacatcatcagctacaggaacttgattcttaacacgccactcctgccttggctttgctttctttagccgatgattaatttcttgttcaaccccctaaaggcgctccctgttcctcaatctttgaacccttctcttctgattcttcgtgaaaataccagaaggacaccattgattcttcctaatcacattgtccttgtcgatatgcttagtggccatgatcttgattaattggacccaatctttgatgaacagaaactctcatctgccttagccgattgctcctattatatgatcggccggagttctcgatgatatcactgcacccagggcagttttcaatagatgacaacctcataccttcattccagcagaatctaaagaactcacaaccccaatgaggatcaaaaccatcatcgtatttctcatgatgcttctcctgctgcttgtcatacttcttccgatatttcttgaaaatcttagccgaattcacctgaaaaccccttgcatgggccctatcggctgcttggccagctgtatgcaccatattaacaggaaaagggttaccatcgaccttcatcggctttttggaatcatcaaacctaatcttgcctccctcaatgaccacctgaatctgctgtctaaaaaccttgcaatcgttagtagaatgggacctagaattatgccatttgcaatacctctgtttgcctaattcctcagccgatggggttgtatgaccagcagtgtcacgaccggaaataacccaacgggcgttccttatgtgcgtgcattattccttgtcccaggaggcaaggtacaccaaaagttgatacaattcagagtttaacaagctgaagcgtaattaattaatttattacatgggcggcgaagacccagcacacaagaagacaaacgaaaaacagcagaagactagggcgacgaccacaggcgcttgacggcaggcacgagctagacaccaaagccttcatcatccaggggctcctcttctgggtttgggaaaaattgagcaagactgagtacaaccaccgtacttaacaagatacacccacaagtgcagaataaatgcaagggagtacaagggagccataatatagggggttagggtttgcagtaaacagcattaaaagtcactttgtaaacacggtcctagagctatacaatattattaaccaaggccgtaaacccacacgaacctgccttaacccaaggcctacgatgattcagaccgaactggcaacccgaccctgggtcctagctcgtcccaagccaacccaggctaaccattccacattttagctgttaggcaggttttaagaattaaaacactaacttgggtacattgctcagcttgcccataaccgagggcgcggctattcaaataggttatactctgataagaggtgtacatctttacccacaagacacatcttcctcacgtgtaaccacgtgccacataccaccacggtatacagacggaagacaggacatagtttccaacccatcctagccataaacaagagtaccgacccaaccccacctacggccggaacccccgggacaggtaggcaggactgagcccctagcagcaggacaccggccctgtgccatgacatctcgactaccgggccgcagctcgtgtagccttcatttgccctagagatgtccattgacccccgacttcgtccatctccatccgtgtacttttgtttataaccagactgagccacaaactaagccttacccactagacatgtggaactacgatagtgctttgcaacagaggcctgaagaccggtccttatatggccgaggtgctactatcaaaaccatgcaccccaagcccagcctaaaaccattttgagggttttgaatagagagggaggtgtaaatccaattccacaataatccaaccattccatagtgtccaggtgataagagtattcccaaagtctagagttgtaaaaccacctaatgttgccgaattaaccagtgaagcatctacctaaaatcatactagtgttaccataagtagagtgtccactagttggggttttgtttattctagggtgaacaaggaaataataacaataacaataataaggtcataacaaaagtgaataggcatggctagataaaacagtgataacgcgggaatttaaataaagcgataatgcaataatttaaatcaaaataattttataaactgggattcaatatgttcaaggatgatgtgacttgccttgctcactttcccaaacgtcggcttcaacctccacgaagagcggatcttccaaagctgcaacgtctacacgaccaacggaaaataaaagggcttttactctaataaactccatataacaagcaggaaaaaagcacaaaaatgggttcttgacttcttaaggaaaaaaaagagacttgaacggtccaattccgagttcaaatggccaagttatggccatttgaagtttatatgctctttaaatgaatatttgcgaatttcttcatttaaattttaatttaaaaagggtttatttcgtcagccgaggggaggggacgcgcggaccgggtccacgggcgtggggcccacgcggcagcctcacggtccacggtggatcgggcgcacccgggctcgcaccggccggcgccatgggccccacgcgtcagccgcacccgagggcacgggcggctgacggccgggccccacgcggcggccactcggcgcgcccgaaggcggccactcggcgcggccggcgggaggcggcgcccgcgcccctatggtcgccggcggcggccgagagaggggaagggaagggggaaaagaggcggcggtccacggctcactctaggtcgacggcaacgacaaaaaaggtggccggagcggaggaaggcggcggcgcggctcgggtcgacggggtcgacggcgttccggcggtcggcggactcggcgagggggtggacggggttgacggcggtgcggcgaagccggttgaggcgacgccggggcgggagacggtcccggcgagcggagaaggccagccggaggtcgtcggcgacggaggtcccggcgagagggcgacggcacgagctcgattccggcggggagtgggtgcggcaaggggcggaaacgggcgagggaggcacggggagggtttaaatagggttggaagggggagagagcggccggaggggaaggaaaccggcgcgggaggtccggccgccatcaatggcgccggcgagatttgcgggggcaaatctgcccgtttgaacacgagagagagagggaaaaatggggcgaaagggagaggggatcacagggagtatttccccccactttattgcacgcagggacggcgcgatgcggcggatttggcggcagcggcggcgcttggcgcgggcggagcggcgggagcggcgggagtggcgggaggacggggatgacgggtgggccccacccgtcagcgagggtggcgggcgggcccgcccgtcagcggcgcgcgcgcggggagggaggctgaataggccgcggggaagaggagacagagagggggggtggatagggagatgggccgagccagcccaagggagggaagggggacttttagggtttttctttttataaaacctttttaactttgtttattttttaataattattatttgtgctctgaaaattccactaaaatttatttacgcattttaggcttttaggaaatttacaaaaatcctctaagccttatttggcttttaactttgcacaatttaattcttggaggctttcacacggattttaattattctaggcaacatttaagggatatattttagagtcgttttgggacgtgacaaacctaccccccttaaacggaacctcgaccccgagattcggaagaactggcgaagagatcgggatgggctgccttcagctcgtcttcacgctcccaagtagcttcttcctcggcgtggttgctccattggaccttgcaaaaacgaattacccggttcctggtcctgcgctccatggcgtccaggattttcaccggtctctccacgtaggtcaagtcttcgcgaacttcaatctgctctgagtcggcctgctcggacggcactcgaaggcatttcttgagttgcgacacaaggaacacatcatgcacgttgcccaaggaggcgggcagctccaactggtaagcgacttctccgcgtcgagcaatgatacggaaaggacccacaaaccgaggtgcgagcttccctttcgtctgaaaccggtgtatgcctcgcaacggtgcgacccggagatacacaaagtcatccactgcgaattccaggtcacggcgtcggttgtctgcataactcttctgccgagactgggccacctttagattctcccgaatggtcctgaccttcgcttcagcttctctcaagatatcggtcccgaacacttggctttccccaacttggtcccacaatagtggtgtccggcatttgcggccatacaatgcttcgtacggtgccatctgtatgttggcttggtagctgttattgtaggagaactcggcgtaagggagactcttatcccatgtcttcccaaaatctaggacacatgtgtgaagcatatcttctaggatctaatttagacgctcggtctgtccatttgtctgcgggtgatacgcggtgctgaaatttaagcgggtacccaactcttcttggagcttcttccagaaatgagaggtgaactggcgtccccgatcagatatactttttttaggaacgccatggagactcacgatcctagcgaagtagagttcgggtagtttgttccctccataggtggttttcacaggaataaaccgagctaccttggttagtcggtccacaacaacccatatagaatcatatcctccttgggtttttggaagtccgatgatgaaatccatcccaatttcatcccatttccattctggtacttggagaggttggagaagtccggccggtcgctggtgctctgccttgacacactggcacacatcacaaagggccacgaactctgcaatttcccgcttcatactaacccaccagtatttcccttttaagtctaagtacatcttcgtactgccagggtggatggaataaggactttcgtgagcttcctgaagtatcagctgtttaagttccttgtcgtccggaacgcatacaccatttccgttccatagggttccatgttcatcttctgtgaaaccagcggctttaccttgtttcatattcttgaggatcccatgcatatctggatcattcttttgagcctcgcagatttgatcgagcaaggtgggcttggcttccagcgtagccaagaatccacgaccaactatgcttaggttcagggcttccatctgttgatgaagttccggtggaatgccacggacgctaagagtgttgcaacggctttttcgactcagcgcgtctgcgaccacgttggccttaccagggtgatagtggatccccacatcataatccttgatgagctctaaccatcttctctgccaaagattcagatccgactgggtgaagatgtatttcaaactcttatgatcggtatatatttcgtagcgattcccaatgagataatgccgccagatttttagagcataaaccacagcggccaactccaaatcatgggtagggtagttgccttcatgaggccgtagctggcgtgaggcataggctaccacatgaccttcctgcatgagcacgcaccccaatccttggcgcgaagcgtcacagtacaccatgaagtccttgcgagtatccggtaagattaaaactggcgaggaaaccagattttccttgagagtttggaacgccttctcgcattgcgggctccacacaaatttttcttctttcttgaacaactgtgtcatgggtcgagcgattttggagaagttctcgatgaacctccggtagtatcctgccaaacccaaaaagctgcgaacctgagtaactgtcttgggttgcttccaatcagtgacggcggtcactgtttcggggtccacagcaactcctttagcagatatcacgtgccctaagaatttgacttcggataaccagaactcacacttgctgagcttggcatacaattgatgttcccgcaactttcccaacaccagacagagatgctgttgatggtcttcctctgattgtgagtataccaggatgtcgtcgatgaagacaacaacaaacttatccaagtattccacgaacactttgttcattaagttcatgaagaaggcaggagcattggtcagcccgaacgacatcaccgtgaattcatacagtccataacacgtggtgaatgcggtcttcgggatatcttcttcacggatacgcaattggtgatatccggagagaagatcaatcttggagaataccgtggcacctttaagctgatcgaacagatcatcaatccggggaagagggtacttgtttttgatagtaacttcattgagagctctgtaatcaacgcacatcctctttgtcttgtctttcttctccacaaaaatcacaggagcaccccagggggaagtgctcggccgtatgtaccccttttcttttaactcttccaacagtttcttgacttcggccagttcatttgctaccatacggtagggtcggttgtacagaggagtggttcctacagcaagatctatccggaactcaatctctcgcttgggcagcataccgggtagttcttccggaaacacatctccgaactcactgactatggggatttctgacagtcctatctgatgaagttctaaactaccgacagaggttgggggtgcaaagaaaacaaccggttgttccggccctcggtacagagtgacagtgcgtcttgcgcaatccactactccttggaattgagccaaccaattcatcccaaggatcacatgcaagttcttggtgtctagaagaatcagatccgaaggaaaaggaattccctggatttctataggaacggcagggctataatactttgctgtcataacccctccaggggtggtgatgagcagagggttcctaagcctttctacccccaactgatttctccccacgaatggcacagatataaacgagtgggaagctccagagtcgaacaaaatggtaccagggatggaatgaatgaggaacgtacccacgatgacgtctggagttgtcagcacatcctcggcagtcacgtggttcacatgaccccgaatgacatccttaccactgttgttggggcggggaggcgcttggccttgctggcgcctcggctttgggcatttatccgcaaagtgcaataatttaaaacagtgataacgcgggaatttaaataaagcgataatgcaataatttaaatcaaaataattttataaactgggattcaatatgttcaaggatgatgtgacttgccttgctcactttcccaaatgtcggcttcaacctccacgaagagcggatcttccgaagctgcaacgtctacacgaccaacagaaaataaaagggcttttactctaataaactccatataacaagcaggaacaaagcaccaaaatgggttcttgacttcttaacgaaaaaaaagagacttgaacggtccaattccgagttcaaatggccaagttatggccatttgaagtttatatgctctttaaatgaatatttgcgaatttcttcatttaaattttaatttaaaaaaggggtttattgcgtcagccgagggggagggggcgcgcggaccgggtccacgggggtggggcccacgcggcagcctcacggtccacggtggaccggttgcacccgggctcacaccggccggcgccgtgggccccacacgtcagccacacctgagggcacgagcggctgacggccgggccccacgcggcaaccactcggcgcgcccgagggcgaccacgctggcgcggtcagcgggaggcggcgcgcccgcgccccgatggtcgccgccggtgaccaccggcgcggtggagcggcggccgagagaggggagggaagggggaaaggaggcgacggtccacggctcaccccagggcgacggcggcgacggaggaggcagccggagcggagggaggcggtggcgcggctcgggtcgacgggtacggcggcgctccggcggtcggcgaccgaaacggagaggtggacgaggtcggcgaggatgcggcgaagccgaaggaggcggcgccgaggtgggagacggaccggagctcggcggcgacggcggagagagagagcaacgtcgcgagctcaaatccggcgaggaggaagggcgccgagaggcggaaacggacggaggaggtgcggggagggttcaaatagggttggaaggaaaccggcgcggcgctctcgggctccatcaatggcgccggcgggattaggggagggtttccaaacgagtccaagggagagtgggatggaaaattggggggaaagggagaggggatcacggggagtgattccccccactttattgcacgcggggacggcgggaggcggcgggattcgcggcggcggcggcgctagggcgcgggggaggcggcgggagcggcgggaggaaggggatgacgggtgggccctacccgtcagggagggtggcgggcgggcccgcccgtcagcggcgcgcactgggagggaggccgaatgggccgcgggggagaggagagagagagggggagggagatgggccgaattcggcccattagagagaaggagggattttagggtttttctttttataaaatcattttaactttgtttatttcttaataattattatttgtgctctgaaaattccactaaaatttatttacacattttaggcttttaggaaatatacaaaaatcctctaagccttatttgacttttaactttgcacattttaattgttggaggctttcacacggattttaattattctaggcataatttagaggatatattttagggtcgttttgggacgtgacacatattcctaatgcttataatgatgtttctaggggatatcctcccgatacaagacaaggccaatataatcatattgcgccacaaacacaacctattaggccaccaaacccaccgccaaatcaacaagggcctaataacatggaggatatgattagtgatattatgaggaatagattcgggattgaaactagaaatcgtgctagaacttacaaaaagtcatatcctgattattatgataatgtgctgtttcctcgaaattatagagttcccaaatttgccaagtatagtggtgaggatggtaagaccacatgggagcatgtaggtcaatttttggcgcaatgtggtgaggctaatagtgatacttttaaattgcgcttgttttctttatctttatccggtaatgctttcacatggtttacttctttaccagcaaattctattcatacttgggctcaattagaagaacaatttcatgattatttctatactagagaaactgagcttaggttatgtgatttgacatcggttatgcaaaagtataatgaatctgtcattgattatattaagagatttagagatgttagaaaccgatgttatactttgaatataactgatagagatttggctggtcttgcttttaatggtttagttgctcctcttagagaaagactagatggccaacaatttcttgatgttagtcaactcatgcaaagggctctggctcaagaaagccgggttaaggataatagaaaacttgctagaccatttgataaaaagcctaatgttaatgtggttgattacccttaagctaatgatagtgaggaagagggtgatcatgatatttatgttgccgaatggtcatggactaacaaaaataaaacttttgtttgttctaacctaatcccgactcctcgcaaagatcggcaaagtgaggttaaatatagttttgatgtggccaagtgtgataagattttttattatcttttgcaagagaaacaaattagattacctaaaggccatgtcataccttctcaagaagagttgaaatgtcgagcatattgtaagtggcatgattctcattctcactctactaatgattgcaatgtgtttcgacgacaggttcaatcggccatagatgaaggacgattgaagttcaccgatggctccaagatgaagcttgatcatgatcattttccggtgaatacaattaatttcaatgataagaaggtgttgattcggccggagcaagccgaatctactaaggggaaggaagtggtcattggtgaaccaaggtccaagatgatagtgctaaagaagccggaggttggcgtttggaaagagaataggagtggagcttcaacttctaaagcccctaggaagaccaaggtgacttttaatatgcttttggagaaatatgaaaagcaaggtggtgagaaaattcgcaacaaagggaaaagaccaagatcaccttctaaggagcgatttggtcattcaccaagacggtcgcgttcaccttcgtatcattatccacaagatatgtcatggggttcctatccaatgccgccgtgggttatccttatccttgcttcatgccatggggccgacgccgccaatgttcaatcatatgcctcctatgcaattcaaccaagggaggggaggaccacggaggccaatt

SEQ ID NO: 65455 - DNA, 854 bp, Oryza sativa
  unsure (1)..(854): unsure at all n locations
acttcgannnatgcacctacnagttggnacagnagttcatcatcgataggaatctttctgctgccactctattacctacgtacaagtcaaagcagtattcttgagataatcttttggacaagtagatcacttagtttttggagtaaattgcatatatgacctagctcttcgatttcctaaacttccaaaagctaaccttttcaggaatcaggagcctatagctaattaacctttttcagattaaagttgtttaagggagtaggggttgggtatttatgacaatatatttgttgggaaacgcctgggctatgatggcataaattaaaatttctttttgcgtaacccagaacccaagaccggtttagaacatgtacccgtcacactaaacgcgctgcgcaagtggagagaaaccctgaaaatccgagacacctctcgcaagatagcgcgcgtccatcagaggaagcagtcgatcgccgcgctcaaccttgtctcatagacgttcttctcggcgccctctgatgccgatcagcacccgaaacaaagggcgcctctacctgtatccacacgcagatgtgctaccccccgcgcgcggctaggcttttgctcggggagggaagngacagctagggttcatacctgaaggaaatgcttccgcggtcacccccgacaagatattattggatccatcatgcggacatccaacgcccgggaggttcctatgggcatcccaatttaaatggacctaaagttggttttttggcacaccctttttcgccttcccagagggggccatcccggagtgttattataatttggttgaaacctaaaattttttttggcccgccggggaaggg

SEQ ID NO: 65456 - DNA, 1433 bp, Oryza sativa
gcccgccaccctcgctgacggggggggcccaccggtcatccccttcctccagctgctcccgccgcctcgcccgtgccctagcgccgccgccgccgcgaatcccgccgcctcccgcagtccccgcgcgcaataaagagagggaaatcactccccgtgattccctccctctttccccccacttttccctctctctctccctcggattcgttcggaaagtttccccctaacttcgccggcgcatcaatggcggccggaccttccgtggccgattccccctcatccggccgttctctccccctcccaacactatataaacactccccgtgcctccctccaccgtttccgccactcgccgctctctgtccccttcggaatcgagctcgcgccgtcgttctctctctctgccgtcgccgccgagctccggtccgccgccgtcgttgccccggaccctctcccgtttcggcgtcgccttcttcgggttcaccgcaacctcgccgacctcgtccacccctccgtttcgcccgccgaccgccggaactccgccgtcctcgtcgacccgagccgcgccgccgccttcctccgctccggtcgccgttcccgtcgtcgccgtcgacccggggtgagccgtggaccgccgtttcacttcccccttccctcccctctctcgggcgctgctccgccgctccggtggtcgccggcggcgaccatcggggcgcgggtgcgccgcctcccgtcggctgtgccggcgtggccgccttcgggcgcgccccgcggctgccatgtggggcccggccgtcagccgcccgcgccctcgggtgcggctgacgcgtgggacccacggcgccggccggcgtaagccgcgtgcacccggtccaccgtggaccgtgaggctgccgcgtgggccccactcccgtggacccggtccgcgcgcccctcccctcggctgacgcaataaatccgattttaaattaaaatttaaatgaagaaattcataaatatccatttaaagagcatataaacttcaaatggccataacttggccatttgaactcggaattggaccgttcaagtctctaatttttccttaagaagccaagaacccatttttgtgctttgtttctgcttgttatatggagtttagtagagtaaaagccatttcttttccgttggtcgtgtagacgctgcagcttcggaagatccgctcttcgtggaggttgaagccggcgtttgggaaagcgagcaaggcaagtcacatcattaaaagcctaaaatgcgtaaataaattttagtggaattttcagagcacaaataataattaagaagaaataaacaaagttaaaaaggttttataaaaagaaaaaacctaaaaagtctttttccccctcctccccctcttgggccggctcggcccatctctctccctctctctcctc

SEQ ID NO: 65457 - DNA, 2522 bp, Oryza sativa
caacccaggccaaccattccacattttagttgttaagcaggttttaagaattaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacagacggaagacgtgacatagtttccaacccatcctagccatagacaagagtaccgacccaatcccacctacggccggaacccccgggacaggcaggcaggactgagcccctagcagcaggacaccggccctgtgccatgacatctcgactaccgggccgcagctcgtgtagccttcatttgccctggagatgtccatcgacccccgacttcttccatctccatccgtgtacttttgtttataactagactgagccacaaactaagccttacccactagacatgtggaagtacggtagtgctttgcaacagaggcccgaagaccggtccttatatggccgaggtgctactatcaaaaccatgcaccccgagcccagcctaaaaccatttttggggattttgaatagaaggagcggtgtgaagccaattccacaataaccaaaccattccatagtgtccaggtgatatgaatattcccaaagtctagagttgtaaaaccgcctaatgttacctaattaaaagcgaagcatctacctaaaattatactaggggtaccatgagtagagggtccactagttggggttttgtttattctagggtgaacaaggtaataataacaataacaataataataaggtcataacaaaggtaaataggcatggctaaataaaacagtgataacgcgggaatttaaataaagcgataatgcaataagttaaatcaacataattttacaaactgggattcaatatgttcaaagatgatgtgacttgccttgctcgctttcccaaacgccggcttcaacctccacgaagagcggatcttccgaagctgcagcgtctacacgaccaacggaaaagaaacggcttttactctactaaactctatataacaagcagaaacaaagcacaaaaatgggttcttggcttcttaaggaaaaattagagacttgaacggtccaattccgagttcaaatggccaagttatggccatttgaagtttatatgctctttaaatggatatttacgaatttcttcatttaaattttaatttaaaatcggatttattgcgtcagccgaggggaggggcgcgcggaccgggtccacgggagtggggcccacgcggcagcctcacggtccacggtggactgggtgcacgcggcttacgccggccggcgccgtgggtcccacgcgtcagccgcacccgagggcgcgggcggctgacggccgggccccacatggcagccgcggggcgcgcccgaaggcggccacgccggcacagccgacgggaggcggcgcacccgcgccccgatggtcgccgccggcgaccaccggcgcggcggagcagcgcccgagagaggggagggaagggggaagtgaaacggcggtccacggctcaccccgggtcgacggcgacgacgggaacggcgaccggagcggaggaaggcggcggcgcggctcgggtcgacgaggacggcggagttccggcggtcggcgggcgaaacggaggggtggacgaggtcggcgaggttgcggtgaacccgaagaaggcgacgccgaaacgggagagggtccggggcgacgacggcggcggaccggagctcggcggcgacggcggagagagagaacgacggcgcgagctcgattccgacggggagagagagcggcgagtggcggaaacggtggagggaggcacggggagtgtttatatagtgttgggagggggagagaacggccggatgagggggaaacgggcgcggaagatccggtcgccattgatggcgccggcgaggttaggggagaggtttccaaacgaatccgagggagagagggagggaaaaatggggggaaagagggagggaatcacgggaaatatttcccccccccccactttattgcgcgcgtggacggcgggaggcggtgggattcgtggcggcggcggcgctagggcacgggcgaggcggcgggagcggcgggaggaaggggatgacgggtgggggtggcgggcgggcccgcccgtcagcggcacgcgcgcggggaggaggccgaatgggccgcgggggagaggagagagagggagagagatgggccgagccggcccaagagggggaggagggggaaaaagactttttaggttttttctttttataaaacctttttaactttgtttatttcttcttaattattatttgtgctctgaaaattccactaaaatttatttacgcattttaggcttttaatgatgtgacttgccttgctcgctttcccaaacgccggcttcaacctccacgaagagcggatcttccgaagctgcagcgtcta

SEQ ID NO: 65458 - DNA, 15961 bp, Oryza sativa
cagccctagcatgccactgacccaccacccttctcttcctcttcccctagcttcactttcctccgaacagtagtagagtgcccctgcaccttcttccccgtccttaacgattcgccctaaccactctagatcccacgtccccgccaacacaagtccaccgaccttctctcccactgtcgaggctactggtaccaccgccttgccactccaccatggccaccagcccaccatcccttactctcatcatcacctcttatccctctaagtcgggaacacctcctacttcctcttccaagttcatttttttgtcgggcccggtcaagatagaccaaccaaatttatttaagattgaggaatatgtacaaaatttgccaagttcatcactcgtcggagctcaacagatagaggacgtacaatgaatctagaagcataatggaaggtagggaattcgtgtgatttgcccccttaaaatgtgtagaatgatgtattaccataactgtatttttaactcagccatcaccgaccatcagaatttcattttgttttgttttattttcgtgaaaaatgagtgttcaatgtgaaaactggcccatgccaagtctggtccagctgctccttctacatcataagaaaatttctggattcgctacaaaccacacaactaccttgcatttgtgccaaacaaaagaaaaaaaggccaattttttaaaaaatgtatttttttaattttgtcaagattgttgttcctacttattcaagcaacagtgataaggtgtctgcaacaccgatcaccaggttcttttatcgggcggaagggcatgtgacctgagtagcacctcaaggctctgagttcaaatctttatatgagcgaattttatattgggttgtttgataggctaagttcctaatgtaaaaatgttatctgaattcaaatctccatatgagtaaatttcagattgagttgttttgaggggttaagtttccaatttaaaaaggctcacatgcatccgattggatgtagaggccaggtaaaatataaccttgtaaaaaaagttcatttatccgtgtttgggtcggacttgggagagagtagagttgttcggcaagattatgggaaatggagaggtcgaacaaatctagctccgatgacaatacatatttgaatcctcatcgcagctgccatcattaaatctccatatttaattatcttagagtatccctttaattttctttggagcatgtttcatatatttctccaaacatttgttccaaaaactcaatcactcaccagaaccatcgatcgtatgtactacatttcattgcgtgtcgtgtgtcgcagaaacagatgagatcattgtcaatatggccgctggccgacgatgttgcccggcgggtagtagtcgcagacggcgacggtgtcgacgccgttgcggcaggtgcggcgcgcgcagccgagctgcgtcgtggcgcgccacaccacctgcgtgtacgcgccgcaggtccggccgggcggcgccgcgcaccggccggcgtcgcggtcgtaccaccgccggccgtccgcccagaacgccgccacctccgcgccggtgtggcgccggccgtacgccttgaacaggttccggccgtagacggcggcgccgtcgccggtgccccgcgccgcggtgggcggcggcggccgcaggctgcattccgtccggagctcgccggcgtaccgcgccgcatccagctgcagcgtcccgttccacgacagcggcggcacgcccaccgccgcgcgtgcctcgttgtgcacccgcaggaactgcaccggcgtcggctcgacgggggtctgcacggcggagacggagatggatgccgccgccaccggcgatgcggaggcccgcgggaggcacaggacggcgacgagacagcagtagagtggagacatggtggtttcggggtgaagttgtggtgaactcgcgattgtatatatatagcgggggttcttattaattaatggctgccgttttgtgagtcctttggcttttaatttgtacttttaactcatggttttttactaggggagttatgctacaccgactgtgaaagtgtgaatagctttcatatgcaatggttgacggtcttgcagttattatattttgaatgttgcatctctctggaacatcttatgaagcaaattgaaacaattttttataagtgataaagcatcaattaattattttcattaaaatatagttatgttagatcttgttgtaaagatttaattaaaaaaatacaactatgcaatcatattgcattatttgtatatgggattaataatttaagagaaaaaataatttaaacatgttaagaaaagctagatatgcatcgataggggaaagtgagggtagtattggatattgcatgtagctgagatgtaggcataggaagcaagtagctggcatgcagcattcatgcaatgaatgtgtagaggggagcgcacaggagggggacccgatttttctctcaaaaatccgacgcccgattcgtagttgcctcgcaaagatatagtaataaaagaggagaaaataaaattaatgtcgggacctagggatggaattccggaatatccgaagagtttaggcacgatgattcgctagtacacgtatcacaaccttattatcacatccacacaacatacacatacgtagaagcaataagattttcataacttattaagcacatgtggccgaccgaccaaataaaagatataaaatgcagtgaaatattttttttcctttaattgatttcctccgtaatttcctaattcctcccatgcatttaatataaacaagcatatagaagcaagaaactgaatcgatgtattgcagcactaggcagcgagcaaaaaggtaacaaagcaatgtactatcatcatacaagcaagcttgatactctgataaaagcagaatcaggatggatcaggaaaagccagggccggccctggggctatgtagccgaggcgatcgctgggggcccatgatggtggggggccaacacctaatactagtagtctagtatctgcctatggcctacctagaagcagaaatgcccgagagacgagaggagttgcagcgtcataggcaactcgacaaacgacatcgcattgcacagggcacaaccgtacaggcgcacagaagtgcagatccgataaaacagccctcacctagatgtggagacgttgcctttgctttagtgcaggtggaggaggcgtagcggaagagtaggtagagtgcgtatctaccaagcacccatggcggcactgctagatatggcgggtaatataatgctagcactggtcatttccagtggattaaactcgaggaattagaactatgaagtacttgagactatctattattatggttaaatgatttttcgtaagtgatgtctgaaacacccatctgtaaaaaagttctcaaaagtgaatgtcttcaataaccacctacgaaaactcttttcataggtagatgtgtcagagcgtcacctgtataaatcggtgggccccggtttgtttttaaatagttcaaaatatttaaactagcggactagttgtccgtaaaaaagaattttgcagacggttatctgtagaagccgtccacaataataatttccaaagttttgaaaattttatctgagatgttgtcgctgttgttatcctcctaactagttttcatgctctgcagatggagtggtgaaaccctgtatggctagagtgaatggggaggaggtcatgaggcgcagtaagtgagagcacaagtgggtggcgataaaactcccattgtcctcagtcccctatttattagaataaaaatatgtggcatgggagatagagaggcgagccatggtagtggaggacgtgatcggcgtatagcggttcatcttccgaggaggaagtgaccagcatggcagcgtccacgcaaaaaccgattgttttgaatgtcgttgagaacattaagtagtggcgtgaggaatacgaaccgtaacaatcatttcattaaaaacgtccacgcttgtactgtgctttaataatatataaaaaaacagggagtagagttcttcaacaattagaacgtgcttctcagttttttgacggctttatatgtagtattaatttgtcaaacatttgttccaatgcaagaacaaaaacgttcttgaaagttgatcacgcacgtgttattacaccacaacattttatgagctcgcacgtgcatgtgctacatatatataccgcggcatatatatgcgttagtaagggcgctggccggcgatgttgcccggcgggtagtactcgcagacggcgacggtgtccaacacgagagggcacgtgtcgcccaggcagcggcacaaccagcgcgcgcacccgatctgcgtcgtggcgcgccacaccatctgcgtgtactcgccgcagcaccgccccggcggcgccgcgcacgagtcgccgtcgcggtcgtaccaccgcgcgccctccgcccagtgcgccgacgcgtccgcgcccgcgcgcacccgcgggccgctccccctgtacaggttccgcccgtacaagccgtcggtgccccacgcccacaccggccgcgcctcgcagctcgcccggagctcgccggcgtaccgctgcgcgtccagcgcgatcgtcgcgttccacgccagcggcggcacgcccaccgccgcgcgggcctcgttgtgagcccgcaggaactgctccgccggcaacaaactgttggccggaggctccgcggcggcggacaccgagatggacgccgcggccggcgacgccgacgccagcgacaggacggcggcgaggcagcagtagaagggagacatggtgtgttggttgattaatttgtttgtggagaagttgtggtgaactcggggttattatatactgcggtgattgattaattaattgctgctgttaattttgtgggggtttggcttttgaattttactttgtatagttaactcatgggatttattaccggggttatgcaagggggagtgttaatttcgattgattaatgactgttaataagttgtttattacttggattgatcgctcgtggttacgagcaaactagactcgaaagtcgaaactgttgagacgaacaagttcgtaatgacaataatgcggacattcttaataggatttcagcgccatctctaaaaacggcatattcttttctttatgttatatttctcgtaaatggtggaagtattgtttcacgatttctccgattattaggggattttacgaaaaaaacatgtgtgcgtgtcctacatgcatgccctcaccgcccatatccagttgacagaaccggacacgaggggatcaccatgcacaagggaaacaatgccatggtcgctggaacggcgtgccaccggttccccttgcccaactccaaaaaaactatatgacaaccaatccgagaagccaaaataaattcatgtaactgtgaaaagagtgagggtaggggagttatgagctgttgatattatttcctttcaggtctcaaagttgtatgaagttgtgcctccaatcctccatgagataggcaaggtaaatgttctaccaggtttataatgatatatcctctaatttcatgtttgtggttgttatggtcatcatgttctggctttgtatcttcaggtcaaaaatccatggcccaatgatgatgctcacaaacaaccttacccacatgctgacataacataagcaatcacagactaatagacaccaatacaaaataatacaaaataaaaaactcattctatttatgaatctccattcgaatacacgtaacatcttgtatttgtccttggcatctctttgagttttgtgtcgtggcctcgtggggcaacgctaggtctgtgcataccccaggttgcgtcgaggcacagccatgtctgacaccaccgctctcgctggtgcaaacaaatatgctagtctgtctgattgcctctaatttacttcatcctgtcgtgtaaacgtatcgttttgaacatttacaaagccttcagtatagcaataatatccatagatatacattcttcacaaaacctgatgataaaattatactgtttcatgcctattctaaacataaattgtcatgtatatatctagtctaaagtatttaaaatatatattgatattctatgctttgaatattgtttggttcgttgtttttcagaaaaatgaatacgagagcataatcttcacaatttagctcaagacattacagatcaaattgtactaattcaaaattaaattatatttgaagaaaatatatataatgcacaagcattagagcacaacggcttattgggcagaatagtaattcactcgcatgcacaacgacctacactctctgtcccataaaaaaaataacttgtaaagatgaacacatacatatattggttcaaatttgtccgtataaattgattttttttaggacggagtgagtatgtgattattctccggggcacggcactatatgtataacacgatcagtatggtcggccggtgccgtagttccccggcgggaagtagtcgcagacgagcagcgagtcgccggagtcgcacacgatgcggccgcacccgacctgcgtcgtgttccgccacaccacctgcgtgtaccgcgtgcacggcgacgacgacccggacgacgcggccgccgccgcgccggcgcacgtgttgctgccgtagtcgtaccgccgccggccctcgtccacccacgccgccgccagcgccggcgcgttccaccgccgccccttcccgacgaacgcgttctcgccgaagttgaacagcggcgagcgccgcggcgcgcagtcgccgcgccgcgacgctgcgtaccccttcgcgtaccgggcgatgcccgcgctccacgccagtggcgccacgcccaccgcgcgccgcgcctcgttgtgcaccgccaggatccccgccaccgtctgcgcggcacgcgcgcggcgtccggcgtccgcgcccgagacgccattgccggcgccggtggtggcagcgaagcactgggaagccattgccaggattacaacgacagcgacatgggacacgtaggtgttagacattttcgtctctttcttgtctgcgacttctgattgttttttagaagggagagcaatgcaaagcatgcgatgatggaatgttttgggttcagattttgatgcgaatttatagacgattttgcgtgagaatattttaaattattgcgatttctgaattcgcgctgtggatgatccagtacgtggatatagctttgaacgctcgcatggcggctagctagctacataattaattatgtgtgtgatctagcttgttcttgcataacttcttggtacctaagtaacaagagaatctcacacattgtttgatggtgattgtgtgattgaccagataaccgatatgaagaacatgcatgcatgatttgtatatttatttgttgagtgtagagtaggcatgcatggttgctggttttaggggctgatgatgtgtgtgtgttcctgtcattgatcacagctgagagcgaagattaagcactacgccagaaccctacatctatgacggcacattagtgacgggtttataaattggtcacagatgaccgtcacctttgacgggtcgttaggtttaccgtcattggtgaggcatctagccgtggcccgtcacaggtatcacctcacctgtgacgggccagaattttaagccgtcacaggtaagacagtgacaagtttgacttccaacccgtcactggtatgacctcatttgtgatgggccagggagttacaacccgtcacaggtgatgggccgtcacctgtgacggatatgacttctggcccgtcattgattttaagtttgcacccgtcaaaggtgatcaattttgacatataaaaaaggaacccccaccccccacccatggggcccaccgccacctgctcagtctctctcctcctcctctcagtctctcttctcttcttcccaccgaccgccggcctccttcgcccacctccaaaggtcgccgcctccttcgccctccgccccatggtcgccgccgccgtctctccgccaccccgtcatcggctccttcgcctaccgcctccgggtcgctgcctccttcgcccaccacccacggtcgccgcctccttcccgcctccaccacgccagatccaggtcatatcgagccaaagacgaagacaacgccggtgccaggaccatcggccaatggggcaccacgcggctgcccaacgccatcgacaagcccctccgtccatcgtcgcttatctccggtcgacgacgagcttctacatcccccagcctccccctgacggtcccagcaaccatgaactcgggggctccagatccggacaccctgaactcacaggtcgcggatccaaccatcccgagtttgggtgctccagatcctgcggtcctagcttcagcgataccagatccgttcgtgaggtaagcggtccgccgtccacaccacaccacgtcgtcgaggtcaacctgccgtggggagagcaggcgtcggctgtccccttccaccccatcctcggtagtcaccgtcgcctcatctattttactcagtttagtgctaagcagaagtcaccctttccttctcttgcatccagatctgagcttgcagtcaaccaattccggcgtctcctgtggttcctgtggctaaatccttgtccaaggatgcatctagctttaaccccatcaaaaatcatgagctattggatcattagttagatgctctttgtgtactagtattttgtttggatagtgggcatgcatgttgtttcgctttgttttcttgttctatttaagttgatgcatcactaaatctgtttttattttccttgttagacctcttaccagaagtttcttttggttgtgttcttgcatactctacaaatcccccaatttctatactaggggggattctttgctaataatcagtcaattggcaggagagtatggatgcaagaatgatacattgatagtttattatgagaagtgccacgaactaatgaaagagtttcggctggttactttaaagcatgtctctcgagaacaaaatgttgaagctaatgatttagctcaaggggcgtcggggtataagccgatgatcaaagatgttaaagttgaaattgcagcgatgacagccgatgattggaggtatgatgtgcatcaatatttgaataatccatctcaatcggcttctaggaaattaagatataagccattaaagtatacactgttggatgatgaggtttattattggacgattgatggagtgttacttaagtgcttgagtgccgatcaggctaaagttgcaatcggcgaagttcatgaaggaatttgtggtactcatcaattggctcataagatgaagtggttactttggtgtgcagggtatttttggccgacaatgctggaggattgtttcagatattataaggggtgtcaagattgtcagaagtttggagcaattcagcgagcgccgacgtcggctatgaatcctattattaagccatggccattcggaggttggggaattgatatgatcggtatgataaacccaccatcgagtaaaggacataaatttatattggtggcaactgattatttcaccaagtgggtgcaggcgattgctttgaagaaagttgattctggggatgccattcaattagttcaagaacatataatctaccgatttggtattccttaaactattactacagatcagggttcaatcttcgtgtccgatgagtttgttcagtttgccgatagcatgggtatcaaattgttgaattcttcaccttattatgcacaaactaatgggcaagccgaggcgtctaataaaattttgatcaaattgattaagcggaaaatttctgattatcctcggcaatggcatgctcggttggccgaagcgttgtggtcttctaggatggcttgtcatggatccatccaagtccctccttacaaacttgtttatgggcatgaggctgttttgccgtgggaggttagaatcggctctcgaagaacggagttccaaaacgatttaacagtcgatgagtattacaaccttatggccgatgagagggaggatctggttcagtcacgattgcgagcccttgcaaaggttaccaaggataaggaacgtgttgctcggcattataataagaaagtggtacctaaagatttttcggaaggagaacttgtatggaagttggttttgccgattggtactcgtgatagtaaatttggcaagtggtcgccgaattgggaaggaccgttccaaatttataaagttgtgtctaagggagcatatatgctgtaagggcttgatggtgaagtctatgggcgagcgctcaatggcaaatatttgaagcaatattacccaagtgtttgggttaacgcatgatcgtctagcattgccgatgcatgacagccgatgtgtttacatcgccttgagacggccgatatggttatatcgcccttagttgtttttcatggtgtaatcggttgtggtttgccgatgtacagtggctgatattgttatatcgcccttagttgttttataattttaccagtgcttttgacactgtaaaattaggggggcacatatatatatcaaaatgcaatgcaaatttttgagcgaatttcaaagtcatattaaaaatcatattaatcggcacaaaggattgtcaagacagtaaagtattagaacgtcttagccgattacaaaatttctaagtcctattacacaaaagttattgagacaagtatcgctggatagccaaaatagccctttgcctaatttgttctacttcttcaatagcttgggcatcttgagcatcagttccagggatgacttttagggacttggtcaagttcgcaacattcttgatagccgatttcagccttgttttttgttcttcaattgattttgggagatcgactagttttttgtgttccatatctagcgcggcattgcattcttcaagttgcaccaagagctcaatcttgcgagcttcaagctgatcaatattggatttgatcggaccttcagatagctgatcaagtttggttttttcctcatgcacaagctgccgattagcttggattgtgacctcaatctctttgcgctcacggcgttcggctagtcttagcttggctttttccagcttgaactgatgttgctcgagataagcggctggagttaggacatcggccaaatcttcgggaatcagagcctgaatttcatgcagccgtgacctaattgatccacagtcaactaccaagctatctaaagaagaggcttctagccgatgagagatgtcttcaagtgtttttcttacatcatcggataggggagctagggctttgcttgaagtgtcttcgtctgcctcatcaaggtaatctctgatatcaaaagagaagatatcggctagaacctgcagagacaatttccgaaaaagtaagagttgggtaaattatagccgatctaattgttgagacacaaggaaaacttactgggatagcaggagcagctggttgttcttcctccttgatgtgatgactccccacagccgatggagtctggtcacttgacgattgctatacaggaggagaagcaagaggaggctgtagaatagacaagtgttatatagagccggttgagtttgattaagtaaaagaattaaagtcatcttactggtggagccgacttggcaatcgttgctgctggctttttcttcacagcagttttctttttctgcaaccacaaagtctatgagtaattagccgaagagggaagtaattttagaagatgtcaaagagagatacttactcttgtaaaatgaatgggggcagaaggagttggaggcgtttgcttgggtgaagcccatggtgttctttctgtgtcactcatttcggctacagcctggtcaacatcttcaccaatttcctctgcatctaaagcttgttcaatagatgtatccaaggcgggtagatcatcagccgacttatcagtcggtttagttttcttgaatttggcctttttctttggagctaagaccaaggtactcatggccgatgatctggttttccttttcttgcgtgcatcggctagttccctggttaggccgtgaagaagagttgaagtcttgggggcatggtagctgataacagggggagatagtccacctccattcggaattagaccttgagcatattcaatgtccttgccactattactttgatgaggaggggaggactctgttgtctgcaaaataggagaaaaagattagtcaagtaatgaatcggctaactgattatgcaatttagtaatgacaaagtttacctggggtatgacgtcagggaatagatctgtcatatacattgaagccgattgatgaaatagatgcagcttccattcaccccaccatctgtcaaagtttttgcttctaaatcctgccaactcaatattatcaatgctgcccagagggggtcttggtaggttaagtagccgatccatcattagagtggatgtgatttgtcctcggcattgaatcttgtcggcaaagaataagccgattgggagttggcccaatccaagttgtctggccgagctcattgggtgataaaactcgtaggagacttggatgtttctcccttggtgaatgccgacggggaggatgcataggctgattgtagctataagaacttctctggatttttggaatttttcatgattaatgtcttcaaatctaaagtccgatggaagttcaaggtctgctgagtcttcatagggaaaccagattcgtgcatctttcttaaaaccttcataggagctgcagaaccaattcttaagtagctcagccgatagcttcgctccagcatcggttggtgtggatgcatattctccatatgacatgcatctgcgatgggtgcgctcttctccatcgtctcctgcaatcggctctggcagtgggaattcagcttctgtcatagagggccgattgacaaccttcatgactatcaggactaaccaggtttgcagcagccaccatggtccgcctgctccaactattgagccgacggctattttagccgatgcgttgttcaatgtttggtacagatagccgagatggattttgcccaaaggaaattctttctttgattctaaggcttcagctacaaattgcctgttggttgtagggccacaactagatccatagaaggggaacttttctaaccacatgagcaagaaagctacatgttcccgaggggtaacagacccttggcccatatatgctgccacatagccagactagccacctatgcttttggtcttgaagtcaaattggttcttggtgttcatactcatagggttagccaatgaagttacatctaatccagtaatcatggtgatgtcgattaaagttggagtcatcggcccttggttgaataagaaagcattgatggtgttggaccaaaagtaggtggcggtagccatcagaggttcatccttagcagaattggctatggtgagagcaagcgcttggccgattccaatctcatcccagtgaactttcttactagacgatacgcgttggtaccaggtggtccagcttttatcaggtgtgggtttttcgagagatggccaagacttgaaggtattcttccagtgacccaggttagggttggctagtctaaaggggatccggttggtttcaccaatgatgaaatcagtggggtcgaggttgccgattgggccaagaaaatagtggattttgtgcgaaaggctgggaatcgcgactaggttgaagagatgctacaaatccaaaacaacagagaaaaagagagcaatgtaagataagagaaaatcgatctgctgctaagaaaggggatcaagccgacgggaacttacctcagcatactcggctgaaggcgcatcagatgggttggtgcaggacgacatcgctgcaggcggaaatctcgccgaagatgaagtcacctggaagtcgcttttgcgtcggaggaatcgctggagagagagaagacaaagtttcgcttgagcggtgaaaacggaagtcacggtgtgagatttctcgagggtgacgtttaatatttaaagcatggcagtaacggtcggaaaacggcaaagtgcgaacttactcggggtcgatttacagcaaatccgaaacattaccaaatattccggacttggggggcatgtgttaacaaccaaatttggtaatatcggcatcgggaaagaatattagatcgaagcaaagtcggaggcggagattgagttcagaaacagagcaggaatcggctggagtccagatcggctacgattaggatcggctgggtctgagtcggactaggtaagctgatacaaccgattccgataatgcaacttgatgtatgatattgggttgaattaaggcgcttcaagatgattgccgcacatggatagagtcttgagaagtcaattgtatctattaattaggatattttatgtaatttccttagagatatgcttgggcaaaagtctgccgtaaagacttatggtatcttagagtttgttaaagatattagtcgtgtccgttatgggcatatcttgtaattctcgggtataaatagacccgagccctatgtaacttttaacacacacgttcaatacaatttcggcgcatcgccaccctttttgctttagttttatttcgacgagttcttgctttcgggttgagctgcatcggtttcgatcttcaacaaaaggtaaaacttgttatgacgacttgtgttctcgggattagtgcttccatctttgtgatactctgatctcgtttatgtaattcgtcgaactatcatatatcttacataatctctggcaataccactatctaatctacaatcggctaacatctgtcggtagaggacagccgattaggttagatttcgatgttgacgtagattatataagatatctaccactctatgaaacttccagcagcttgattgtctagatattgttcttcttttcatacttaatgctgtatcagttgagtttgatctattaagtcgtgcttaaaaaatcaacctctagcctgccttctagttgctgattagggtagcatcagagtttcagccgatcttatctgatttaactatatttactctatatgctttattgacatgttaaatctgccctttattttaagatcttattgcatttaagtatattaggcctttatttgatatattctacttgctttaatatcttagtatagagtggtatcggagtattagccgatacatgctagatctatatgatcggctatgctatgaacatatgtagtcccattattaatatatatttcgatttaagtgatttatactgtctcggcatggcgtccgatctatcccaatcacttgatttaagtatatatcgatacaaggagtatatattgtgaatacctacagccgatcgagtagatttagttccttcttgtttattcatgactgccgatcgatacatatatgacatcggctcaaagataaatgatatgtcatcggcacctagccgatcgactatcatttatagatttaaccgcggtttctttgcttctattttttgttgattacaggatcaaatcaactggcacgctcatacattcgaaggcgagctttggacctgcactagagttaagcagatctcccaggtcacgtgttttctgtcaacacaccagcccttgaggtttgctgccaacccgtagaagtcactcatgctctccaccccgccacctcgcgaggagcaacacatctagcatcctggctcagaggagctcgttagcaccatccccaccaacttccacaccgtgcacggtcgaggaggat

SEQ ID NO: 65459 - DNA, 22638 bp, Oryza sativa
tctcccactggctggagggcccacgcgcatgcaggagaaaaggcggagccgtggcaatcggtaattggggcgcgcgatgtcgagattgatcccaaggcatgcgtgggtagtagcggcgcggatcatccgtggaaaaggtggacttgttgtggcggacatgttgtggctagctacatgtcagtgatatgaggctttttctttggagtggaggaacaacggatggcccagattttatctgagctagtgttttgccctaagagcatttgtgacattgtcttagttaggggatttcagccacattggacaataataaggggtggatgcttggtgagaggtctccctttgagtcgcctatacaccttggtgtgagagagccttcatagctttcgtgtgtgattttaaattcaaatccaatgtgaagatgtattttttagtgtgttagtctcacggcagcgactactcatacgtctactgtagacaatccgacaatagaggagaacctggtgaagcatcgagttcgacctaagcgtatcaagtgggccaatgtcagaatcgctaggccggaatggatcatgggctgatgtattcgcgcggctatataagcgcagtaggtggaagggaaaagaggtcgaatgaattgtattctgaactatctcctaaactgaatacttcttccccttccccaagtctgaatatctctctctctctctgtctggttcttcccctgttcgactctgttctatcttcttcctctcaaactttccagaaatcaacagagttcgtaacagttagctccactcttttgtaatgatatgatttgaatttattttatgtaatttaaattcctgtatttacttcatgcaatttaaattccgcatgagttttgcctctcctattaatttctgtggagtgtgtttctactctctctctccaattcttcgatctcgtattcctagcgaggaacgtagaggcaaccttatatagccctcgagctatttgagagggagttcaatttgagaggttgaactcctcatctgagtagggttctttgtagctttttttaacctcctcctagatctagctttccacataactatgatcttaaggaaatgtttgatagaaattttaaacgagtattatgggggaagaattttgggacaattttgttcttgccccaactttgattgccaatattgattttgcccctgttttttagggttttcgtttttaccctaattttttaaatgaatcaaccgtttgcccctgttccgttaattcttgctaacggtgttaaatgtggagggtaaaaagacaagtaaaccattagatattttcccgtacttttgatataatcaaaatacaaatctattgatgccatactatagcagtaatttaatttgtcaaaaaattgtgaaagtttgccaaaatttgggtcaaatttgaaagtggtgtacaaaagtaccggaaaatatctaagggtatacttatcctttctaccccgcaatgaacaccgttagcaagaattaacagaatagaggtaaacggctgtttcgtttaaaaaaaaagtagggataaaaacgaaaacctaaaatataggggcaaaatcaatattgaaaatcgaagtagagacaagaacgaaattgccccaacaatttttgtacgctttattcatgcccacactagagcgggtagaggtcctaaaaaacagccgactttttctggacttacatagttacatatggatggatgtgcggtagccttctgagcggtggaagatatctcagagaattaacccaagcctttcgagagtaataggtttttttatctacaagccaaggtgcatctaagagatcagctctacctaaatctgaaataacaagtatgtgtacctttggttgaggatttatattgctcctccttattactgtctctatttctaaatcactactataaaaaaacatttttgcaaacgggccaaagcgatttttccaggtggccatccactccgcatgaacttcaaagcatgcgaaaatacacgatttttgtaggcggacatttgtccctcctgcaaaaatgattttagcaggcggcatctccatattcgtaggcactatagccacctgcttgcgaaaatgttttcggagaaaaaaaaagccaccacccacccgctgctgccctctccccctctggccatgccaccgccttcgccccctccgccagatctgtgagggagacaaagagggagtgggggagggagggtaggggaatcgcaccaccgtcgacttccatgacgacgaagaagacgaccatgacgacgaggaagatgaccacacccgtcacctgatccgccgcacccgcacgtcgccatccaggaactgccaccccgcccgtcaccatctccagctgccgaggtagagtagagctgaggagaggagagggacgggagctacaccgcccctcccctccggccacgctgatcccctcccctcggttcgcgccaccaccgacgcccctccccttcggccgagccgccgctgacgccgctcctcgtcaccaataccaccacccacacctccccttcggccatgttgccgccattgcccctcctctccgcccgcgccgctgcaaacgcccctcccctctgcctgcgacaccgttgacgcccctcccgtccacccgagctgccaccgacgccgctcctcgttgccgataccccgactacccacaccgctcctcctcggagccaccgctgacgatgccgcccctgccctctgagccgtgcgtgagagagaagaaaggtcgagaggataaggataaggatggtggagagaaaagagtagtggatggtggaggaaaggataagatgggacgcaatattatttttggtgagctgcaggcacgattttcatagacggaggacaatctcagccccattgtcaatttcgtaggtggccatttacttccaagatgcctatccgcctagaaaaaatatatattatcgtctgaaaattggtttttctagtagtgaatatttgatattggttagttcaaaattgaaaatgtagggctgccacgataccctttgcaggaggactatgttcccgattatttcatttttcgtgatctacttttttgtttggagaaaaggtaatggaaacaaatctgatgtttatatacacagaagtgcttgtacaaaatcgaaagatacatcattaatacttaaactacagatctcataacaaagagaagaaaaacaaaaccaaaactacttgactaagcatcaaaactacattcgttctgtcctgctttcacaaaacaacactgaagtgatcttgatagattttccgaatggatccacatgtcctgacacatattaccttcgcccaccgacgctctctagcagaggcagagaagaagaggccctgccaataccatttgcgttccacgaatggatcctgcacaaacacctcatatcccgtggcacttaagcctccgatctaacatagttccttaaccattgtcaacacctccaaaaagcctttcgtccactcctcgccgtcctcacatgaacgctagctgtatctagccattagaccgaatccagtctccacggttgccgctagcaccgtcactgagcttattgttatcctaccaaagcccctccttgttgtcctaccagatctagcaatgatctggcagccagcacacctagggccctcgccgctgaccatcgtcaccgtcgtccacaccacaacgttgaaatgtacaggctgccacgttgaggaagccgcccctccaaccggagttgatgccgtcttccgccttcaattatctcgtgccacccctccagtcagaaccggtgccatagcccctgccaatgccgtctaaccaccgcctccatcgcagcctcaccaccctgccaaccaaagccgaacgcccgcctccaacgtcgttgtgcccccaccacttggagccaaggtaaagaatcaccactagcggctagcaaaggtgaatggcgagacaaaggggagagatgaccatccgtccaaccgcctgccaccataataaacaggtgctgccggccagcctatgtcggcgtgccaccaccaaactcaagcgtgtgtcatagtgaatgtggatctagaagagagagtgataaggacacggctatggtgcccggatttgtcccaatctttcacagtaaccaaaagatagcaaataatacagaccattgactagataaattgagcagcaattaattttcaaataaactagcagaaccaaatagccactccataaaatatagtgacaaaatagttgtgcaaatctcgcaaatatactccacccatgcggcaagggagtcacacgatcagagaacgaatacttctgtagaaatcaaagatgtgcccaagaaattgattcccgagcacactcctgttggttgattttgtggacttgtggcgataaaaattaggagatgggctaaaccaccggtttccttatcctaacaagaaacaaactaagagataaatctgttttgtgtgatcggtacaaaatagactcgaattttagattgagatagacccccgagccccaccagtgtcacctataaaaggaaagagaaggagggaggcaggtgacgacttatctcactctaacctcaaaccctaaattaatcacccgatcgatcaaggcactggaaggggttcatgaggtatctcacaacagaagaaacaatgaagaagaaagaagaagagcaatggcttcatctcaggtcagttagatcaattaattttcgcataagcagaaggtgaccatgtttaggctaagactcaattatttaattggaataaattccaacattgtggtatcagagcctaatcttagccttcttgttaacagtgaaatttggtaagcccggagtagtcatcgacttagagtcagcatcggcttcgaagtcttgagattagccgatgagagttgtcaagtcatcagttgtcggattcttgctatattcggttaaggaaattgatctactagatgaagcttatctagaagagaccgagttcaaagagaatgtggcatggcaagttatctattaattaggaatagtttgttagtttccttttatctttaggaaagtgtgtttagtgtcctataaggattttatcttttccttttatctttaggaaagtttctttcttgtccgatgaggacttgtatcaacccatgggtataaatatgtacacctaggatctgtgtaatttatcgctacgatcaatacaatttgacgcatcgccaccctttttacttctacttttgtttttacgttccggcggaacttggcacccgatgcagggctgcatcgtcttcgatctctggcgaagggataagtccaatgttccgccggcccaggcaattgtatcgtctacatcggcgtagttcaaggctgcatcagtacattcgacctcttggattgctttggtttggatgatatacttgcctacctatttatcatatgtctatgttaatctagtcttagcatatcaatttagctctatcggctgcttctcgttttagggtttctgccggtatcggctaaatctcatatgtctctgttaatcttgtcagttgcaggatcaaactgactggcacgcccgcatctcatcaatctttgaacctgcacaggagctaagcagatctcccaggccggtgtgttcgattttttcatcaacacttctttatcccatcatccctaagtgaagccattatgccaattaaaccctaatttctattcggcatgcatgatgcgattttgagttaattagattagattaatccctttgccttggttgcataagcgaagccctgttatactgctgatctcggccaactgctgatctcggccaacagtagaagaagcaaaattattgaagagtttaattttgttgatttttatgagaagaagaggattgggataaacaagattgaaattcccaattcaaacactaagaattcctagaccgatgctaaggtttcggctagcactcagcaaacaagaaaggggataaactagattgaaattccccattatcaagcaaaagggaataaacaagattgaaatttcccgaaatccccaataagccggatccaattggcctaaaatccccaaatgaggaagcctaatttttgggggaagaaccctaagtcacaaatatccgaattaaatgcaaattcaagtcaaaattaggtttgagtttgggttacttatcggatttagaccccctaagattgccggcgcacaccggcctcctcggggcagtgccggttgaccgccgtgcgcgcaccaccttggagctcgtctctccaccgtccctcgccggggacgggaaacgtcggcttggcagctgccttcgtgctcttgccccaccccgatgaggtccggccgcatcgccgccgcctcgccggactgccgacgccttggcacaacggcttggcgccgccctcgggggcgccccccagccggctgagatggagccgctgcggcacttgtcgccacacgcgtgcgccgcctcgtcggaccgccgtcgcaacatcgccgccgattcgctcgctcgctcgccggacgccgaatcgggaatagaaggggataagaatgagctagggttaggtctcacacccattcccccctggcgagcgatttcttcagtgcgggcgaaatcttggccgtccgtttgatcagatggccgccctcgctcccgcatcgggccgtcgccgtcatgggccaagctgatctgggccacgtccgccaaagcgccgagcgcgcacataaatgggccggtccattttgggccagcttttcgataagagtgggcctttattttttatttattaagcccatgattttaattcctcagaatgtgttatatctttattagctaaattttagcccgattttagccttttttttatgggccggcttaggaagtgatgagccgtattattattttaagcccgccatttatgttttatgtatttccagaaatttatttatgacctttcttagccattaaaaattgctggaaaattatggtcaattatttgatcactcagaaaattatttctagttaaatggaaccaacaggaagtttagctagaaagaaattaatgatatgatattatatttgaccaatgttaatatgatttcatgtcaatatttattaagattattatttccttaagccacttaatttattcctagttgaatagaaatttaactagaaagtatttatgatttcatgtcaacatcattatgatggtcagtgccttagtaacttaattatttatagtcgaatggaaccaacgagaaattcgagtagaaagcattaagatctgaagttatatttaacccacgtttttataattgcatgtcaattataatttttttattccttagttattttctaccaaatggtgatataattaaggaataaattttaagattattcataattatttatgaccaatggtgttttgactatgaaattctaagtttattttgcatatgattgactaagccaaggtgaattaattatatgcaattggcaatgtttattatttaagatcagttgcaatacttggtaaatatttctagattaatggaaccaacagaatgtttatctagaaagaaaaaatatttcattaagatagtaatttccttaattattttttgcccaacggtgatgtaattaagggaagaaatctaagtattgtcaatcgttattttaattttctctgtcattttggccttaacggtgattagacttagaattttatttatgccattagtgcattaattcctttgtcacttctaccttatggtgatgtgatcaaggatctaatctatcagtaagcttaattcctttaccatttctgcccaacggtgatatggctaaggattttaattttaattctatggcatcactaatggcgtcatttcctatatcatttctaccgtatggtgatttgatttgggattttaaattatttacattatcacttctaacctttggtgatgtgacttaagacattaatgtttattccctaatcagttctgcccaacggtgatttgatttttggattataagtaatttcatttaatgattctttcgccttgtctcttcccaacggtgagacaaagcgaaataaagattaagctatcgttattgtgtaagtgattgtaataatgtacatcatttgcacaagcaaccacaataatagtgccacttaatattttagcaataaataatgttgtttatcagttaaagtctatggaattattattatttttcctcattgacttaactgagcctaaggcctacttgagtatgacttggcattgacaaaggattccttatggctcccgtagctaatgtcactaatttttttttctaaactcaagaggcatctttagcctgggagtaggccaatataatgttatgtttcgcatatcactcataaacattaagattatcatccctgttggtgttaggggagaattttgagcatgactttgcaaaactgtatctagcaaacgttgagatgaacttttagaagtttgtgaaaactaatgcttagtacaattttagtgcctatgcacatttgccgccataatttaaaaggtagcacaagaaataaatcataaggcgtgcaaacttagtgggatggacatcgaacatttcatatgcgccacttgtccatttcatattatttttctcccattagactacggtcattttcagttatgtaatactaagacaaagtggaccataattgacttggttcatcattccccaaatcaataaaaaatatagaagattaagaggcaaaataagtaagatcctattaatcttgtcatttgatggcaaagatgaagctttactaaggggttgtagcaactctaaatttaataataataaagctcactttcctcgcaaggggaaataaaattgcctctatgtcctatgtatgctactcttgaaattttcttgtgtaagttctttgcaagtaatagggacatgcttaatgtcctgattcaacaaactagttaaataagaagattaaaggcattattttgggttgaatcattatgagacgttgtcgaaattatggccttatttttcggccacatttctaggggagaatatacgtctcattaaggtcgagacacttcacccttagaaatttttgacatctatcattacttagatgataattcgctaagtaaagctaaagtaaaatcaagtgattcaagttcataaggtattatgcttccattacataaataataagagaagattattctacctcatttatgactcatagctccattatgtggatgctagaattttgtatctcttaatttgtgacttgcacaattaaatatacataacatagcttgagggttttgttatggaaagaaaagtcacatatagggtgcagacttaagaaatccatttgtggacttaatcaagcattgatgatgatttaaattccgctgcatcattagtgaactaagcttaaataagaatcaggagaataactattctataatgatggaagtaagacgccattgggagtgtgtcattgtcgcttatgtcacataactaggggagtttggaacgtctcatgagatagagatattcttttccttagattttaatggcgttgtttagctttaagttaaaatttcactaagtcaagaaattagccaacaaatgatcatttaaggctaggtttacccataagcgacctccgatttcctttaagaaatttaagacactaatgctaaaatcaaatgaagttatgagatcggattatggtggtaaatactaaataaagtttgttcaccttataagacattaaaaataagcgttcatccaaatggttttcgaaccatgtaagaataaattgagatggatgaacaaaataagacattaaagtgttcatctaaatggttttcgaaccatataagaataattgagattgatgaacaaaataaagaatttagtagaagtttctgaatgagtcaaaatattcggccatttaagtgggttaataagattaagcctgactctaatggaaatttcgaacaattcaagtgaggtggacaggtgcatgaaaattaaaggtggaaaatttcattcaccggtactccatactaatgatattttattgttaagcaatgcatattgctgttagaaactaaggaaatttttccatgaattattttggtctgaaggagcactgggcttatatcagtaagtcatacattgacataaagaaataatttgagagaattcagttaaagttagtcaagttgaaattaaattataaagataatcatttatgattcagctgacagaagcttgagattagctcaaatctggatgcctacagatttggcaaacatttttactgggaatcttggcagtatttaattaaatccagagtagaccactggtattaagaatgttcacaaggcaatcttatgtaacatgctcatgtttctaaagtccaatgatctcagaagtttagagacatttggacacttattttgtgagatgtgtggatatttataaagattattcagattaagctatgtccacacataggggagcaatgaccatgtaaaagctccaaaaatagtctcttactgcatagtcgatgatgcagttagattttaaagcatgttatgattaatcatatatataagaatatttcccagaactaagagtggtaaatagcgctcataaaccactcaaaaggtgtaaaccactcaattatactgtgttatatgttgtgcactaattgaacacagttttctattttagtagcaacatgttgtgtgttttctgctaatacattgatatagttgtgaaacatatgtcctaggatcgaattattattaatctaagcttttgcttatggatgcatactctaaaggctcataaagttaagattaattaagatatgttctagccagtacatgtgtaaataagagcctcactaagatcctggatgagggggacttaatttttcaatcaacacccactaagttaagcttgagtttatttgagttctatagtgagatataggtcttgttgtctcggtgacgcataatgttgttgaagacacattgccttggggagctattttatttaatagactcataagtaagtctcgaaatcaaggggagaatgttggttgattttgtcgacttgtatcgataaagattaggagaggggctaaaccaccggtttccttatcctaacaagaaacaaactacgagataaatctgttttgtgtgatcaaaatagactcgaattttagattgagatagacccccgagccccaccagtgtcacctataaaaggaaagagaaggagggaggcaggtgacgacttatctctctctaacctcaaaccctaaattaatcgcccgatcgatcaaggcactggaaggggctcgtgaggtatctcacaatagaagaaacaatgaagaagaaagaagaagagcaatggcttcatctcagatcagttagattaattaattttcgcataagcagaaggtgatcatgtttaggctaagactcaattatttaattggaataaattccaacaactcctccaaaccagcacttggccggtggcttcaatagatcatggtcgatggattcaccattaaccagctcagcagggatgataaccctagatgcgaaaacttcgacaaaagatcaacctctccaaaaagttgtcttcggcttggtgaagtgtcacgcccggaatttctatccaaaattccaaactcttacatgtgtgtgaaccctcgtccaggaatcagccgaggcacacaataacaaattgataatagagtacaattattactctaattaataagcgaataaaatgtcattacagaggtagatagttcctatcaatcaataaaaatctaagcagcggaagaataagataaacggcgcagacgactccactccacaggcagcttgaccaaggctacacctaatcctccacaccatcagcatcactgtagaactcctcctctgatgaatgattgcaaggtgagtatatgacatactcagcaagccacgcagcaaatatgcaagtgcacaggataacaaaggatggcatagtagggtttcatttgcataaacaacatttaatgaacatttcagaatttaataaaacagttaagtaataattaaacaatattaatccaacgctatacaacataccttgttgcataggcccaaccattctgaacaaccatcccggctgcacagttctatctccaaaccaggaatatgccattccaaaccaggagctaatcaaattattaccagttatagcatcttttactatggtgagaggtgtgaaactaatcacgaaagacattgttagacccgcccataaccgcgggcacggctattcgaatagttttactctggccagaggtgtaccactgtacccacaagacacagccccacaacatgtcaccatgcgcctcaataccaccacggtacctcagaaaggagctgtgacagtacccctcgcacaacacaatccaccacagcgcaccgttcctggatcataatcacccccttataaacaaggcatggactccccagtgacccccgtgggcttatctccgccacttctcagtctggtgccccgcaatgaaccatgctatacaaaaggtaaagccgttgcccacgctggcttgtggttggcacggttaatgtttcacaaccgaaactcgtgaaccggtccttaatcatcatgagcacgaccatcaaaaccatgtgctcacaacccaccattatcaagttttagttggcaatttaattaattaaccaatcacgattgaccatcgtgaactatcattaagccatcattaaataatagtaatttataagttatcccaatagtgtgctaatgtttctaagcatggctaagcaatcatatctaatatctagctgaaccaatatataaagctcaactagtcaagttataataacccaaggtatcaaggaataaagtaatcaagaacaaaagggctataacaaacaataggttaattccacccaatgacattcgaaaataaatgcaatagttgaatagaaacaatagctttaaacgagatcaacatgctcaagggttgtttgggatctgtgtgacttgccttgctggccttggaactcttcaaattcttctcctgcaaaaacggactctctggaaacatcggaatctaaacagaaaggagcaaaacaccaaaacaacacataaacaagcatgaacagtacatgtggatatttttaacatgtagatctcaattttagaaaaaaatagagacttgaaccaactaaatccgagctaagatgaattagttatgaattttcaaagattaaatcggattaaaacacttatatggattttaattgaattatgacgcaataatcaattatttttgaaaaggaaaaaggggtttattgcgtcagcggctagggttcgcggtgaaccgggtgcacggcggcggctcacggaaacgaacggccgagatcgattcatccaaaacggacggccaagatccatcggtccacgaccgggccacgggaaacgacgacgatgacgtcagcgggaccaccggcggcggctcgggcgcgcaaggttgccggcgaacgacggcgcgacgacgcgaacggaggacaccaacacgtagagggcgacgcggcgaactcaccggtgaccaaagcaacggcggaagatcaacggatggtgacagcgtcgaggaagaagcggcggcgaccttcggcttgacgacggcgacggtgttccagcggcccacagtgacgacggaggggcagacgaggtcggcgacggcttggcgatcacgacggtggctttcccgagcggcaacgacaaccggagcgacggcgacgcacggttggagctgcggcggcgacggcggcgcgaagctacacggggctagggcgctacgggcggcgacggacgaagacgagggtggcgacgggtagcggcgggcttgggggtccttttataggggttggaaggcggcggcgaaggcccacggcgaccggcgacgagaaggaaagtttagggttcagaggagagagacgaatccgattcgagatcgaatccacggatttccaaacgaaattagccgacgattccaaaagagaaaagatagaggggatcccggggatcatttcccctctattaatttcaccggaaacggaaaggggcggctggatttggaaggagacgacggcggcgcggcgctagggttcggccgggcgatggcgcgaggaagacaacggccctgacaggtgggccccacctgtcagcgggcagacgcgcgcgcgcgagctcggctgcgggccggattgggccaggagagagagaaggttccaaaagagaactttaaaaccttttccaatttaaattattcatgaaatgcaattccatttattaaaaatacttccttagctcaaataaatcccagaaaaatctaggaattatagaattaagcaaagtatttaatgaaattttatctggccccattttatattgaaatttattaattaaaactagatcttctcttctaggcttttaaaataaattctaataattccaatttagacaacaatttaaatatttgggatttttagtgtgtgacatgaagtgactggaatagatatactggattgggacaccaccatttttaatttctggcctttctggtatatcctccttcttcctctcgtgccctgtagaaccaattataagtcccttgcattcaaccctatggttccgattcacttgaataggatttgttccaactaactaggctctaaaaaaaatatcttatatattagaaggcatcttggtcccatcactctatccacctcgaagcaaagccgtcctcggctttcatgtaattttggaaacctcttgttgagattataaacacataatgatttaatttattccataaataaatcataatattgcagatgcaaactagcatgaacgtatcattggatctacacatgtacactaggcagtaaaacataaacagatcaaatatacgtaccatattgaacacgtaccgaggttgccgaaaaatcggttgctcagcaggaattactcgtggttgtgggcgttgacgaaggcgtgcaacacgcgagcgaagaggaagacgagccgtcgtggacgaacagggagcagtcgtgcgaagcgctttcaaaaacattattgccgcctctcccggtgcagaaagtcgaaggcagaggttctggagaactgctctcccgatcgccggtgcacgccggcgagcaggatggagtagtatacgagcgacggcgcagcacagagtaggaggcaaaccctggatgatttcgcgtgtgttgcgtggaagcggcggctcggtttatatagagaaaggttgctttatcagggcgcccgcatgatctctactccgcgtcgcttaatcagggtgcccgcacgatctccactccgcgtaactgaaccagatacactccgcgtaaccgaaccagataagtcgcgcataacttatccagatgccacgccgtttttcacgcaatggatttttcggtatgtttccaaaacaaacaaatctgaatttcccacagcaaaacaaaactgcaaaaggaggctgcatctgcgacaattcgacacgtacgtcgtgcacgcgcatcgccggcctagcccggcgagcaagcgcgcgtctgtccccctcttctctccacctcacatgcttcaagtggctaggagggcatcctcccttttaaggaggtctccctctcttagaataactccccatgcatgtcatcctatgaggtggtcttttgtgattttccaaagaattaatctttaagtgggctaagacccatctattaattccaacacctctttctttttcttcatagcaacaaacacatcagcctcaatagcactcctcgtcatcagtttcagcacatgttgcaccgccttgtgcacaaaagaataattattggactgaccaccatgtgtagcatcaagatcaaactgccatagtctacccaacaataaatgacatgcactcaatggcgcgacgtcagagtccactttatccacatactttccgatagaaaattttactctcaccttgtgagtaattttcagtataccactctgattcatccattgaatataacatggtgttggaagcctccggattggcaaagcaccaaatctaaactaacaacatttgtaaaacttccaccatcaattttaatttgcataccttctcacgaataatacattgcgactgaaaaatattggagcgttgtcccttcacaccattaacagtatagcttctacttcttgagccatcatggataaaccgtttttactcacctgtaactattggcttatagttaggatatgcgtaggttacgatagcataaatcaaaattttctaccgtgtaaaccaggaaccacatgcaagtataagatcatagatcgttaccactcgacgcgctgcatagcggaagaaagcgctaagaaggcaaagccaccctcgcgatgtagcgcgtgccgatatagaggaagtgctcgattgcaccggctcgaccttctcctcctcgtgcgttctcctcgtcgtgctcccacgccgatcagcaccgcaaagcagcagcgcctctaccggtattcacacgtacaaggacggaacaccatgcatagatgtgctagcacccgcgcgcggctagggttttgctcgggagggaagtgacggctagggtttctcgcatgatgcaataactccgccggtcacacccctcataaatatataggatccacgactcaggcctccaaggcctataggactcctattcagatccctatctgaactaaggtcatattggatctccatccaatccccttattctggcccattaagcgtgccaccttgtaggttcatgtacactcggctgtaacccgaaaactcattttcggtccacgtgtcaacagcggcccctagcagaacttattgaccaaccggacatacataaagatcatatcggctgaacctctagtatatacttgtataaacccctttgcctcacgatatcgattaagctcgaggctagatatgtgccatcctataatagctcaatcattcactcgaacttgtgatagattataaaacctgtgattgactcctcaatcacctttagcatggccatgcactttcataatctataatatcgaggggcccaaatatctctccataggaggggcaaatcccatattcttgattaattattcatatcccactacatgtttcattgcatacccgaaaactgttttataactacccaattacgaagtagtgtttagcagtccctaagcaagctactacacatcatagcaatccaaaattaagctaaggctaatctacaccgcacactttactctggagtcctggactcttttgtagttccccgactccctctccctaatggcagttgcagcttgcagtgccatatccatgtccccctcctatattccgtgctcacctcaacattctcctgggagttatctcctagctcagcaggtggccgccctgctctctctctcccttcctctccagtgggtatgtcctctctatttccttagatttgtggattgggcgtcagccgctggactggtgccgcaggacctcttattgcaaagataactcgtccaaattgcatgttgtagaggaccggaggatggagccactaaaatcgtgtgttgcagaggattaaaaggtgttgctgacgaggtgtacatatatatgtatgcaagccggtgcatatatatatatatatatatatatatatatatatatatatatatatatatatatatatatatatatatatatatatgtaatcttgccttaaattttgctttgagattaatttgaaatattgccttgtgtacacaatgatggaactaatcttcgtttattcatgacaaatacatgctctacacgtgcctaatcttgcatgccatatgtgattagattttgctttgacattaattttgaatcttgcctcccatacacaattatatggaactaatcttcgttagttcacgtttcagaattagttcacggttggaactaacccatacactgcacatgcgggccctagggaattctcaactctctcgttgcaccacgtggcgagcgttttgagggagacatgtggcagactgagagcgtttttagaaagtttaatggaattttagtatataatagatagatagataatagataatagataatagatagatagatagatagataatgtgttatctatttcaaggaacaatgttagataattatgtaaacatagtatgtgatacaatcatctatacgattgcctctaggacatatcacctatagtaacattagtggatgagtcaccaagaggatcatcagagaaagctgtagttaccaatcctggtgcagaagaaacttcagcactgctagcattcatgcattccctttgcactagaggttgatttgacatgccgattaggagaagaaaagtttttactatggaccactttaaacttcccataattattcatagcagcaattcttttgttgttcaagtctgaatactgatctctagctgcaaaaacacatacctctttatttttctttctactaacatctttgcaggacttaacgataatttgcttcgtggcaatagaaagattttcagcaaacataaacctcttcccatcaagttgggtcgcacaaccatgtgcattcagtaactcatctctgataatagatgcactccacgaagaacgtatagcctgcttcttggaagccttaaaatcttcacctacaatagccaacttctcaattggtgaatcatgttgttgacgcagcagcactttcatccccttccacgtcgctgtagatttgttcttcctgtagatttgaccaccactgcaaaacacgaaaagaaaatcgccgctctgcaaaatccaacatctgggagtctttgtagcatcttaattagcggcataaacatagatttcctgctagatcgaggaatagtagctagatcgaggagtctttgtgcatagcaccttcccaatcatagtagctagatcgaggaatagtagctagattgaaaagaaatcctccaacgcacatcttcacaatcatagtagctagatcgagcagtctttgtgcataatagcggcataaacatagatttcttcccgagccaatattcatccatcattgaaaaacagtagaaaaatttctaaatgaagaatgatcaacccaaagctttgatatcaatgtttttttgagcacgatcaggatgctattcacttcttgttcactcaggtctccgccgagtgatatgattttggcggggtcagagtcatctatctgcaaccagacaaccttgccgtggggacgggtttcagcgtcggcctggttctttcttgccgttcgacttctaaggtatgaactcccctgtcgaaggaggccacctatagatggccataaggcccgaggcccgaaggcccggcccatggcacggctttttggcccggcccaagcaccgcacggcttgacttgggtcgggcccgtgccagcctggcccgaccgccgggccgtgtctgggcctcccctccggcacgctgggctggcccggcacggtcaggccggcctggcatgatgggccggcaggccaggcatgccacacaaagtatagggactaaaaataaacatataaatgtcactgtccaaagaatagggaccttaaatagacttattttagctattgatatcacaacccaaagaaaagggaggtaaaatagactttttttagctatatatatgtcacagcccaataggagggaggaaaattagacttattctgaggaaaagcactatgggccatcgtgccttcgggccggcccggcacggccccaggcgtgttgggccgtgcctaggccgtgagtgcggcacgtgggctggcacggcatggcccggtgcgtcggtcgggccgtgtcggctcgacaagccttggcccaggcacgaccgggcctgggccgtgccgtgccgggtggcccacatggcgatctataaggccaccatggtagccgaaggatgggaacccttgacaactaccacaccggctgggctaggcatcttgagcttgaggtagttgtgataagagactgcttcaaacttggtcaaagtgcctcagccgaagatggcgttgtaattgtatgggatgtcaacaatgtcgaagagtatctcttcttctctcttgttttcttgtgtgccgaaggtgactttgaggtgggcttgacccaaaacttgcactacttcgcctccaaaccccctgagcgaggttggtgcttgggacaatgccagtgtcggcaaacccatcttggcatatgttccggcgaagatgacatcagccgaactgcctccataaatcaagatatgccgaacttcaataccaaccatctctgcaccaaccgatcctggtgtgggaaaaggactccttcagcatccttcggtctgaaggatatctgttgcgtcaagtatcttgggaccccttcgcctgccgaaacaatactatgcactgctcgaagttgcatctttttttgtcgtttcgacacttgcgagggggggataagatcttgtgatgacctagatcactcttcactgtgcatcttggcgctgttcagcctgaggtgcttggttgaggaccgcttcgcgcgttgcctcttcagccctggcttgctgctgcctgagctcttgagtgttgccttgctgccgaatgttccggcattgctcggttgtgtgcgaagagtgtccatgaacggcgtagtataggtctttcctgatctttttgcgaaaaggttgttgctggccgcccgcttgctgagcgtcgaactccttgcgaagggcttgcacttcttctcctgccatcactgctttgccagctcgatcagttctaaatttttccatgtcatcggggcatggttcggccttaaaggctgcccttgattcaccggaggggttgagtgaatcagaacgggtgccgaactagtaacttgggcttgaatttgagcttgtgcgtgagcttgcgcggtggccgtctcggctgcggctgttttgtcatattcggcttgtatctcttgccgccgcttggtatctttttcgcctcatgcataaccatcgattatgcgaaagaggtgttcgagcatccttggttccttgcgggcgatcttcctagtgagttcgcccttaagtaggccggtcgaagtagcgttgatgacagaggcttctgttatgtcttgcacttggcaccgtgcttgcgagaagcggcgcacgtattcccttgtcgattctcctggcctctggctaatgccgagaagaccttattgtgttttcggctcctcataagtgcctcgaaagttaagaacaaagacattgcgcaattgctcccatgagtaaatgctactagtaggcaaattaatataccaagatcgagcaatgccatcaagagcgaggtgaattaccttcgcctttgtattctcgtcaccatgggcagcttcgattgtggactcatagatggagaggaactccttcggatccgtttctcccgaataccttgggacatgagggaacttgaactggggtgggatgggatgattcttgatcccccaactcaacggcaaacccttttcgccatccgacttgatcatgacgccttgctgagaaggccagcttagctgcgggtacgggggcgcaaatgaggttgagcagcagctgttgattgatgccccgtgccaaacaccattggctggttttgttggtcagtcggagcagcttgcatcaccatagctgggtcgaacacgacttggttccaaacttgatttggtagtgggaccgctccgtagccagagggcacggcttgtgcgaaggtcatgggtgcttggaccgcggtgcttgggtcgaattgcggcagttggctttgaggcgatgccccttgggcttgacttgtgttaacgaccaaatttcataatctgagtatcaaagatagagatcagatcgaagcagaatctaaatccaagatcttttaggaaacagagcaagaatcggcaagagtccgaatcggctttgatcaggattagtagagtccgagttggacagggttagccgattgagccgaatcctacaatatgacaaagaatacattgtcgggttgagttaataagcttcatgatgattgccacgcatggatagaatcctgagaagacaattgtatctattaattaggatattttacgtaatttccttacagatatgtttgggcaaaagtctgccgcaaagacttatggtatcatagagtttgttagagataagagtcgtgtccgatgtgtacatattttgtaaatctcgcgtataaatagaccccgagccccatgtaatcaaact

SEQ ID NO: 65460 - DNA, 768 bp, Oryza sativa
  unsure (1)..(768): unsure at all n locations
agtgattttgactgccagtcggacagnaccncatcatgtcgagaacagtttcgccgctagatcggtttgtaagaccccaactcgtgagcttaatcattcatctgcaattttgattgttttctatctcgttcttgtttgtgttcttcgattggcaaacagggattagccttctcggtgaggtcatccgcgtttcgacacgggtgataaccagaggagacgtggtgctgcgattgcggggctcaagagcatgcgtgttcaagaagtcggatcaatttgtgtcgcgactccgcccaaatcgttgtgtatcagaacctttcggaagatcgggaaccctagtgcacatcaagtggtatcagagctctaggttcaccgtcaggttcgcttagttcctttaccctagattagtttttgttttttcgcatttatcctagagtctatagaaaagccaaaaaaaaatttagtcgttagttaccttaacctataccgtttttagcctttgcatgattctttttcagagtccgtagtgttgagtttgagtcctaattaaagttcctgttgctggtctagtgcgtgtttaactgtgcccactacaacaagaacctcatttaacaacacatctatgtattgctagaaatccaaataagtgttgcaagggtctacaccaacgcttttagtatgcgttctatgctggtgttgcaatggtagaaatatatgatcatgtgttagtgacactaaaaataagcgttgcaaagttgcaacagataactg

SEQ ID NO: 65461 - DNA, 756 bp, Oryza sativa
  unsure (1)..(756): unsure at all n locations
cagggtttganttcngattgcggnctactgcaagnacntcatcagtccaatgtgaaattaattctagttgtatcttacgatttgattttattcggatttcagaactgtttttttcaggttagtagtactacgttctaagcatgtgttcttttcctcgagtttttagccatattgtccaagttgattacttgtaaattaatatcccctctagctgacaacattgatatcttactgtaatagcaaacttattaggccttttatttgtgtacaaacaatgactttcttttttactttttgccgaatagtttatcgaggtcactatctcctcttattggattcgtagtaatgcctgacgatgatacatcaaggagtattcctgaaaagagaaatatctacaaccaatatcgtttaactattagtcaaaacttttaaatattgactttgtggaaaacaaggacgccttgtttttttaagacagagggagtactactgattaatcacacatgtcaattaatttcatttgcggattttgaaactggacttatacgtaggctgcaaaattcagagttgctcgacatatatttgggttacttgtatacaaaacttatttgaattacatgcatatgcatcgattttgtgtaagtcaactgtgccattcattatgactattatgcatgttagccctctttggttctgtcaattaatagccaaatagagtcaagtgtacaagtactggtaattaatcatcaagctgca

SEQ ID NO: 65462 - DNA, 3151 bp, Oryza sativa
  unsure (1)..(3151): unsure at all n locations
agtttgctgttgctgagatgagccaagtcaataccatgccatgtcttcctgttctttgcctcccttcgtctggatgcttcttcaacttcattacttgcttcatcttttatagagcagctttgaatagtttatggctacaactacaagggtcatgtgtggtgcaacttgggctgaagactggggtctggggattcagactcaagatcctgacgatgatggaatggatgacaatccccttttatgcgatagaaaggttcagatggtcagttcttttagtcgcatttttcattaggctttttatattattaacttcttatttgtaccaaatactaaattgttcaaatttcaaatgtttgtcccaaaaaacaccagctggattgttgactgtgtggtttgcatgcatcattggaatcaatcaaacattagcatccattaaaaaacacagtgaactttgaaaaatcctccatggtccaattcttgctggaaagaaagcaacaagaatgcagcactagtgtgttgtgaaaacgaagcgtctgctttgtttccttccctttgacatggtcaatactgtaactaaaaatttccaggccggctgtaacattgtcctcttgtgaacatgacctggagataacgtagaatagcttgagcacagcaaaccgaccaatgttaccaatgcacaagcacaatgcactgtctcatcaattgatttattttggtcactttacatacttttttctgggtggctgctatgggggcttgccaagcacaactttcacgctactgccatcggtcactgaaacctgttttggaataatgtttttgtaatcacgataataagctttggatattataaaactttaaagcacgttttgagacaaacacatgatttttatgcagcaaaacataaacatttaaataggcatcagtgtttaaagctttaaaattttgattaggacatattcaaagctgaaacatgttttcattactggagcgagtacacatcagcttggcaaaaagacagtgttatacatatgcgtcagatgacatatgtatgcatgcatttgttctactagtcatttgtacgtttgaacttagattttctatcatacagaaaagattttttaaaaaacatagctttagttatctttagttgcttcagtctgtaaaagaatgtgccggtaatatggtggttatctctctaccacttcaaaatttgagttgtggtttttttattaggagggttatgcttgtatatgttacataggatcttgtgttgaggattggacctctgggtcatgtatgtcttgcacaaagattcttcatgtatttcttattcatcatctgcaaactatatttcgaatcgaaaattagaatgaatcaacattgcatgttgatactctgaattcagagctttgtgaaccgtgtacatttatttaaaaataacagggtaacttcactgtaattaatagaacattaattaatcatcattgcaaagtgatctatggaaaattccattgaatttaagaataataggtgttgtgaatatcagttatatactagtaagtagttagaaataggatgattatgagcaatatttagtaaactaggatttttttactttatttccacaatttctccaatccattgctctctttgttttttggctaattacaagtatatgcacatatgtgtgtgtatcatcacgtacacacgcttaaacagatgcatgcgtagggataaatccatgaaccattaaaatttgccatcgaagtgcactcatgtatgcataatttgagacaccaggatttgaactttgatcaaatgattttgaaattggtgggggtaaaatattgtcaagagaatatacaagcatagctaggttgaagtcctacattgcatacatcacccctgttgacactaatgagaatcaaaatagtttagacctacctccagatcaccactgtgaacttgctatgccataccatcgaatgtgaacctcaaattgaggtatataattattaacgtgtatacggtttccccacagctagctggccaaagtaatatcatacatagacatgacactgctatttcaagttagcgtgtaactaaccatgcgttgcataaagaattgctacctaatgcagaaggatatattttttgaagtaaaattcagaaggatattgcgtgggggattggatcgctgactcatgtgtgttgtacagagattgttcttgcattgcttgcaaactactacctatgtttggaaatcccataattggacttgaattgacactgcatggcattctcttaatttagaactcttagtgtaccatgtacagttaaatatttgaaaattgcttcatcacactagtacttggctagtaattaatagaaaatatcatctaatcatcaatgtagaagaaggattttagaacggctatctttggtgtgggtatcgttgatagcagtaggaagattatgagcaaaatgtcacacactcacactagcaaaatgactctatacgagtcattagcttcccctcccctgtcgctgccaccattaggcactactggagaaatgatctttgctcggtcggctgatttccataatagtcccggatctagtaaaaaccgggactaaaaattgtttttagtcccggttataaaaattttgatctttagtcccagttggtgatgatctttagtcccggtttataccctgtcagagccatgttaggggaccgaggatctttagtcccagttgatactaccaaccgggactaaagattatcactttagtcccggttgatactatcaaccaggactaaagattatcactttagtcccagttggtagtaacaaccgggagtaaagatcatttagatctttagtcccggttggtactacaaaccgggactaaagatctatctttagtcccggttgaagttactaaccgggagcaaatatttttctcccatctctcatcgattaagtcccagattaaatatttagagataagatcatccctctccaactcccctcagatatcgccctctcccaactcccctcagattagaagcctcctcctcccctcccgtatcgtccccattttcgtgatgaacgnctgcngcagagcgcagatctcacccact

SEQ ID NO: 65463 - DNA, 1012 bp, Oryza sativa
cccgccgacggagaagcggcggtggaggtggcggaaccggaggcggcagctggtgggcgtgaggcccgggcgcgcggcgagggggctccgcgtctgcacctccatggcgacggagtcccagctccccgtgccgtgcctgctcacggcgcaggccaagagcagctcctccaacgtcccccagatctcacctccccctcctcctcccgccgccgccgccgccgccggagacacgtcggggccgtccgatccgtccgccatgtgctctcgtcgtcggcggctgcttcccccctttttcttctctctcgctcgcgcacgcttctttgttcgatttttatctcggagagatggatgggatggatagatagcctctgcctctgtgattcgagcgcgcggcggcctcgcgcacccaaaagacaatttcgcgtttctcaggggggtgttttggagaaggcgagcgtgctgttttcaaactggggcccaccttctgcctttctttttattgtacgatccccatattgcccctgattgcgcatactattatcccgtactatatatgagacgcaaatgtcgcaacaaaccgtgtttatttgttaggccttgttccattaatccctataagtaagggattagaggagatttatttcacatctattgtggcgtgaaattattctccctcaatctcctacaatcctattcaatcccctctaaattgaacaaggccttataggagaaaattcttgctctaattccaaaccgcaaatttgatacgcagtactctctctataaaaaaaaactcagcatatccagatttgatgtactataattccatcccaaaataaactcgttatgtacaaattcgttatactaggatatatctctatatccaattcgttgtaatatgtccaattctagtacgaggtttattattattttttttacagagggagtaagttttttttagaaaaaaattgattccagtaaacgtgtaaacgatctaagcaaagtcagaccg

SEQ ID NO: 65464 - DNA, 1001 bp, Oryza sativa
gggatgtgacccctcctaagattatgaatctggactaccctttgtccagattcgttgttctaggaggggtcacgtcccctcttagattgaggttttttgtagaaggagggagtagaagtcagaagcaggaaaacttaattttttttccagattctcagaagttgttaccaaccagctgtttctcagaaatttaaactcccctaaataagccctaagcttcttagctggtagggagccgctgggaggaaggcaccgatctcggttcaaacctagccaataactttttttttacttagttctggatgtaacacaacaacattttaggacagatgtgtgcacagtacgcccttccgagaacatcacccacgcccttctaaaaaacgcatatgctcctgttacaacagaaaactagcagaactatcgccccgacgtactacacagctacccgactcacgacgactcccaaacagaagccccccactgatcgacttgacggactgactgagggtctgtttagttactaaaaagtttttcctaaaaatatcacattaaatctttgaagatatgtatgaagcattaaatgtagataaaaaaactaattgcataattatgatggaaatcgcgagacgaatcttttgagtctaattagtctataattagccacaagtgctacagtaacttatatatgctaatggcggattaattaggctcaaaagtttcgtctcgcggttttcaggcaagttatgaaattaattttttgattcgtgtccgaaaaacctttccgacatccgatcaaacgtctgatatgacaactaaaaatttttatttcaccaaactaaactggcccagactaatcctatttgcagggacgatcgacatgtcgtgaactcgtgatcctccggtttcccggccgtatacatgctaccgctagcaagcatcaaaactttctctccacagtggtgccatggcaggtgtacgtgcgatccctactttgattggct

SEQ ID NO: 65465 - DNA, 1233 bp, Oryza sativa
caacaggaagaatacatggactgatagcagccaagaagacctctctagacttatcatatctttcagaattgatttcttcaaatctaaagtctgatggcagttcaaagctcattgagtcttcatatgcaaaccaaactcgagcatctttctggaagccctcatagaatctgcagaaccagtctttgagcagttcagccgatagctttgctccagaatcggctggtgttgatgcagcttctccatatgacatgcatctgcgatgggttagtacttccccatcgtcacttgtgatcagttctagtcttggaaattgggactctaacagagctggccgattcacagctttcttggcaactaagttaagccatgtttgcagtaaccacgatggtccacctgcacctactactgagcctgcggctatcttggccgatgcgttgttcaacatctgatacagatagccgaggaggattttgcccaaagggatttgcttctttgcttcaagggcttctgctaggaattgccagttggtagtagggccacaacttgatccacagaaaagaaatttctcaagccacattagtagaaaggctgtgtgctcttggggggtgacagatcctatgcccatgtttgcggcgatatagccagaccagccacctattgtttttgttttaaattcaaactggttcttggaatttagggtcatcagattggccgaataggtgacatctaaaccagtgatcatgatgacatcaagcagagtggggggtcatcggcccttgattgaataggaaggcattgagggtgttggaccagaaatatgttgcagaagccatcaggggttcgtccttagctgaatttgctaaagtaagagcaagggcttggctgattccgagttcatcccagtgaccttgcttgctagccaacacacgcttgtaccatacgggctaacttttctcaggagaacttttctcaagcgaaggccaagacttgaaagtatctttccagtgacctagatttgggttggccaatctgatgctcatgtgataggctaggaatcgcaaccagattggaaagatgctacggataaaaatagagaagaagaaaacaagatgagacaaggaaaaaccaatctattgcataaagaagaagatctagccgatggacacgtacctctgcatactcggctgatggcgctgcgaacgggctggcggaagtcgacatcgctgcgggtgg

SEQ ID NO: 65466 - DNA, 4086 bp, Oryza sativa
  unsure (1)..(4086): unsure at all n locations
ataacagcattaaactaaagaaccatgtgcttcctttttatgtattgttactgcttctttataggcttgtagctttgcttgtgtgcttcgtgtagcttctgtcgttccagaggttcctgaagcgtggttcgtggtcgtcgccgaatgttcggaaggccattctctctgagcaaggcaagtcacatcatccttgagcatattgaatcccagtttataaaattattttgatttaaattaatgcattatctctttatttaaattcctgcgttatcactgttttatttagccatgcctatttacctttgttatgaccttattattatttctattgttattattaccttgttcaccctaggataaacaaaaccccaactagtgggtactctatttatggttccactagtatgaacttaggtagatgcttcgctgattaattaggcaacattaggtggttttataactttagactttgggaattctcatatcatttagacactatggactggttgccttatgttggaattggacacacacctccccctctattcaaaacccccaaaatggttttagcctgggctcgaggtgcgtggttgggttttgttagtcgtacctcgggtactataaggattaagctcaggcctctattgcaaagcactaccatacttccacatgtctagtgggtaaggctaagtttgtggctcagtttggtcataaacaaaggtacacggatggagatggacgaagtcggggctcgatggacatctctaggacaaatgaaggctacacgagctgcggctcggtagttgagatgtcatggcacagggccggtgttctgctgctaggggctcaatcctacctacctgtctcgggggttccagccgtaggcggggttgggtcggtactcttgtctatggctaggatgggttgggaactatgtcacatcgtccgtccgtatgccgtggtggtatgtggcacgtggttacacgtgaggaagacgtgtcttgtgggtaatgatgtacacctctgatcagagtataatctatgcgaatagccgcgccctcggttatgggcaagcctagcaatgtactcaagttagtgttttaattcttaaaaccgcttaacaactaaaatgtgaaatggttgggctgggttggcttgggacgagctgggacctgggtctggtggctagttcggtctgaatcatcgtaggccttgggttaaggcaggttcgtgtgggttcacagccttgattaataacattgtgtagctctagaatcatctttacaaaatagctttgggcaatgaagtaacttttaaatgttgtttactgcaaaacttaacccctattattatccccttgtacccccttgcattaatcatgcatctgccggtgtggcttgctgagtattgtggttgtactcattcttgctctatctttacccccttcagtaagagaagctttggagaagaagtcgtaggtggagtcctggcttataccctagttgagcgcctgtgaagatggaaccgtcggcccgctagtccgctgctgattatttctgtttgtcaggccttaagtgcctttgtaataatgtaaatattatcgatataataaagatgtgccttttgtatcatgtttgtttggtgtaccccagcttttcctgggacggggattaatacactagcgttctggaaaaggtatttttccgggcgcgacagtcaccgaattgggaaggaccgtttcaaatccataaggttgtgtccaaaggagtttatatgttacaaggacttgatggaaaagtttatggacgagcacttaatggcaagtacttgaagagatattacccaagtgtttgggttaatgcatgatcggttgggtgttgccgatgcatgatagccgatgtgtttacatcgccttgagatggccgatatagttatatcgcccttagttgttttactatcataatcggttgtgttttgccaatgtatgacggccgatatagttatatcgcccttagttgttttattatcataatcggttgtgttctgccgatgtatgatggtcgatatttaatatatcgcccttagtccaaattataattttatcgatgccttcatcattgcaaaattaggggggcacatatatacaaaagttgagaattatcggcagaaaggttcagtgataatcaaaaggagtaccaaagtttcttagccgattacaaaaattttctaagtcctattacaaagataatcatctagacaagttacgctggattgccgatacagcccgttggctaatttgatctacttcttcaatagcttggatatcttgggcgtcggttccaggaatgaccttgagagactggtcaatcggcccgttcctgatagccattttagctgacttgttcttcgacgccttgggatantcagttnnaacttctatcnntgctcaagagccatttcggcgttgcattcctctagttgagctatgagatctattctgcgagcctcaagccgatctattttagtttgaattggcccaaccaagagttgatctagcttagctttctcttcatgaacggtttgccgattggtttgaatagtggcttcaatatcccttcgctctcgccgatcggctatcctttgcttggccttttctaccttgaattgatgttgctcgaggtatacagctggagaaatggtatttgccagatcattcgggattagggattgaatctctgcaaatcttgcccggattgtaccgcagtcaaccaccaagttgtctaatgatgtctctagccgatgagatatgtcttcaagagttcttttgacatcgtcatctagagggactagagttttgcttgttattttttcttctacctcttcatcaaagtaatccttgatgtcaaacaagaacagatcggctaaagcctacaaaaggaaaattgaagacagttaaatttcaaagcgaattatatagccgatctaagatttatgacaatgaaagacttactggtatggcaggagcagctcgttgttcttcctcctcaatattgtggctgcctgcagccgatggagtacgatcactgggcgtcgactgcacaggaggcgaaggaggaggagaaggctgaaaaaaagacaagtgttaattaacatcagttatgatcatatttaaaggattttatagaggaaaccttaccggtggagctggtttagatggtgctggtgctattttttcttgacgacagttttttttttctacaaatacaaaattgataaccaatcaactctgcaagttttttcaggagatgatcaagatgggttatttccccttgagaagtgagctggagcagcaggagttggaggagtctatttgcgtgaagccgatgatgttttttctcctaagtcactcagttcggctgcagcttggtcgacatcttccttaatctcttcttcatctagggcttgttctatggatggatctaaggcaggcaagtcatcggttggcttggatttcttcttcttggcctttctctttggagccagagccgatggattagcggctgatgccttagttttcctattcctactggcatcagctagttctcttagctgcccttggagtagacttgaggtcctgggggcatggtagccgatgacgggggagttagtccacctccatttggtaagaggcctgaagcatactcgatgtccttgccgctgttgcttttgcgaggatgggaagattctattgtctgcaagacagaagatgagactagtaaaggtacaaatcggctgacaattattttacaggattgacaaagtaaggatttacctgagggataacatctgggaatagatctgtcatgtacatggaagctgattggtggaacaagtgctgcttccattcaccccaccatctgtcaaagttcctgctcctgaactttgctagttctacatttttgatgctgcccaaagggggtcctgggatgttcaacagccgatccatcatcaatgttgatgagatttcgcctctaaattgaattttatcggcaaagataaaagccgattggcagctgtcccatccca

SEQ ID NO: 65467 - DNA, 9119 bp, Oryza sativa
ttcctgcagccccacgtgacgccgtcgcccggggtagatgagccgccgtcgccaccaacctacaccggccggttgcgttgcattgatggtcgcggttgccccctctctccgtgccgttgagtggagcaccgagccgggcggtgtctttgccagagctgggtgtcacggcggcggcaagccaagaagagcttggggaagggcaagggcgagcccgccggcgagatgggcgtggtaggcgtcggaagggatggtggggctgggagcgtggcgccatgtgtgaccgcgtggcaaggcgttgcgcggagaaggggatcgagccccgtcctcttgtggtgtcggctcggctcggctgagctagggcttccaagccagcctcaaaaagaggggaaagaaaaggagagaaaagaagagagggaggagggaaactagactttttctgtgcagggagggctgagggaccagaaacagacttcactgatggtccttagatgaattgggtcagtaacagggggaggaaaggtagaggatggtggaaggtgaggggaaagtttaagcttcccaagagaggggagtggagggagcaagaatagactttctcgggcaatacagggcagaggacttgacaggagaagggaaggaataagattactaagcttttctttttaagaagaccataaaaaaaagaaactcaagtttaagaattttggtataaaagaaacttcaaataaaaagaaaattggctgaagaatcggcacgatgctgagattgagatcgatctccgaccttaactatggcaaaaacccaagttgttacattgatattgcgaaccactgggtctagtaccagggggtactaccccgggtggaccactcggtcgggatgatccgagcggtcaaacttgattccaacttcagaccatcgaagatattgaggtgtttctggctggacggcgttgatttccctatcaatcagcttctatttcctcttggattcataatcttgtggcccaccgaagatgtgattgagctcttttcggggatcttgaaaacctggttgtccctgatcggtatcatctttcttttgagttgaagtactatgctctgtgtcagtcggcttcttcaattgtgtggcatattgctcggcaaattacttgtaaataaaacaatcctttgcaaattagtgtgatgtgactaggggccgttcatgatcttgttgtaggtgctgacacgcggtcgttgatatgatgaatgcttgtgaaagcggcgactccttcatcgttcccatcgttgcgatccggtttgtgatgacgttgtcggtcgtctctgtctgcaccacgacgtttgagggtgtcaagtaagtggacgggctaccgataggggtgaaaacgataacggtaattaccgaccgaccggtgttccttttcgactttctaccggccaagccatatggaaatggtaatcgaccgaaacaaatggaaattgtaaaaaatatggaaatgaaaacggaaatggttttgctgttataccgatcgtttccgtatttaccgtattcttgcggaaattaccgtttcttataatatggtaattaccgtattctaaatatgtcgatattatagggcatgtctatacttgacccacagcttacagattgaatgactcttcaataaaatctctaacttttgtacatggctaaaatgaagttaatttataatttatatagtataagcttgaatttatctatatatataacatacttatgtaaagtttaatatatgtttttatagtttaatgtttccatatttgttaccagttttcgatctgtaccgacatgtttccgtccgtattgttccgttttcggtttttcgataatttcgatatcatttttgttttcgactttactgtttccgatttcgtttccgagaaaaatatggttacggaaatggttgaggctgttttccgatcgtttctgaccgttttcatccctagctgccgatgatgagggagcgatgctcttgatgtctatcggggggagagtggacggagttttcccgacaagccatgccatcatgacgtgatcttgaattagcggcgctaaggcttggtttgtgatagtcttgagatcggagaggtggagaccctgactgccaaatggtgtatgaaccgaggcagagggctgccgagtgcttccctagttgactggactgaagcgggaaggaagacggagtcgtcgatgcccgaaacgaatcctattgcagtagtcggcgaaaaacttgatgtaacccctacttggcgcgccaactatcgaaacaagatttcggcaatactaaaaggggtagcaatcaagctggaaaagtggatgggtcagtagagaaaggtttatacaggttcaggccttgtcgatgagaagtaatactctactcctgtctggggaattattccgccgagtgtattattgatctaacgatctgggagaaaagttctgccgccctaggagtactcggacccctccttatatagggggaggaaccgagatttacaatgtacagcccatattacttacggactaggctaacagatatattacaattgtaactaactaggactacgggatatttccttgatatacaaattaatataattcccgagtccttttctaaacatattctacctgtataagctatcccctatacacagtcggatatacttgccatgtgggtatgtggtacccataatctccacaatttgtgtgcttaaattcctaaaaaaaatattggcaaagaagctgatccttactgttcgtatacgagcagttcctttgttgcaaagcaatgagcagtaaaactttaaatggaatttgaaatcatatgactttcctgcaaaaagttcaatccaaaggaggcttaaaaaatatcgtgaattgagatcacctacagttgctagtatcatcacgtacgaccatcgttggatctctcacatcacacaacagtattgtccattactctctctatcccataaagaagcaacacctagctacgcaatgcaaaattaaataagaggataaaggaccaaaataccccttattaatagcaaactagtattggcggatattgttgacgagaaatccatgctcagccgatggtgccagaactgtgttggtgcgaactaaatcgacgaacacaacggcttggtagatctgcttagctccagtgccggtccaaatcttggtgagatgcgggcgtgccagtcagtttgatcctacaactgacaagatatacaaagagctgatcggctatgttaacgaccaaatttggtaattcaagtatcggagatggaaccgaagcggaatccaagatagagatcgttccggaaacagagcaagagtcagctaaagtctaaatcagccgcgacaagaatcggcagagttcgagtcggataaggttagccgattgagccgattccaacaatgtgactcggtacacgttgtcaggttgagttaatgtgcttcatatggattgccacgcacggattaagtcctgaaaaggcaattgtatctattagttcggatattttatgtaatttccttatagataagtttgggtaaaagtctgccgcaaagacttatggtatcttagagtttgttagagataagagtcatgtccgataaggacattttgtatctcgggtataaatatgacccgaacccatgtaatcaaataacacacgttcaatacaatctcggcgcatcgccacccttttactttcgtttactttcgacgagtcctcgctttcgggttgagctgcatcggtttcgatcttcagctagaggtaaaacttgttatggcagcttgcgttctcgggattagtgcttccatctttatgatactctaattttgtttatgtaattcatcgagttatcatatatcttatataatctttgacaatattgttatttaactttcaatcggctaacatctatcattggaaggcagccgattaagttaaataccaacgttgacctagattatataagatatccaccaccctatgaaacactcaacggcttgattgtctagatattgtccttcttttcatacttatagctgtattagtttagtttgaccttataagtcgtgattaaaatctcaatctctagcatgcttttttgttgctgattagggtttcatcggggtttcagctgatcttacctgatttaactactttatatcttatatgcttgattgatatgttaaatctgccctttatgttaagatcttgttgtatttaggtatattaagttcttgttgcacttaggtatattaagcttcctgtttgatatattttgcttgctttaatatcttaatatagagtggtatcggagtactagccgatacatgctagatttatctgatcggctatgctgtgaatgcttataatctccttgttaatatatatttcgatctaagtgatttatactgtctcggcatggcgaccgatctatcctaatcacttgatttaagtatatattgacggaagtattatataccattaatagctatagctgatcgaatagatttagttatttcttgcttatttatgactgccgatcaattcaaatatgacattggctcaaagataaatgatacgtcattggcgactggccgatcggctattgttcatagatttaaccgctattttcctatctttatttcttgttggttgcaggatcaaatcaattggcacactcacgaacctaaaggcaagattttttggacctgcactgaagttaagcagatcttccaggcctcgtgtttttcgcattaacacgcttttggcacgcccggtgggacacgacaaacatgtcagcagataagccacctccgccatcaatgggcaagtcgttagaccctcaaaccaagattccaaaactgactgggtccgatgttaataatgggaacattgttccagtcactgtcgacaagctgtcactagaacaaaaaaaggattttgaattcatgatgaagagcgctcaggagcaattcatgaaatcgttcgcagaaacccgcaggaaagtttaccaaaagtacaaagtaaaagtagttgctgccgacgaagttggctcaagctcatcccaaggtgataaaggcattgcagatggctcaggcaataaagttgacggccttcaggatggagtggttgaggatcttggtgaagataacaatgaagtgcaaccgcagtttaacaacttccaagatcagattaactatgcagcgcaacatgctttgatcaactaatcaggagacctagtcaataccttaacaaacatggtaaagtctgtggttgatggtacaatagctgagcatcaagttgcgggaccagtttatctttcaggaggcatcttcccatattacaaaaacttggtaactggtaaccagaagtttgctaccaatgcaccaccaattcagccgatggcatcagcttcgactccagcaccacctgcgccatcatcggcaccaaggcaaataattaataatcctcgcctcttgtctagcgaacaaccgcaacatgctggtcagaatatcaatcggctgtcccgggagcaaattgcttgaatgtttttgccaactcagccaactggtggaccaattcagcagacgccgccaaggcagcagacagttcagtcgattcaacagcagacaactcagccgatacagcaacagatggtccagctgatgccgactgggttgaggacgcctgataatcggctgacgcatcaaaatgtgactcaggttgtccctgagcatctggtacacattgtacaactagatcaatcggttgcagcctaagttatccctgagcacttagtgcgtaatattcagccgaatttccataattgtcaagggggtaacttcaattatcaatatcagcctccttcgcctcatgctcagtatcaacaagggggatcacctcagcctcagtatactcctcagttcaaccagtttgagccgatacagcaacaaaagcaagggtgcctcaacagagacaatgggacgatatgattgcagatgtgatgagggagcagtttgggcttaagccgaaggatactggaaacttgtatcggcatccataccttgagtggtttgagagggttccattacctaaccgatacaaagttccagatttttcaaaattcttaggacaagacaatgtctcaacttatgaacatgtcagccgattcttggctcaatgtggtgaggcatcggctattgacgctttaagggttaggttgtttcctttgtccttgtccggatcggcatttacttggttttcttctttgccctacaaatctgtcaatagctgggccgatttggagaaacagtttcacagttatttttacagtggaatccatgagatgaaactatctgacttgacagcaatcagacaaaggcatgataaacctatgcaggattacattcagagattcagacagataaggaataggtgctacagtttggctttgaccgattcttagctagccgatctggcttttcagggtctgatagctccgatcaaggagaaattttcatctcaggagttcgaaagcttatctcatcttgcacagaaggtaaccctgcatgaacaaatgtttgcagaggctaagaagaatatcaaaaagatcaaccacgtgtacccttacatgtatggttccgatgaagaggatgattccgaagtagcagtagtcgagtgggtcaggagcaagaaggttgtgccattgtcacgactggaattaacccaataggcattccatacatgcgtgtattattccttgtcccaggaggcaaggtacaccaaatgttgatacaattcagagtttaacaagcggaagcgtaaatagttaatttattacatgggcgacgaaggcccagcacacacgaagataaacgaaaaacagctgaagactagggcgacgaccacagacacttgacggcaggcacgagctagacactaaagccttcatcctccaggaactcctcttctgggttggggaaaaaattgagcaagattgagtacaaccaccgtactcagcaagacacacccacgaatgcagaataaatgcaaaggagtacaaggcggttataataaaggggttagggtttgcagtaaacagcattaacaagacttttagttgctcagggtcattttgtaaagacgatcctagagctacacagtgttattaatcaaggccgtgaacccgcacaaacctgccttaacccaagacctacgatgattcagactaaactggcaaccagacctgggtcccagctcatcccaagccaaccctggccaaccattccacattttagttgttaaccatgttttaagaaataaaccactaacttgggtacattgctaggctttgatgtgcactagggttcccgatcttccgaaaggttctgataaacaaatatttgggcggagtcgcgacacaaatcgatccggcttcatgaacgcgcacgctcttgagccccgcaatcgcagcaccacgtctcctctggttatcacccgtgtcgaaacgcggatgacctcgccgagaaggctaatccctgtttgccaattgaagaatacaaacaagaatgagatagaaaacaaccaaaattgcagatgaatgattaagctcacaagttggggtcttacaaaccgatctagcggcgaaactgttctcgatagaataatctaagaaaaacccaaaaacctaaagatggcggcgggtactgatacatagagtttagggtcgtgcaaaccgctctcgatgcaaccctaatggagaacccaacacgatacacggcccaaaggcccaaatacggtgacgcaacaccgggatagattctagacatcaacttgttctgtcgattcccattgactcggaaagaatttggacgtgggaccaaaaccattggaaatgcgatcttcttagctttccatccatataaagaatgccccaatccgagcacgtatgcgacctgggcgcccattttagtgtagactggttctagactccgaattgcacccgaggtcgacttggtttgggcctccaccttgacttggacatcctcgaggatcctccatggctctaagtccttctccaagtgtctccttgtcccctccattgtacctaatcacaatataatcattaggtagcaatctattctcgaattcatacaaagaagaacataggaatgagctcacctctaaattcaattgtcgcgcacgagctcttgttatcggtccttgaatgaccgttggaggattgttgtttgtatccgaagtagtgatgtccgcattaggcttgcccataaccgagggcgcggctattcggatagattatactctgatcagagatgtacatctttaccgacaagacacgtcttcctcatgtgtaaccgtgcgccacataccaccacggcatgcggacggaagacgtgacatagttcccaacccatcctagccataaacaagagtaccgacccaaccctggctacggccggaattcctgagacaggtaacctaggttgagcccctagcagcaggacaccggccctgtgccatgacatctcgactaccgggccacggctcgtgtagccttcatttgtcctagaggtgtccatcgagccccgacttcgtccatccctatccgtgtacttttgcccatgaccagactgagccacaaactaagccttacccactagacatgtggaagtatggtagtgctttgcaacagaggcccaaagaccggtccttatagtggccgaggtgctactatcaaaaccatgcacctcgagcccagtctaaaactattttgggggttttgaatggaggagaaggggtatgtccattttcacataagccaaccattccataatatccaaatgatatgtgcatttccaaagtctaaagtaataaaaccacctaatattgcctaatttatcagcgaagcatctacctaaattcatactagtggaaccatgaatagagtacccactagttggggttttgtttatcctagggtgaacaaggtaataataacaatagcaataataatgaggtcataacaaaggtaaataa

SEQ ID NO: 65468 - DNA, 23154 bp, Oryza sativa
gtagtactttacaccgaaatcaattaatgtaccgcatgattaattaattagtaggaatataattttttttgggaaacaatctcatataactaactgttaaaaaatatatatttaaaacttaaagtatcatcgaacaggttccttttaattcgcagacaatgagacaagacgatcaagtcccacagtgagttatatgctgcttttgggtgtgcaacaactaacctatataatgacccatcctaaactaggccatagctaagttgtttagtagttttttcatattacaagacttttttctagtaaacatgtatatgaatgtgggcaatactaaaaagtcttgtaacctaaaacggagatggtatatactactcctactacattactccctccgtttcacaatgtaagttattttagcatttcccacatttatattgatgttaataaatttagatagaacatcaatataaatatagaaaatgttaaaatgacttatatatattgcgaaactgatgaagtagtattcatatgtatgcatagtacgtagttaatttggtacactcatctattgtggaatagtcaaatgtatatagtgtgtggaagtggaatagtcagatgtatatggagtgatctgccaattaaagtttgtgtgtgtacgtgtatcaaacatgcaggcgtcatctatccggccctgtctgcctgaaaatatatcactgatgcaaagcatatatgctaagattcgggacaaatatgtgaacatgttatttactacagtaaacacggtgtacgcacgtacgaatgtacgagcccaatatatttgcagtaggcttgagatattaattaatttgtataataattaagttatgttcggatcttagttcattaccgttctctgtactgcatgaatatatcccccaaagatctcactgcctcatgcaagcatggtgatataatgcatgcagatcgagtgatatatattttcactggcaatatatatctaggttattttccctcaaaacaattgagaatttgctctatatatacacagtttcaagatttatgacatatacattaagtttccaagcacccttaaaatttctaacattgttaaggctctaaatcaaacacatccaacgttgaaatatgggtatgggcgttaacaaagtaaataagtccttaatttgattttttttctgttaatactcatgcggccattattggcaaatctctatcttaattcttacccctgcaggtaacgcctatagttaattcaagcattatatacctggcctatattaaaccatagtaccctgcttggtcccaactgtgcatgtacgtactgctgcaatgttaatcgaaagatataaaactgtactaaagaactgcgatggcagctagaatgcagagaggcttctgcacgtatgattggtcactggctacaattactggaccagcagctaattgatcaacatgtacatacttcatctgttccagaataaaacgaatgtaagtaagaatgtgatataatctactagtataataaatctagacataactttatctagatttattttcctagattataactcatcttaatgtaggccttgtttaattagattcaaatttttttcttcaaacttcgaacttttccatcacatcaaatgtttgtatacatgcatgaagcattaaatgtggatgaaaaaaaccaattatatagtttgtatgtaaatcgcgagacgaatcttttgaacctaattacgccatgatttgacaatgtgatgctacagtaaacatcgcaaataatggattaattaggcttaataaattcgtctcgcagtttacaggcggaatctgtaattttttttgttattagtctacgtttaatatttcaaatatgtgttcgtatacttcaaaaaattttcgcacacgaactaaacacagccatagattgttttttttaacggaggaagtatatatgatactataatatatcgtccgtacacgtacggtgtatatatgtcagtcttatatactactaaggttgtgtttagttccacgccaaaattgaaagtttgaagaaattggaacgatgtgataaaaaagttagaagtttgtgtgtgtaggaaaattcgatgtgacgaaaaagttaaaaatttgaagaaaaaagttggaatctagacagggcctaatatactatgctcgcatagttgcaccagcagcttggtagctatagtactccctctatcccctaatataagacgtggccaaagttggcacggtctccaaaactaatctttaacttataatttctcatatattataaggtttgtagaaataaaattataatcatatgaaaataaatttaaatctcaatctaatgatataatttttaaccaataaaattcatttcatattataccaagtgttggttaaatgttttaaaggttgaatcttaaaatgtgtgcacgatttatattatggaatggagagagtaataaattaagggagagcaatgcatgcaactacgtggtaattaattaagccagtaaaaatgttatagttgcctggagacataataatgcaacgtacgtacgtgcaggccgggaactagctctcacagtctcactagctagtcattgcatgcccccgtgtactccagccgtctaaaaaataaaataaaccctaggtttccgtgtgtactccttccatctaaaaaataaaataaatcctgagtttccgtattcaatgtttgactgtccgtcttatataatttttttttataattagtatttccattgttgttagatgataaaatataattaatactttatgcgtgacttgtctttttatttttttataatttttttaaataagacgacggtcaaacgttgaatacggaaactcagtgtttgttttttttacggaggaagtacgtacgtagtactacacgtttgcaataatatattaatcagcaaggaaatattcgctgtaaattaatacagctatagctggctagctgctcctactatacgcgtacgcatgcagcgtacagtaccatatttttgttttcagaaaaattaagggtacatataggtgtatatagtagcgtacagtactgtaaatgtaaggagagcaatggatatgatcaaattgtcaattgaatggtaccatgagtacaattatgggagtgatgaagtattaatttgagcatgcatgcaatgcaacggacgtaggagaggaaagaaaaacacttactgaaacctatgtcatgtatgatcttggaagacatacgtataattatatagaagacgtatttacacatacaccactatgcacgcaaccaacttgcgagtgtgccctctctctccccacgcccacgtgggtttgtaaattaaatggacataaacctgctgcaaatttctacctcactaattaaatacctattgaaattgcgtttgtctaaatccacaaatccgattttgctgccacaccaacccagccaacaacaattgtcagaaaatggatgatttaattttgcagaaaatatatggcgactcatgggggtccattgtcctttttccactgccttgtccagatgcaattcaacatccacgatccaacaagattctcatatttgaaataagtattatcccattttcaatctattatctaaaaaatgtgaatagatcatgtgtgtttatcgatctatgcatgcgcattggcggatctagaaatctagatgaatgaatgaaaattactatcatccatgcatgccacagcaatggtcgatcaattgtcgaattgtcatgtaatattttaataaatatgaatttttttccacataggaggtataacttctgaccaggttctaaattttatggatgaagttataaattccactatcaccacaacaatagtacatgcataaagaaaaacaaatgcatggtctattggttttacacaattaatagcttgtgcaaatcgtatagtatcgatccaaggacttagaaatatataaacttatatagtagagctagtactagcaatacaaggatacgaacttctcatgctgtcatgtaagtgtgatataatcagatcgaatatacatacaatgtacaatgaagtacgtgggtccgaactgacatggacagattaatgcatggttgtgatcaactttaaaattgttaaactctaaggaatggaatgcaggaaggaccacgatatatatacacacacacagagcaccagacaaagtctgtttaatgccaacggatattctgcttctcccgtatatttcatccttcctgcatcgatctttcatgcaatatatctttcatgcttattatatagctactccaagaatatgtagttagatccctaatctagattgtgtaatttgatagaaatgatatgtaaaatccatgcatatagaagtctcattcagagatacaatcaattaaaaatacttatattttagaacgagtagaaggttctcatcagctgctgaacaaagcaatatattatttttcgagcggtgaaatgaacagatcaagcatatatcatttttttttcactcggtgaaatccccagatggagcccatgtatatataccgtatctctgtggtgccaaacacgtagggccctagttaatttcttgtcgtccaaatggcgagtctttatatcattggcgccaaattaaactagattggccccagttagttaattaattaattaattaattttgtttttggaatggtccctatcaattacttaattagttgacacatgttaagtttgatatatgttatgttgttccataattcagttggtcacttattagaggagctagggatttgtttcttttccaacaaacataacttaatttattgctgttgtgcacacatttgtgctagcttgatggcagatgccagggatgtaaaatatttttattgtcttaaaaaacaaatgcataaatatatgctactgtattgggtagtacagtctcatatggaccaaaattaaataagctattgagctactagcggactagaactagatgaaacttagccatccttgtttaattaccgtaaaaaaaacgcatatattaatcggtaggtgaaatatactccctccggtaaaaaaagttactttggttagtgtgaagtcttaaaacaatgaatataaatatctattatattttaaagatatttagatttcatgcacatatgaaaataacattctcacggattattatttcaccaaattaagatgctatatatcataagagttgtagtttaccaggtttaaactttaaacataaaacttgtttaaaactccctgctagaaatgcttgtatggtttagtagtagaaacgtggacttgatccggatatataggctgccaataatgcaatgacctgcaaacagagctactactagtgcagaccatgcgtgccgattagacatgccctacccattctgggaaacaggtttgcatggttggtgatcccatgcctgcttgcttgttgcatcatcatgtggatcgatcgatggatcgaattcttaatcctgattaattaattttgcgtgtactttggagttgggatcatggggatccgagcactaaacttcctcatgtcgttgactccatgtggcactggattacattttttcactttgggatcatcagcttagccccacggcaagcaagcaactagctcgatcgggtgaataataataatctctctttctttggacttctcgaaactgaatcgagttacaagtccaacacaagcatgaagaattgcaatgggctatcgcaactttcagttaaaaagttcagctaatattctagcttgggcagctggttaatttagtactccgatccctctcttcctaaaaaatatatataggttgtttacgaaagataaaaaaaatcccttttaatcagctaataatcaaaatttaagttttgaattgttggattcccctcttaagcacctaattggttaaaaatgcttaaattttcgtgtattgaaatcattgttccagaaataatgatatgtgtacaaattaaatttaaattgtagaaatagttatatttggggatggagtagctctccggcttaattacatttatttaactgcattgagacaaaattaattcagactactacagcttaattacattgattaattgcattgtagacaaaattcagactctgggccaacgctagattgagttttattttttattttttttgggggggaatgggtaggagctctaccatttttttaataggagagaaaaaaacaatagttcacctcaaggattgagttggatcgatcagatatcattccgaccaaaacaacttgctcgatcgatccagacgggccatcgatgtctgaccggttgtcgacagattcgtcaggaaactcgctctcgcatgcgtgctcccgttactccattgctgggatgcaaactgcaaactcgcaatggcgaattaatcctgacgcgattcatcctctttacagcttagcactactccctccgtcccatgataattcaactcctggattcccaatgcaaacttagtacaaccatgaaaataccgaaatgccctcaacaacaacattacacaggattgtactgggttctctgcactgtcctcactgaaaaaaaaggtttaactggattctctgcacgcatcaattacacaggtatccagcaaaaaaaatgaagttttaaattgaatatgttaacaaaaaattaagaacctctagtctgaaaaaagaaatcgtcaaaaaaaatactactccacaatctacaagatggtttgcatccataatctgttaaaaaatacttctccacaatctgtaaggagtaggaattaatctgcaagaactagaaagaacaaagaaatgtgtttgcatccaccaaggtggcctgtagtcatgtgtgtatttatccagattgaccctgcaagaagtcatcaccaaaatccaagaacttagtatagttaacaaggtgaaagggcagaaataaacaccagagaagaaagagtgatggaaaaagagtggtggaaaagtgtacttgggtttattctaatggcaaagcttctcgaaccacctcagcgctgggagacacaaaatcgttggctccttcatcagatccgccattgcaaaagcttgtgcatcaggctccctgcaacagatccactggcgctggagaccataggcttgcgcctccgccgtcgtagccaagcagcacctacatgttgcgttcgccttctcctgcatcacaatcgcaagaccctacctctgccgccgtactgctagtgcctcatccgagccatctcaatccgccggggctggcgccgcccccgccgacctgtcgtatccatgacatcacgggaggtcgcagggagggagagatggatggagcgtggagggaggggaaatgactcatcgccgtcgagggataagtgaaggtcgtgaggagagggaggagatgagaccgggcggtggtggttttttttttagcgcggttgtgtggtgggcgagaggagagagacgggcagggataaggatcattgaatatttctcgagtgttacgcagaagtcggttttttctgggacaaatcctcaccccgatttctttctgggacggagggagtatgtctgcaggcaatgcaattctctgccgatgcaaccaactgcagcctgcaggattgcaggcacacacgacggaacaaggctgcgcgcgtcttcctccggtggagatgattggttgcgcaagcgcagtacaggcggcgacggcgatcgatcgatctggatatcaacttgcgcagtggcaggaaggcggccgggctgcggcacgcgtgttgcaggttgctgtcagagtcggaagtggcgaaaatattaagcacacgttactgaactttcaataagattttgatgagatcgtagatacatcgttagttttcgtctatctagcatgcgttagaagatactcccttcgccccaaaaagaattaacttagaagaaaaatgtatgtggacacctcatatatccacatacatcaacttaggaggggacataggttaattctttttgggacggagggagtgcattcgtagatgagtatagtattacgtctgtagtaatgtgtgtgcgtctgtcgtgtactccctccacggctaaagaaacaaatatagaaacggatataacatattctaattaatgaatctggacaaaagtttatctagattcgttgcaccaagtttagaccctgtttagtttcaggggtgaaaagttttgatgtgtcacatcggatataggacacacatttgaagtattaaatatagactaataataaaacaaattacaaaattcgtccgtaaactacgagacgaatttattaagcctaattaatatgtcattagcaaatgtttactgtagcaccatattatcaaatcatagaacaattagacttaaaagatttgtctcgtaatttacacgcaacatgtgtaattagtttctttttttaatctatatttaatactttcttcgtttcataatgtaagtcattctagcatttccacattcatattaatgttaataaatttatatagatatatatatctagattcattaacatcaatataaatgtggaaaatgctagaataactaatattatgaaacggagggagtattttatgtatgtatctaaacattcgatgatagggtagaaaatttttacgtgagaactagacatggccttagtaattgagaagaaaaaaaaagttaggcaaggcgatcgatctctccgacatggggagtgattgggaacacctggggccggaaggtgtccgtgcctcggcgcctcagcctattggaatcttcatctttagggatggttgattggttgcttcttggttgcctccagcttgcagcaccggccaccggcccatcccgactgagtttgagcctgccactgccactgcccaggcccacccccccttgagcatctccaacccacacgactcaaactgaaccaggccccccctgtacttgatgatggcaattgcttcgaaacgccactaaatttcacccgaatttcgtcactttcgtacctcattccaaacataactcacttccaacacgagtaattttggatggagattcataaatagaattcaataattttgtgaacttctcatgttgtatgtgtctttattagttggtgtgctcctgtttttttaatgactatatttctttattttgttgaattgctgtaataattggttgtagctccctgaggaaaggtcgggattctattccattatcctaaaaaaaaataactcacttccaacacgagtgctcaatggaatattctatatattctcgcaaaaaaaaaaagagaaaaggatagagtaatatatattcaataaatgagccactttcaggcgtgatcgaacgacacaacattgatgggtgccatacaggcagccaaaaagaatgataaaaacactgaaagagagatcaacgaacgcattgccgcgtgactttacaagcaagtgatcacgccactatcattgacgttacagcacgctaaaaagcgcccaaaatggatcacgaaaagagcgagagagtagaggattagggctaaagttacaacatacatggcccacacggagtatggcgactgtatatgtacagcgacaggtataatcatacaggtgagactcttcagaataccgaatcattgtcatacagtgctccatttcatctcgacgtgtaccatcccgttcctcgagttgatcagatggtatttttcgttgatccgtccgttgttcacgacgtccactaggtttatatccacatgccccaatgattcctgaaattttcggagaaatgagaggttgattttagaaggcactatgaactggatgtgattatattctctctgtttttttttaacaactggttgtgaatatcattatcagaagagatggttttgcaatcagcaggtaacaacagtgactgactgaccttattgcggaagggaagccggagcccacggcgtttgcttactacttcgatgtggatcttatcatccacaggagcctcatcaaccatgaactgaaactcttcgttccatcttggatctcttgttttcttgattatctgaaatgccaagttaaacattttaggttcacataaaagtattaggtagtactactatgttcttaagcgcttttagttggggtataacgtggaactacaacataaagttagtgtggcaaaactaattccaaaaataaaataccttcgtttccttcctttctcccctaaaatgaaccacggcatacggattagtatgacgctttccctcgacgtcttctgcattttctactgaaaccaacagcaaccctccactaggtgggacgtccctttttacactgacattgccttcaccatctgacatcagaatggtactgttgctgtcatctctgaagggatcaaatgtcagctctacgacaagctttcctctgttcttcttgttatgaggatcatttgggtccatgcttttcagaaggtcaagtgtgaacagtttactctcataaggagtaagcaagcggaggggaactacttgcatacccagtttatcatgcattttaacctgcacaaacagaaaaaggaaaaggttattgttatttcctacctatgccaagcaggaaaagagcatagaaataacaattactgctcttacaaatgacaaaccaacttatcagaagaaaagttgcatacagcaaagctaaaccttttcccaatcaaacatgcggagctcaaggatttgtgtttcaggatccttgactataaatctgaagtgttcattccactcaggattcaggttgctcatcttaatagacgtcttctttgaaggcagtttctcaccactcaaacggagcttgacatagggatcagattttccaagcaagtccatcttgagaagattcatggctcgaattacctttacatgtaatattccaactggtttctttgtcgcaccactgcaaatgttccacaccggtaatatgagaaagatcaaattaaactggagtacattcaaaactaaaacaaccttgtttcagctatagaagccccattaacaatgttatttcttttgcactaaatgaataacaaaattatgtttttcccaacatttaatttccttcgccacgtacaaatgcacttcctttttaaacgggtccaaggatagcaatgtttattgatgctaatatgttttctgggagactcttatttccaaattatcttggcaatatatgtctcaaaaagttcatgttgaatgagaatatactcgagatagaagattatcaagatgaagacaggatagacatatgcaactcggcatgcaaatttggaattaataaactcatccaacaacttctcattgtgatccttacaataaaaaaaatatggatgtcatttgtaaagaaaatcacctcgcttcatctaaaataggaatttgtataagcttaggccagtgatacaagtttgcgatttgctttgatattttctcctgtcagaaagcaaaaaccactaataattaagaagtccacaagctaggaacatagtactggtacccaagatagtgaaataaggaatcgtagtagtaattaaatgggtacaattaaactacaagagtccatcaggacgttcaaattcagtgtcctctgtgggaatataaatgttaaagagaaaattagttacccggacaaaccgatgcaagccaggtattgccatgacatctccacccaacaatttgaatccaaagtcgatatgtggctttataataaaataagagttagttttatttacagagttgttttaacattgaagaaacagattaataccttctccatcagtgaaacacacaagtttgcaaagcagggaaagcttggcacaagaggcttcagagtcacacgtggtgtcagcattatatgtaaatctaaaagctgaaacagaaatatgatcagtcagaggactaatagtccattctttagaacgagataagagaaagctaacctgagccgacacttggaaagaatgcaccttcactttcacaattacatttgctatgctggcccaccgaatcacaggttcaattaccaactctttttctctcatttcataaactttaattcctgcttgtcaaaatatcgagtagtataagaatcaatcaatcttaacaagagttgactgacagcgtaagtgcagactacagattttgaactgctctaccaatctatattatttacaacatagacttgagttatacaaggatacagaaacactgtacttataatgataatcatgatttgaggatacaaggtctgtgtcactgaacaaattgcatcattacagaaagtactcttacagaaatcaacagaccttggaacgtaggaggaagagccccaagtgttaagtgcccaaattcaattgattttattccatattgtccaacatattgatcaaatgttggtctgattacacttcttattgtgttgcagattgcctgatcaatgagtcaattgagtcttaaaaaaatgaatcaattgaattacccaagctgacaatggttcgagaagaactctcaacgctcagatgatgaagcactgaatattacactaaaacttggtagcaaacaggccatataagacttgaaaataccttatcaaggaagggccacatatcaaaaataaacttgttaatccagtcaacctgcaaaaacataaaatgaattctccatttcatgaattgagtattgtgtctttaaatgaactatatgtaatgtagcatttatggtgtggataaaaagaaacaagaacacaaaaataaatacaaagtaccagcacacattctctcatatatgtgcctcagtcctcaagagcttggctatttagcaatttatcataccgatcaatatgatttcttgaccagattgctaagctaaaagaaatggaatcctacaatagattaggataatggaagctgtcaccaccaacagcgtaatcctctctaatttcatttgtcaaattttggtattaacatattgtatttatctctctatgaaatattttttttttaaaaaaagaaatactctgaaaaggggataaccaaaagatttccaaataaattgttgatatgtgaaggtgtattctaattttttttcttttcatgggaaatacaaagatgctaagataattaaatttccataaaagttacaaagactccatatataatatcctacactcatgttactcaggggcctgttatacatacttctatattatcatgaatgctcacgccttgttgtactgttgacatttgacaactaaacagagattgatttacgacacacataatcccaaagcaacaaattataagtcgtttaaatagtagcgcgccatgtttatatacccacccgttcataatctggacacttcacccacaacggaatatctggtatagttgtctgtaatgtctcagaatccaagtcgcgtagtggtctaataataggatcctgcaaaagtcaacagtcagtttccctcaaaaaatgttgagatcaaatttgtactatagtatttactatttgggtttgtgtaagattttgaatattaatttatgttgaaccctgcttgatagtagtatgtagtaaagcagtggagctcaagaggatcaaaccgtctgaatctaccatagttttctggaccctggagaggcaggttgaaaatgcttatacagctccatccagtattgaccattggttgcaaagtgaaatagtggatatccaacttgactttcagtcagattaatgtcaccaaacactggtggttatgacttttcttttacttagcatagtggatttgattatttcttttcttatgaagtaagtaatccaattttcgttagtctcaacataaaagggtgcatcggagtaggctatatacattaagcaaataaccaagttggatttttgctctgtcgcatctaaccatgtcgttctcattccaatgggctaacccaccctgtaactagctgaaatgattctaaccatatcagacaaatatcatatgtactactaggctaattaaataacacgccgtgcactacaaaatattctgtattcatatgcaccaacccgtttcacattgctaaaccaaattaattaacaaatgcatataaaatacatcttgtgtttttcatgtatttggaatattcgttcagtaatcccatagcaatcccacttgtcccaaataatcccaagcaaactcccccagtacacatcaatatatcgcaatctaataaaatccccagtgtctagctggcgcatcgaaattagtcaattttattgaaacaatctcactaaggaagcatatgtcagctcacggaggcatcgcaattggcaagccggaatcggatacgcaagctagcaaagcaaagctgttcaaagctggaactgaaaagtgagtactggacggcgaaactggtaaagagacgtgcttagtcagagctgagaaatggcactactccagcaggggaagacaaggactttggagcacacgtaccacgtcccgttttccccacgtcgcatcctgaacaatccggtagtctaatcgtacgggcagaagaaatcaagcacgtcccaatctcggatttaatttctacaaccattttgttgggttagttggtgtgcacaaaacctcgatcgaaatccatcctgctgctgttcatgagtaattttgatatgataaaccgcacacaaatcaacaaagtgacagtacacagataacgaattgctaacgatgaatgcgttcaactaaccactaaattgctaggattagtacaggacgggaaggatcgagaaggaaggaggcgatggatggactgacctggagacggcggcgaggggcgaacaagcggaggtagacgaggtaggcgacggcgatgccgagggggaggccgacgccgaagccgaggaggccaccgacgagccccatcccgttcccgcccgctcccgcgaatgcagcggcgcccgcggcggcaaccgcatgggaaaccacaagacgacgatgggttggtggccggccgcctcccctccctccccagctacccgccgcggataaagtaatggccggccggcgaggcggcgagctcgagctcctcgcctcctcggagacgtcgagcgagacgaggcgtgagcgggagccagcaacgcgccaaaagcttagtttattgggaggtagcggagaagcggatgcgggagagacagcggcgtgggtggtttagcttagcttatatgggtcgctcgccgccgcggcaaaaatccgcggaaatcctcgcgtttccggcctcgccgcggcggcaaaaatccgcggaaatcctcgcgtttccggcgatgggtttcgcatcgcgcgtgggcttttgcttagctaacaaggctactacggctcagggagggggaggaggaggaggaggaagcccagtttcttgtctcgtaagaaatctccggaagcttcgtgggtttagtgggcctggcccatgtagggtgaaggttgggcccacgctggtaccaggattgcgagacaagctgcctttaaaacggctggccttctcggcgcttctcttcttcctcctcctcatttcaaattcgaatcagggcgagttggcttctcggagaaggcagaggagagagagagagagagagaggcgggatggtgaagcggcagcgggaggaggagccggcgacggccagccaatccggcgacgacgattccaactccgacgagtggaaggactttctaaacctagatggtggcgaagaggcggcggaggtggacgacgactgcaacctggcgccgccggagaaggatgcagaggcggcgaaggcgagccaatccggcgacgacgattctaacaccgaccagtggaagggctatctaaatctagaagatggcgaagaggcggcggaggtggacgacgaccgcaacctggatcagccgccggagaaggatgcggaggcggcgaaggtggacgtcgaccgcaagctggatcagctgccggagaaggatgcggaggcggcgaaggtggacggcgaccgcatcacggcgctgcaggagaaggctcgggtgcgcatcctcgacttcctcccgatcaagtcggtgatcctcatgggttcgctctgcaaacggtggcgggagatgtacggcctctactggagggatgtcgccgtcgacgtcgagctccccaccgacggcgatgcgctgagcaagctagaggaacgcgcggggcagcaggagccgaaacgccgcctccgctacttcttcctcctcgtcgtcgagagaaaaaatgttcagagagaatacttcaattcctgcctcgaatacgccggcaagtgctctcccgaggtcatccacatcagtgatcgaggaggagcgggccgcaagtttaagatgcacctgacgagcaaacagctcgtgcgcctctcgataatcggcgtcgcgttgggtcatttccagggcaagttttgtgaaggcgtctccttccccacgctcgaggaaatccacatcaagaactccactatcaataaaatggacgacctcaagaatctagtcggcgcgtgccccatcctccgcgtcctcgacctgcgcggatgcaaaaccatcacccaaatcgacgtcgacaccgctggagagcacctgatgagcctcaccgtcatggactgcgaacgcgtccgacggctgaccgccggcaaacacctgcgctcctttcgctacagcggtaacttcctgacgtcactgtcccttccggacaacgactcgcttgccgacctcttcatcggcttcccgagaagccaatctaccaccccggggcccgaaaattcgttcaaacgcctcccagatctctcgaacctcaccttcctcaccctgtgcagcacttctctccgggttcgttctttttttttctctcgatcatgttaatttcatctgatttcattttcatctcaatcgtgttgtttccacttgattcacaaggttgtttgctacttctgattttcaggctgtaactgtggcgggtaataccattcagacaaacttgaggagtttaagagagcttcagttgctcatgttcaaattggaaccgatcaacctcagtgacgttcgtcgattcctgaacacctgcggctactaccctcagctgacgaagctctttgtgcaggtcaccactcaccacctgctattccattgcttgcattgcgtctcgatctgttactgtttgactattttgtctgttcgagtggagccaatgttagtatagtttcttctttctgatgattccaaattatccctttgtgatttcagctcccagaaagagattgcacatacacggagaacactagctcagagaatgtggagggggaacaacaggatggcttcgaaaagcttgatgtggtaaagatgacgaacttcaagtacgactggaatgagattcggctgctgcagtttctgttcaagaaggccaaactcctccagaagctgatactagttcgtcccataccagtaccggtagatcgccccttccgactccaggttcccgcaaatgtccagctaactgattgtgctgatgattctacagtcaagtcatttcattcagaactccttacctcgaagacgaactagtgttcagtcaatagtcgagctgcttatagttctacagatctggagcattaataggttggaaaagagatacaggacaagataacatgtgcagaaacaagtacagtctcgtcataccttgatttcttttttccttctgttttacttgaaaaaaggtgattgaatgacttggtatttcactgtcaatttatgatgtatttggcattttagcaactttagctatacatatgagtttacagtgaaatatgttcttacctacttctgtggaaaaaggattagtacaaaataaacttggatgcagaatccttgggcactgaagtggttcctttctgtgttcttttgccacaatgcgagttacaactgaaattttaatcatccatgtgtaaattgactttctgtggatgtgatagctagatattggatattgtcatgtcagttatgaggtttactaattgtttcttgtcaatctgaaaagagtttaggagtttacctgaatgtaatttgttctgcattagcatagtttagttatggagattgatgcggaagctgttatgttaaacctgaaagttgatcctgtaatgtaaactgaactttgtggatgccatagctagttttgaatatttctattgtcggttatagggattactgtcctcctcaatttgacaagattacctgaatgtttgttctgtgttagcataatttaatataggcagactgatgggatatatcaaatgggagattctgccattgtacctcatagattatttgtttactgatactagttcaagttatgaaatgcttgatgtgatcctcatgagccatgatactagtactgaagagtatagcaaagtatgaaatgctagatgactctgcagatttttgaagatttgtagattctcctctgcctgttctttccatttagcagtacaagtcaacatatttgtttcggcatatgtttgcatcttaactgacaccatataccttgtctttttcaaatggtgagttccataatggagtaacagattaccagtattttcacctgtagtttcatagttatttgatccatgtttgcaaagatcaaaatggacaaaaacaagagcagtgttgtagctagtaatttcgagatttttaactatttggacgggttagtgtctttgtttttatcgtttggaagggtttggatttcattcataagcatgaaacttagcatagacttgcacattaaaacatgacatgagaatgccatatccagctgcttggattgtgcagttgttttagctaaagtattatgtgtctgtaacgtaattgtgatatgtgatccctgccgttggaagcatatggactcactcaccctacagcaccactcgcaagagaataaaatgctacacaacctcatgtgttatgcaaatcaaagaaactgaaatgaaaacggaaacccagtaaatgagtataaattggggaagtggatttttgtcccttgaggggacatcccctcgtcttgtgcatggcgtttaaaagttatcattttttttaaaaaataatgtcaagatagatcaatatatggtatatcttttcgcgaacatgcaagttaaaattcgacttgtgcaattgaaagcaaaaagtaacaaatttgatcgtgaattaccgttctatttatagtcaaatttgttattattgtttctacttgtataagttgaattttaatatgtatgtttgtgaagtgacatcacatattgatctatcttactatttttttcaaattttttaatggatttttaagtgacatataaaaataaggggatatcctcttgaagaattaatagagttttccataaattcgtgacaaactgaaacataccacatgattgcaattctgcatgccctcttccccttgcaactcccatcaaacccgtataaccaccacaagttcactgtcatattcaccggcgtattctcacttgccccttttcacttgtttaattgagtataacccctgtgcacctctattcttgtgtgactaagtgcaggattgcagttcctgcattaggggatcacactgtaacatctggattcgagtgaaattccccccaaaatgatgaaaacgttcagcaatgtagcaccctcaaacgctaaaaaaacaatggctatatataatcccccgaaatttccactcatcataagcacaaggagtccacaaccgccacaaccatcacaagcactactgccatgacaatctgcccgaggctcgccgccgcggcggcccgccggtgcgcgctcgacggcttgggtatcgtgtccgggagcgcgcactcctcgccgtcgaagtagagcctcttggggaagccttcccccttggcaatgttgacgttcggcgcgtccttccgcgagaaggagatgacggactgctgcttcccgggcacccttgggtcctccggcgtcctcccgtcggtgatcggctcgaggtaggtgagcccgggcaacccctgcatgaagatgctgttgttgaacggcgcccccatcttggtgccgttgaaggagtagacgttctcgtagccgctgtagtggtcgcgcatggtgacggcggcgaaccagtccttgaacgtgtagtcctgccagttgaagatggtgatccgcgccgcccacccggacttgtagttgttcatgatgtgccagttgacgctgaggccgcagttgtcgccgcagggcatcgggttgggcacgcggcggtgcttgatcttggcccaggcgcgccccttggccgtgcggttgtcgaacgggatgagcagcgcctcgggcggcagcggcgtggcgcgtgcgtccgcgtcgcacgtcgccgtgtcgttgccgccgccgcagccgccgcagctcgcagtgcgcaggtgttgcacggcacgacggagtcgtcgtagtaggcggagaaggagacgcagcacttggcggcgcgcctcttggggcgggtgatgttgcacgccacctgccacgacgcgacggccggggtggacgacatgagccccgtctggtcggggaacaccacggggctcaccctcaccggctgcctgcacgcgtactgcgggttcagcttcccgatgatcttccagttctgcggcgggtacagcgccgtccggttgaggtccggcggcagcttgaacacctgcatctggaacacggcccgcgacttggactcgtccatggtgggcggcagcagcgtgccgttcttgcagcagaaggggatgttcccgacgtccttgtccttctcgcgctccggcgggaggtccacgacgatgggccgcttctcgcagctgtacgccggcgtgaagtcgaagtccttgtagtagccggcggcggggctgtacacgcaggcggggccttccttgttgagcgtgtacgcgccgcgcattttgtagatgaactcgccgcgcttccactcccaggtgaggttccagttgtcgagccggccgatggggctccagttgtcgatggtcacctgcaccatgtagttgttgccgaacgcttggaggacgtcgtaggcgatggtcaggtcggccttctgccgcggcaggtagcgggtggtggtgttcaccttcttggccttgaattttgggtccttgacgcagcacacgtacatgacgctctgcttgtgtgtgggcttggggcaacggaacccggggttggacagcttgatggtcctgggcatgggcgctgtgggcggcttgacgccgaactgggtgccggtgatgtcgatctgggcctggatctgcgtcaggtcgccggcggtctcgatggagttgaggaggttggccatggggtacccggcgaaggtgacgccgccggagacgttggcggggaggtcggtgccgtcgaggagcacggcgccgccgacggtcacgaggatctccttgtgctggaacccgacgaacatctgccacgccttgaggtcctcggtcatggtgttgagcaccgtcgccgtcgccttgaacgcgaacgcctgcgccgtcgcgttcttggtccgcgggtactccttctcgcgctccgtgaacgtgtacgtcaggaacgcgccgttgcacgcctcctgcgccttgaacgacggcttctcctcctcctcctcatcctcgccgtctccgccgccgccattgttgtagtcctgcgcacgcgcgccggcggcggcgacggcaaggacgacggcgacgcctaacaaaagcgccgcccaccgccgccgaagcggcattggcacccccgtcctctgcccagctaagcgcgaacggaggagaggcaacaagcgttcgccggctcgctcgaccgatcgaccgacgggcagtggtgggaagcaaaggcgttccagcggaggaggaggaggaagaaggtataattaggcatgcactgtccgtggtggcagctcgctaaaatcgaggaggcctctcgtgcatgcgcgcgtgtccgtcgcgttgcctcgccgttgatggttgcagatggccgacgctggtttcgcgtggctcgtcggacgaccgagtcaaattgaccggatttggacaccgtcgttggcgctggttcgtctcccccgtgtcaaccgggcacgagccatatatattctaaagttattcaactggataacaaacacagaggaatatttttgtttcttttcaagaacacagaggaatgattttgcctaggatgcgaattttcgaatatttttttaagaaataatacttttttaaatagaggttgacaaattaaaattgcaagtttaggccctgtttagtttccacataaaaattttacatcctgtcacatcgaatatttaaacaactacatgaagtacttccttcgtttcacaatgtaagttattttagcatttcccgacataaatattatgtctatattcattaacatcaatatgaatgtgggaaatgttagaatgacttacattgtgaaacggatggagtattaaatataggctaaaaaaataactaattgcacagattgcgactaatttgcgagatgaatcttttaaatctaattgcttcatgatttgacaatgtggtgctacagtaaacatttgataataacggattaattaggcttaataaatttgtctcgtggtttcattgacggattctgtaattagtttttttattactatccgaaataccccatgcggcaccctatataatacccgatgtgacacaccaaaagtttacacccctgaatctaaacacccctttagcaccccatcgaacaaccaaaattcgataggcgtacatatcgatcaacacctgtggaaccacaattgttcgataggggataaaaaattaaaaaaaaagaacaaccactatgtgccactgtgcatgcagcacatatagaacatccacaattcgattggccccttgccatgacctttc

SEQ ID NO: 65469 - DNA, 22899 bp, Oryza sativa
aagtcaaatacattcgactaacaaagtcgacaaaatagaactccgcacgctcggagtcaaatacattcgactaacaaagtcgacaaaatagaactccgcacgctcgaagtcaaatacattcgactaacaaagtcgacaaaatagaactccgcacgctcggagtcaaatacattcgactaacaaagtcgacaaaatagaactccgcacgctcggagtcaaatacattcgactagcaaagtcgacaaaatagaactccgcacgctcggagtcaaatacattcgactagcaaagtcgacaaaatagaactccgcacgctcggagtcaaatactctcgactaacaaagtcgacaaaatagaactccgcacgctcggagtcaaatacattcgactaacaaagtcgacaaaatagaactccgcacgctcggagtcaaatactctcgactaacaaagtcgacaaaatagaactcctcacgctaggagtcaaatactttcgactagcaaatttcgacctcgtcactccttcgaaaggtgaggaggacggcggttttcgaactattttgccttagtccaaaaccagctcaggaatgctcgaactctattctcgttcgagctcaaaaagcggaaaatcagcgtgacgaggtaaaacacgtttcgacctcgtcactccttcgaaaggtgaggaggacggcggttttcgaactattttgccttagtcctaaaaccagctcaggaatgctcgaactctattctcgttcgagctcaaaaaacggaaaatccgcgtgacgaggtaaaatacgtttcgacctcgtcactccttcgaaaggtgaggaggacggcggttttcgaactattttgccttagtccaaaaaaaccaactaaagaatgctcgaactctattttcccctcgctcgagctcaaaaggcggaaaatgcacatgacgagataaagtacgtttcgatttcgtaacttcttccaaagataaggaggacgtagtttacctaagggtgcttgcacaattgaaataaagagcatttataaagaaaagaagaaaggaagggtttatttgatgttaagaaggtataacaagttacatacaaactctacaaagaagaaagaaaagagtcgggataaacaatgttgagaggagaaggcattactgtatatgaaactattgaataacgccttttccatattctacgttggcgttcggatggttggaagttttgccaaaaggctttactagcaagattattgttcgaacgccgttccctaaactcaagtacaaagtcacgtaaactgtcatgtcgatggcttcgttgccatcggaaaaacttaaaagcaaatatacaagtattatcataataggcttcgagttcgtcatcggagatggcggtcctggcagaagaaagctttgcagggtctcgaaatgctaagtgcttcacatttcgagtaggcaaagtgttgttgcgtcgaatcacaagttttcgattcgagttaacctgcagccccccaaagaaagggaatttccatgaaaagcatgcaataagagaaaagcattatagtcagctacactataaatttttacaataaaggctctcaaccataacggttttgaagcagcaaaatagcattgttttcgaacatacgaagcatccttaactattcttttcacgaacgtcacacctgtgcgctcgagctcggagtactactgtctttatcttgttggctcgaactggccggctgtgactttaatcttgaggcaagagatgctcggagagacctcagggtatcttcatatcctttcttcttccagtaaagcacttggaaagcctttacgatgggttgagctgcatctcgaagctgtgcaaatttggcctcatcattaagcataccttgtatatcagctttaagggtggtaaagtgttcacacccatttgaacgcagacaggccgaaaggctctccacagcagttttcgagcagcgagatgcaaagggagtaacgctatcttttagcccaatggaaaattcctcgaaccattttcccacagctgctaaagtattttcttccgatagcaagctgatgtcagcccctagacttcgcaacgcgattcgaacggtctcgcaacttttcagaagaagttggcggcaactttcgttctcgagctctaaagcagatatcttctcgctttgatttttgcaggcgagttcgagttctttattcttcttctccaagacctcaacttgttccttcatcttgtcttctgattcagcgcgttgtcgagcgacgtcttgatactcgatgatttttcgctcgaatgctttttcacgagcgagtaatttcttcttttcctcagtaagcaacttcttttcttcggaaagctctttcttttcgccgcttaacttgcgcacgagatcggtggtgattttcttctcgtcggccattcgatcaagtttgcagcgaagataatcccgatccttttcgagtttagcgatgcgatcaagtgatttcttccatcgcgtgcaaatagctcgaagagctttccgagcaacaccacgttgaagacgagcaaggctcgcagtctgcgcatcagaaaataggttttaagtcaaaaaaaatacctgtgcagcagatacatcaagtgctgcccaagaggacataagatcattttcttccaaaaactccttttcaagatcaggagtaatcagaactttctcgagttcatcaccaatcgaactcagggggtggcgatactttaggtcattcaaacacaagtttgggccatgatggctactttccccgagttcattgaaattaggaagacccataagccaatgtccatcttttgcacatcgttcgctaaaaccaccaagaacgttttgtatcagctctggggaaggggttgcgatgaacggcagtgacggaggtggagtggggttcgaactacctgtaattcgaacacctccatcagcagcactcttccctgcttcggacttttcggccgcattgacgggcgtttttgccttttttgcaaccaaatctctatcagctcgaagagggtttgttgtctcaacagtatcacccacttgggtcgaacaatcttcatcgacaaccgtgttggctggggcaacaacatacagtgaagctacttcttttgtcgaaagggcaaaactagcatcagctcgaattggggtgacatggatggcagaaagatcaatacggatatcatcttcatccaactcttcatcactgtcaataacaagctgcactcatttagaactcggttcaggcggaggactgctggcagttttcttccttttcaaatcagctaaaacagtaggaggaggaaccgttttgctatcatcagattcagacgagtcgctcgagttgtcgctcgaactgttactcgagtcgctatcatcactcgagtcgttctcttcttcatcagctccttcctcgccttcttcttcttcagcattttcttcaccaatttcttcgtcaacatcttccaattcaacatcatcatcatcatcatcagaagaaggcttcacagatttctttttctttagtttggggacaatttcaggatgaacccggacagggatatcggagcctagagaggcgaagacccgattttgccttttcccgttttgaagtgtcaaaaatttcaaatgctcatccttggtataagggccaagaaatttccgaactgggcggaccatatcctctggaatcacaactacaaggaagaagataacaaagggagaaaataaatcttcttaactaagtcactttttcaagaaaaacaaggttcgcaaaaaatcaagttcgaaaaggaaacttacgatcagacgaaaccacaaatggaggaagactggaagggcaatcttctgggatttctccaagagtgatatcccagccgctcgaaagaggcctaattttgagaagaacaaactcttccaccaggtctcggcagctaaagttcgaaacaagttcttcgattcgaggttgtatggcagtgaactccggcgacaaagagactgatggctcggagacagctttcggtttcttcccagagaacgaaaaaggacaatccttatcattcagcaggctaacagggatttgatgataaaaccacttcgactgccacttgttcccccattttgctcgaatagcagacacagctggccatggacttccgcgcttcggatgaggagcaaagtttacacacccaaacttcgagttctgtttggtgtagtgccgagtacaatggaagtatgcaaagtcttcagcttggagagtcccaccgcagcttcgaaccatctattcgaaaagcccaattcgaactaaagcattcggagtcaattgaggaaactcaagtttgaacaatttcaggacctcgaccaaaaaagtgctgcacgggaatttaaacccggcgtagaagaaatcctcaaacacaagagtgtatcccagcttgggagaaggccttgattctcccactggtcgaattacaacatttcgaccagatatccaaccaacatcaacaagatcgtttaagtttttgtccttaatcaaagaggcaccaataccacaagaagtattttcgtggttttttgatttcttggacttcgacttttccgcagttttcttgtttttccccatgttgtgtagtgagaaaggaagaaatcaagcaaagcaccaaaactcgaatggaagaaggaagaaagagatttagttcgagtcttttgtgatttcgagttgatggcagaacaaacgagtggtggcgtaggtcacgtgatagcgacccctcctggccttatatagcgcagggtggtaagggtcgcgggtttacgagcggacacgaaacccaaagcgacgcgaccccttaagcgcaccaatgaaataccagcacgtggcataaaaaaaacaacatttaaaaaataataaataaataaataaaaataaaaaataataagaataaaaataaaaataatgaatagtaaacgtggcatatatgcatatttgaatagtgtgtttcgaccgaataggaggacggcggttttcccccttttttccataaactcaagcacggtttcggccgaaaatacacatcgcccttacccgtgaggggcttgttgtagcagggtgcaaacaccttttcctccaattcggtcaaaacactacgaggttttgcaagacctaagtatccagaggggaaaacactcattctgagtggaaactaccttttcaagaggaagaacaccttcccaaaaggaaaataccttcctagaggaagaacactcattcgaatagaaaatacctctttgggtgaagaacaccttattagggacattccataatcgctaatacaactacacatattttggacaagttacaatttcacaggtgttttccaaggatgaaagagaaggcaaagggggaattcgaattcccaggaggaagaagacggtccaggacggaaaatgcatttttcccaagagttcgaggaagagcactacccgaacaagagaagatgccaagggaagattccctggggaccaccttcaaccactctcgccagctagcacctaaaagactaaaagacccctggagatgtactagaatgcccccacagacgctgatgtggcaggggcattagagtaaacttacaaagacccacaggggtaaaaatgtaatctcacgtgtacgaccaccggtaataaaagccagtcaaaaacctgtagcaggacaagacatcttgaatacaaaagtaatcctcaaaagttgtgtttgctgttcgagctcgtttctaaggataggcgggaaaacacttctttccggcctatccccgatcttgttcgtgacctaaggtcacaacaaatagccattggattaaaaagcaaacaaaatagatgaaatgaacatcagccgttggatgaaagatgatcgagaaagaagattctggagtatgtactactgcatgaagcaaaacttattaatgaaagtgacaaaatcaaccaatcttacaacatgccagaagaattctacaaaagggtccactgctagagtagttctgaaaaatgcaatagttaattacataactttaacataatcatgcctttttatttccttaaaaacgatggatgaacttagagagaatctactgtatgcataaaattccaagttgaaattcatactgtgttgagagtaacaacaagaaatgcaatagattaaaaagaagaagaaaaaagtcaaatgctacagttcacagcaaacttacctgtcttatgtttgcttgctagaacactgtttgctacatcatcgtttcttttctcttgaatttttcatataaaattgacttcctgattttattaatagcagcaaccctattctggagttcatctggacaaatataagggcagtgtgcaaaccaaaacataggactgtcggtttcaaaagaagaagaagaagaagaagaagaagaagaaagaaaaagaaagccataggattgtccatttacccaagaaatctatttttgacaggtttaccatcatgacttattagaagagtgaatagaccatcaatagcaacagcccctattaacagtccctgcttcactgaacttgcgttctttaattatgagaaaggagggataagaggttgacaatgataggttatagaacattaaatgagtctaaggaacagaggccgctctcccttgtacattaacacatggtttccaattccacaaacacttaatgatcaccaataattctaatcaagataaggatcaagcacaagaataccataaaatcagcacataatgctaatacccagcacctcagagacagatggaacactgtgtttgttatgagtcactatctgcatatgcacatgatgccatctgccatccgataacaaatctgggatgttgcgactataaatatcgattatcaggtaaaggagtgaccaacgttagagcaaacgttttgaaagctaactaaaataaaagggaccacctatatatttgtcgacaaattttctagtaaaaatttgacagatgtaattatagtacaatcgtagtgtaattacactataacttgtatgtaattacactgtaacttgcatgcgactatagtgtaacttgtatgtaagtttcacgtaattttgaatcgttagatctattacaagatttgttctggtgaggaagaaaaaaatcatagcacacacatatgtgaaaggatttgttcccacgacctctattttactgaaataacatgttaccgagagattcttgaaagttacatacaagttacattatagttacagtgtaattacatgcaagttccagtgtaattacactacgattgtactgtaattacatctgacaaatattaggggaagaaatttgatgacaaatatctagcaaaatcgaaataaaatagataaatctgcaggtaaagtaaggcactctataaaagaaccaaactaccaaagcttgttttgtctttcacattcatttcaactcatgaaacgattgaccgaagcaagagatgttattgcataaccacataggcctagttaatatatttctgacatatatcattgcttaaattcctggaagtcatagttatgttgagcagtttggattattcatatcttcaaatatacccagtatgcatgggactggttaaggttccaactctcgatatgagtaggtacaacgtgaatgtcgtcaaaatcagatctttttccaaggtaactagctgggtggcccgcgcaattacgcggctattatctatataaaattatctattttaatacgattttatttaaaatttattgaatagttatcttgttattttaatacttttaaagaccaaaccatatcatctccgtgtttaattttatagtttttaaaagtcatcctattccttatctgtttgcttgatctattactatttatatttattctcctcggaaactttaaaattttgtttttatagtttttagagtttattgtctcattgagtttcgtttttataatttttagaagtcccatcaaacattgccactctattcctctactgcccatccgctgcctcctctctttattattactgggatttttaaaatcgaacataattattatttgggttcattttttactttttagaagtcccgtcaaaccattagcggctttgccactatactcttccacagctcgcctgctacctcccctctttattgtcattgagattttaaaatcaaatattattatcatttttttttactttttagaagtcctgaacttttaaaaataggacctggtagtttttagagtttattgtctcgtttagtttttagagtttattgtctcgttgagtttcatttttataatttttagaagtctcatcaaacgctgccactatactcttctacagtctgtctgctgcctcctctttttattgtcattggaattttaaaaatcgaacataattactgtttaggtttttttattttctagaaaatcccgccaaaccattagcggctttgccaatgtactcttctatggctcgcatgctccctcttctctttattgtcattgagatgttaaaatcgaacattattatcattggtttttttacttacattttagaagtcctgaacctttaaaatttggaccttgtagattttagagtttattgttttgttagatttcatttttataatatttagaagtctcatcaaacgctgtcactgtactctatgtaccattgtttagtactaaagatacaattatattacatgtatttatgttatcaatcttcaccgttctaatttggttctaccacagtctaacggcttggattttattcttcgattaacgtgataatttataattaaaatagtcttcacccgttgcaacgtacgggcaatttttctagtataataatacttctgagtttcttttttcacttaacaaaaattctagcatgaaaaaagttacaaaactcttaaaatttctactattagaaaccatatataaatgcattgtttactaatagaaaaaaaattcctagcaacataatcaccttgaaagattgaatggcaacatatactgatatacagtaacccgtgtatgtagttgtatgagcgttttcttgtggattcaggtttatgtttgctcagttggttgctttaaggataacacgatccattaattaagtccatgtccgtttcacacgctaaacagccccatgtgaaaggagtccggatccaatacaaagttgaattttgtgcttatacatctagtatttgtcagtgtggactcctaataggatttatgtaaattttttctctacgtatatattccatcaatctcaaccactaaaatctagaggtatcaagatctaatggctaatattttttctttttctccaattaacgtgggattttctagcctctacatcgaacgtgatgtcttcttttcgagctgtcttaataatataatagatattgataaaaacaataggagtcattgccccaacctaaatggcaaaatactcatttttagtcatagaacattaaataacactaacccaccatttgatcaatttcagggtggtgcttctttcccttgtcgtagtacatcatgatttcgtccagtaaaactcaaccacgggagcgtctcactgtctgcaagcaagcaacaaaaaatcactaatcaccacattttacaccctcgaggatcagtttcagaaccatcaacagttgaatactggacaaatctctcagctttcatggcaatgctcatgtttcagcacacacactcggatacagtatcaaatttgcaaagggagaaggcgtctcatctgataacaatcaccccatcctctcaagctctgacagtccttccagtccaactatccaagacccagtgaagcagcaatgctacgttagagcccaagactacacgcatactgggccacaaacttttcaggcccagtactactctgcctcactgagccgcgctcgactgggcccgtgtaatgctattgttcttttttttgacgtaaaaaatatatttttgacgtaataatgctattactctcgttcgatgtcggcaacagtggagtgagcaacagagtcaacggccatgcacaagcctgcagtgcagagcacagtactgctacgtccgcgacatgtcaagcacgagaaagctttggtaccggaattcagcaacgccagtagtgacgagtggtcacgagctagactagcacggatcaacacacagaagttcaagacaaaattggttctggagcattgaaagttgtccattttgattttatagcatccaaagttcacatctcattttgatagcatcggaagttacatccgttgcttctttttagcattccgtccaaacttccgttagttttattttctaattagtattattcttcaacaaaaaactaaatcaaaccccaatggtggccctcttcctcttgcttgtcacctccaaacagtagtcgtacaggagctcagagcggtcagtcatggtgcgaacacaggatcgatgctggctccacaagctcgtcatgtaatacgtacgtgagcccagcctcacaagctgatcatccgcaagccactgtgttcgtccgcgcttgctaggtgtgatctatccactttctaggctctagctttgcccggacagcgccatcgtcgatcgatctcatctgccattccgccatgctagagcttgttcaaatgcggctgtgccgcttccgagttcgtccgcgcgcactgctctcggtctctctcctagatgcgtcatccgatccatgaatgcccgaagcgaagcaacgtcctccagattattatcggcacccttgagctcgctccgatatgctgctcttgagctcatccatcggcccccgaagcaccaccctcgcgctcgtcgcgggctcgcctgagtaccgacccgctcctccttgccctggatccgttgtctgctgacccaagtcaagagccgccgcctctagcttgccagaaccagccaccatccaaggctccaactcgctcagcgctatactgtcgtggtcgagctcacctgctgccttgaatcgaagagtggtcaaccataggagggagagtgcaggaggaacaagacagatgtaggatggggtgaggagacgaactgctgacggaatgctaaaaatagtaacggttccagttttgagtgctattaaaatgaaccataaacttttagtgctatgtaaccaaaatcgagtactttcgatgccatagaaccaattttgccaaagttcaatggcctaatcttttcacttatacttatacttatcagctaaaatttaaatttatagctttaaatttgaatttaattttagactttttcatcgtagtttatttttagcctttgtttttatatcgttgagaacacgtatataaaagtagttattcataaattatttttttatttgtaaatactcactttattcacaaaagttacgcatattagagcaggtacaatagcaagctacaaaccagctataaccacatatcgagaaaaaaaggaagagagagaagaaagcgggatatagatttgtagccggctgcaagacggactccaagacgttatgtgtatgagatgtgggaccaagtattaatggtgtagtatatttttatagttaactattgtatgaatgggctattagactagttatagatgatttggagccaacagttgactatactattaaacttgctcttacttttgacaccaaaactagggaaaaattaaatcaccttggatgttacaaaatcaatgagtgaatgcaaacatacaaccaatgagtatttagatgactctttggcttctaataaaactcttcatttaagttctgaatatataaagactacaaatagaaatagcttattggaaaaatttaaatgtaaaatatgtataacttttgtggacgaagggagtatatcgtttgggttattccgccgaacagccaaacgatgggctgcaaaagtctgagtccgcccgggcagacgcggccagaagcggcgccgtgcatgctcgggatccggaccacaccgacggtcgacgactcgccggagcgcgcgcctcaagaacaaggaaaaaagagaaaaaaaacacggcgtcgcgcgccccgggcggcggccggcgcggagcggaaatcgagcggcgagcatcgcgcgtgcgcccgtgcggcgacatcgggcgcctcggatctacccaaccatacagatgcagcagctagcagtgggatcatgtttggaagttttattattattattattattattattattattattattattattattattattattattattattattattattattattattattattattattgtcttctcacgggcacagaaagataggccgatcgatgagagattaattaattaactagctaaacggtggctttaattctctgctactggtgtactaactccaaggtgcattggatggattgatcattagctgattgattagggttttaattaatcttgagctagctagctacaacgatctcgatcgatcgattgacctgccgcttgttttgtcattgttttcttgcttggtagcagaagtacagtacaagcataagtaaactgaaatttaaaatggatctacgaagaaaccattgatgagtgcatggatatatttgtcaatttcttgtatcaatttttctgatggtactgtgctgtgttctggcttggttttttatgtatgcatgcccacttgcacgcgtagaacttgttctacgtacgccacctttgacaaccttgccgcagtgcatacgtaacgtacgtacgtactgtatagtggtggggtgtcggtactcgcgtgtcttcaatattgttgtgagcaaaatctacgtgtatacgtagacgatatcaaagtaatacgtacacgtactaacctactagctagatggcaaatggacaaaccgtagtagcagattttgatgctcaacagatcgatcacatgcatgttccaatttgaacgggagaaaatactgaaatttaagtttctttcacctgcagacttagcttttcaaacgctctatatttttattcaaaatttgaaaatatatctaggttctctttaattagtataactccagatctcatatccatgttatatttgaaatttatatgtaaattatactggtttaaaattttatatgtttcataaaatgagaacaaaacgatttatccaaatattattaatgctatccccagatccacgaattaatggagctagagacaccccgatctaaaaattctcgagtctgaaattgtgcaaaacgggaattaatgtagttacgtggaatttagaaaataagttagaaggtaaaggttgaaaaaaccagcttatcaaaattctcacccattgacttctcataagttagttatcaaaattttgagcttccctagacaaggggcttcgattctatgtgtgcgtccatctgcatcaattctgtatagtgatatgtagagggtataagattgtaaatacctgaaggtaaattacctataactagatgtaaccatgttccaatacaagtcatcgccgctatctgttgtccatcttattccgccgttctattatacatgccatgcatcgtgtcgatcgatcgcaagggccgtagcaatttgacgatcaaattttacatcgaacctcgttcattgtacgcttcgcaccgtgacatctactctaattcctaattagctacgccccaatctgcataagagtgccgcagcatatgggcacggcttaggcgccggccgctccgtgacggaacgggcaaccgcggccgcgcactcgcttgcattgacctgtcgcggccggacgaacgagccgcgcgcggaacatcgcgtccgggggctccggatcgcggtcgaccgccccgcccgcgcgcgcgcgcgtccacgtacgtgcggcgtgccgttccttccttccccgacctcacgtgggcgcgcgccgtgcgcgccacggccgccgcgcgctcgcgctcgcgcgcacgtacgcgcgctcgatcgtacgggacacccggggcggcaacgccgagacgcgagtgagagacaagagtaaaacgcgcgcgcggtgcggtggcagcagcagcagcagagcgcgcgcgctgcgcgtaccgcgagtccgcgactgtagtctgtgcaggggtcgcgcctcggcttcaagttttcaacggtggtagccacaggccaccccacatctccacttgtgctgttgtgcaaccgctcgcgcgcatccgtgtccgtgcatgtgtggaagaaaaaaccttttaagcatatgcatgtgcagcagtgcacgtacgggggtggtgatgaactggtgaggccgttgtttgtctagctcgttacaaaacctctaccccctaattcgttctcacgtcaagaagagaaacgtaacatgccgtaattctcgctgtaattcagtcattctgatacggcgcgatcgatctctgaacagtattgaattctgaaatagtacgtctgctactagtactagctgagctactgagtttagcagtaaaaattgcgcctgctttgccgaggtttctgctgtaaaaatattccatccacgtactacctcttatgcccgtacgtgcaaatcaagagagaattcagagcagtagtagtaccactccgttttttacccgaactagctaaattctttacccgtgcagaaggtatatcaggcgggcaaccgggtccagcgtacgtccgtacttcgatcaccttgcacaagctaggttaatgtccgggccggagatagatcggaaacacatgacacatctgttgcatgtacacacaaaagatctagctgcaatatactccgttgcacggttgcaaggtgattccgatttcgaagcattcatcagtgcaaccggccggggacgtgatcgagctgggccatgcaccgcatcgatcgctgggttggtacacgcagcagcaccggccggtttgcttgctgctgcaacgatcgatccagatgaaaatcagagcgcgtcgcacgcgggaatctccgtatgatacgcgatttccccctcccgcgcgcgcggccgcgacggcgcaaccaccgatcagcaggacggggaggggtagttccagtacgtgctcgccacggccgcctgattgactgctgctacgaaatgcacaacgtcaaaacggagaggatcggatcggacggctacgtacaggtacagcgccagtacgcgtgcagctacatcacgtctccgagaccatttcgctccgataccgtattgagttttccgtatatcaaaaatcattagctaaaccctagaaaaagcagcagcgataaaatttgatggagtaatagatatactacatccgtcccaaaataagttcttttttagctttctgtatctaaagtttgatcgtccgtcttatttaaaaaaattacgaaaaaataaaaaaaaattagtcacatataaagtaatattcatgttttatcatctaataacaataaaaatatactaaaaaacaataaaaatattgatcataatttttttaataagacaaagagtcaaacattgtatccaaaaactgaaaaataagttttttttaatggaatggaggtagttcatgagtttagtaaacaaaattttaaatcgtagtgctcgtaaatattacacacgagcatataatttcggtaggattatagtatggttttgaattcacttctggctttggttttcgtcattttaacatgtgtacaagagggggctcatttacgtgcgtgtgtgtcctccgtataattgaaaagattattatctgataaataatacacttgtatatttttgccaatatgtggctactggctgttgcaactttgacagtacaacctgaggggagaagagaaggtgccgtccacggatggcatcatggtaagtgtagctgcagtggacgtcgccgtcggacggcctgctggtcggtcagtcactgcagcatgtaggcaaggcaacagaacacacgacagaacaagacatttgcgatccgtcttgctacagatttttcctacagaaacttgcgcccggtgtttcagattgtgatgtgagttggaagcgtgcgaccgtgtgaatgaatttcgatggctataaaccaaagcaggggaaataccaggtgctacggtaacggtagcatcaatgcatcatggtgccgttccacgaaatattcagggaaaaaaagagagagtacaaaatgcagagcgtgctgtcatatagtacaatcttgcaaaatttcaattccaaattcagtgacacacacaaattttgggccattctgactccacttcttcgattctttggtatgatgaagtactacaaacagagcatgcagatgtagttttttttttcagacaattcaacgcatttgcgcgcaaaaattcccgtaatcgcattcgtttagtaacggttcatggccgagtacacaccaacgatcaaatgcaatatgatcggtttacatgacagtaggatagatccagtctggtaaatctgccgataaatatgggtaccggattacagtcaatcccattctgggagctctaattaaagaaaactgaattgcctccttgaaattgcaccagtactaggaaaccggcaatttttgccttcaaaattgccaccgtgctccaccagctgtacaattgagaatagctttaatttaccctacctcgctaagttatcgccgcttgtatctgttagtatattcagcctacgcgccgtcttcgtgaactcgctgcaaattcagaacaggtactttagtccatcaagtattatgttcggtacacaaggaagaaagaactgtagcaaacacgaattgagaacgatggtttcttggacataatggatagaaggtgttttggtgtcccagcttggaactcctctaaagtcaatgtaccatatggatgcttccaaggcaagaagacctagagtttgggtgcttcaagttaagctaacttaaatataccacttaaaagcctagaaatatcacaactacgacaatgtggacatttcaatgttcttaaaatgatagccattagccaatttaaatggagttataaaggttaccatatgcatcttatcagatgaccctagggaaaatttgaagtaagtaccagcgcattaatgatttgtttacagcataaaacccgagaaaataggataaacggccttctatttgatgagtggacatgactaaataactaaccaattcataaaacaggaagtattctgcttgaacaaactataacaataatctaaaactggactgacctgaaaggttcatctccagtgtgcttgagtgccccagccgcatcacggtagaaaacatgactcatcagctcagctttctcgatgccgaacatgtcagcaagccgccggtataattcctcatatgaaccaacaacagagagatcaagtgtgcgcccgacatcctccgactgcatgaataccttgcagtgccctgtttccagcccaacatcaagtaccttgttgtcttggcacaatggaactcctccacatgacaaattatctgtggtgccattctgattacttctcgggcttgaaacatcggagttactcttattcaccgtattttcagcattaccatcagaagagctcttcttaacatccaccgaagcagcatcacccaaggatatctgctgctctgtgagtatgggttttccgaaaagcatcagctgggctggcgccttcttgccatctgatttcttgttgttctgggggctaccaatggtcaacaagcatgagatatcatcccgagcagccggatgaccgataattagaccagcggcgatcctcggctgcatgccgtgatcaagctggtgaaagccgtggggcgatagactcgactgcagtttgttaaggtggagatctgataaagatataccaaattgagcatgcctggctccctgtatgcctgcaggagtgccatccgggaaatagcacataggaccaaccccacgggcgagcgggtttccatggaacatcggtgtcggaaattggccgtcgatgggaagctcggggtacaacggcacgcaaagcttcttccgtggaggcgagaatggagcaaggtggatggccggcatgtttgacacaagctcaaccaaccatgggctcaccctcttcacattctgtaacaagtccggttcatcccatgaaacctgcaaaagccattcccaaaacatcaatgcaagcaacaaaccatggacacgatcctgaataccaataatgctactggaacattttgtttgcagttgcagtagtccttcataggacagtgcactttgagacagagaattcagaactggattgtacctgaagaagcctccatggtgaattaggcatctaatggggtcagcaacctgcacggccgatacagtgcccatgaaccagctgatccttgatgagtcctccgtctcgaatgccatcttgaacctcatgccggcgaaccactgcgtccgcatcgccgctctgaccgccccggccttcacgcagaactccggcgtgctcgccctcgggtagtagacgacctcgaatggttgcccgctcacggcgagattggccgcctcgacgacctcctctggccggacacgggctctgaccttgcccctggccgccgccgccatcttgttgccgtcgtcgtcgcccctcaggaacatggagaacccgccgtaattgccgccggcggcaggtgtcggcggcggcggcggcggcggcggcaggaactccgggcctcccacgccccctttcttggcgcggcggatgccgacgcagagatccccgttctcggtgcgcatgaacacgatggagtcgccggcgacgagcttcttctggttcacgaaggtgctccaccccgtggtgaggaggtggcgcctcggcgtgccgcggtagatgtggcggaacttccagaccacgccatggacgtccttggcgaggacggtctggacggggggatcggcggagtagtcgagacgcgggaagatggtctcggcgcagtagcgcggcacggagaaccccccgccgttgttggcgtcggactgcgtgagcgtcttggcgaacgacgcgggcttctcctcctgcgccgccgcggccgcggcggcgccaatgccgtcgtcggcgtcaccggcgtagccctgctcgttggcgcggacggggacgaggcggatcttggcgaacacctcgtcggtgtccggatcggccatgaacctgacgcccgcgacgcggcagagcacgagcgccgggacgcgcccgcccgggaactcgacggggccatgcccctgcgcgtgctcggcgtggccttgcgggaagtagtacaccttggagctcaccggcggcatctggaccatgccgccggcgcaggcgtgccacagctgcgggtccaagcacttgtcactctcccgctcccgctccttcgccgcggaatccacgaaagttatcatctcttcgacgcaaaaatctttcacctccaccgatcagctcgagcacaaacaaaattcagcggaattcgagcgccacggcgatctttatggatgaaatttcccacagcttttaccactaccacaaggtgaagaagcttttcagctgcacagccgccatcatcgtcatcatcaatcagagctcatagctgaaaaaggctgggggaggagaaagaaccaaccaaccagcagagcagaaaggaggaagaagggaaaaaaagaaaagaaagaaaagggaacaaagcgagcaaaagagagaattttggctcagaaatcttgcagaaaaagggagacgcaacccagaaaccactactcaccttttctcacaagagcaaaagatgatgaatttgaagggcaatcttgacacagctcagctactactaccactactatcttctctcctccccctctgcagctcagctatctgctctgctgctgatgctgatgctgctgctgcttctgcctcctttcagtctctcaggtgagcagcagcctcagattcccccagactgcagctgacatgggggcaaaagaactaaatagagagagagagagaggggaaaggagagagaaagagaggagaagaggagtcaagggaagaagaggagcttaagcaagtacttctactactacccactagtacagtccactgttaactcctcttgtttagtggtctcgttgattaattaacactacttttcagttcaacccctctctcctcctcaagtactcgatcaacctgatatttttgcacaaggggtattagccgatgattacacaattattcacctctcttgtttggaaagtagagataaacaaatgcatgcagccgccctgcaaataaactgaattaaaatatttgtgttaaccaaaactgcatgacctctttccatgatcactggatttacatgatcactctcatcgctatctcgtgatttctttcacaaggggttcaaacaaactcataattctttctttgattcttctcagaatcaggttactagtaagttattatatgaaatctttttggtatgaaaaatcgcgaagggcaagtgtgtgagcgagggagggacacctcgtcgggcagcgggcactgccacgtgtgggtttaggaggaggatgatgcgatgggacgggatgggatgggatcggggagatgttttggtcggggaggcgaggtcgcgagaggcgaccgggcgttgcctcgagattcgcgtggccggcgcggccgaggcttccgcgtccactgctgctggctgctgctgctgctgcttccaccgcttggccaagctagctcggtcgcatatactcgcatgtgaaggttgcttgttctcttcccatcactacctctgtttcgtaaaataaggccacctttaattcaaaagaaattcatagaagttttggagaaatttatttttatagaaattttttctatatagcccttcaaatcaaaggaatggatcttatgaaatcctatgaaaatcttatggattgtctaatgccatataagttttggaggaattctaaaacctcttggaaactttcctttgagtctttatctctcctctaatttctgcgtttttcctgcggtccaatcaaacgaccattcctatatttttcctgtgttttgtaatcctctgttttacacttacattcctatcaaaattctacgtttttcctattactatgttttctcattcatgcgattcaaaggggcctaaaaaacacaatcttaaatacaccctttatccatcaaccaagaatttaaagtgttttatttatcaatataaaaaggaattaacttatccacagtgttataaaatcaagaaattatgcgtatgcatgctactgatgagtattaaaatgactttctagatttcagttaataatttaatttagcacttaaagaagatatgcacatcttatttaaaagaaccagaaaataaaatatgcccctatggagaggaaataatcttgagtcggtttgatcatcggttttaattttaggctgtatgcaaattgggactatcttttccagatttttaaaataaatttaggagttaaattcaatagtgttatgaatggcatattgggcagctatagaatggttcggattttgactccgcatccgtaccctatgagtgatgtgaccaaaagactcaatttatcaattaaaaagatttaaataataaaaaaatcttgttttgttaaagaacaatgtatcttcattttgaagaaaaaaagcaaatatgtgttgttaagaagagatggcttgtcttgaaatatccgatttctagtagtggaaccaccttccggtagggctgtcaacgagccgagctcgagcgagctcgtcagcctaagctcgagctcgatcaagctcgagctcgactaccgagcttgtaaaaaatatatatatttcaaagataacctttaaaaaaattaatttctagtttatcatactaataaaaaaggaaaaaaagaataaaataaatatattatgtcaatataagacatacaaataacatatttgatctcctaatttattaaataacaataaaaatgatatattactaggctcgttaaaagctcgagctcggctcgacaaagctcgcgagcttagggagaggctcgggctcggctcgtctggagctcgagccgagctcgaatcgagcctagaacgagccgaactcgagcagctcgcgagccttgagcttttttgacagccctaccttccgggctagtcgggtgcccgcctgggctctttgtccgatctctcgtcaccgacatgtttatgcaaaaaaaaaaaatcgatcactagtaaacgttcttcgatactcagacttagacaatgccgttggctcaaccattgattttagttttcaagcttagggtaaacttttctatagccgtacgtgttattcacgaaaaagctaacacgcgatcgatcacgcacggcgatcagccccctccccccacgttccttccttttttttttcaccgcattactttcctgttttagtaagtttatacacctaaagttggtacacatcaagtttatacatctaaagtttgtatacccaaagtttataggttaaaagtttatattaccggtttaaattcgaaatcgaatttggattcaaatatatttttatatagaatatttctatacataaagtcaagtttacacatctaaagtttgtatacccaaagtttataggttaaaaatttatatacccagttcaaattcgaatttaaatttggattcaaatatatttttatataga

SEQ ID NO: 65470 - DNA, 4896 bp, Oryza sativa
ttcccatttgccaaacaccacctataagaatagagattctctaaagattcttcagggcagacagtgtagtgttacgttttctgaatggttgcctgccctgcccggaagaacatcaacacagacaggttgatgtttttccatggaacacaagcttaagacaatttgaaggcgccaatcgtaatattcatattgttgttccctcaaaaaaaatatttatatttttgcagactttccaggccttccatccaccaatcggcgatgttccctgtgttcgctgccgttgaataaaacaactcgtctgcctcgtcgtcatccagccatccacgttctagaacaaaaagctagccaaagtcgtcggcatatctcgccagaatggaaagaacgatacgaatcgaacacaagaagaagaagaataagcagaggcagggcatgcattttccttcaaacctcgcgtcaaaacacgctagtacaatacagtagtaagtacatattcacagtacatgatgatgattgggttaagtctggattcctaatacgctacctagtctcaattttgcattttacattcatacacaagggatcgatgcgaggaggaagattttactttttttttacataggcaggcatgggtgatcaccgtaactaaaaatttgtgaggtgagcggccatggccgtgaagagacagaaatcgcgtgtgtgcgctaccagcactggtcggtctcccaggtgcggcgtgggcggcggccgtaccagcgcggcgcggcggcgggagccgccatcgtccggtggtgcgcgccgcgcgccatggaggcgacggcgacgacgtcgcggtcgtagcgcgcgcggctgtcggggtcggagagcgtggcgtaggcgtcgtggagcctgacgaagtcgtcggccccggcgctggcggccacgtcggggtgccgctcccgcgcgaggcgccggtacgccgccttgatctcccgcaccgtggcgccggcacgcagccccagcacgtcgtacagcgtccccgccggcgccggcgcaggagccacggccaccgcgcaccggaccttccttgcccggtacgacccaaccgccgctgccggtggcggcttgggcgcgaaggcgatccccacagaaggcgcagaaatcatgagaaggaaggaagagaggaatggtgggcaagaagcagatctgggaagacggagaggggaattgggaagcttttatctaatacaagatgtggaaaaaggaaggagaggaggcaggtgagacgtcgttgggtggcacccgcggattgtgttggatttcggggtggaatcgccggtggtttagtggtattttaaggcgggtttggcgataggatcgttgcttgggtggtagtcagcatccggttgcgtcgacttgggtagtagtgctcttttctttgagcatgaaatgaaaatgaaggttaagatttttagaacaattaattaagatttaattattatagacttaaaatagattaatatgatattttagaacaatttttatatagaaaattttcgtatgaaatacgcagtttgaaaagcgtgtgttgtgaaaattattatcttcgtccaaggcttgatgaagaaatgaaggagacattggtgcatgcgtcgctgtccgcttccaaatcccaaattgagcatttttttttctccggtggattctgtgggtgcaggctgcgtccgactctgggcgtctggccccccggttgatgggaggattcggattctttgcattatttccttcctgccccccacggtttgtttggcgcgcgcacgctgattccgcccgccgtctctctctgtcgctgctctccaagtccgacatgacccgcgcgccgcggccgaccaccaccttcactcgctccttgcaagttgctgtagctctcggacagctcgccccatcagcacaaaagtcagctactactaaacttctactactactggtttcttccttttttgatagggagaagtttagcaggccgggccgcacttcgttcacgcgggctggtgatataggaccgaacaagtatggttgtattgtaccaaatgtcactcttcagagccactgcattgttcagtcaggcccaacagatagcacaagtatgttaagtgcaccgttaaaatgggctattttagttttttttttttgcctttgcttcgaataagttacaacagattattacagagtttattggtcaaaacgactgcgttttttcataaataaatacagtctaatgaaagcaagaaaattaactggaaataggctaaattttgagatgacaacctactgctaagggcttattcgtttcaaaggaattgcaaaggaaaagcataggaataggaatgtgttttaaaataccatatcataggaatgcaccataggaaaactttaggaaagttttccattcctccatatttgaaggaaaagcataggaaaaaataatccactctaacctaatgtttgcattcctttggttggtttgctcaaccaacataggaaaaatttctgtgtttttcaatccataggtttgcacatgtattcctatagtattcttacattttttatattcctacgttttgaaaatcctgtgaaccgaacgagccctaaatctttatctatagtcgacgaaaatctacatataatcggatatcgcgcactgcgcacatcgaactgaagcggacgatgctacaaaaagtgtcaacgagaagtaggtgaacttcacagcacgttacaattcgttgcggtaacagtatatgctacaccgttcaaacgtgctcatctgcacctgcctgttctgtctaggacaacgaaatttctttccaagacagtgcggtcttctagaagatgctacagtaagtgccaacaaaaatgttgccatccaaacatcaaagtatggaacttatagaaaaaaaattgaaaatatacttttatttttcatattttgcatttatatacatgtctgagattaatttgcaaaaatatacccaatccacatgatggttgcgtgagagcgccggtcccgcaggccggggatgcgataccgcaccggtcccgcaggataggcgaacggcaccacgggttgtttgcgtcacggtgcggacccgccgagctagagcgctcccgcatattggatgcacgggaccgccgctcccgcacccacatcgtttcctaaattgtgaatacatgtcccgcacggaaaacggaacagtacatcagcacatgattaattaattattagttatttttttttcaaaaatggatcaatatgatttttttagcaactttcgtatataaacttttttaaaaaaagccctatttaactgtttaaaaagcgtgcgcacgaaaaacaaaggagatgagttggaaaaattaggggaataaactcacgtaaccggagcactcccgcatagcggatgtgcgggaccggcccctctcccgtattccgaatgcgcgggaccgccgctccctcatggatgttgtttcctaaattgtgaatacatgtcccgcacggaaaacggagcaataaattagcacgtgattaattaattattagttgattttttttaaaaaaaatggatcagtatgatttgtttgagcaactttcatatagaaacttttttgcaaaaaatgcaccgtttagtcatttgaaaagcgtgcgtgcgaaaaacaaaagagatgatttggaaaaattaggaaataagacacggaaccggagtgaccacgggaccggcttcggtaccgcgcgttggagccgtgggaccacgccgttctgcggtactgccgcgctccgcggtaacgactcggtcccgcagtccagctatgcgggcccggctcagttgctcatccagttccgcgcgaccggctcaagtatgtggttcgccctcgctcccgcataaccaatccgcgggttaggtatatttttgcaaattaatctcagacgtgtatataaatgtaaaatatgaaaaagaaagagtatattttcaaaattttttcggaacttataggctacaacaggcctcaggccaccaggagactataaattaattgctttgaatttgaatgatgcaaccatgtaataactatttcacatctaatcaaatcatacatgggcgacaatgagcgtcttaaccacgacccaatgtagcggcatggcaaaggaagcacacaagtacagagacctgaacaatccaccagctcctgatgcttccatttcaccgatgacagaaagtatcaagctgccgctacttcttttaaattatacgcccataatggctacaatatgtagtgatgtcatgcccgggtgtcctgtgaagtaggaacttcagcactgcacatagggcatacctgcaaagcaatcaaggaaatttatcacctttcggaaatgaaaatgctttctccaataaacctaaactgctcccgttattgggtgcattgaacatgccaaatgatgtatcttcatagtcaggtggcaaaagaaaaacattgattcaatatctgacaaggaatagggatgtagggttcataagccgttgctttcattcatcaaggggttggtggatatgaagactggagatgctgttaattatataccttatttaattgcagccattggtttatgcattcagaatggtatgaatgcttgcaaggaagtgcaaccaatgattcaccttcctcaaattccacacggcaaataacacatctgcaaattagtttcatttatcagtacagtgccggttacttctaaaaaaggggggagatattaacatactgttccatgttgccgtcttgcttatcttgtgctcgataagttattgaaggtaatgaagcaagtgtatcagcagagaggcctctgctctccgtagggctgcaggaatt

SEQ ID NO: 65471 - DNA, 2459 bp, Oryza sativa
cgtggccgcggcagcggtcgaggagggcggcggccttgtcgagggccttgccggtgtcgtcgaggatgcggcgggcggggcgctcgtagaggtcggcgcgggcggcctggcggaggagggaggcgaggcgctccaccttggccttgaggtcgaggcactcctgccggcacgtctgcgcctcctccgcccacttgatcacctgctccgccaactggatcggccgcgccaagatcgccttcaggtcgtccatctatgatgatccccgccgacgatcagcaatggcggcgagacaggaggaggaggagcacctcctcggcttgggggggattccggccgtgctcctccggcggcggcggcggagaaaccggcgggcggtgggggtgggatcgctaattgggggaaggggagcggcatgtgcatgtgaggcgagcgccgcgcgagatgtggatgccctgccatggattgccgccttcggatggaaagggaagacgagaggtttccacgcttttcggggtttgtatttccgatgccgttggatcccccacctcctcactatctcctacctccgctcttctaattactagcattttagagtatattcccattggtagttatactagaaattaaggattttttttcctgaattttagatatagattgtaccaaggttttttttagcatgttttttataaaagccaatcattggttttagtaagaaaacgtttttaaaaatgttgttgtaaaaatactaccaccgtttcaggttataagactttctagcattattcatattcatatatatgttaatgaatctaggtatataataatttataacctgaaacggaggaagtatcaaatagatttattttttttaaattataataattaaaactcaacaaattatgtgttaatggttttctcattttacgtgatcttacttgatacagtctccatctcttgcgaaccgggcttattgaaacggattattttctccatgcttcagaaaaaatatgtttttcctttagaactttttacttgtttcttaaaatatttaatttttcctataataaagtagataatcgtcttgataatctaaataaaatggctccgagtaattttacatgtagttagatttccagacactatacctcatagatacgagcacgactcttaacttttggtttcatggatacaattggatttgatgttacaaataattcatacaatcgtattttctatacaatagatttttaaagtttacttacatcttgtatacaattgtgagctttatatccatggaaacatgtattccttcatctacaattgtgtaaatcattttttgcctttcaaatttgataatttctagatcctcaagagcgaacaatgacattcattttcgataacagatccaacaaatgcttgctacaattgctctttcatttgttgtctttctcgtaggttagtagccaaggcatgtctaacgtgagatatcatgtcctactcttttctcctatttaattaactctatgcaaatcaatagaaacctatcctacatctacatggcagcaaaataactatacataaacactatcctatccgtgtgacatcgaagcaaagtggatcccgcttttctccaccatactgtatacggtgtaattttcataagaactttctgcacgtgaattttctataaaactattttcataaacaattaacaatgtgatttcatttggccaccgccatcgacacggattgagacggctccctcctcttcttgttcgacttcgaccactgctatcggtgtagatctgggtgactccctcctcgtccgctgcccatgtcggcggtggcatcttcccgatgatggcctccaagttcctctattctgatctctccaaattgtcatcctttcttccaacttgttggactacacgaattggtttctctctcctagagccaccgcttcttctgcaagctcttctgacacactgcaaaaccactcctcccctccatgatggcatccaaaccttacgtggaggctgagaccccacgttggacatggcctaacaagtcgttctcgtccacaggaaaacgcccatggatgtatcaatgcatcatgcacgatcactctctttaaaccttgtgatccaaaaaggagaaaaaaagatcgtgtcatgttgacttgaatcacacccaagtactgtatattgaaactacaagttggcgttctatctgagttgccgcagaagggaacagaaatacagaatcactgaagaagatagaaatacagaatcaccgaatataattatacagtagattggttcatgtcaaccaatctactactccatccgtctcacaatataagggattttgagttttgtttgcaacgtttgaccactcgttttattcaaaaattttttgcaaatataaaaaacgaaaagttgtgcttaaagtactgt

SEQ ID NO: 65472 - DNA, 1455 bp, Oryza sativa
atttcaggggatatactgttaaccatctgccagtttagttaattgtagggtataatcggctgatgccttttatttttaacaacagattcacagttgtactagtattaattgggttctgagtgtattctatcagttggttttacaggttcaggttggtgaatggggaattcgcacagctgtagtgttgttgcttgagcacttctcagaaaaagcatcccaacaaagcttcgagccgattacaagacagtgggcaccaaggttgcctattgctttatgatcagcaatgcagagaatgtgctcaagctaagatgaactttctgaaccttgcaggtttcatctcactttatgcgttgtgtaatatgtaattgttgcatgacactcttgctctttgccttactaaattcacctggccgtgtacatcctaagcagaagagaatgctggacgaaccattgatcagtccataattacccatgaatgctataggcagagcaaagtaactcgtgttggtgctgtgtcaatggtctgtctggtaagttgcctatcacacaaattgattctcatttatcaacaatgcaaattctacatgtcctcttagttgtgaaatacaaattctagcatttgttcgcatcatgtctatttcctagtacgatccttgcatatatcaatgtctgtgtacagtttttgtgctaatgttgctgaaataaacatgattttgttcatgtagaattttattgctagttctatgtgcaatccttttgcgtgttcacgaaaattgctctacattagtgtcccttgaatatagtgttgtactatatgtcataccactcggttctcacccagtaaactggtatatagatatttgctgagagatacaatgcattggccaatcatatgaattgcgcaaattagtcaaataaaataattggcattaaccaacctgctataaaccgtctttgcttggattggagcaaactaaagtattctggaggcaagatcttgataacttctcctgaagtctaggacagacaggattgcattaggaaccaaacattggagttatttacacactggcacatgtagaccaggtttggtgcctcaatttaaattgacattgcagattgcatcagttcctgacagtgactagtgactacatggtctgtacatgcagctagtactactttgatagactagaggcgtcaaatgggccaatttgctgttgcggacattgtatcggtatcttacttggatactccctccgtcccaaaataaatgcagttttacactatttatgttcaacgtttgaccgttcgtcttatttaaaaattgtttatgattagtatttttattgctattagatgataaaacatgaatagtactttatgtgtgactaaatatttttaaatttttcataaatttttcaaataagacagatggtcaaacgttgggcacggatt

SEQ ID NO: 65473 - DNA, 2256 bp, Oryza sativa
tagtgattaatagtcatggaggcagactggaggtttgagatttgacaaggataccgtgtgcatatgactttgacgctcttggttaaattcagctggttgagtattgggcacatatagtcatttgctaattagttgtatacaaaaataatctcaattattttgttgggacgccaatactgatattagatagcaatctgtcatactatctatgctcctttactttcagctttagaaattgatatgatctgtagcacacaccttcgaccatcattttttctcaatcaagatttcaagtataattatacgaagaagttacatgaaaaattaaaaatctagtaatctcattttgaaataacaaatccaaacagtttgatgcatattagtggtcaaagctttatgagtttgatccataaaagaaacagagggagtgatgtatcactatgcatcttgtaataattaataaatgcatgcatgcatacatcatgttttttgttcatatacatagtaaacatactacaagttaagtgctcatacgatctttagaaacacaaatgcactgcttctaaagcataccaagagattgatatgtaactacacactgctacatacacgatgcacacactaactgcatgcaatttggtttttgagaagcattgtggcaccactgctcattaccatgaagttttgctttacctatattccgtttttcctggatgcttctaaacttaatcaaaaggaattcactcatgggttcatgcccaggaatgcatgcagatagcattttctagcatagcaggaggcagatggatcaacatatgagatgccctatatgcaagcttataagcgtgctacaatatatcatatcatatcatgagatatccatgcaagtaggcgtacctgttaccaagcttggcatggaggtccacaacaagctgctcctcgtctgcggtgaggaggccacgcttgaggtcagggcggagatagttggtccaccgcaaccggcagctcttgccacagcgcagcagccctgccaacttaggcactgctcgccagcagcagcggccatgtgtcaggatgaaactgatgagcttcttgtcctcctctgccgtccatggccccctcttcaccttcttcttgtcacagcacggctgcctccccatttgctagttactgcagacttgcaccagatagatggaatcctgtataaaatgaacacttataaatttctagtgcttgcacatgtccagtgagctgcaaaactcctgtgcacaagcgtcagatgaaagggtggtgacagctctgttgcaactgcaattggtgtctgtgcttgcatatttataggtcagctcctcacttcctcagtttctcgaaaaaaatgtgtctttcatgaattttgtgtggtggtgatgatgatttggcttaatttagtgtgcttagaaagcaaggcctcaatccgtgctacagtagacttgcacccaaaaatccacatatatgcattgctgcaacgtggtgcatctacagtttagttgttgatcgaatttacaaattaagtataaaaaatatgtactattttattagcacagcagcaatttggtcgcacatgatgctacaggaaactcagatgtgattttctctggaatgaagttgcattttaactagtatttttaaagcttttgctgctttcatttcccacaaggctacacatttatgctgcctttgctacccacctatgtagccatttcgtcatcagctgtgaactatagctaactgctaaccaaagtaccaaaccatttgaggagcccccctaacttcatgtgattgctgtgagctgtaactcatcgtatggaccagaataatgactttgagcacatggtggtgtatattttgctacagtaatatgtagaaaaataatcacgatcagtgactccagtggtgaaaattgtcatacaagatacaggcaatttaggatgtcatagcactgaatttcatgacatcagctttcagtaggcaagaactcaaccaagtgatttcttctggcatacatgtacaggtgcaaattgtttttctagggcttgttcggttaataccgaagaggaagggattggaggggattaattccacacctcaataggtgtggaacaaatcccctctaattccccttcaatccccttctaagagggattaactgagcaaagccttaaggaaccaatgctaagtctgttggggaaaaaaattacaagtatacctggggctggg

SEQ ID NO: 65474 - DNA, 3589 bp, Oryza sativa
ctttccgtaccaactacttcacccaatgcaaccagctcctaagaacaccaacattaaattttagtagcagatcctgaagctttagatgtgtaccaaatgcagacagtaccggtcttttttaagggaacaaacaacttacctcataagaatattcatctggatcaacatcttcccatgcatcctaaagtcagaagtaaataaaaaagtcagacaatagctttattattggaagacttcaggaaaacaagaccacggcattaagaaaagtgcaaattgctcctagttgggtacattttaagccattacctcccccccccccccacacacacacacaccccatcccaattctcacatacaggaattggcattaaatttccattttcaaatgaacaatagtatacttatttgcaagcatcagaatctgatcagcaaaagcagcaggaaaagtcagttcccaaattataatttgagtatctagaaatggaaatggacggacaaaggtgataccgtgccattgagttcaacaaacctgtatcgcttttaacataagtagcacagcttctaacttctatataccaggaaaagaatgtagtatatatgccattaccatattagttcgatatgcacctaaaatattcacctacccattctgaagaatgggactacatacagatgggtatacttgaatttctcccataataatccaaaagttaccctccctttctccttgtctctcggaatccaaattattcattgaatggttgcatgataagcatggaacaatgaattggagatatcgtgcattccaaactcatgaaatggaagaaaatgtcacctgtggatcatccccgtcttcatcttcatcatcatcatcatcatcatcatcctcatcatcatcatcatcaacatcgtcatcatcatggtccatcactcgccctacaaaacaacaacaacaacaacaacaacaactgtaagctacacacaaaaatgaaataaaactatgaaaggaagaaaaaaaaaggatgggggataaaattctcccttgtgcactcacaatcactgaggcccgcgagcgccatgaggcggccggcgacctcgcgctcctcggcgtcctgcagcgcccgcgcgaaggcctcgtcgtcctcgtaccgcgcggggtccaactcagccgggtcaccggcggcgtctgcgtctgcgtcggccacctcctcgtcctcatccagcgcctccccgtcgccgtccccgtccccatcctcgtcctcaaaatcgctcccctccccttcctcgtcaaactcgtagctcccaccatcggaggccgcgtagtcgccgccgtggtgcgcgctgagcatcatgtacgcccgctcctgcgccgacaaaaaaaaaaaaaaaaaaaaacacggataagccaaacccccccgaccgtggtgaagcagcgagatcccgaggcggcggcgtacggcttttacctgctcctggaggacgcgggcgagggcgaggtcggcctcctcctgggtgaggctggtgaagggccgtctccccgccgccgccgccgccgtggagtcatcgggtggagctgcggcggtgggagggttgggggtagggttttggtcggcggcggcggcggtggtatccttggcggcgtccatgggaggagggatcggagaaggggggaagtggtggtgggagacaaggagaaatggtggagaaggaaaagcgaggcggtggcggcgtggcgtgggtgaacgttaagcaagcgaagcgcacacacgcggtggtggtgggctgggatggtttcagtaaaagaggaaaaggacgaggcgaacagaggtaaccgtttccgtgtttcagctttggaacggcagtccagcaccccgaatctacctgacctcagtttaggatgtaaacgcagccagcatgggcatggcaggtcggttccgtttgggtcccacaggtcagcctctttggtgaacttctcttacaaacggcccatcatcgtggaaataagcaaaacggcataattacaaatgaaaaataatttatgaataaaacttttatatacatgtttttggtgatctaataaaagtaaaggctgaaaaataaacttccataaaaaaaacctcaaaatcaggttcaaatcaaattcaagattaaaaattcaaattttgactgataagtataagtataaacgaaaagatgagatacgaagactccttttggtgaacttatgtaggttcattttggattattttaggagggtaacaaatcagcaattttgtttggagtctcatgaataactctgtttcgtttctaactctaccctaccaaaaatgacattttggtagtgcaaggcataagaaaaaaaaaagaacagcccgtaatccagctttgcttatgcccatatgtattggcaaaccatataaaagtttcatatggagcataactttttcatacggaaaaagaaaaacgaaaggcaaaggatattcttgatttggggaaatagctcacggaacggaacgcaatagaagttgttgaataggaattctatgttgcttagccggtgggcgaagagagaagcaggcggcatgatcacggcaagcaaggcatgctgctgcggcggcggccaacctcgtttcttctttcttgcacggatgcggcgtgtgccatagatgctttttcttgaggtgttccaagtgaaatgttaaaggtacagtagagaacaaactatacgtgcaaagtcttccatggcctgccttgctgcttcacccaatgttcgtatgcaattgcaatttgcttgactgattcagcctctagcacaaatgggccaacagtagttgctgtttcctagtttttgtatggtctctgatgtcacgtgggtttgcttctggcccatcatagatgctgactagagagttctgctagataaacaaactttgcacaccaacagcaggaggtgatcaataacgagatccaaattaggggaactatcttggtctatctattggggcctgcgacaactgatcgtatgataaaagctaagtagttaaaaactagtctctagatttcatcacggtctctggtaggtacatttttcacatgagcaatttgtaactgaaaaaaattatcaagcaaacaaggctctggtatccgacgatgtactaaacgtgcacaaagcccataacatgttgcatcctgctgcatttttacaccactccagacggaagtcgaaggacaagttgcccaccaaaaacactgcagcaaaagatcactggttagccaatcttcacaattttgccttgatgacggtaaaaggtagatttatgtacctcttcacatagtagtagcagaaatcagcaaggatgaacgtctgaacgatttcagagagaagcaccatcgaaggccagagaccatagcccagagcagtcaacaagcgaccacgggtatccaaaacctgcagattagatcacagcaaattgatttagatgggcttgctaaaaaaaatcctattctgtttacagattagatcactactaatcatgcatcagaagtaacagatttctcaagaatatatacagcttaaaatgcagacatt

SEQ ID NO: 65475 - DNA, 19929 bp, Oryza sativa
ggcggccacatacatttcccctccgacgacgacgacgacgagggcggttctgatggtagtggtggccacatccatttcccgtccgacgacgacgacgacgctgagccgcctcccccacgccccgccgcggctccggcgccgcacgccgccacgctatacacctacgctccgccgtacggctacggccccggcgccgggcagtatgaatacggcgtcgacatgggcggctacggccagagcttcttcagcatcagctacgcccggagccagccgccgccgccgtcgtccgttgtgtcctacgagcaccgcccccaaacggtcaatgcgactgttcactactacccgggggacggcgccgccgggccaccgcttcccggctctactacggcagcgccgcgccgccgccatcgccgccgcgggtgtccgcctgggacttcttcaacccgttcgagtcattcgagagctactaccaccaggaccagccatctcctgctccaccggcctacacgccaagccggagctccaatggcgcgcgggaggaagatgacaatggcatccccgaggtggagcacgacgaggtcgacaaggttgacaaccaccaggatgccaatggcatgccattgccggcgaaggatgtcagtgaggagcagcacaggaagtccaagtcctcggaggccagcagtagtaccagcagcagcatgatcagtgatctccatgtagttcagaagagtgtgattgaagaacagctgcggcattcggatgccgcggggcctcccgcgatccccaggaaggtttacaatgacgatgtcgaggtggtggaggagatcagatcacaattcgagcatgccgcaaagtccgcattcgatgtatccaaggtgcttgaggttgggaagatgccttactaccagaagagttcaggattaaaaggtttattatgatgcattccttgctttcctgtctaaacttccaatcttttttgccattcaatgagacaagtggaaattttcataaccaaattgctgttgcagtatcctcgatgatgatttgtgggctatcttcggtgggggaggagttcctgcaatttgaggaggacaaggctatggaatgtggtaacctttcttcaacattgcagaagctgtacatgtgggagaaaaagcttcttgaggaagtcaaggttctgatcgcgctctacaattttgaatttctagctgaatgattttaatccttcatgggtgtacttctttctcccctttagatgtctgttttgaacattcagttcaggaaagcaaagctgactgtttgctgttattaacttgtttttagctgcctaatattgtcaaagtatattcagttcgaatattttgagtaacaaactgtatttacataatgaacttggatataactatttcttgtcaaatatgcacatttctccttttcggaaacttgtcgtgtagttaattatagatgattaggagtttgcactacaaataagtgcaatctgatagttttaatgccactgaaattgtttgccgcatcccttatctgcattcgttgtcataatgacatgtgggatccaactctgcatatcagtattcccaagaaatgattatgccttacagttttactctgtagagggctttatgtttcttgtgctttgtctttaccattcctttcccttgctttggcatgtcatcccattattgttttacttttataggcttgttaaagaagacttgatttcttcttttattatgttcagtgttgggttatactcaagcaactttgtttatcacagactgaggagaagatgagggtgctgtataaccaaaagcgtgaggagctgaaagttttgtatggaaggggtgccgaagcacacaagcttgaggcaactgaaactcatatcaggaagctatcaacaaagataagcattgccattcagattgtcaatactatctcaaaaaacatcaataatctgagagatgacgaactatggccgcaaacatgtgaactgattcaagggtatgcgatatgcatctctttacatgaaattccacatgagttgtactactactactactaatgcatattttgcatacacaatgcacatacacatacatttttatgactttttcattgaatggagtagatcagggtaggcagtatggacaaatttagaatttggttcgcaagaaggcaagaatttagcattcttaagtacacatttagacacaactgttagtatgtgaaatatttggcatttcaggcatttagtgattactggtgagcagggtttcccataccaccggggccggggttaccgcgccccggcggtaagcacggttaccgcgcggttaccgtggtaaccgtgaaaaaccgtgcaaaatttatcaaaaattcaaattatttttaaaatttatttgaatttaaggaggttaccgcggtatttattaccatacccccgcagtaagcccggtaaccgcgcggttaccggcggtaacataaaccctgctggtgagcattaacagaatgcattgttacattttctcctcactttatggtgtactggcactgccatgtgattattagtttcgattattatgactttctacatgctgtcagtacaaattcgaaatgcttcttaaatcttaacgggtgttgttattcaactttaagttgtcaccttggattactttgttatttgcatgctaacttggacatacacaatggattttcaggttaatgcaaatgtggcatgccatgtcaaaatgccatcagatccaatgccacgccatatcccaagctagaaacttggactctaagctagattctgcaaggttcagtgaagctcacatggacttaatcaagcggctagagcttcagttactggagttgatttctagttttgctacatgggtcaatgctcaaaagagctttgttggcactttaaatgagtggctcaagaggggaattgactatgtgcccgaagttaccgatgacgggactccccccttttctccaggacgcttaggagcgccccccattttcatcatctgtaataattgggcaatcggcacgggaagaatatcggagaaggaagtagtagacaaaatgcaggcttttgcctcaagtgtcctgcacctctgggagaagcacaggttagaatggaggcaaggtatgatggctaacaaagatatggacagggaccttagagtgatggagagggatgaactctcaatgcgcaaggctctcgatgcgcaaagcaagaagcttgtgcttgtttccaatcagagtggcgtgtcgttatctgcgcaggtggttcacgatagtggtccaactgctgaagttggtttgcaatcttgtatgaataaggtctttgaagcaatggagagcttcactgccgcttgtgcgaatgcatacagtgatctccatcttcgctctgaagaagagaagactcgactcggccaaaacaatggcagagttcctagcttcatttcagacttagctggtaagtacatagcaagtaactgaccttggaggtttggatgaacagcaacagtgtgcagagccatcacagattctcaattccagtctcacaaccgatgtgccttgcttttgcttggtttgggccctctgccaagtttcagggtcatccttaggcctgcagcaactgatgtgagatctgtgttggcctgcattctcagggttgaatgatcttcttttgtggtcataatcatactggagaaaactactgtcctgtaaagaagttaatcaccaattcaccacaatgttattgacaaaggggcacaaagcatcagactatcagagatacaaaacaatggacattatctataaaagaaagagactgagcaatggaagattctgacaaagaaacagagatcaagatatttcttcttagaggccctataattgcttgtagaaattctctatcaagaatcaaggcagtgtttaaggaggttggtactgtggatgaatcttagctgatactcgataatgagataatttttttagataatggatatcactcctgcctctacatcgataatgagacatgtttgatgctctgtttggagtctctactcgataattcccaccgaagcatttgggaattgggagcctcagcatgacagcattttaggcagacatggccctgatactgcaactcttcaatctcctaatttgattggctgtcgaaaaaaagtctctctctgtgtttatctgtatacacatgatatgattcatttgtacctgtgacactgtaactttgtacagcgagtgtaacttgagttgagcctttttctttcatctcttaacctgtctcagtatgcactgttcttgaatctggttgccaagctgttcttgaaagtgacaaccagatcagtacatatgaaacatgatgttgaagtttttttctaaattttttttgaaccttcttaattttaaaaataaaatctcgcaaaacctatttctaaatctaaacctattggtgtggcaaaacgatacagacacatccactacaggtagggtggcgtggctaaaatgttcagattcggaaaaaatatttttaaaattaaaaattaaaaaagaataaaaaaagtaataacaattccatgatgaattgagaaaacaaaagccaggatgtcagcatgttgtcatctgttgcatcagtggagacaagacaaaccagtttcacaaacctggtgagaaagtgacacgtacatgtattaggtgagagagacagcatcaatcagacgaaacacagcagagaaaaaccttaatcatgattatacttatacagatacagataatgctgtatcaggccagcgtatgaacgtatctgacgatgtcatgcacgtcagagcacaaattaatcaactttaattcgtttgtttaatccgattgcaggatccccaaagatctcctcctcccctccttcgctggtacggccgtgcaatcattcattcaaattcgcgcgcgaacccactcgtcggcttcgcgcgcttccgtggagacgcgccacgcgtccctagccgagctcgtcgtcaagctccaaccactcgtggttgcaactgctcgacgcttcctagtacgtacgtggtgcgtcgccgtcgtcgccgtcgcgcgctcgtgcggtgtgggtgccgcgcccacgggaggcatgccagccaggccttgccggcgaggcaggccgtaccgacatgccagcgatgagattcttccggcggctcaggatatatatcgcatctgtccatggtgcatgcattcgtcttcctcgatcgatcgccattaattcccaagaattgagggaagctagtgtggtgatctgcagctatggaggagcagcagctgtgcaggctgaggcagaacgtggcgtcgtcgtcgtcgtcttcctcggcggcggcggcgatggccggcgcgctggagggcgtggcgcgggtgtacgagcacgtcgggccgctcgtgcggttcgcctgcgccgagcaggtggaggaggagctggaggcgtcggtggcgctgctcgacgcgtgcgccgcagcgagggacagcctgcgggcgatgcgcgcctgcgcgcttgacctcgaggtggccgtccgccgaggcgacgccgccggcgcccagagcgcggcgagcgcctacgcgcgcctcgccaggaaggcgcgcgccgacgtcaagaagcagcagcgccgcctcacgaacagcaggaggcgcgagcggccaacccgcgacggcgacgacgcgcagtcgctgcaggaggcgcggcggctcgccgtggacgtgctcgaccgcgtcgtggcggcggcggcggcgggcggcgccaccgggccgagcaggtggtcgacgtgcgtggcgcgcgcgttcaggaacaggacgcgcgtggcgtgcgaggacgccgaggagatcgcggccgcctcgccgccggcgttggctcacctgtactgcagctcgttgccgtccaaagatctccacgacggcggcgagacggcggcgcgggtgcagaagcagctgagaacgctgggagacacgatccagaggctggaggatgggctggagctactcttcaggcgactcgtgcattgcagagtcttcttgctcaacatgtgcagctcactgtcagagtgtgtatgaacagatcagagctcaaaaaatgcaagagctgcatgtacagtagatagctgtcagctataattttgacacctggatatgagtatatggtgaacaataaaaaatagcagtagaaaattttgagccattctcttggactactgtgctctccgatgccatcatacccatcgaaaggaagaagaaaagatcagaattctcatgtcacatatgctgatgaacacaatttagctttgtttcataactactactcctttagtcttttacattcgtacatgtacgaaattatttgttgtgaaacaactttcacataaactggactaacaatcagtcattaactaaggctgcgttcgttcattggagataggggagattgtcactcgttttccgcgcgtacgcttttcaaactactaaccggtgcggtttttgcaaaaaatttctataaaaaagttatttaaaaaaatcatattaatccatttttgaagtttaaaataattaatactcaattaatcatgcgctaatgactcatctcgttttgcgtatcttcccaatcctctctccctcaaacacagcctaagttttggatgcacaacgtgcacaccatctaacaaattccacttaaaattctagaaaaaactgtacatgtgcttccaatagtactacacatacatgtaaagtctccgcttcaaagttatttttatttcatccgtttttttttataaaactaatagttttaagaatataagtaagttagaatttggtctctctctatatataatgaattttttaaagagacttcacacacaattacaatactattggaaatacatgtataattttttcaagaatttttgaggatgcacccgaaacttatttgcataggataggttacctccttaagtagactagtgtcagagtaatatattaccagctcagttttttcgcgaacgcgcaaaaggattacacgtcaatatattagaagaaaaagaatttttgttacaagggaagggagaaaaagcaaagccaaaaactgaagcttaggaactactgcggcagctaaaagcaactcctaaacagcgggaaggggcaaagccacgctatcagctcagcttcacatagttcttttcacttagccaaagtagagttattcacactgttccctgaagctggagcaaattagaggattgcatcttccggctgtctttttgatgtcacaaattttcagactatttgagatcatttgcagtatgaggaatctccgatgagcccgctggcatgatggagaagtcctacttagagttgtagacaaagcattggacataaaagaaaaaaaaatcctacagacagagcaacaggatcaacgagtagtgaacctccaatgttgccaaacaagtgatgatgtgttgcttcagatgttcatttgatcagatatgctcagatccttacaacttggcaggtgaatacaaatggtggatcctgcttacgatatctgaaacaagtttcaacaatcaacaccgatgaaacttccacgtacctctgttgtttcgttctttttgtgcttttgtcatccataagaacccaacagtacaatctcttgagcgtgcagcttactctgcttgcaatgcatgagacatgacaacacagcaaaggttagttagcagtgtacctggaattagacaacatctgaagggcatcaccttgtctgcagctgcattggccatgcaatcaaagagcagatgggagagcagagcagtggagattcctgctgtctctgcataatttgcctcataccatcttctcaacctcctgattataagtagggagagttggagcattagcaccaccagttcatcatctgctcccaacactcagagtctgaggcatagcaccaaatttcattccaaacatggctggccatcaaagatcgacaagcctgccgtctatgcctcaccccaactacatcaagatcgaagaagagctgcgcaacatatgctcaggcatctcatcgccatccgccaccatcgaaatggtgtctgacgctctgaggaggcttggtggcgtctacaactgcatcaacgagatcataagcttgcatagcaaccaagcacatggcaagaagctggaggaagagatggagcggtctctggaggtgctggatctttgcagcgccatgcaagagatgttcgctgacctgaagatgaccatccaagagctgcagatggttctcaacaggggagaccatgcagttgttcaagtgaaggctcagtcatacatccgcctggtgaagaaggctaagcatcacctgaagaaggccagcaacaagtctacctctgatgaggatggaaggcttgtcagtctgttgacaacagcgagagggatcactgcctcggtcctgaaatctgccctagagctcctgtcgaagcaaatctccacctgcaatccaagcaagtggtctcttatctccaaatcgttccagaaggccaaagtttcatgcgaggaggtgcaattgcaggcattagagttgggcatcgttggcctagagagcggagctgagaatctgttcaggagattgatccaaaccagggcttcccttctgaacactcttagctcatagatgctccattggcattggcatccaacttttataggacctgtcaatcaccacaaattttgaataatatgtacgtaagtctaaatgtatagcaagatacataattgagaaggcatgcattgcttccttgcaaaaagaaattacacagttttgttaacatgtgatttgttccttctctaccatcttggagcctgtgtttaccctatcaacttatgaacaagtggcacattatctctatccaggtgtacaatcggaagctacgcaaactgacttgactactgtgacaacgattgtttgatttctcaacacttccttgcacgcctgcaaactcttaaaatatctcaaaaaattttgccagatgatgattgcattcgtgtgcaagtgttgcatcctagaaagttcttgtcaaaatttaagctaactaatcaagtcacatttctgctgtatgcttagctgctcactgctaccttccctaataaatatgatttgacatgatcgtgtcatatctatccaaccgaaactttgatattacaagataaattatactggttgttgagtcaagaatgcgtgcacttgcatggtcatcctttctgtggatagctggaacatgccagcgatgctgctgctgctgctgctgcatgagagatgaatgttcaactcgtcctaatgtaggagtatcagaagaaaaccaaaataattatttcctcaccagcaccaaaaggctgcttttcctccttccttcctgatgatgtatctggatctgaaatcaaactaaaccctcgtgcaagtatactgtcatcaatagttgagacatgacaggctcataagctcactcattagcatttgttgcactaattaaaaatcagatgaataacaacatgtctaggcttgaatggctatgtttcagaacagatcacttattatgacaacgcacaatgcagggaggttagtagatgagattctttctgtcgattgctctgttcaaacccaatcacgtttttggttctgcttcttcagttataaataagagaggagccaaagtgtttgagtaccagcaaagtgcatcttctctcttccttgctcttctcttcccattcccacagaagaaaataacaccaaagcttcaatcccgacatggcttgccatcaaaggtctgcaagcgtgccttccagcccttgctcaaatgataccacaattgagcagcagctccagaccctaaacacagtcgtctcttcaccatcagcaaccatcgacacgatgtgcgatggtttgaggaagcttggagatatctacaactccattgaggagctgatttgcacacctagtaaccaagttagcctttgccagaagctgcaaaggaagttggtggaggaagagcttggacggtcactcgtcttgcttgacctctgcaatgccatgcaagaaagcttcatggagttgaggatgagtgtacaagagatgatgttggccatcaaaaggggagaagatgcgtctgctcaagtcaaggcatacatccggctagccaagaaggcgcggaagcaattcaagaaggtcagcaaaaagactgcttctgataagatggactgtagggtggtaaagctactagcagaagcaagagaaatcaccgtctcattgcttgagtctacatcctgtttcctgtcgaagaaaattgagacgcctaagtggtctcttgtctccgccacattccagaagagcaaagtcatgtgcgaagaggagcaattgcaggaattggagctcactatcaaagaccttgagagtggagcagaacttctgttcaggagattgatccagggcagagtttctcttctgaatactcttagctcataggcaacctgagctccaataccctgtgataggcctccactttttaaaggatcagtcgatcacaacaattttgcaacatgtatagtcttgtggatatgtatacaaagttcactaaattaaaaagaaagagaagcaattttgtcaatttcatgctatgagtctttggtattattcacatcatgactgattgacgtttctcataactaaaatataggtattgtgcctcaaacataccatccatttacagggcaaaagaacaacctaagatccgggccgttccagccaagtaaaattttgtgcctcttataattttttgatgttaaaacaaaagtgacatgtctccataaggttatcaacttgttattacagccttgcgggcttcacgttaatggtttttttttatgggaacaaaggttatgttaactcacatgttcctctagcggaagatccttctgaaatggatcttgctctactcagctgaaacatgccagctccaacacacgagctacaacccggtaattagcattatcatttatatttactgatggaaacacctactaatgtcaaagagcaacaagaattgaactaatacacatgcactaataatactcaattaagaacctgttaatggttttccttgcatttccctcaagacccatcgtgacggttggaacaaatgcagattcttgctacctataattgcaacatgacagagtgttaagaccagtttgtgaagtctagtgaactaaatatgtgtacttcacgtgaaaagccttgataatgcagcacttctgcagcattagcatgcaacttcaacagacagcatctgggaaatcaaatggcatgattctttctgtctacctttcaaaagatgctcgctctctcccatttcttaaaaaattgatgctgtctcagttgcttccagtgtataaataggcatcgcctgaggagtagagacatcaaacccaagtttcatctttcttccacatctcccaactctcgaatactccaatacaaagatggcttgccacctaagatcagtcagtttgccatccaagaggcaatccaatgaagctgaaatcgaggatgagctgcaaagcctagaggcaagcatctcttcaccctccacgaccattgatggtctgaggaggcttggagatgtctacaatcagatcgaggagatgatccacttgcccagcaaccaagttttctctgcacagcaaaggaaaatgttggatggggaaatggagtgctccctcgagctgatcgatctctgcagtgccatgcaagagaacttcaccgagttgaagaccatcatccaagatctgcacgcggctctcagaagaggagacagtgcaagcattcaggtcaagatccaatctttcacccgcttggccaagaaggcgcagaagcaatgcaagaagatgagcaagaagactacttctgacaaggaggactgcaagctgatcaagctattgatcaaggctagagtgctcaccgtctctctactcgagtcgacatcgtgccacctatcacagcaactagtggttcccaagatgtttcttgtctctaaggcattccaaaagaagagatcagttgtttgtgaggaggagcaattgcaggcattagagtgcatcattggagatcttgagaatggagccgaacttctgttcaggagaatgatccagagcagagtagcgctcctaaacactcttagctcatagattctcctaaagtgaagacactctaacaccctgtgattggcctccgccttttaaaggatctgccaatctttgtacatctgtaaatgtatagaacaaaaagagcaattgaaaacagcagttttgatctagccagtgtctcatctccaatcatttatacatgcttctgatttctgatttcagtggtatctgatgatgtgattttgtgatgtgctgatgtccataaaactatgggtaacaaaaaaaaaacatgaaaaaaacagaagatgtgaattattgttgcaagtgaaacacgatttctcttctcaggaagatagagaaaaaagagagagattcgactagaataagttataagtagatggaatcaactttcaactgcttaatgctgtccatttctgaacctaaatgtttgatttcaaagtggccatgtgacctcgcacttgtttaatcccataatcagcgcacgatccttcaatggtggatcatgctggcctgccctgcatacacgcagcatgccagatccaaccccacgaggtctgaccttgtgattagcaccaattagtctgtaatcattccctaacccaatcgctaatgcgataacgcaacagtggaaggacggcggtaacccactgcaacgctaataaaaaagtagggttccgaactgacctccggcgggaagcaggctgcgggggcttgagtgcttgaccctgcagatcgccggcgacggcggccggtggccctgtggcggcgccgccgccgatgcgcctctcgtgagttttttttttttttggtcttttatttcgttttatttttatttaggggcggaaatttgaagagacgcgtggtgggttatgggccgtgtgggctttactatgggcgtcacatgtcaatttcggcccaagctgatgaggaagatggaggagaatcagagaatgcgcatctcgggtcctttcactttgttgacactttcaattttatcaaaacttggtaatgacgaaatttgaccaattttggcattaatatattttgatatgtttggtttaaaaccttaaaaagattttggatttagaatcacctaaagatgcatgcacctgtttggcttagtaccagtgcgctactggtttcattctcgccaataactggaaaatgtatatgtggtaattaagctcttaagaggcaccaacattgtacttgaaaaaggatcaaacatgcataatatcaaaataaaaggcatatgaacatcaaatactaaccgcagacagctgaaacatactataacaaagactgatgccggaaactgatgttgaaaaaacataaactcatctacacgaacggcacctaatacactgaaaaaatgcactaaatgtggatcatatccataatgaacacttgaacagagaaatgtgctgtaccatacaactgaaacatgacagcaatgctgtgaagacaacagagtgatatataatggctgaaatgtcaatggaccaaggctgtcatttataagaacaacgaatcctctcacacaagcaagaaccaaccacgccctcgtgcagatgagtttgccactttgccaacacaacctaagacatgaagcatcaacttgttagagatggttgacaatgtcacaatgtgtccttattttgcagcatgacaactcacaactgataagaacattttgcagtttagcacggcaggcaggagtaacatgctagtgcagaaaccgcatgattgattctcccatttcattgcatgcttcattggtctcaccatcttgaacttgaattcaacactaagcaacccgctcgtgcagctgagtttgccgccaataatcgggacatgatggtacaatcattagctgagctagagatgcctcttacatgaaaaaaaacatcagcttgtcgaggagttgggtggcttctgttgcagcagcacaacaattccatggctgtctacacaatcagaaatgccattgcttgagctcctttcgttatatatacaggcaaaccatgcccaggtcgacaccattgcagcacagtttcctttctcttcctatccatctccagagaaaagaaaacaagagaaaaatataatggcattccatctcagatctgcgagtgcgccatccagcccacggtccagcgaaaccaatgtcgaagaacagctgcagagcctaaaggcaacaatctcctcaccttcttcaaccatcaggacgatgaacgatggcttgaagaggcttaagagcatctatgatagcatcgacgagatcatgtgcatgcctagcagccaagttctcctttgccagtcacagaacaggaaagcagtggagcaagagctcgagtgctctctcgtcttgcttgacctctgcaaggctatgcaacagaacttttctgagctcaaggcaagcatccaagacatgatgttggttatcaagagaggagaagacgcagctgttcaagccaatattccatcatgcatccgccttgccaagaaggcgcagaaacagtacaagaagattagcaagaagactctgtcacctgatcaggagagctgcagggtggtcaagctgttggctgaagcaagagagacagccttctcaatgcttgaaatctcatcacatctcctctcgaagcaaactgtgatgccgagttatagcaagtggtctctcgtctccaagacattccaaaagagaagaattatctgcgaggaggagcaattgcaggcgttggagttggacattgttgatcttgagagcggaatcgagaatctgttcagaaaatcgatccagagcagagtttctcttctaaacgctctcagcatgtagatagaatgatggaacattcccaactctgacacctgtgattggcgtccgcctattagaggatttgttgatcaccaaaacaattttgtatgttcacctacatcatacatgaggaaatgtacaggagttcattcaatgaatatttcactcttttgcctctaatttcccccttcacttgacgcatactgctctcaaacaatcaccggacatttggagcgcttcacctgaagcatgttcaagcaaaaaaataataaattagtcagaagacacataccatttttggctgtcataatatatgcaattagtaataagtacacagttcccaccttgccttcgtaaagccatgggatggtcatgtcaccagtattcacatgagacaggaacaggcacaagatcctttgctccccatataactaaatagttgttgataaattgctcagcaatcagatgcaatagcacacatggcaccaatactagttgattagcaatctccattaaatgggtgctggagcatacacgtatgacaaggctcagtaatagaataagctgccatgctgattcctgctgccaataactggaacatgacaatgtgactcagttaggcctaatgcatcagaaatttggacagcacgtggaatcatcttgagattgcagcagatgctgaatgctgtgagtgcagaaggcaggccagcgatgtgatgctgcacgaagaacgtaccagataagaacacatcatggaggtgaagtcaactgttgcttggccgagcaaaggaacagctcttgttctctttcgtggcaagctcatcaatcccatgatctggatctggatctaaatttaaactacatgctcgtgcaatgagtttgctgccaatagccaggacatgatagacacaagatgagctagacatgccacttgcactgttacacacacttgattaacaaacataaaattcatcagcttgtcgaggagatgggtggcatccgttgcagcagcacattacttaaatgtaattgagattccaatgctgtctacagagtagagatgccattgcctctgcttcttcttcttcttcttccgttatatatagagataaagctaaccgtgtcgacaccattgtagcataccttctcctcttccaacttcagagagaggaggaaaaaaaaagtattacagcttcctctgaagacatggcattccacctgagatctgcaagtgtgccatcgagccctcgctccaacgaaatcgatatcgaagggcagctccagaacctgaaggcaattgtttcttcatcgtcttcgaccattgagacaatgagtaatggcttgaagaggatcgggaatatctacagctgcatcaatgagatcatgtgcctgccaagcagccatgttgcaatttgccagccactgcagaggaaagcagtggagcaagagcttgagcgctctctcatcttgctcgatttctgcaatgccatgcaggagagcttttccaaccttaagcaaagcattcaagacatgcagctgattatgaagagaggagataatgcagctgtgcaagtgaagatccagtcttatatctgccttatcaagaaggcacaaaaacagttcaggaagatcagcaagaagtcttcttcagttgatctggaaagctgcagggtggtcaagctgttggctgaagcaagagagatagctatcttaatgcttgaaacctcattccatcttctctcaaggcaacttgcgatgccaagttctagcaagtggtctcttgtctccaagacattcaagaagagagcacttttctgccaagaggagcaattgcaagtgttggagtcgaacattgctgatttagacactggagtcaagaatctgttcaggaaatcgatccagagcagagtttctcttctcaacactctcagcttgtagatagatcatataccactttgatcccctgtgactggtgtccaaattttaaaggatctgctggtcactgcaacattttagcaatgtgtatatacattagaggaattgtacagatattaagttgagaaacaaagcacagtattttatctacttcttgttgcatttcatccatgctttgacagaagcacctaattttcttataagatgcttgccattattgcctgttatagaagtagttagcaaagactgttcactctgatctttgaaattatttactattgtatggccacgttattcagatgccatatgttgcaccagcaacaagcaaaggatccttgtgtagtggatcttgctaccacagaaaaaaacaagccagcttcaacacacgaggttgagcgtgtaagcagactgaattgtgcatagaaaaacacctatggaaattaacaactgcaacaaaactagagaacacgcatgccagcaataaaactcaattagcaccccattaaaataatacattgagcacacaaatatgtcaagatccaccagtcaagtgaactagcctgctgattcttgctgctaattgttggaacatgacaatgtgatagctcatcgggaggacacgtagtgcactaaaaatattgaactgcacatgagtgatggaaaagattctgcatgctgctgccagatctcaaaccttgagagcaagttcaatagtatagccaactactagctccaattcatctatagccaatctaatagctcattcatacaatagttacatactacactattaatacctagtcccacctgtcatagacatactgcgtcttggagtccgtgctacagctggctacaaatctgtagcccgctgctcttctctctcctgatttatcttcttaaaatatgtttgcagctggcttatagcctgctattgtacctgctctgacagacagcatctgggaggtgaactggcaggattctgtttgtctaccctccaaatgatgccatatcttacaaatcctctgtataaatagacctcagcacatagctagacacatcaaaccaaaactttcccttcctcatctctcagattcaacagagagacaaagttttagccacagacatggctttccaccaaagatcaattagcttgccttctaggcctctctccaaagttgaagaggagcttcacagcatagaggcatgcatctcttcaccctccctgaccattgagatgatctctgatggtttgaggaggcttgaggacatctacagctccattgaggagatcatgtgcctgcctagcaaccaagtttgctcatctgggcagaggaggttgttggatggagagatggaatgctcccttgagctactggatctctgcaacgctatgaatgaggtcttcaccgagttgaaggccatcatccaagatctgcaagtgtttctcagaaaaggagatgacgcagttcttcaagccaagatccagtcgtacatccacttggtgaagaaggcaaagaagcattccaagaagactttgaagaaggttgtgttagacaaggagtgcaggatagtcaagctcttgagcgaggctagagagaacaccacatctctattcgagtcaacaatgcacctcttgttgaagcaaatcgagatgccaaaattgtccctcatctccagggcattccagaagaaaaacccagtgatttgcaatgaggagcagttgcaggtgttagagtgctgcatcacagatcttgaggctggagcaggacttctgttcaggagattggtccagagcagggttactctcctgaacattcttagctcatagatgctcgtcaagatctgtcactcttaagaccctgtgattggcatccgccttttaaaggatttgctgatccttagtatatggttagacttatagtgtacagaaaaaagttatacatgaaagaaacagaaattttgatctaattcttgtcgtgcgctcaatcctcacatattattgagatatatgatgtgattatgcaacacgatgccagtattattgcctttgtgatgaatataatttgcacaacccaacacatgaactatgaaatatatgtgccaagtaatattgttttcctttattttattatttttatactccaaatgattgctgatatactgatatgccatatggcctcacacatttttcttctagacatgaatatttggaagcaaacaatttgcgctggtccacaactgcctagttgtttatatattcatgtggccatgttacttcacacccgcctaagccaataattagtacatgatcttagttttggtgcatctcacgctacattcatgaaacatgccaggcccaagctacaaagctaaaagcttgcaatcagcacaatattttgtgggtgtgtgttcttagaggtggatcagtgttgatccctccttttatatttgttttctttcttcttaatgcaatgaagcacaacacacctgtgttttcaaggaaaaaaaagttacatcctaaatttgctgcatgatcacatagcttacctagtattgtgttcttgtgtatatattatttttactgttttggagcactgatacacatcttgataataaagcacgttttaattaagttcagaagtaaagagaatttcttttaagcacagaaaaacagtataattatagtgtgcacagcaagacacagattatcttgagacacatctcaagtttatctcagcaaccacaatttaaccatgcaatgtccatgaaactcataactcattggctcaccaggtatgtgcctcgacttggagaaagacatatacttattgagaaagaacaagattttgtcaacttcttgattgattacactgtctatg

SEQ ID NO: 65476 - DNA, 4471 bp, Oryza sativa
cgtcaatactaataaaactttagccagaaaaaaaatgtttttatgctttggtcatagagtcatggtgtggttttggggttacaaaatccattagctgaccagaacaaccaactcgctagtgttcgtgtagataggtacaagttgacgaactgacgagcgtttagatgtgtggtaggccggggcaagccatctgatctgctgattctctaataatctctactgtattgcctaatcaaggtctccggtatttgaccggcccggcacgtatcgtttattaatgcgcctcgtggagtggagaacggtgcgtgaccgcgcaggccacgacgacgacttgtgtgagaaacaacgtatcgcccggggcctcttgaccttgggtaatgggttccagcgagaggagagaaaaaaaaaaacgaaattccggcagcgagaatcacgcctgcacgccgccgggatggctcgccgtacgtcgccggcggcccccgccgcaaaatatatgacccgtttcgatctgggccgttcagatgagatcgagcggtccacactgggcgtcgtcgctgggcaagacgtgcggggctgtgggccccagtttttatgtgcagcgagggggtgcgtggtccctacgcaggccgtgcaactgggcctcggttccccactgtggccccacccacgttatctgacgcgatacggcccgcacgtgagttacagcccatatagtacgggcctgacgtgaatcccgttccggcccatctgctacggcccgcacggtagcgccgaatcccattcggtacggtgtgttgggctggtgaatgacctgttgtgcatgggctggctaaggggattgatggatgagctttaaaaggaaaacagtatactttgactccctcaacgatggcccgagtataattcatgccctccaacacaaaaccaactatatcaactatcaaaactggtgccccttggtgatttgggaagcagtattggctgatggggtggtgttgatttagtcttcgtcccacgtagctctagccctggcggttgtcccttctcgtcctctttatcttcggcaccgctaccttagccatcactgtgattatcgaggttaaaaccgccgataccatgtccttctcgctcatcctcaagccattgttgggtgactttgtcgtgcacaagcggtttgactctcccgctaactgaggtggcttggcgccgatgatgtcgacccccaccgcggttgctacatcggattcggaggtgacgatgaggagcgccatcccggtgtgaggcgatacggtagtggtgcgcgtccggtaagtgttgacaatacctgttgagatgaccaccggcagggagaagggcgcgtctgcgctggcgatgcagaggctgtcattcttagttcttggcgaggtaatggtcgagaagtggccatcgccaacatcgacggcggtgacgagcgctaccgaggcgcaaaaggaggatacaatgatgacggtggagcagacaaggaaggagaacaagatgctgacaagggagttggacgagcttcgaacagtagcaagggggaaaaggaaagaggaaaaagatggggagtgaggaaagaggaaaaaggaaaggagacaatcagacaaatgatgacatgtgcatcttatgtcaatgggtcccatctttttttttgggtgaatgatatatgggtctcacatatttttcttgtttttgtttttattctaatgccacataaacaccacatgggacagatagtagatcaacaccgccacgtagatgctacgtcagccaaaactgttttccaaatcaatcagggtcaccgtttatgctcgttttaatagttggagaaatcaatatatccggtatttgtgtgttcgaatatgaattactcataccatagttgataccatagtcgagggtgtcaaagtatatcttttccgctttaaaacaaatcaccacccttattttgctctttttttttacttttgctacatgaacaatttttatttttcattcggatgcatctctttcatatataacgaagtcaacataggaaaaattccaagaattcatttttttatttacccggtcagtccataacaattgaataaaaaaatgtgtacctttaaaagagtttaggcctcttaaaaaaaacataggaatttcgaagggatttaaggtggaattgactacgaaattcatattccctctgtattttcatatttgacgcttttatatttatttttaaattaaccaacgttacatataaaaaaggatggagggagttcattccaaacaaatccttattgttttctacaaaaaacaatctgaactttctgaaaaagacaggagttcgccctccagccatcgccatccaacgcactgttgtgttgcgccctcgtcaatggcgtccccttccaagcgcgggccgtacgccctcccctccgacggcgccctccccttcctcctccggtggtgggggaagggaaagggtgcgaggtcgccgtcaccgccacctcggcgaagtccgcgcctccgctcggtcagtgtgcgcccgttccgtccattaccaaccaaagattccactgcacttttgctcgcttcgctttctagtctcctgtacacatctcctcgctgcgatccgtgccctagctttccgatcttgccgcgatcttggtgggtatacttgcttgtcttactgacacacatggtcgcaatatctgaatgcgtcgcccttgtcttgtccccccatgagatgaaccgatcgatgcatgttgattttgggggtggaagaacaactttgatgtaggccaaatttagaggcatgtgtctcctctcacactagtttttagtgaagtgttgttatatgtgaatgacaatatgtgaaacaccttgcaaccttcagtagtagtcctctgcaatgacatgagcagatacgcgaagtcgtagagtttggttgcagcaaggacccatgagggtgtaggttttgtacagtctagtcccttcttctggtacttttgtcttatgatgatatcttggaagaccaatacttccgtgtgctcatgtaattcagcatcggcaacaatatagcttgagactgaatcgaggaatgcacacaagatctccatgctgcgttgggtcgtattcgggaacgatgccaatgaatgaacaagaggagcattccagttctaattgttagcttactattagcattgccaatttgtcatgcatatgccgttggtacagcctgctagaactaattccatgctctcattatctgtcagatagagtgatcaatcttggatgattttgtaggtagacaagctacacttcctagcattttttaattatatttttgtctgaagaggcaggcacaacattttcctttaagcccagtcatttctttcaaccttttcagaaagtcattgtgctaattgctaaataaagcaagagggataccttactgagggtaccttagttcaaaacgcaaagtggccatgaagatcaatattcaaaacctaaatatataaattaccctctaatcaagagtacctttaatgttaagcggcatcgattacgcgttttcttagctggaaggttggtaatccaggttgttattcagtgcatttagctgatgtagtgatggaaatactagacccattctctttttcatgcattttaaaagctagccacctccgttacatgagcagtaatcaactaaccatatccatcgaatgtataccaaatccatgtaatctgtctaaaaccttgcattttaatggaatcatgagcctgttggttagtggttactgcacaaacacgagatggtagctcagtggttacttctatgtgatcttatctataacattgactagctcaaccattggagaatcatggtacggacttgaaagtgtcaggtcttttacttgaaagctgtaactcagatgggttggtgaggactgaggagcctaaatattggtagtctcacttacatgcacatgtaattttgaagggtttttattattaaatgacctcatatatagataatgtcacttgttcttttagtaatatcttcctatcctgtcaaggtatagtcagagcttcagggaagcagccagaagttatactgaaaggacacacagacctcccactaagtcctactgtacaagcttgcttgaagttgggcactgaataatcaactacccctctcacataagagggggaaaaacaagagaaaaatgttgaagttactattcccagataatccctcctgtttagtttttttcaggaccaattttgcatgataataccaactggatgatgtcagctaaatcttctcatctagaaatgcagtccattgattctaactagtacagactacagatagtggaggcaggatggaatagaccaaccgactagaaagaaaattactcccatgatgatgggagtttccttctgggctgcaggaatt

SEQ ID NO: 65477 - DNA, 4155 bp, Oryza sativa
  unsure (1)..(4155): unsure at all n locations
attcctgcagccccactctaccatgaactagttactattaaatgcagttttgccaaatttgcctctctttttttattctatgtgtctccaatagtggataacatttttatgctcaaattgtcctcaataaatgataatgctaggctcattgtttttgcccttagaatatttcacagacttgtcgtgcccccacgaagctgcggttattgacctctgttttggactgttcaatttcaggcatatgcatgccttgccgtggacgatggatcatcgtatgatttgaaacactacaccggatgttaacttagaacttaattaatagagaaaccaactctaatatactcatgctcaaagtgtcaaaagtcaaaacaacactcgttttatcgctaatctgtaggagttgtacacgtcagaaacaacattgttttgttctgttttggaaatagaatataaccaacaaagaaaagggagaattttaggttgaaataaataaagtatattgcaaaaggagaatccagccaaacaagtaggagtttaggagaagacaacattgacaaatttaaaactctgcacacacttacaacagggatcacaatgtaataatatattaaaatattataaggttgatccgttgatttgagttggacattattgattggccccaaatgttaataaagcttggaatttctgtggaaaccattcacatggatcgagtcaaataagtacaggctgctgggttccagacaagaaacacagtgatatgccaatgtgcactgtatctgtactggacatagcttggtctagccactgtccagcgtcagcatcttgcagttccagcatagtgcaaaagggattcaatgatggcaataaaacagcaaagattagcatgatgttnattgttgggcgagtcagcatcaatatttattagcgtggattggcttaatctgcctaccacatgagttttgtgttaataacctggctgcgtaattccagccttccaatttgacatacagaaacaaaggtctaaatgcatttagttggtgtgactaactcatacttctggcctataagtttcaatcgtacaataaagaaaaaaagagtactcaaaaagttaattacatatctcttacctgctcatcgtaccacatcataaactgccacagccagatacctaaaactaagcaacatttgcttttcaacgaacaaataaagatgaatgaccttcaacgaagacttttaaacagatggacatcgtatttattcgactataaacatgcccatgtttattacaatgatgtgaatgaagatgataaataaatgatacatagagtagaaataatggcgtgtccatcgagcacttgggatcaaaacctgacaaaacgacgacggcgcgtatagttgcaggaaaatttctacatgatctcgacctagagcctcggtagcagcaaatggaatgcttccatgttttttttatagaacatttggtgatatatccttattgtttacacagaatctacaataattattcaccgtgcttcgtcttctagattgcggaacccggcggtaaggtcatcgtacagcttctgaaatttcgcaatcaaaacttctttgccctctgcgggatcctcgaatttttgcgacctgtgacaagcaacaaataccattggtcatattgcaatctacacagcgagtgttagaaacttgaaaatagggtagaaatgcgtacactaggcggtagaatagatcgcccatgcgatgctttatgacactgtatgtaatcttctgtccatcagcaccagctgcccgctccaccgcctataaaacaataaaagcatacagattattaaaatagtacttatgctacttttgtatgggaatatcctatttgtaattatattgagtaatgagtaaacaatgagtaacttatatgacatacaacaaacagtgcctctaatcagttcagttgtcttcaattagctccactcattcacctttcaatgtaaatgataccttaagtgttgaagttccatgctgatgcccatgctaggattcaattatttaaattcaagtgacaaatcgatccagagcctatctatgccagtaatccaaaacctagaactccgtatataaatccaactcatactactatctttttgttccagaaatcagaaattctagatcaaacaggaaccagtgtctcagtttcacgccactctatgatcttgggatttggggcctctaggtgacccagattgatttaaatataagctcacgagcatcagtgacagctgatagaacacaattattggaaagttttggcatgattttctagtcagctaggattggttttctaaagaaaattggcaaattatcgaattcctggaacaagagaatttacctgggttgccaatgtgttgaaatgaataatgttgcgcatcatccaaacagatttgtagaatgggcaatacttatcatatctgtttcatgcaacagaattgatcaattagttaatatggattatgacacaggttagtagaactatcaaatgggtttaacactcacggggtgaatgcattttgtgccaaataatcttctctcagaagttttgctgtctccagtgtaatcttgtcagattctgccagtgcgtctttaccaacaagctgaatgtggggtagagtcaacaataaatatcacacaaagaacaacaaaagctcaaatcttacttatgccacagcttgtttaaaaataacgtacgtactaaggtcaagtttattatcattttcaaaatattagcaggaccattaagtgaacaaatgccaagaaactggtacaaagcacttatggtaggcaagtaatatgtgcgaacacttctgataggatgttacatttgcatgatgcagattaataagaagcattacagccaggagggatacgacagtatgagaaaaggtaacttcaataagacaggtcaaaccatcgtggaattccaggagagtaaatattcacaaggctcaaaatagtacctgcactatttcatttaaatcatcttccctctgcaacacctcacgtgcctttgttctaatatcaatgaaatctggatcttccctctcatagtgcggctcaagcgcctgcaacacaaaacattgtattgtcacataacatcaaagcaaatgcgaacgaacaggaaaatgttcaaatataacttattagcatttcattgaaaaaaatgagttagaagaccaaaaacaattagaacaaattataaccatagaaactcgtatagttctgttattctagagacctgttgtctacttcctctggccactcaactccttcctattctctccgttttatattttgtcgctttgacatttttcctagtcaaatttctttacatttgaccaagtttatagaaaaaattagcaacatttacaagttacaacatcaaattagtttaatcaaatgtaacattgaatatattttgatactatgtttgttttgtgttgaaaatgttgctatatttttctacaaacttttaagtttgactagaaaaaagtaaaaacaacttatagtgaactctttcatgtttgcccttgtcaaataaaataagtgctacagctctcacaaataaatgttccattttttcaatagtataaaactataaatgaatggcaacaaaaaaaattactttattttcttccccttaatgaaatgaaacgcaattctcttgcattttcatgaaaataaatgaatggcaacaaattcattttagtactttcttaatctttgtgcacaagtctaaatcaacttacagttggaatctgaggggagaataaactatttaagcaagttgcttgtcagaacaaaccttagaatatttcgaataagatatgagccaattcactgatgggaaatgcttcctctgggcaagctttttatctaatccccagaagacctacaaacaagaacatgtggtttaacaacactgaaacgataaacattattaatcatgacagacttagctgcttccttacctgaacaatactaagggttgcagaggtaacaggatctgaaaaatcaccaccaggtggagagacagcccctacaattgtaacacttccgtcccgttttggacttccaagacaccttacttta

SEQ ID NO: 65478 - DNA, 2403 bp, Oryza sativa
ccataccatcaatttgttccataacacaaaaaacagcagcaacagcacaaaagtagtctttctttgctttgtcttccaacacaacaagagataaaaaaagaagctaacactttagatagatagcaagaagccaagaaccctagctcccgagtacctaggcggtgaggaggacggcgccgccggcggccttgatcttcttctcggcgaccttggagatgagcttggccttgacgacgatgggcctctctggggggagcatccccttgccgagcaccttggtgtagccgaactgcgtgacgtcgatgacgggggccttgccggcgccggcgccggcctcggcgggcaccatggaccagaggcgctcgacgttgacggcggggcagtggaacctgttgctgagcctgtggaagtagcgcatcccgaccttgccgaagtagcccgggtggtacttgtcgaacaggatgcggtggtggtgcatcccgccggcgttcccgcgccctcccgggtgcttccggtgcttcccgatccgcccgtgcccggccgacacgtgcccgcgcttcttccggttcttcttgaacctcgtcgtcatggcggcggcgaagggcggcgacggcggcggcgggtgggtggggaggaagaagggggaggtgggagagtgagtggggtgtttatagtgttcggtgaaggggtatcggccgttggatcgtgaggaggggtgatcttgaccgttggatggatgcgggaggggctcgattagggtttttgagggtgaggtgggctgggccctccctctcgctttgtgctcacttgagatgggctgttgaaatgggctagtaaaggagcttttaaataaattcggagtgataaagaaataaaccatttgatctacttagttattattatcgattggagttttaaaacatcaagatttaatcacatcgttttttttaaaactcaggtaatttattagatcaaagaacaattacatcgctcactagccactttacatgcctcattgtttgccttatggcttataagccaaagccaaaatttgaatagtaaaacttgattttgatggtttttcaacatagtattttttttttagatttggcatttcaatcactaagaacatatatataaaattttactcatatatcattttcttaaattgctaataaatcgttatggtttataataaggaccgtaacaattaaagccgatggcttctcctgccatagcagatcaagccatggccatgctactctagcctcccctagggtagtgaacaagagttaccaaggtaaaagcttcagaaataaccacacatttaagcccgcagctgctgtccccgaaaaccctccccgaaaaccctccatttaatcacatcgtttgtaaaatgtttgtaaaagaaagtttgtacttataataaaccacatgcatgcccttggctacatgcttatgcagcaacaagacataccctttctacgagttactgatttacattcagaaattcagatgcgcgtgtattttcacttcagagctgaataacatgaaaacgatgcatatgctgaaaataaaaatcagatgtattcgaataattttctgccattttcaactaattagtatttacacgtacgttgattaaattggtgagtttacggtgtagaacactgtacttcccagcagaaacgaagagaaaatgatgcacatcagaaacggagtatgtgtaaacaaaactcaagagggcagattaactgtaaggttgtgctggtgtcataataatctcttcatgtctacaaagaatggatcatataataacagttccaatctgacaaaaacgcctattcctcaacagatgggaggagctaggaaactagaaagaaaagagagaaaatgtgggcgtgaagagcagctcatagcaacatacaaaaaagcacaacatgttacaatgagggctgtatcaaaactaaataaatatcgcctcagccctacctagggactcagaatttgcaagacatcgccattgccgcagcaacgttgatatgtctctggccctgaatctgtgttacgcagctaaatatcaatttcacaatttacataaaatagaagaagaaataaatcctagggaattcctaggccaaaagcaaagaatcgtgtagagctcaagtggacgtgtagctggagtgcttcagtaggttgttgagagcttctgggtaaaactttctagcaaaaaggtagcatggtctctttgttccgttccacatacagggtgtcattgtcacaactttctgcgatagtgataaatgtacatatcaatattacatgtaggagctacatttctatgttttagttaaattccttgactgcgttgcatgcagacactcaaaagcaaatatcttcagg

SEQ ID NO: 65479 - DNA, 1253 bp, Oryza sativa
aataataattcctaaattttttaaataagacgagtgatcaaacagtacaagcaaaaatgcaaaatcctttatattatgggacggaggaagtataacatttgctctgttgctcatttctaaaacttctgaaaaacgaccaaaaaaaattacaaacttgcatctgatctgatccaacaggctggaggctttgacaagctgctactcgacagcctctacgaagacgagacgaggcggcggcagatcgccggagtcacctacaccggtagcattggaggaggagcacccaaccctttcgacaccaacgatccatttgctacgtcgagcagcttcttgcccccatccaatgtccagtttgcaatgctgaaccagcagcagcatcagtactaccagtctcaacaccagcaacaatactaccagcctcatcatttccaggatcatcaacatcaccataacatgtattttcagacacattatcaacaaaatcagatataccaacaacagcagcagcagcagcatcagtaccctgcacctcaggctggatcttccaatccgtttggtgaccctttcggtgacctcgtaccaatggcaatggctgtctctcaaaaacatggacattcaagtttgatatgaatttgccatattcatgttgttaatgatcccaggcaattttaacatagatgggttaacttagtcaccttctcacttgacttgagtagagcatcttgtacaacttgatcttcttcgtgctaacttgagaattatgatgctgtatttgccatctcgctctcttgcaatatccacatttactcgaaccattgtagatttgtgatgctaatctagtgttgatcccaaatacaatggtataacctgaataataacaccggtataatcccaacaaattctactattaaaatttgctgctctattaaaaatatattagagtgaactgcatccttatatgtgcattaggttacgccaaaatccaaggcaaatccaaatgcattaggttggcatccgcatctgacaggcaatacagatactacatggcaaatcttgatgcgacaaaccatccattcccaatagcatttcgatatcaagaataataatcagaatgatatgcggcacaaaaatatttgacataaacctacatgatcatgtaattcaatcaaaactcatgaatagccaccacagatcttagtagccataccatcaattcgttccataacacaaaaaacagcagcaacagcacaaaa

SEQ ID NO: 65480 - DNA, 7276 bp, Oryza sativa
caaaaggggcaaggtccaaggcatccaatgttgcactcatctatgaaacaacctgcaatccatgggagaaggacgacaaggagcctcgcatgggggttcgatttagggaggaaatgtttgtgggttcgattttgggaggaattgtgggttcgattgcgtgaccacgaaaggatatcgaaagctcgacaacgggtggttctaccttagacggacggtatgggctctgttggattgcattgctttcaatttgatcttcccgttggacaggaattcagcaagtacagcggccaaaacttgaattctcgaaaaaaaaaggattttcgtttcaaaagattaaaaataaagtaaaccgtgatggcttcatcaggttgacaacttgatatgacgagaatgaaccacaaccttgcaggatgacagaatatcagtgcatgtcaatccatgggctgtagcctgttagaataacaaaagatcaggccgaaaactctgattgctacaatctttagcgatggatacacaagcaaaaaaaagacatgagatgaagtcttgcaagcttaagaaaaggccacaaaatcaccacgtgattaatgacatacaaactgcatcaaaacaaagcagatgcaaatgttatgcctataagatgagaaaggcagggaaatacattaaacgaccgacaaagctgtcattagagtatatatcgaagcagctgtgctcaaattaactgaaaaagtttttaatcacaatgcatgcacttccagtttgaagttgcttatgataagatgcataggaatgtaacaataaactggaaagttttttgctgactttccgtacaaaataaaccatcaaacgaacatcatcacaactccaggtagctcatcggtggaagaacagaaattctgttagatcgaatcaaccacagacaaaccccaagtcctgcaatacagcatagataaaacagggcatgtagtcagccttcacatcagttgcagtggggttggtatgacaacatttaaatcatgaacattcgagtatgagcttggagtggatagagacattgcataattaaaaggtgcattgcagattggagtggctagagacattgcataatcaaaaggtgcattgcagaccttcccttgtgaataactcctctacagtagaggcatacattactcctaaatcacattatatcagcatgttggaagttcaacaaaacattatatcagtttgactgtttgagtgcccgtttgttcttcttaaaagaagatctgccaatcattgatctaaccaggtagcaattgaactcatgcaactttgaagaggattacataaaatgctgcaactacgctattatatattgtactaaggttatttcacagatatattgtaccaaggttatttcacagtataccaaggttaagtcagaagatgctcgtttcatatggtgtgacagcaatatgcataatttcaactaatttcatttcaattatgcaaaacagacatgaacaacaaggcctatgcactgactcaaaaaatagctgtgactctcctcctcactacatttatactacaataaacagcgaagatgcatccattcacacagcaaatgcttcaatccatacactacactaaagattatcaataaatatgtttgcttcaatccatacactacactaaagattatcaataaatatgtttcaccctttcaagacaagcaaacaaagcaaagcgtgaaatgcacaaaattagtagatctctgcaggactcgatatatatttaaagttgtaacttgttgcggtggagaggcctgctgatatccaagcagtactatgtcaaaggataaatggatcacgaccaccaaaccaattcagttgtactaaaaacctaataatcaaagttactccttaaatctatcatttaccttttcctataacctatattatcctcaccgtggtggaaatggagcaacatacgatccaaaaaaattcctaatcaaagttactccttaaaaaacaaaaaattcctaatcatttgttttttcctatgaaacaaatttaattctatgaaaaactaattaaacttactcctgaaaagctagtatcacttttttccctataataatccagatccctctcctgcaccgtgattgaaatgcattaaaaaaaaatccccaaccactcgtgatagattttaagaatagaaacatttcctcatatctccatagctaacatttccaatctaaccatcccaacggcaccgaacgaaacaatcggggaaaatcccagatcagatcaggggaggcaaggagacgggggaaccctcacctgacctcggatctagtggtgggcggcgccggcggcgccctgcctctcgagctcctcgaggtgggcgaggtggcggcgctccttggggaggttgatgaggtaggagaaggccatgaggccgtagatgacgtggaagagcggctccggcgagctggtctcgatgtacttgtcgatgtagcggtcgacggcctggtcgctgctcttcttcacgttctcccagctcagccgcggcttcaggtaccccggcacctcccgcaccttcatcccccggatctcgctgatcagggctcgcagcgccatggatggatctctccgatctcgatctctcctcttccccttcctcgcaacgtcagggctcgcggctagggtttggtggcttccgagacgggaggaggaggaggaagggtgggtgggtggtcaagggatggatttgttcgctacggggtgggatgggttgggctgggctaggctgggccgacctgggcttgtgtgacagacatgtgtagaggctcactgtttcggaaaaggaaaatgtataccgaaggtccctcaacttgtcattgagttataaaatcgtccctcgaccttaaaaccggatacaacgcatctctcaacttacaaatccagtgcaagttccctcggtggtttttgactccgattttattcgacgtgtcagctgactcagatggtcggtaggatgtcctccttccttcaggcgaggaatgcattgacctcaagcataggatggcgaggtcgggctcggcctcctcctcaggcagcattgaaaatattgctgaagaccgaatttcaacgcagaaatatcataaccgccaaattcggtctcagtctcggtctcggtcctaaccgaaatttagcaacattttcattaatgaaatttttcggttctaatatttttgcgttgaaattcggtcttcacctttcaaaaaccgaaatgaccgaaagaccgaagaccgagaccacaaatttcggtctaaccaaatgcccacccctacttgtcgaagctcttgctaccggcaaggagaggagtagggtgcggggactagggttacgacggctgtggggtggcttcactgatgaagataaaactagcatgtggagagagatgggaaagaaagaagatgggagaacggaggaagaagatggaactaaaatgtgggtcccacgtctagtcgtctaggggtattttggtctgtatgataaccgaaaatgtgacggtgatggtatgattttaattttgtgcgaattcgaatgacatgaatacgactagatgaattaaaataaaatttacctgagtgggcatatttccaatcaacccaaaaataaaattgcaaacacgcggattgcgagcgcgcgcacgagctaggaaagggagggagttggggagcttagctcgcgcgcggcgcggtggatcgcatgcgcgggcgggctaaaattagcgggagagggaggagttgatcggaaaaagggaggccgcgtcgcattgcgtcgtcgtcgtcgtcgttgtcgtccgtagcgggagggagggagagagtacgtgcgggcgtccggaggtctcagcgcacgcccgcggccgggccgtcgcgccgatcgcgatggggtcgtggcggcgcaaggcctacggcgccctcaaggactccaccaaggtcggcctcgccaaggtcaacagcgacttcaaggtccgtcaccttcactacattttttttatctcctccattaatttctctcctgttcttgtcgacttgtccatgttcttgcagctttcttttccttccttccttcctttctttctcgttgttgttgctgctgttgttgtagggaattttgttcatatggtcttgcaatcttgctttttctgttagcttagctgcatttgtccatgcaaatgctgcattgtctcaggatgaaggcaaatgcataatttgtataccctctgtcctaaaaataatcaatttctagaatgaatttggacaaacatttatctatattcatcctttatttctagaatgaatttggacaaacatttatctatatacatccttgtatgttattgggtttttttttttttgacaaagagggtagtatgttacctgatatttgctgggttaattgtttcaatggcaggagttggatattgcaattgtgaaggccaccaaccatgtagaatgccctcccaaggacaggcacgttagaagtgagtactcgatcatcttctcctccataatttagttggctaccttaatgccaaaatgtatctctttcagcaggtaatataatcttagaatccattttttttctaatcacattgttgcagaaatattcgtggcgacctccattaaccgccctcgagcggacgttcaatactgcatctatgccttgtcaaggagattgtccaagacaaagaattggacagttgggtcttgctcttacagtcctctttgattatattccttatctcgataatgtgcttgttgatggacattttttggttataggttgcattgaagacattgatagtggtacataggctcttgagagaaggtgatcctacattcaaagaagagttcctggcctactcatacaagggaagcgttttgcagagagcaaacttcaaggacgattcaagccaattaggtgattccctatcttgcatagtgatcaatgcaacagagagtcatgtgtatatatttttcccaaatcaaactctaattggaggatagaaatgatgcatcaactcacctagctagccttgatttttgccagcttgggattgctctgcgtgggttcgcgcctacgcgctcttcctagaagaacggctcgagtgtttcaggatcttgaaattcgacatcgaaaccgagcgtctgatgagatctcctgagtgttccagcaaggttaacattatctttctcacattatcaaaacgaagtccatgtagtgaatgagatgttttgcctcatgatgattaaactttcgttaatcctaacaagtgcaggcacacagtagaactagaaccctgccttgcattgaacttctggagcagttgcctgccttgcagcagctacttttcaggctaattggctgccaggtttcataaccaaaatgttttactagcacatccttgtaaagttgttggatgttgtcagtagcttcatccatatttttttgccattgcagcctgaaggtgcagcaggcacgaactaccttatccaatatgcattagccctggtaatttaattcgcaagaaatcttgcataggttactgatccctttatccaacacattatttgttcttaaatatcatatggtggtttcacatgtgctataggttttgaaggagagcttcaagatctactgtgcaatcaatgatggtatcatcaatcttgttgatatggtaaagtaattctttatgatttttttaaacagtcatatgctgttatcgatgttttatataaaagaagaaggtgccccatttttagaagaattctttacaatatcatcctagataggttatcgctttcagtgtcgctgaattgtaaatataaatttctggttcttattgttatgatgcagttctttgatatgccaaagtatgatgctatcaaggctcttgttgtctataaacgagctggccagcaggtatatatctcaattttataatctggtattttctttcatgaaaatggttgaccctcatgcttgtccaatgcacaggctgaagatctttctgacttctacgattcctgcaaacaacttgagcttgccaggacattccagtttcctactctaaggcaggttagttcatcatcttgatctcaaaagattatcttaggtctaaatcagagcaacaagatagcgaaacattttcatgaatttggccacatccctcatgatcttggatttctaatgctcattccttgcacattatattctgcagccaccatcatcattcattgcaacaatggaagagtacatccgagaagcaccccgtccctcgattaacagcgtggtgagtgcggttcttcatgagaaacaagtacttaagaactagtgcaattctattagtactattatgtttgtgtagttcttgtgtttcttttgggaaaaaaactgtaggagaggctcctacagtgaataaatataataataatataaagttataaatacatgtttatacaagtgaaaatacttagaaactgtctagccattctgaaatttgtgggtggtagttttcttttgccctatggataaccaaggcaaactctgctctaaacttatctttgcaaactttgagaaagggatttagattttttttttcgtaattcttgttgcaaaagcaggagaatggtgagaggaagctagtgacctacgaccaagaagctacagaggagtctgaaaaaccagcagaagaggagaaagatgagcctgcagagtctgaacaagaacaagagcctaaacaagaaccaaagccaccagaaaccactggagatctactagtacttttctgcactattttctctaatccatttatgtgctaatccaagtgtccacttccctaaatcttatttctttgtgtctgtttttgttttatatcttgcagaacttggatgcagaggtgagtccattggttgcagaactggaagaaaacaacgcatgggccctagcaattgtgggaacaggtatatttagctgtattaatctcaaataacaaaacattggccacttaaatttagctgtaaatttgcggacttgctgccaaagtttaaatgagccaaaaaagaagtcatcaatgttttttttgtgtgtttttttggtcttttgcttgcaggtgatcaaactaaggcatcaacttccctggacttgtttttctggcaacacatctgggtgggagcttgcactggtcactgcttcaagcagcaccagccaaacagttcaaaccaaat

SEQ ID NO: 65481 - DNA, 894 bp, Oryza sativa
tcctgcagcccgcatttaatagtaactagttcatggtagagtgaaatattgccgcaatgcctcgtttgttcacaatatttatccgcggtacaatgtgtacataaaatttgggcaattaatacatgatgtactttacccgcacaaagtattcaattagatatatagagagataacacttcgataaaccaaaaactccgaggatttgccaatccgttctaccattaattaatcctttcatatgcgtatgacgtgggttttggtcgcgtgttattataaacaacaaatgctagatttcatcttcaactactactacgtacaagggagagtggaatgtcaaatcataaaaatccctgcaataaccacattctcctatgttgttttgtgcacaaacacaatggatcaatattgccatgtgaaagaatatctgggcagtcaataaaaaaaatgtatacactactatagcacatcagatgatctgaccaagaggagaagaagaagagagaggatcccaaccccaccacctctcctcctcctcctctctctctctccgatctgcctcgccgccgccgcggctgctcttctcctctcgcctcgcctcgtgcgcgcggcgagttcgacctcctcctcctcctctccgagcccccgcctcccctggctgcgggcggggggtttcgagggggtggacgcggcctccgtgtcggcttcggctcggatcgaattcaaaggtatcgctcgagctctcgctgctcttacggcggcgcttgatgagcaccgcggcgtagattgtgagatccatcgggagttgggattgatttccttccttttccaatcagtttaccccggatttattttattaatttgatgatacgtgatggtttagtattattgatagca

SEQ ID NO: 65482 - DNA, 1860 bp, Oryza sativa
ccgtcagcttggtgatggagccgagcctcgcgggcggtgtgccttccgctcggttgcctgctcaagaaagctcatcgtggaaacctaactgtaggtaaatttcttgtccaagttcagttttgatgaacactagctagtaatcggtaaattgttcttgtgttctagagagagagagaggagagagagagagatgctttagttatgtagttgttcttcactctctcatctctcctctcccctttgcaattcttggagcacttgctttctcaccgattaaaagaacaccaatggtgaggtttatggagagagagaagagactagagagagagagagagaggagggaaggagaaggtggtggcaacattttaaaggagcaaatgggtgagtgggagctgggaatttgggtttgttagggattaaattatttagtggtgttgcacatgtgggagctctttctgtggaggtttttatttcttgatatttagtggagaatattccacaatatcgattatttatcttatgagaatcaaggacttgtccttctttaagtgcatccgaaaattcttaaattttgcatagattagatatgatcggttgatcgttgtctctttatgaggtaagaccgtaagagtataatccagcggtctccaccaaaactttgtaatgtatagttttattttatgattttttttaaaaaaaactaatttatatgatttgtagtagttgagtgttggtgatcaaatgtgattgatgtacaaggaaggagtactgtagctttgtctgttgagcatttggatgtttgttatggtagattgtccgtgtacacctatatataataaacatacaaacttgcttttcggcagtttcgctgaaattttgttttgttgcatgttcatggaatttttagctctgctatctttgcttgcttctcttgggatgatacgatggatattgctcatgcatacggttacctgcataaacttgtttgtttgttattcagatcatcagatgcacacacgtacacacccttaatttgcgaaattttaagcgatgaagcaacaagaaaagagttagtttgcaacatgattattaaagccagtttttctctttctattaaagcatttcgttttttattttacctgaatatttctttcttttgacaaaatggctcgtgaactttctaaaagcactagggcaaattaggaaaacatatcttggtgtgatcgatccaatgtggacggctctctctgtttctgtgtcacgatcgtcatgaaaagaatagaggaaagtttattgcacatttgcatgtcacttgcaagtgttgtcatcaagcagaaagaaaaggtaaatcctaacgctgtatatattacaaccggaacccaacgcttcaaagttgtaatcatcatgtatgtgccaattaaacagtattatacatgctccaattaaacagtttaattaaaggcactgattagaaccttaagattttttttgacagatctatgcaggtcttgaattattctctacaggaaattcatgtgttccaaacaaactctgacaattaaggtagtattcgataaatgcgagtgctcatatatttataaatcaagtatggtaaaattgtttagtgctcatgtcaatttaattctgtcatacttaactagacatattagtgagcctaattaagaaattatattgcttggtgatataaaatgtgccaccctttttttttcgtacttttagcacaactcatctgtcaatatcttcctcttttctcatgggcggcaagcacaataaatccatccaagacacgcatcatgcgttcccaatatacctgaaaaccaatggtgggctgcaggaatt

SEQ ID NO: 65483 - DNA, 4430 bp, Oryza sativa
atatattgttgcttctttcttaaaaccattgacaccaagcccttccttggtgtccatctttaagctggacccaagtcttgatctgatctggttacaatacattgttagaactgaatcctggacatcatcctggtcttagacttcagagctgaaattcttagggataaactattctcagtagttttgtcctggtaattttgaatctattttagtattatatactacatcacataatctatgaaggattcacctgtatgggttctgccatcacaagtacagtaattgttgaaaatttactcagtatgaaacatggcatatgttcttagacacctcattatttatttttagtaaaccttgtttttgtccatgaattaacattttttaggggttgcttaaatatcagagcctatattttgtcaaatatgtaattgcttaccgcattttagagtaaacacaatgaaataatctttggattttcctatttacctaattccttcttattttcttttagatgtacacgatcttttcaagtactgtactttatgtggctgatgttatgtttccttacgtgttttcatttcatatggcaatcatgtgcagtccacatgttggcacactagaatttctttacttttcttagaacaaaggacaaagcatccaatacgaccaaatcagaccttttgggggcaagaagactgatggaatagatttaagtctttaagcttcatctgttgaatggatacagaacaaattctttcaaatgctttacacagatgctctatattggcatatagtctctatggagactaggttaaatatgaccagtagatttgcatatcatttcgttttccattctgtgatgagtggatataacaacttcccgcaaaactcttatcttcattatttgcagggtagcatttacattttggatatgcactgctgatggactcatcaatcctgatgctacgatattgttgataggcctgttgttcaaaatacagtgaattattccacaaaatatttgtgttgtaaatctgtttcttagctcgacaatgaatattttctgaacaaagttactgttagggggatgtgcatgcaaaaaagtaaaatattcaaaccatcattctgtatcatcaaggtttgttcatggatgagtagctagaaagactcggtgtattagtgaacttgaattgtttgaatgcattgttcctattaagaggctcatcttcctttattagtgttttagttttgtacgccttcaaattttagacaggtagctattgctactgggtgacaactgatgttccttgcaactgaagaacaatggtagacaggaacaggtgtagatgttccttgctgcccccttattgtatcagcatcacagaaatgtgaaagataaaatagcttgtttcctatactatgcccacctgagaggcgagttaatgcgtcctggtagctcatttcctttattttacagtgtgtgactaagaagattaacatatcatgttctcgttttcatgtataggtggtaaccatacaagctgttgttgaagcatttgctagtctgcctgataattctattgccttcagaattgatgatgaccacaagtacgtctttagataatttcctctctgatgtgaattgtgatgctcaagatgcagagaaggcagattgtgccagactctcctcttcggtccattccaggctactgtttgctgctgatcgagtgaatcaaatggtgctcaacgtggtcttgatatggagtgaatggccatagaatctaattccacagatggcaagatcacatccaagcttctcgtattccaccaagaaactattcctgggagcaaattctgtgccaggtcagtatgaaagcagcctacattggcacgtgcctcccggacatttttagtaccgcactgttgctacctttttgtgtacacctgatgacttacaaccagggattaaaaactgttatttctgtcaaaagaagtacaaaaaattctacccctcttcagtttgtataagcattgggcgtagttgaaaaaagaaccccaaagtcttcaagttttggccaacaattagtcaaattttattcctgtttagtctataaaatttatattaataaattcgtatttgagagtgtttttacacgatattggttttgtggccattgaaaatatattgtaagagaaattaatggttaaagtttaatttgaagactacaccaaattaaaaaaaaacgttctataaaattggacggagggagtagcaaaatagggcaatacattagtaagaacaactgcagacttattatcttgtttgtttgataaatggtaagctttcttgcatgctcataccaatactgctgtgtaatggatggtcccaactcccaagtgatgtcactaagattcaggttttatgacctggtgttttcctgatgcatcaacatctgtgatactgccatagtgtacgtgagcaagaatggtcaaagttgcaagttgatcttacctaggcacctagtacactctacgagatatgaaaataatgtgcctgcacatgcatggaccatatggtccacatagatgcaagaatgacaattttctagaggcaaattgtggttgggatagatgaggcaatgtttttttgtgacaatctgtaacttagatggatctcatctgcaactcaaaatttgcctctagaaatcagattctggtgttatttaccagtgcttaattagaactggaagttgaaatactgaaattcggttattcattagaacaaatctgtcgtctagaccataaaacttttacctgagccaattatgcacctgatatgtaatacactctctcttactgaaatttcagaagagaacataacatcaaattcctttactaattacttctgctcgtacataatattgcaagcacgaagtttccagtgtcttgcggtgagcatataatctcaaaactttcttcatctgtttaatctgtttctttagtgtgagaatcctctccatttttttttattcaagccacagttaagaagcattctagtgattactctttatatgtttcatccgcttaattaaatgatctctttgacctctctctatatatttctttgctgctacagaattgaagagcagcctgacggtgctacatcatgcagtcgattattcgatcgactaggcagctgcgacgctgagggagaagggcaatggcgcagagtgcggcgaggccgagtagtcgttggccttgagggcttcagatccacagttgtctgcatggtcgtccattagcatctggtggcacctgcactcggagctgcagaaggctttctcccccctacaggtttgagacatgcacaatgacgtaagtggttgctctactttttctcacttttgacaattccaatgtttaacgagtactagtaatattgcaaagcaatgtgtgacatctaaaaatgtgattggtgaacttgttgttttagtgatgatcccattctacattgaatatgttttgaattgagttaaaagggagaataaaatatgatctgttatttattgaagcaacagggaaaagtcttcactttcactctttaggctagagattatcatgctaatcacaggaaaaagaagaaaacataagcacggttatgatggatccatgttatataacattgtatattgatctggtgtatgtccactagttatttctgattgactagagacttatatactatatactttttacatgtattgcaggttagctgtcttccataaacaaagcaacttcactataattaaaaagctacaaactacatactctattaatcttttaggaagacaaaaccgtaacatcctcttcaaccaaaaagctagaaataaaaaaaaatactaggtaaaacttagaaggtaaaatgtatcatgtatgatatttggcatttccaattgctttctggaaagataatgaacttcttataactatttttgaatttttttcccacctatactaaggtgctgtgtgcttcgcagttaatggcaggttcacgttaccaataaatacaaaaatataattagaattccaaaatgaatgtttaagctcctgaaaattttaagcaatatatagaatagtccataaagtagaccttgggtgccaataagtataatattgtcaaaacaatatagtactattttcatcaaaattttgatattttttatgatgcatgaaattttatttacctgtacatgtagatgtcgagcccatcaagcctcttgtcacacaggaagcaccggctcaagaagtcagccgccggcgccggctcctcgtcggcttccacaagccagccgccgccaccgtcgccgaacccaaagtacacccgcttcctcacgctgccgctggcgccatcgacgccggcgacgtgcgtg

SEQ ID NO: 65484 - DNA, 11298 bp, Oryza sativa
gagcacatgccgcgcctcctcgccgcgtgggccgccgcggtcgaggccgtcgacgtcgaggcggccaccagggccgtggatgccctcgccgccgaggcggccgccgtcgccacggccgcgcggcggcgcggcggcgaggaggagtggaacgaggaggaggggaagaagaggatctgcgtcggcctcgcggcggcgctggcggccacggcggaggccggcggcttggcctccgccgcgtacggcgagctggtggtggagatggaagagagggagcgcgcgagggagatggcgggaagggacgaagagcaaaatcaaaactgaaccaaaccattgtaattgtaaattaaatcgtccttaaccattcacagatcattattagagtcctttgaagcatagaaatcgcactcaattatttatcaccatgaattgttcagaaacgaagcattcactttcagagtaaatctgatttaccatatccctaccagatgaaattttttcgaccatttggtcacttacctgaattctccaggctctcaccaatgatggatcatgaattcagaaggcaagctcaaccagatcagaaaaaaatagttccaaattccaccacatttatacttcgtagtttcagactttcagtctcttagctagtcagttctattacaggaatagggaagagtgcatgacacttcgacacgaggactctgaaaaactcaagtccgttcacttggacacatcacgtttcaaacgtagctgagctgacatagaagtaggaccagtagtttcacttggacatgccgccgttggggtggttgtcccagccccaggcgtcaaccacctcgccgccgggcatctgcaactgctccggctgggacagcccggccgtgaaggggtcgtcgccggcgtagtccaggccggcgagcacgtcggggacgcggcacgcctgccgggggttcagcgccggcgacagcccgcccaggtggccgagcccgcacgacagcgccccccgcgccaccatgtcctccgccatcttcacctgcacttacaaacggggacgaattcagagctcagaaaccggccgaaaatgcaggacggatttgacgatggctacagtgatgagcaatgcaatgtgcagatgaagatggagatgaatgatcaccttgacccggagggcctcaacgtctgatttgaggattctgttgtccgtgacagaagttgtgaattgctggttggcatccgtcaactgcttgaaaagcgatgcgttttcgccccggagctggtcaacctgacaaacaagagcatgatttgagctatggaaatctgaaagaaccggcactagcatttcgcattttgactcagaattacagctaccaattggcacatgatttgttagtcgaatcaatctgttactgtttgaattgaacaatggcaaatgttcggcaggtacaaaacttcagatcatatcagtttacctgtgactcgagatcagctaagtgagcttgctttctcttcctcgatcgccgagcagactcccgattggacaccatcctgtaatttgaagcccccaaccgtttcatgcaagttctttgtcaaacattccttctgaaaagcaatgttcaacttctactactagcgaatatgcccataatttttcacgcagtgacagacaaaatgcttgacatagtcgcttatgttcttggaataccttctcactctcttcacgtccaacgggttcgtgctttgttcgcatggaccaccctctatatccaacagcgattcactttcagaatccgaaccacttgtgcctcccagagtttggctctccttcatgttcagattggtagctgatgtgggacttgctgctgctgattacagaaaattgaacagagagtgagcaagaacaattaaataaactgaacattgtttgtgcctcatcaataaacacaattttgatgcagtacatgacacagtaacagcactggtactgtccatggatgtccatcgctgaaatctccatgagttgaaaaatccaagttgcatgtgcttttcagtgtgcaatacagtagcaaatcattgagtacatcgaacaacaagtatttttgtgtgcaaattgttgcagtcttatgaataattgatgaaaatcgtggaagatgacgagtgtgaggccgtaccacagattgatgactgcgactcaattgtcgtggagaccgcaggatgccgtgcgttcaggttctgggactggggccatatgtgattgggaatgccccctgtgatggtgctctgcttggacaaaaatataagtaaaattaatcgagtgatcaatcatgcaaatcaagaatcaagtacgatttaagataagcaaccagggcttgtaatcatcttccttatatgaaaagaattacttatcaccagtccttaataccaacttaatcaaaccctgtcatgacaacggaaactctcatgttatgctgttaacctaaaatggtttctcctcttccatgctttagaattcatgatttcctcttatcgggctattcaaataaattcttttaaaacacaagacatcattcgttcgcgaactaaaattgtgcaagtttggtgtgcttgtgttgtgatgtgtgtcttccatataatcggggaaaaaaaactcctagtaagagtaaatttattactgtctatccatattcatagtattaggatatgtcgcattaagttgcacgtaagtatatgagtatattggattggaggtcggagggagtacttgcgtaccaactatgaaaaattactgtacaagtaaaaaaatggtagaggatgaaccaacagtcttctacttgagaaaggtagtaggagtcagctgatcagcagcaattaacgaaaatttcgcagacatgaaactctagtcaagcatatacaagcacgtttctaaaaaaacgcatatacaagcaccgtacgtgctactgcaagctatccaatacagcaagtgttcaacttaattttagcacacgaatttaatactacggcccagtttagatccaaattttatcttcaaactttcaacttttccatcgtatcaaaactttcctacacacacaaacttctaatttttccgtcacatcgttttaatttcaaccaaactttcaattttggcgtgaaaacacaccctactactactactatactacgtagtcgcagcaggcagcataataatcagtaatcaatcactcaccgagtccgcgaagccgaagccggagaggtcggcggcggagaagatgccgagcgggtggtcggcgtcggcgtcgccgcccccgcttccgccgtggatgaacgcctcgatgtccatctccgattctccgtcgtccctgctgcttccagcggctgcggcgtcggcgatcggccgggtggtggcgcgcggcggcgtcggagtcggatgcttttcgagatgccccggcgagacagatcaccgaggaggagaagggaaagagaagctttttgtgttgatcgctgcgaggaaggaaagcagctcccttttgcccctcattcccctacgtatttacgatactgctttggaagccgccgcgaaatgcgttgcggcgtcgggggtagtttgggaaaatggcggcgccggcccagtgatgggagccgactcggatccgcaccaccgaccaccggcggcaacgtgacggcgcaccacgtcagctgcccgtgatcttctgtggccacacgtttttgcacctcacatgtgatatgtcctcagtcacacagcactcgggtgcaaatttttggtcacttttaaccccgaactattgttttctttcgcgttttagggtttgcattttgtccttgttttttttgaaaaatgaattaggccctgtttagatcactcaaatttttttatcatgtgacatcgaatgtttaacacacgcataaagtattaaatatatgcttaaaaaataactaattgtatagattgcgactaattcgcgaaacaaattttttaagtctaattgctccatgatttgacaatatggtgctatagtaaatatttgctaatgacggattaattatacttaataaattcgtcttgtggtttactgattaattttgtaattagtttttttattagtgtccgaacaccctatgcgagactctatataatactcgatgtgacacgccaaaactttataccccggtatctaaataccccttagttgtttgccctcacgggtgacggtaggtttgacggtgttaactctagcgcgaaagaacatttatattctcgattgttgttgtattttgaccctatatttttcaacccgtgcaactttgccctttccctagatcgcatagaagcaatcccatgaccctttcacccgccgctcaccgcaacaagccccacagtcaccacctaccatggcgtgccttaccgccgctcaccgcactaggcgtaggaagcctcacgattgtcgcaggcctccacgcgcctggccgctgcctcctctaaggtttttgggtggtgacggactacaagtacgagattcgatggtgcttggaactctatccatttactcagggataacaatgaatcaatatttcataaatcattttctcatactccctccgtttcaaaatgtttgacaccgttaactttttagcacatgtttgaccattcgtgtacatgaaagtatatttaacaataaatcaaatgatatgaaaaggataaataattacttaaattttttgaataagacgaatggtcaaacacgtactaaaaagtcaacggtgtcaaacattttaaaatggagggagtattttaaaaatgcccgagcgttgcaacgggtgaaggatattttaatcatgttactgttatgctagaaaaatacacatgctttgttacgggcaaaggaacagttagatgctataaagtctagagttaacatgtatatagtaatgtttcatgatagataaattatttattaggctaatgataatcaggatggataaaaaaacacacactctctctcaacccttgtgtgacaaactgtgatatcattgcactgggtaatggttaggtgaatgaaatttaacctcaatgatttatcgaagcaccttcatagttatcacaaatgcatatttgtgcttggacaattaatccgctctacgcgtgtaggatgtgaatgatgtccctaacacatggtcccgatgattgtagcattggagaaatggacgtctgagcaacgcacctttacgtataagtacaaaatgaattttttgggagttcattaattattttaaactacattttttatgacacttttatattcttttttcataattgataattgctataacattgcattgatttataatcacaatgcaacagtacactgctatgctctaaccggcaaaacctgaacagcgccagccgtaccatgccgttcctttttcttttgtagaaaacctcttagtgcatgattaattgagttttattattacaaaaattaagaaaaaatatctagtattttatatcaattgtatatagaaagttttaaaaacgcgctaacaaaaaccgagatagaaggaacggagccatggtgtgaagtttcacaccatgcacatattcaattttcatgtttttaaaaaatatcggttggttcacgtgtttatactgattttttttatataatataattataagatttcagaatcactaaaagtctgttgaagaaagaggtgcagaacttttgattttttattcatcggatgtgcatggtccgtgctattggttgagagaaaaaaaattacgcgcaaatatgatttgacagagggagggaaagtagacttattctagggcctaggtaaacgtatatttatattgatttttgtgtacataatttaattatttttaattttcgaattaaaaactgattcattataagataagatttcataataaattaaaatctgttggaaaaagagaaaaaaaatcgaagtcaaatataatttgacatgagggaggcaaagtagacttattttaaagggataataggtgtaaaaatgagaggaaagtggagtcgaaccagggtggccgaaatgaaaactttcatccctcaccaagtgggcagactactacatgtgagaagtgaatacatggaaaatatatataccgtatcaaacgtggttgtggagtagataaaaaaagcccgatcgggctgttaaccggattaaatccggatttagcgtagcgcgtggtaatgacgtacgaaaaaaaacacccggaaaccttacgtattttttaattagctatatatatatatatatatatatagatttaactaaaatccatggggcccatataaccagacatcaaaggtggaggcaaacgactgattccttttaaaaaataaaggcaaaaatacaaaccctaataagagagagcaaaacaacagtttatgttaaaaataaaggacaaatttccccatcatcctccccatgcgggtacgggaagcgggggcacccgtcaagttccccactgcccgtatggcatctacaaagatagaacctccatcaacgagtggaaaactacagtattgcaatcaaataaggtggtgggcgatggcacatgtttttaaacggctaaacaatgtgttttctagaaagtttatattaaaaatactatattttaaaaattatattaatttatttttaagttttttaactcatactctatccgtaaaaaaaagcaacctaaatgagggtttaacattacctaggactacgaacttggacaaccatatgtccatgtccagattcattgttttaggtggtgtcaaatcaccaattaggttagttttttttacggaggaagtacttaattaatcacacattaatccatgtctcgttttacgtgtaggaaggattaattccaaaacccacagtaaaagactcactatcctaatgagggctaaagtaaaccgggccaattgggccctattgattgggccgtgcccaaccgtagcactagcagtaggctgcctgaaccatcatcgccgtcgtcggcgaccgcccgctcgctatcgaggtcgccggctcgcgccgccgccgccatgcgagagcttcccttcgccgcccgacgagatgtatgtacgctccgtgaacccatcctccttcactaatgcattcccctactcgattgctctgctgcatccttagccgttgcttcagatctgaaaagctaggtccatgtgcatttggcgttcgattcgttgcatccagtcatgttggggatttgtgcgagtcgtttcgaattctctcctcttctctgaatgcgtgaagctgttgttcgaaaaaaaaaacccccaatattttgctggatgaattggaagttggaattggtgtagagaactatggaggctatcacaaaaagaaactggaatacaattttttttttgtagttcattttagcacaggtggaagatgcatggcttcttggtgaatgaaaggccacataatgctgacgagcatctttcacctaatcacccttgttattctaagctaagctcgaatctgtcgctagcacattgttgtgtacacctgaagctgttcagcattatttagctacttttattctgaaattggttagatgttatctaagcttccaggctcttccacccttcatgttaaacgttttaagcctcccgaaaagcatgacgatgatcaggatcgctttcccattgtcgctccatttccccgcaaacccgtacgaggcatccttgcagcgtgcatcatggttcagtagcctcttgcagctgtagccaaccgagaaccccacatttccatatgcactgcaacaatcagagccagatgttcagtgatgatactcatgttaaaaaataatcatgagctttctgcagaatgcagtgaatttcagtggcttgcctgacgacttcaaacaatatgctgaaaacattgaaattaagtggatctgtagccatcgagtcccgttctgtgatgcaaattagcattacaaagatagccaaataagacatatgtgagaagatccagttctccaatagcccttttcttttgtttatcttctcggtcttagaatcctcaccatcatgtctgggtaaaaacgaagtgtaaccagggagatacctacataaaaattagtcaaagtatgtgttaagattacatattaagaacaattcctctcaatgataacatatactggactaactgctttgtatgtaatatactgttgagcctgtaagtggttcttgaactactatagtcctcaaccaaatctagcactgagtctggcttgtgggattgtgtgattaaaaaattcctttcttaataggtaggagtactatggtaggaagctttcctgtgtattcttaaagattatctgatgtccttatgttccattctactatatgcaacctacctattagtgaagtacaatatatttgaacgttgctgcacatattcgagagaaccactatagggctattataagtgaaggaaggcaaatgtgatgtccatgataaggtagttaaattatatagtttactgactagagcaataaatacaggaagttttcttacttatgatcattcttattttggggagaaggtttgagaagggacttacatcatgatggtgtataggactaggattgctgaagagaggtttgacagatctgtaacagattcacctgcatgcctagcattgaccgactgaaatagagcggatactatcttttgatagttgctcattccatccaaagctaccgagctccactccaaagagaggaacaatacggtttgcagaatgatcaagctcacaactgttaaagtcaaataaacactttccctggtactcataagatgtttatatccaatggcctttggatattcaagaatgtaacgacaatccttttttccggtaatcttctcaagtgaccacaccattaatctcaagcatggtgcaaataatgtatttcctgctagtatctgaggaagaattagcaatagaagaatggagttcttctgaaagataatcatattctcatttactggagtgaagccacaatttccaactgaggagatggctgtaaatactgagaatacgatgatcccaatgccttttctctttagaattttatgtgcacttggtaccaggttaaggtagaggtaaataagtagggagccgcctaagtttgttattagaagatatcccatcactacaaaacctaaaaatttaatcgtcttgggctctacatgtcctccattttccatgcggagttcagaaaatgaaactgtaacttttgtgccctgggtgctgggaccaaattttgtggaagtaatagactcaatatcaatgcaaggtgagtgatcccttgtgctgactgactcttttgtaccaaattcggctctcataaagtgaatgccaagcattgaagtgaatacctcaccaccaatcagcattaaaatagtcaaaacccagagttgagcgcttgagaaatcctccatttcaacagtagccatgcttgaaacagttgatgcagatacggaagtaaatagcacgtccaagtctttcagagtatttgacttgtctcgtggcttgaggacctttagagatccatatccagcaaaggagatcagggcaaagtaagctacatggacaaagagtggattgttttggtagatgaactggaaggagtattttatagacttctgtgcagatttggtaaaagaagagaacttgctagctgcaaatgtgcggaaagtttggagttttttgtgggatactacaagacaatgattcattttctaactatttgtgtggagctaaacagcatgtattgggtgcttccttatttgcatcaatgtactgatgtttgtccatttatatagggaaaaaaatattctcctctccaacttatacttgtgatgttcgtacatataatctctgctgtagaacaaaagcaatcagcatcaaagagttagtggtgaacttactggacaacaatgacagaagaatcaaagagtgctttggattccatatagcttatgtgaatgtaaatgaagtgctgaaggatttattctctactgcgattgtggcaaataacagtctgttctgaaaagattatacaggttagtgaaaaatgcagaacaaagaattagcaccccgaatgcaatgatatttcagtatgtgcttttcattaggctgccttctgatgaaatatatgcttttttttttgagaattacacagtacaatgctgacactcacaacgcacgcacacttatgctttctttgatctgtgagtttcagcatgttggacatgcactgctttcaagagttcgaattcagttagaaagctaatatgttctcagcaactgatcactagtgatgtacttttgcttgactaccctaaaattgtaccttgaatattgcacctcatgccatttcaggatgtgggcattattgttgttaagcctctactttaatatattgtcttgaatatatggtttcgaagcatgaaatgaaaagatatgagtaaaaatttcaatcaaactacattttaaaatctcttttcaagtaaacaatttcagtggtcaaagcggcatttgttgactttgaattgaaaaaaattgacttgtttttgataggagggaaataggggaattctagaactgaacagtcaatacatgaaatattttttgcataagttttattggcgttagatccaattagagcattaaattttacaaaattgaatcggtgagatgatttggtcataaactcataatgtactgcaagtctgttttagagagatacaatgctatatgcgagaagaggtttacctgttccattttactcagagtaatttattccatcttaatatctgtaactatgcatatacagttgcaagcggttactcttatgaaatatgggtttgaaagcctatttttgctatcctaattgatactccctctgttcttttatgtatgacgttggttagttcaattttgaaataatcaatgtcatatattaaaggacggaagtagtattagaaactactagaatcacgtctttggttactaaataatatgctaatatttgtctccctacaaacagtgttttctttccctttttcttgaaggtaaagtctgacattttgttctggaacacaaaattagcccaataagcttggtgtattgaagaagttaaagacaagatctactgaacatatttgagctattctatgattgctattaatctagttggttagtgtt

SEQ ID NO: 65485 - DNA, 13918 bp, Oryza sativa
  unsure (1)..(13918): unsure at all n locations
tcgctcttccaagtagccgaggtcagggagcgtcggcttccttctttttgtcgctcgcaggcctcctctttcgggtggccagcgaaatgccttcgacggcgaggacatgaccctcgtcgtcggaatgggccgacctcttcttcctcctcctgtcccgccgccctgaccgagcggcggacccgggggcggccgaagctgccacaccggaaccggaggggttccaagtccaggcctcctccttgcgagccactcggtccgcgagctgaaaaagctccgcggtagtctggggctctttggaggcgatcttttcgagcatgcggttgtgccgcacaccccccctgaacgcgtagatcaccgcgtgtgcagggatgcatggtatggtgttgcggacttgacagaaccgctgaatgtatgagcgaagtgactcatcatcccttcgctggactgcatgtaagtccgcttcttcacctgggcgcggatatgtgccttgaaagttcatggtgaactgttggcacaaatcctcccaagagtggacggacgcgggtggcaagttcattagccaaccccgtgcctgtcccttcagggccatgggaaagaaattcgccatgaccctgtcgtcacccccggcggcctcgatcccggtcgtgtagacctggagaaactcggcggggttgacgctcccgtcatatttttcggcgatggtgggccggaaccttgggggccaacggacgttccgaaggctcgccacaaaggctctacagccgacaccaccaaccgggggcacggagggctgatccccgcgtccgtgttgatgtgacactccggacgaggaggcgccctccgttgcgtgggcagcacgtcggccattacgccggcgctcgatactgatgcgggcatccggccccccacgcagatcttcctgggtcggaggcgctgacgaaggagtggcggccgaatggcgagcaacagccgccgctcgccgcgccctccgccttgacgacacggagccggtggtagcagcgccagaggtcttggtggcggaggaccgcccaccagcacctaggcgctgccgtgccgtcatgaccaagttggccacgtcgtccagccaacgttgggctggagactccgggtcagggacaatgggcgggtgacgtaggagcgcgcccgcagcttggagcgcgccctggggcgtgctgccgtcgccgtagacgaggagacgacgctccccatctcgccgcacttccccatcacccgtggatgtcgaagtcgcagatccttcgaccctctcgagcgcctcctcccgcctaggactttggcgtggagggggcggtggagtacgagctcgacggcgtgggtttggctccccgtcgtcaccgctaacactcggagagaggttgtgcgcctttgcttgttcagccattgggctgaacaggaaaagcttggcgcacacgaaagagtgcgagagcttagaagaacacacgcagaaccccctacctggcgcgccagatgacggagcgtggggctcctcaccgggagaccgcgcaggcccccctttgccggttcggccgagggccctgggtgagattctaagctcctagtctgtgtgtggaaggttcgcgagaatggaaaaaacacaagacacgggcgatgtatacaggttcgggccgctgagaagcgtaataccctactcctgtgttttggtggatctgtgtatgaagaagttacaaagtgcgagccagcccccgatcgttccgggatcgttttctcctccttcttttcctctaagtgggcaaggtcctccttttatatctcaaggggataccacatgcaccatctctctctctctttcttttgtgtggggactcatcctctcttccctccaacttgacttctcttcattaatggacggagatttgtatggctgccgtccgaatgaccttctgatgggacggcccatacctacctccacttccgccggaagcaggcgcgacgtgggaacatggctgtctgctgacgacatgatcagtgtcagaccggtcacaaatcggtcattcttgtccaccacgcgtcagtttatcaatctgcatgttcgcccctcttcatacaatatcttgcctgtaatggttaggatgaagcctggcatatatctgaccggaaccaacgtgccatctccaggagctaacacgccggttccggctagggacgagtgcttggaggctctcatcctgacgggatggggcgaggcgtgcgtcagaccgcctgtcgccacctaacccacgatctgatcggtctgtgactggtcacagaccggataaacgagtgcgctgcactgcgttacatgcggcgtgacgcgctcgtccaaaccgcaataaatgtggttaggtgagccccgctatgctcaccttccccatatacgcggcgcaaaacccacaaggggtcggggcgcctcggccctcggggccgagacgggagcggtccgacccctcggggagacaaagagaagggcggccgtatcaccctcgggcccgacccccccgagggggttaggccacgtgggtgatcgtgtctgcctcaagtctctaagtcatgatactcccggtcccatgtcaccgacaattatgcatctagatgggttttattttttttaagaaaaaagtttgattgaattatatattttcagaaattagacataaatccacatatcaggatgtacacagttacattaataacatatcgattaatcgttctatacaaattctagagtaaatatcatgtttttagaccactaatctgctgctacctagagcttaaacaaggcttagtattacctcacctaggcatatgttttaacttgatcaagatacatggcttacctcgattttcattgcatgctttttaaattattaaacattacattctgtatgaaaactttatatatatatatatatatatatatatatatatatatatatatatatatataaaatatgaatttaagttgttttaaaacgaaagataaaattattcgttaagagtataataattaaaactcaattaatcatatatgctaatgatttttttcgtgttttatcttttatgtttagtgagtactccctccgtatgctaatgatttttttcgtgttttatcttttatgtttagtgagtactcactccgtccaaaaaaacaacttagtattcgatgggatgttttatagtccaatgagtctgtttagattcgttggactataagagcaagtataatagtaggctataagccagctaaatgctgagatataggagagaagagaggagagaggagaaacgggctgtaaactaataaccggcttagacacaagaacaaaaaaaaactctgtgagagagacaagtgggccatgtatcaattgtaaagagctaactatttatatgagtaggctaagagaaggctataaagaaccttatagtcaacaggtcggctgtattattagccttgctctaaaacatcacatctaatacattggtttttaaagagagtagaaacaaaagccaaagccacctgggtcctgggaggcgttgttgcgtatatgaaccgcaaagaaaggaaccacgtcagctggtctagtggtctccctgtcctccaaaaaccaaaccctatgatcacgcgacacgccatgatctgatccagctcccagacgttactagctcgtcgtcgacgtcgtctctgcagatgtacgtgtctaattaaacacacacacacacacaaattacgctttattagcgtattaaagcctctgattaacggtgattaattagctaaggattgtagtccacacaagctcatctctcatgatcatgaccccacaccatgggaatcttttaacgggcgacgatcggagccacgagcgctccggtgcctaactccctaaaatcatttttctagttaatcgcatggtctccatcggccatcgcatgctgtcacctctcctaccctcacaaatataaaaatgccaacaaaaggttgatcagattcttttttttccttttttctttttgcgtcccatgccatgaccatgagaagatttcttactgtagcatgtgtaaaaaaatcatatactactccatcccaaatgaattgtatttatagtatttagaatttgtcttaaaataattgtcgctacagagtattaactgttctatcaatcactcctcatttaaatttttatcctatatattctacccttagttactttcctactctcacgtaatatgtcatttaatgagagacattatagttttcttctcaaatcttaatatatgctaaacaatctacaattacaattattatgatacggaaatggtactatatatatgaaccatgtatcatttaggactagtttttgtcctaccaattctttgttagtagtacttttaaacagtgtttctagatattggattggtgcccatttttactagctccatctgttaggtagtagcaaatttgtcctaccaaatttaatggtgccaaaagttgatagtgtcaaaagttgcttaaaatttgacactatcaatattttggtatggctctaaaccaaactggctgtgatttgttgtgtaactgtgctattgagattgttgttcaaatcattttatattatgtaagaaagattgatcttgacaaaagaaggatggtcagatcaatcaggtgtgtcatccttgaaaaaatgtatatataaattaggtgcatcatatgctgatatgcatgtggacctgcatcaccagaaaaggaaatgcatcattatctaaactaatcatctaataatcaggatttggtccatacatacagagcatgatgaaaagagaagctagctaatagacagatcaaatagatcgatttgacactggataacattttcataagcaataattcagtggacattccatcactcatggccccatacaaactagagatagagtgaacaggaaaacaacattattcatactaattatgtctatctctctatctcccaatccaaaagctcaaattggagattaattagaaaattccaaaccgaaagaaaccaagcaactagcttaggtagaaacttttccttcaggagaggtgaaagaatatttctcttttgaccccaaaaaaagtagaaaaaaaatctggcctctctcttcgaaggcgacgaggtttttgtggacaaggatcactctacgactccccaaccaacggctcaggtatgtccataatttcattaagcacacaagctactccctccgtttcgaaatatttgacaccgttgactttttagcatatgtttgaccgttcgtcttatttaaaaacttttgtgaaatatgtaaaattatatgcctacataaaaatatatttaacaatgaattaatgataggaaaagaattaataattacttaaattttttgaataagacgaacggtcaaacatatgctaaaaagtcaacggcgtcaaatattttaaaacggagggagtaattaactaagaattatttacctgtcgtttaacggtggccgctagctcgtcagaagaacagataatatatttcgggcatcactccaacatggttttttttttagataatcactccaacatggtatagaataatactcctagtgtcatgtgaaaagtacacctgaatggtggtttattcacaagtggtaattgttttttttgttaattgggatggttggcgacgagaaagatcggaatggaaggggattgggtggatatgttagagaaatttgtcatgtgtgtcatattttgttagatagacacaaggttcagtttgatttagggaaatgatcagatcatgttgcccgggagtacatattttaggtgttaaaagttaggaaaagtctatacgtactcactttttcttactaaatttttactaacactgacatatcatgctataagtgtatctagattttttttataactttcatctacttgaattaaacggttgagatgattgttagtacaaatttagtaagaaaaatttagtacgtgtagcggtgctctaaaagttacgtcagttagatgagggattaactcttgcgccgactgcccattggtcagcttccgtacgacaattgttctgcgtataatagaagatataattatacttattagctaaaatttaaattttaaaccttatatttagaaatttttttaggttttacttcatcgtagtttattttttaacctttacttttagattattaagaacacatataaaaaagttttattcataaattattttttatttacaaataagtcgttttgcttttttctctaatatgccaaatgatgggacttttaaatttagaacaatttgtagggcatcatattacttgtgctaattgcagctgttttccttgttgagataatgagttaaaacccgatctctactttgtaaatggattacacggccaaaagtttatacaagagtgcttaagagttaagactcaaccccttacacgaagaacatgtctcaaacaaaagttaaccaaccaaaaaaaaaatacaaagttaagtttctaatctcctcccgatgttcctgttgaagaaacactttttctttaacacaatgtcatcctccaatttaagcaacatagaccaaaactgcgcccaatgaatctccctaaaagttacctatatattttttttaaacaataaagttttaacacaccattaaaaaccacatcgttcctgtttgaccatatcgctagccaacacttgatattttaccttaggttgaacaccattatccttcccttggccaacacagctccgagagtaagctacatagaagttagaatgttacaatgtgattataatattatagttatagctcaattaaatatagttatactctaagttatatatgaaaaataattcaataaaaaactgtgacttcagctgagtttagttccaaaaaactttcatacacatacaaacttccaacttttccgtcacatcgttttaatttcaaccaaactttaaattttagcgcgaaataaacacacctgaatctttaaaaaaagaactttgtaaaaaaaaaaccatgttggagtggagtatttagtagtacaaacgagcgggaaaaggtcaaagtaaaatcctactagtcgatgggggcgaggagaggagagcgaggcacagccaccaccaaagccggtggccgcgggtcctctttaaatacaggccacactcccctcgcactctcgactcattccaatccacatcgtctcgctcccaaccaaacctcccccctcgccgtccgcgcgcgcgcccgcggtttcccccgctcgccgccggtttcccccgctcgccgccggtttccccgaagcgcgccgcgcccgcgcctgcgcccgccggtcgccatcgccatctcgccctcgcgcggagactggtgtccctgttttgctctgtagtataaagccacgcaaacccccgccaggtgttcgaccgagtgacacaagagtccagcctcttgcaacctgtaatggaggtcggcaacggcaagtgcggcggtggtggcgccgggtgcgagctgtgcgggggcgtggccgcggtgcactgcgccgctgactccgcgtttctttgcttggtatgtgacgacaaggtgcacggcgccaacttcctcgcgtccaggcaccccccgccgccggttgggggttgaggtggtggatgaggaggatgacgcccggtccacggcgtcgagctcgtgcgtgtcgacggcggactccgcgtcgtccacggcggcggcggcgncggcggtggagagcgaggacgtcagaaggaggggcgggcgcgggcggcgtgccccgcgcgcggaggcggttctgnaggggtgggcgaagcggatggggttgtcgtcgggcgcggcgcgcaggcgcgccgccgcggccggggcggcgctccgcgcggtgggccgtggcgtcgccgcctcccgcgtcccgatccgcgtcgcgatggccgccgcgctctggtcggaggtcgcctcctcctcctcccgtcgccgccgccgccccggcgccggacaggccgcgctgctccggcggctggaggccagcgcgcacgtgccggcgaggctgctcctgacggtggcgtcgtggatggcgcgcgcgtcgacgccgcccgccgccgaggagggctgggccgagtgctcctgatccgccgccgccgccggccaccgcacgacgaatcttccggccgcctgagatagaaagtactaaaaatgcgaaacttgtgggcaatgattgtttgtttgcttcctccctaattaattaaattaatctcaaattcttaatcaccatcaaggacccaaaaatcttgtggtttaggaaggcctctcttgtggttaacatcaaatcacaagtctaaatccaaatggatgggactctaatttttctgtgtagtattagtatacaatgatgatagtacaatttgatttgttattaattggttattaattaaaggtgatttgatcaactagactttatgtggtcaagaatgtctccctgtattgtatagtaccaactaccaactcgatatttttttccttccaatctttgctagtcctgtcttgtgtttggtgttagttggtatctcaatgtactgggcttaccacttgtatggacagtattgttagcactaacaacagtgtgtaccccccagtcgtgttagcttgaatgggaagagccaatgatcaaggaatgctgtcctcatgtcttgccgatcgcttttgagccgatagcacgtgctacctccctcctaaaatattacaactcaatggcttatttggtttgagagaatttcaacccatgaaaataaaaaaaagtggagaaatagtaatacacgaacccattaatccatagaaatttttttgagtggatgaatatttttatatattttctctctacgacttgtaagaaaggaacattttcatttgattttcctatatcttattcatacaaatcccaaatggtacttgtagaaactaatccataaaaattaaaatcctttactttatctccaaaccgaataaaccctaaggctacgttcgttctgtcgtgttggagagaaatttttagcgtacgtgaaacgagaaagatgactaacacatgtttaattaagcattattattataaatttaaaaaataaatttattttattttcataaataacttctatatagaaacttttgtaacagacatatcatttagcattttaaaaaacatactaacaaaaatcgaaattgaagttttaagttgaaaaaaaaactaggcctaatacaaaatgagacatactccctccgttccacaatgtaagtcattctagcatttttcacattcatatcggatatctatttagattcattaacaccaatataaatgtgggaaatgctagaatgacttacattatgaaacgaaacgaatgaagtatttaacatgaggaacaagagggagtgaagcagataggaaaaaaaaaaggcctcgtggtggcctctcgtagcgatcgtacgcgagacggcgagagaggcggcttcaactgcgtacgcgcgtgagtgagcgacacggtgagcacggccacgcggcccagcaggagggagcgtcgcacctgacctggtccctccctcccgcccccggcgaccttcaactccacctaactgcaactttttagtgctatgggcttatttgattcttttactgtgggtgtgttttagttcacgctaaaattaaaagttccgttgaaattaaaacgatgtgatgaaaaagttgaaagtttatgtctgcaagaaagttttgatgtgatagaaaagttagaagtttaaagaaaaagtttacaactaaactcggcctgtgtttagttcccttcaacttccaactttcctgtcacatcaaatggagtattaaatgtagaaaaaaaaccaattgcacaatttacatgtaaattgcgagacaaatcttttaagcctaattacgccatgatttgacaatgtggtgctacagtaaatatttactaataacagattaattaggcttaatagattcatctcacactttgcaaacgaaatctataatttattttgttattagtctacgtttaatacttcaaatatgtgttcgtatatgtcaattttttttgccaaaacaactagactcggcctttagcctaccaattcatcgacaatgccaaagcaatattaaaatattagtaaagtaaaattattcagctaacatttggattggtaccaatataaaagtcaaattctcatagtatagtgaagaaacttctagaatatgatcaaataagataaataagataagataagagcactaccaaacgtttgacctcaatccaaactaatacacatattatacttttttcttagtattatgggaagaaggttaaccttaacaaagttttttttcaagcttcttgtccactttaaagattggtaactgaaaatctaattgttctaaaaaaaactgaaaatatactccagtaagaaaaaaaaccatgtaaaattctctccattacagagccacatggtaactgcggtaacatatgagacgttacattttttttttctttttgtggctgtagtgaacaatgcccaattatggtagtaacacccactttgtaagggcaacatgagaatctctcggcatcatatagcatgcaactatgtctagcataatactacctcattccctaaatgtttgacgccgttgatttttttaaacatatttgaccgttcgtcttattcaaaaacttttgtgaaatatgtaaaactatatgtatacataaaaatatatttaacaatgaatcaaatggtaggaaaagaattaataattgcttaaattttttgaataagacgaatggtcaaacatattttaaaaagtcaacggtgtcaaacatttagggatggagggagtaatatttaagcccttttcaaaatgcatgaattttactgttttagagttttatagcttcgaattttacataacttttaaccaatggatatagcccgttttaaataaaataaccataagaaaaatagacaaacatgccgacaattgtaaatatagagagacaaaataattctaaaatttaactttggtatagagtaactgactatgagtgctacatagacggtaagtgtaaatgtactgtaactgagcgtaataacaaattggatatacaagaacataaaacttggtacaaaatcatacgaacggaaaagcaaaagatagaagccaaaaatctatcggaagtaaaatagcaaaatcgttcaacttttatatgaacaaaaaggaaaaaaaaagttacatattccaaggcagaaacttaccagtactatacgaaaaaggccattaatctggccctaagcccggcccatctatccacttcgggcctccctgccatcatccaccccgacctccgcctccgcctccgcccgccgccgacgactctccgactcccactccacctccaatcgaaccccacccgccgccgccgccggaggcgtctacccctgctctcctcccccgcgcgccgccgatcgaatccgcaagccgcgatggattcccttcttgccaactacgcctcttccgacgacgaggccgacgaaaccctacccactcctcccgccgccgccgcggcccgaccgaagccgccctccggtggcggcatcttctcgtcgctcccgcagcccaagtcggcgctcctcttctcctccctcccggcgcccaaatccgggcccgtcttctccgccatcccgcctcccaagtcctcctccgggaaccctaagcgggtcgtgcagttccgcccgcctccgatccgccagcccacgggcgagagctccgacgaggaggacgacgacgccgagaagcgccgccctagcgaggccgagccgcgcccgcccgtatccgcgggcacggggcctgtctcttcgttcctcccgccgcccaagcgctccctcgggctcggcggtggcggcgccgccaggaggtcggccatagacaccgctgcgccggagaggtcgaatgttgtcgccgctggtccatcgtcctcggccgtcaacgcaattgcccccgaaaggcctgatactacctctgccgatgatgaagacgatgaatcgaatgggagcagcgatgacgatgagatgcctgtgccggaggagcagcaggagcagctcgctgttgattccgaagctggacagcagcagcagaatcagcagcaaagctatgatgctggagttgggagcagtaatggacaggaaggctacgcatgggatccaaattactacgccaattacggtgcaaactatggctgggatccgagcggcaatgtgaactatgggactgaagcgcagtatgcggcatatggaggagagcacggtggagtgtatggaaatacatacggagtagaacatggtgatggatatgggcattcgacggaaatggcatatggagggggctatgctggtgggtacgaacataatgcggctgcagcgacagcaccgccaatccagcagccaatactgccaccggaggttggtaggattggagggaagagaggtaggagcgatatgccggcagagattttagaggttaaccaggcagagctgatgaagaaccgaccgagggaggataagtccaagctcactgggatggccttcggccctagttaccaggtaccgagtcagcttgttatgatttctacttagcttgcagcattattgttatgttcgattatttttctggcaagtatcacatgtagtacataataggatgagatttctagagtagctcactctcttgccagtaactgtaatcttttatccattactatgactggttagagcacccgacactgtagttattcctacaaatggtttgttggtaccaagataattggcttattggttaagcgatacagtagtatttatttgacttgcttgtgatcagtttagaatgctgcaagctcccaagcaagtatttattggaggacataggcagaatcatgatacagtggttctttcttattgtaattttgcagttcattatgtcagccatattattgattgctgataacctctgtaaggacataatttgataattatgttacttatggttcatacagcgtttctgttggtgggtgcctgggtggtggctttatgctatttgcatgtactattaataacatttgatctacttttatttggccagtgactgtaggctagatctggttctgtataaaaggtttaaattatagtgggtggaaagggtattaggttaacttatgtacatatggaacatatatcacagcttcccagtgtgaactataggatttcagttggaaagcaataggagtgatgttttttgcagatccaacatcccttatcagtgaccaacaatcttagttattacttcctccgtttcacaatgtaagttattctagcattttccacattcatatagttatatctagattcattaagaactatatgaatgtgggaaatgctagaatgacttacattgtgaaacggagggagtaattaacattgaaatgatggtggaaaggaaatttgtcaaaaagatggattctataagtttccaacatgattaaagttgcaattgccataaggtgtttatatgtcatcatgtccaccgttagtttgaaaagatctaaattgtgagtgagcatcatgagctcataagtgataagatatcatttttgaaaaaccaaaccatatttgcatcgctaattaagtaaggatcgttctaacccaagatttctatcttgaacgcagcccgccccttcagcaaaaggaaagccctccaagctgcacaaaagaaagcaccagattgg

SEQ ID NO: 65486 - DNA, 554 bp, Oryza sativa
  unsure (1)..(554): unsure at all n locations
attcctgcagcccttagttatgtagttgttcttcactctctcatctctcctctcccctttgcaattcttggagcacttgctttctcaccgattaaaagaacaccaatggtgaggtttatggagagagagaagagagaagagagagagagagagaggagggaaggagaaggtggtggcaacattttaaaggagcaaatgggtgagtgggagctgggaatttgggtttgttagggattaaattatttagtggtgttgcacatgtgggagctctttctgtggaggtttttatttcttgatatttagtggagaatattccacaatatcgattatttatcttatgagaatcaaggacttgtccttctttaagtgcatccgaaaattcttaaattttgcatagaatttagattatttgaatcccggcttttggaacttcccgctctcgctncccttccctttttttacttggcaagcgcctcaaaaaaccgtaagagtataatccagcggtctccaccaaaactttgtaatgtatagttttattttatgattttttttaa

SEQ ID NO: 65487 - DNA, 2074 bp, Oryza sativa
tcaaaatatatccttggggttttgtgaaattttgatcgtaatacctaagattttgtaggttttgttttagaaaaaactaaggtcttatagaatttacttaaaaaaagcatatacaacagactatgctttttggtacgtagtgtgtcttgatgagctcaaccttagtctctcgcaatctatactacaggaatgagcatcctatgctgttgagatctctctatattttctcttgttgagttttgagacacgctgcttatctagtattaattgctaggggactgcatggtactagctatagcaagtgcggttacttataaaaaaactagaatattagggaaggacctaatatcaaataattagaaggggtgaggttttgaacccagatcgtctagcccaccaccttgtgaagctagctggaagacccctggtcatttctcaagtgcggttacttataaagagaacaagacactatagagccttaattttcaacacacactatcatattttttgcattagaagcacaagattggaatagttatgtcaatcgatagtacacgcttaaatgtgtatagcctagtacttctcctgacataattgctatcattaaattttgatcgcatccaagaatatatatgtccaacaaaaagctcgatcgcttagcccgccaactttgcaaaaatgaaatgaaaaaaataggagtattggcctaagttattgatcggtacctcctcctcaagaatcgtaaaggagatttcatataaacagtaattaagaagataccacaaaagcaaatacaggtacatttcatcatcatttggaaattgccatgtcaccagtcaccactgcattgtacatatatatcaccattgcatgtaaaacttttttctactttaagattatatatagttcacatcaacagaggcgcgattacaattaataccatccacaagaatttaaatcttggtgttcatagatatatgcacgttactatgcttttaatcagagtttgtctccttaagtttaagtgtgtgtccacgctcatggtcatgggtgtgtggatatatagtggtgtgtgcgtctttctctatatataaattagtaatatgcctatgttttagaataggcagatcctatataattgggaattgcatggatagttggattatattgaggataaagcatgggactgtttgggtgagtggattaagaataaaatactatatcctacatatgtgtatgtggttaattatgtacgtatacataaagaagcggatgacttcgtttttaaaagtagtagagataaaataatatttttttcttttgaattatatgaaaaaggagtggtgagtggatcagttctcactgcagcgcggctatacaaacgctccattaagtttgggtatagacatgattggatgttcctctaaataaagaccaatggtttccttagagaacctgtttggacgagcagtacaggccagtaactcgacatgcagtaattttgtcagtgcattaatgccaattataaattttgttatatcatattaattataattaatcatgcatgtctctttggtacaagctagggcactctcaacgaccatggacagtgtcaatagaagtattatcgacatcctaattaaaatataaaaaagttttagggttagatacgggtatcaaattaaaaggtaggtaattaaatatgtgatgattgtgattgattgagaagggaataagttgttactattttaggataggaaaaagtacgaattaccccccgaactatcatggtcgtctgaattacccccgaaccataaaaccgggcattcttcaccctcaactatacaaaccggacaaattacccccctcgacccaatccgcggtggttttggtccacgtggcgtacgcgtggcagtctcgtcagcactctatttataaaaaaatattgtgggacccacctgtcatctcctcatcctctcatcctctctcttctctctctcactcttcctctctctcaaacgggaggacgcgcggcagcgtgagggggaggacacgagcacccggcggcggatgc

SEQ ID NO: 65488 - DNA, 6689 bp, Oryza sativa
cacatgtcagactatctgagggatgttctgttcccattttggataactcggtgatcaagcgagcaggggccggctgggttggattattcggatttgtttcgatttggcgttacatatgcgctgtgcttgtgtccgtagatttgttcacttgtgtgcaactgtgagctactactactggtaatagtgttatgctgctcggtgtggggcccacctcccacaggcatcgtcacctaacaacggtgtctggttgtggcccctgcgtcaagattcgtgcatggtcatccatgagttttggcgccaacggccaagctatttcaaacatgagttaatatagtattatcgagtagtaactaaacgtgatcaaattttcattctttttttggttcatgaaggtggatggagagaaccctaacctgtacttcagcaaggatgatgttatactatgcctgctgccactgttccacatctactcgctcaactccgtgctgctggctggcctgcgtgccgggtcgaccatcgtgatcatgcggaagtttgatcttggcgcgctcgtcgaccttgtgcgcaagcacaacatcaccatcgcccccttcgtgccccccatcgtggtggagatcgccaagagcccccgcgtcaccgcggaggacctcgcctccatccgcatggtcatgtccggtgccgcgcccatggggaaggaccttcaggatgcattcatggccaagatccccaatgccgtcctcggacaggtaaattgatgccacattacaatcattgcgcggacgaaaacaaaatctcctctctctctctttttttttgagtcactgacaagttagtccgtcatatcccttcttctttagggttacggtatgactgaggctgggccagtgctggcaatgtgcctggcgtttgccaaggagcccttcaaggttaagtccgggtcgtgcggtacagtggtgcgcaacgcggagctgaagatcgtcgaccccgacaccggcacctccctcggccggaaccagtccggcgagatctgcatccgcggagaacagatcatgaaaggtacacacatcacccacccccacccaggccaaaccctccattgatctctagataggatgtcaataccctgacgctgacgtggcgcaaaacgacacaaggccgttggacactcgcctctcccactgttgggtgggcccggggtggcgacttctctcccgcacacttggctttcaggtcgtacatggcgtcttgctgcgagctgagtgaacaaacttgctgcagcttaatttggtgcataggttggaaaccaactcgtttggtcccctgcgattaggccaaaacacatgtttttacatgcgacgatgagtcgtcgtcgtgattttggattggtctctaccaagccacaaacgtggtagtctagctgccagtaccagtagggtaggttccagtttccaccgactgaatctgaattctttcggagaaattctgtgcaaaaccagctgaaaaatcgatatcgtctccgatttctttgaacagaggaaggttctgattctttttttttttttggcttttgaaacgtggttagtggctgatgttgaggggtcggaatttcccgtactggaaacagttgaggtgttgctgattaggtggttcgttgggagatcctttttattaaaaaagaagtggacagattagtggtttggtccaagctccatggcgatgattgcctgaacagctgaaagaggagagaggaatttccgtccactccacgtctttttttctctgatttatttgtggtagcagtgacctcgcgtggttgttggcacgcaccagctcgcatcctagcttgcagccacacaacgacgcacgttgctactgcaaaatcatgctcatcatcatcatcgcagtggcacgatcctggaatccaagttgcgatgcttcttcaagcagatgaaagaatgggggaaaagagagagagagagagagagattagagcaagtgtgtctgccacatggatgatctgaagatcagaaaattcaggaagtgaggttccactaatgtttgttttcgcaatgcgtttttggacaaggcattattgcaattaggaacctggcaggtcaaaggcttttgggtgaggcgaacatgggcattggcaatttaggcttatgcgtctagtatgcgtgtgttcggtagtgggcttatagttggacatgacatcaagcaaaggagaagtggcagcttatcctgaccgtatcttatctcagttctcaccatgtggatgtcatgtccattgttcacaacttattttttctgaagatttcttcttttgaggacttgttctgaacctgtttctctgaagaactgttctgaacttgtttctctgaagaactgttctgaacttgtttctctgaagaactgttctgaacttctaattgattggatatttagttggcatagtcaaacctgtactacttacatggtacacaataaattatgtctactggttttaaaatggttgatgttgtcatgcgggccaagagacagctggtaccggttaattagaacgagatgttttctttttctaagcctttcctttcaagttcctttcagaagtttgttaggttctagtttacctatcaacggatcattggttggtatctgcttggcgtgcaaagtggagatcacatcaatttcagtcgccagccatgcttcagttctcctgcatctttctgttcatcaaccactactataatgaaacccaaaccaaaccaaacacccaaagcttagctagtcttctagtattaatcaataccacaccatcatgtgaagcaagtgtcaccatcacataatgcaggattagcatggacatggcatctcaagtaccaagttgaataaggaggtatccaattagcactgctgcatctcagaaagcattgcacaattcatagttagaacaggccaaatgagtggtccatcaacctaattgctgtcactggcttggaaatgtttggtggcccatcatgtgaaattgtgaacaagaaaagccacagttgggtgactgctccagttgctcaaagtccagcctgaaaatcaatcaaagaaagatggcaatggcgtcacaagtcaatcctaacctttgtcccattaaatttgaagagtctatctgaccaaaccaaactctagttggtacagtaggtacaaatcccaagactctttggtttggttgatggatgcagccgccagcatcctggatatctttgtgaagtttttacctttttttttactttgaataaaacttagaattctaccagtgctgcaaaaacaacagaaaattcagaaaatgattgccacttcaatgctggcaccaaacaagaatcacctgaaaaataagttcagtaccctgccaattgccatgtgcatgtacacatctgaaaaccaatgactctccttgacgttaacagttacagcttagctctgccatgtgcgtgcatgcactgatgcaaagctggatccgatgtttcctttggattatttgatctgcagtacagaattttgtcaccactgaaactgtcttctccttcagaaacagcaggaaatgattcttggccgtactgacgagctgtggggaattttgcaggctatctgaatgatcctgaggcgaccaagaacaccatcgacgaggacgggtggctgcacaccggagacatcggcttcgtcgacgacgacgacgagatcttcatcgtggacaggctcaaggagatcatcaagtacaaggggttccaggtgccaccggccgagctggaggcgctgctcatcactcacccggagatcaaggacgccgccgtcgtctcgtgagtccatctctgatgaaattcgccattgattaatcgcgagagaatgtagtgaactgtcactgattcagttgctggtgaaacttgttttcaggatgaaggatgatcttgccggtgaagtgccagtcgccttcattgtccggacagaaggctcagaaatcaccgaggatgagatcaagaaattcgttgcaaaagaggtactaatcacatgcaaatgacagcaacaaggattctgatttaaatcttgctaaaatttttctgacacgtttgcaacaggtggtgttctacaagaggatcaacaaggtgttcttcaccgattccatccccaagaacccttccggcaagatcctcaggaaggacttgagagccaggctcgccgccggcatccccgacgccgtcgccgccgccgccgccgatgcgcccaaaagcagctaaggccaacgccgacgttttctctattttcagtcacacaaccggtgaaaaaaaaatgcagagatatgatgttgctgtccatgaaaatggaggcagaaatggagcagaggaagtttatagtttggtttgttggttggttgatgctgctgcagcagcttgtgcaatgttcataaaatggcattaataatattattattattattatacatagatgatgtattgtttttgaccataagaacaaggctgattacaaaataatacagtgtattaattacgccctgtttctctctactttggagattccagatgcttccttttacacttggcctagtttcggaccaaaaaaatgggtgaaatttgattgcatttgagtggcatttcagggagaaaattattttctggaacatatgcttttgaaaaaggccccagtatttgagtatttcaacctcaaaatggagctggcccactatatttcacgtgaagcccaagagacatcgaggcccatgtaaggcacagtaaacgggccatttcgaagggaaagcctcacggtcgttggcctcgtttggtttcatggccataccatttgtgcaacaattggctaaccattttccaaacaaaattcagttttgaagaacaaatacctgcaaaaatttcacctccctccatttttcatataaccgaaatctatgataaggcaataggcagactattgatttgtctatagttagggctacatagtttgtgaatgttcttttcaaattatgcaacagattatttgcttcacattcaaaaaatatgtttttttcaaaaaaaaatagagactttcttccactgggtagtgtttgaatatcctgaaaataaagatgaagataaagattaagtgtttcacgtaaaatgaggtggtaataatatgtgattaattgagtaactcttacaaacttgaaaaatgaattaatctgatagtttagaacaactttcacataaaaagttttcgcacgaaacacaccgtttaacagtttgaaaagcgtgtcattttaatacaaaatttcatccactcttttcagtggattcgaacggggcctcgtgaattgataagaccaagtaatctgttaagtttctttctcaaaatttttaatttatctataaaactaaatagataatccgtgactcttaaattcttaataatctacaataaactgggtatggtagattggtaggtagctagtcgaggaatcaggacttcttctgtcacctatttatttctctagtcaaaggtttgctatctatcacctattttatttctcttcctttcgattgtatatgatctatgtagtgaaagtgagatcaaaaaacaaaattggagttcataacttttttatttttgctcttccattatctgaaaacttacatagtctgcaatgtcagacgttgctaaaaagcagccatacgtagcttcaaattacatatgtacttgctggcctcctatagctagtagctataattctgagatgtatctgaacatacttatattcagattcatctctatctctagaattagagatttctagtgcggagaggtagctagtactgccgcgcgcgggcagctgcggcggtggccggccggcgagtagaggcggaagaggcggcgggcggagaaggcggagaggacggccatgccggcggcggcgaggaagctgcagagcatgccggcggcggcctgctcgcagaagcgggtgtagatgttgcagagcttgctccactgcaaggcctccacgccgatcagccccaccatacacgcctgcagcgccgccgccgtgctcgcgaacaccacgtacgcgcatccctgcgtgcatcaccaaatcgatcacaatgggaagaaacaaaacaaactcatgatcaattacaaatcgctattatgctggtttttttttctagctagctagctaccacttgaccaacaagttggattcttaattaattttactgcaagagttttccaccatggaacttgaagtcaagtactacctccatcgtgctataatataaacttttagcgttgacacgagtattaataaaatatttaaaattcaataagaaaatattgtgagtggtcgataagtagaagcctacgagaaaatcgaatggtgaaaagttatgtttggttgaaaagataacattgatcgagacgtcattatattttaagataaattatatttcctccgtcttaaaatataagaatctagaactggacgagacatttcctagacagagaattgttctatccgattttaggttcttgtatttgtattttagaaccgattttaggttcttgtatttgtattttagaacggagagagtaaggatggattgaataaaatatattttgaagaaaagatcgatgtggactag

SEQ ID NO: 65489 - DNA, 35335 bp, Oryza sativa
aagctttgggatgttactttgaattggggatttggggattgatttagggatatacatggcactatattcgggagaaaatatagagattaaatctgggcaaaagaaaaaaaaagcgctactctctctttagtcccggttggtgttatcaaccaggactagagattcctctcatttttcccggttggtaacaccaaccgggactaaagatcgatctttagtcccgggtatttgaaccgggactaaagatagtgatctttagtcccggattcgtactcccggttggaaaaccgggactataggggggttaccaatcgggagtaaaaaggctttctcaaccagtgatggggaaatttgttgtatccaaatatatgtacatgttttataatactatgcccttctttggatatttaaatgcatacaactatatgtaaatattttcatatatactatttttaattgaacaataaataacttgatactaacccaaaatgtagctttcaacacttgtaattgaagactagacacaccaggaaattcgataccttccagtacctcattaagagccataaaaacactgagtaaaaagaagactggttgatgtaaaaaccctatattaattgtaaaattaaagggaaaaaatccaaatattccccctaaattttggatggaattctatttgacacctgaactttaaaactagacatctaaccccttaaattttgtaatacagttcatgctaccttctaaggtggttttacataatggttttacgtatttgagatcttacatagttgtatttaaataagttcaatatatttacgtatcatcaattgtaggctgttaatttatatactatacaataatgttatagtattgctactctagtatttctctttgctactctagtatttctcttgcgagtaagagcaaacaaggggtaaaaagaaacatttaagtgaaaaatttacatatatgtttcaatgcatatttcgcatgatcaaagctcagccaaaacatatgctaatgagataacgactttgtaaaactaccttaaggatccgtatgaacagtactataaagtttagagaactgaatgtccggttcaaaacttcatgttgctagatggactttttttttttgagaattacacagtacagcgcagacactcacaacgcacgcgctctcacccctatgaacacacgcacacaaaccctacccctatgagcattttcgaagactgggccggtaaagtttagggaactgaatgtcccgttcaaaacttcatattgctaggtggacttttgatttcaattaaagtttaattaggtggttattaattaggacttctttttcaaatttaaaatttgatactgcttaaattacaaacccaacctaaaacaatcaaacaagcacagtagtacatgcactggcctctctctctctctctcctctgcctttttaagcagccacacgtcgagtcgtctcctccacacagatcgcacacaccagtagctgcactagcccactgtgatcactagctaccgagctgcactgcactgcacacaacttgttcgtcccgagtcccgaccaccactagctagctttcgcacgctcgccgcgcgccatgatgagcagcaggctgaacgccggcgcgatggcggtgccagcggcggcggtggcggccgacgtcgtcaacttcgggtacgccgcccccatgccgccgccctacgtcggcttcgacccagccggcatgggcggcgagcgccagctgttccagcacggcggtgcatgccatggcctctacgacggtggcctcgacttctccgccgccgcggcgttccaggaagcggccactcttggagttggcctgccgggcggcaatctgctgcagtccctggcgccgcccgccgccgccgccgccacgccgtcgtcgctgcagatgccgatgatgatgtcgctgccgggcctgcctgcgacggcggccgacgtgtacccgttcggcgtcggcgggttcgtgaagcgggaggatggccccgtcctggacgtcgtcggcggcggcggcggcgggaggatcgggttgaacctcggccgccggacctacttctcccccgccgacgtcctcgccgtggaccgcctccttctccggtcgcgcctcggcgggatggggatggagatggggatgggcatgggcgtgctcgggctgggcctcgccgcggcggcgcaccaccaccagccgccgcggtgccaggccgagggctgcaaggccgacctctccgccgccaagcactaccaccgccgccacaaggtctgcgacttccacgccaaggccgccgccgtcctcgccgccggcaagcagcagcgcttctgccagcagtgcagcaggttagctccgatcccgcgcaaccatgtcgctgccaggtgggacccagcaggcacacgtgtcgctgccaggtgggacccagggcacagccacacacgcactcacacacttgacatatagctgattcaattccgtacgagatgaacactgcagcaaactggtgagatatgtttgcttgtcttttccggtgcctacttgccaaccacgcatctcactcactttccatgcatgcatggatatttctatttcatcaggatggatcactgtacattcaacctacttcatcccttctaaaatatactacctccgtcccaaaatataacttttagctataaatctggacacacagttatccaaattcatagctaaaaatacttatattttgagacggagagagtaaataattttatatggacgagacattttctaatactacaaatttacgaatttagacagagagcatgttcacactggtatattaagggaatacccccctccgtcctaaaagaaagttcaatcctaactataaacctagacacatatatgtccagattcgtagctagaagttggttttttatgggacggagtagtatgtcatattcatttaaaatctcttatattttgtaatgatggagtaattatataaatagctccccagatgatttgcatgcatgcaattgagcttaattatgatgaaaaacaacctgatcactagctagtggtagtgtatagctacctgcattattaattcatggccatgcaacagagaaaaagctttcttttcttcagttcttgcttttcttctctctgtactgtgagttcatcatgcatcaactgtaaaagaaaaaggctactagatgagatattttgatccaagagtttaatctgaggtcagatgctaattactagtattagatgatgcttgcatgcatgtcagtcagatcagatcagagagcacaaggcagtggttgcactttatcactgtagctatacctagcgctgcatgaccagtgtagcacactcatcattgcaactcatctgacgatccatggatggagatacatggcccctatatatatgtcccagtatatattactgtataggagtacagctgacagattgtacacctactagcccctacataagcagtctctgtatctgcatacattggcatatttacgtgtacatgcagtgcggatgcatatgtattacagttaatttacagtagtagcagtgtccattaagtctaatttggtactacatttatatattcagtttgatttaaatttgtgttcttaatttggacaggtttcatgtgcttgctgagtttgatgaggcgaagaggagctgccggaagaggctcaccgagcacaaccgccgccgccggaagcccaccgccggcggccaatcgtccaaggactcgccgccgccgccgccgtcgaagaaagggactgacgccagcatcgctagctcctacaccagctgtgaccaccacaagggtacgtactatactaaaatttaactcaattaattagtttggtcctcagaagggagaacacatttgaaataattcaaaatctaattaagtgtggcaatgctcaatatataatgctgaacgttagatcgatctgaaagcaaaattcagatactgatgttttcaaatttcaaactatgtacagactagattaatgctcttcttaaattaaccatttagatcagagaagaaaaatatacaaattaaagatgaactgaatctttttttctataactaaaacacagtcaataactcacctcagtttgtaaaagggaaaagtaccatcaggatctgttactcttcactgtttttgaccccaagcacaagccttgctattttttttcaaaaaaaaaaaaagaaagcccttgctaaattttttgttttttttttagaaaagctaggtcgttatataacgtctattcaccaacttgtctatataatggagtgctactacgtaccatagtccatagatacgatcttttgtgcaagaacgtggcaaatatatatacagacataacacatatgacttgacagttgtcacgcctagctagatgctacaaccacgtacaactagctgatcgatcatgcacacttcgcgccaaattaagctttcatgcacctactatagctaatactctagttagcaaagtacgcgtcttaaaataaaacaacctaagataatatggtatataacctaatataacaatctagatagaaaaatgttcatatttgttaaactagattatatttaggttgttttatttttggaacggagtgagtagtttacgtcgcaattcctgcattattctacatgtgatcatcatctctcttcgtgcagcagctgcgagcaccacgacggccagcggcgtgagctgcctgcaggagcttgcagaccaccacgacgtcggcggcggccatcaggcagccatggcggcggcgccgccgccgacgctgtccctggccgcgctgccgccgcaggaggaggacgacgaggacgaagacggcggcctcggcaacgtcctgatgatgcagcagcaccatcaacggcggcgactgcaacacgacggcgacggcgacgacgatgtcgccgccgccgccgcccaccaccatctgatgagatctctcgcgcggcagcagcagcagcatcgccatagcagcggctgcagcaacaacaacgacggcgacgacgacgaccacaacaacaacaacaacatactgtcgtgctcgtcggcgtcggaccagcagaacagcagcaacaacaacaacatgcatttcttcgaggtggatttcatctagtcgtctcgaaaccaaaaaaacatattaattcgtcagggtaaatatcctttggaattaattaccgatggttttttcgaaccgattcacgtgaaaatcctgtaaaattccaaaggagatctcgattggattgatatgtacgtgtacatctgtgtttttcagaaaatttagagattggtcgatgggaagtaacgagaaaagggagtagagataggctgctactgctggtttgactgcattattatgagacgatgagttgaaaagaaagcagctagctgctgttgctgctgcagctgcagttgctagctagtattagctaggttcgttgcatgcgatagctaggctggagtgagtgtgtagctaaagtttgctttttttttttcttttggggttttcttttcactgtgttaatttgtacttgctcttgctgcttgccctttttactagagagggggggggggggggggaatagtgtgcagctagcatgtgttttttctttgttcttttgcctttttggtgacaatatgtaaattatgttgctgtgcatcatgctccttacaacgaaacactagctctgtttgcatctcctcttgacttgttgtaacttgtaagatcttaattttaaatgtcgaataagttcatgattaattatctcccttgtctcgttgagtttttagaccattatgttgacagatctctgaacatgtccctggtctggaattctggaaatagctctttgagctccttaatttggtgattatggatcgctactgtctagctagctagctcccctaattagtcacagcaattaatgtcctgtccaaatgggagctgatcacttacaagtgacattgtctatacataatactccctctgtattttaatttaaattttaatgtatgacgccgtcgactttttaaccaacgtttgaccattcgttttattcaaaatttttatgtaaatataaaaatatttatgtcatgcttaaagaatatttgatgataaatcaagtcataataaaataaatgataatgacataatttttttaataagacgaatggtcaaacgtcgatcaaaaagtcaatgttgtcatacattaaaatacagagggagtatatataaaagacgatagtgatagtggtaatcagggtacaaaattattaaaaaccgcttgctttcatataaaatggagatttcgagctagctagagatcaaatggcttggtaaaccaatcatttttctttaaaaaacaaaccaaattttagtcgaatttcaccgttagtcaaaccattggtactatcaagagcggttatcgagggtggttctgtttagttagccgggtggtaccatccgacaacggaattttctatatatgcatatggagtatttgttttgcttgaaatatgttttgttcgacaattagatcgtttgtttgtatgtcttgtaataagatcatttgagcaatacaattgaaaactgtatgaaaaatttaaagtttatattttttttatatacttattctagttctagctagatgagaattaactatatataattaattgaaaatatagaacaaataactttatgtgccttgagctaggctgcaataagttgtactgatcactatctacggagaacctatttgagttgcgtcatatataaggcataacaaattttgaattttagaacttgatatgatttagggttttcttacgttggtttcgttgcttagccttgtcttttggaccgttaacactagaattgtaaaaagttcgcaccataaaatacctcccaagcatgatttctaggtttagttaatgcatgcctacaatattactactcatagcataggccggccatcgatctcataatgaacgttggcctcatcagcagtgaatagaaagggtgaacatatctttctcaataactagggtatctcttcgtattgaaaggcggtaggaccagcaacgacacacacacacagttactgctgtactgcagtaggagtaataactaaggatttcaattgaaaagaagagatgaaaagtactactagtatcaatcaagcagggaccggaccaagatcgcatcacattgtttatctacatgccgccatcgatatatgcctgcgtgttttaaatttatggcagtgaaatctaacgctccaagaacattaattcaaaagctagagatggatctcgatcagtgaacaaaatccattaggtagttcatgccaaaattgaaagtttggttgaaattggaacgatgtgacggaaaagttagaagtttatgtgtataaaagttttgatgttatggaaaagttggaagtttgaagaaatattttggaacaaaacaagggcatagatagttcaggaagaaattttgattgatatatagacaaaagcgatgatctcataaaagcttgagataccagctgctggatcttttatgagctctatctgtgctgggacccaaattctcttttcttacggatatttaattgtaccaacagttcgatcaacctcattgtaaatatgctcttatgcacttaattaacaaattaattacctgtagtacatgggagagatagatggaccaaatatataatactccctataatggcttgtcaggactgatcaggagttgttacaacaattcaattgcttctgcaggccagaatcagaaagaaatcacacagcaggatctctccccattttaattactcctctcttgatctcttcctacaattgatggaaccaacaggcttttctttcccgttgatcccgtcacacgcatgtatatatatctgaatcgttagctaacgaatcaagcatattcaatgttcataggatcacccccaaatctctctctctctctctctctctctatatatatatatatatatatatatatatatgaaaaaatacgaattaccccctgaaccgtggcagttcattcagcattctatttattaaaaaatgtgagacccacctgtcatactcctcccactcttcctctctctcttctctcactcttcctctctctcacgcgcacggcgaggcagggcggaggggcggcagcggcgaggcaaggcggagggcaggcggcggcgaggcgagcgcggaggcggaggaagcgaggcggtagcgaggcagggcggcgcacggggcgggcgggtgagagagaggaagagtgagagaagagagaggtagagtgagagagagagagagagaagagacttgacatggccatgtcttgaggtccataaagtctatccgtgacagggtaccatatttttttaataaatagaatgctgactggactgccacatgtacgccacgtagaccaaaaccaccgcagattaggtcgaagggggtaattcgtccggtttgtatagttgggggtgaagaatatccggttttcgggttcagggggtaattcggacgaccgcgatagttcgagggggtaattcgtactttttccatctagatatgtactgtctgatctgttctgaaaacaatgacatcctaaaatacgtacagacacacatctctcaaaagaggacagctaggggacggaataccgttcatctgacggtatagtttatgatcttgatcgtgcacgacattctgctacccccgcttctccgaagggacgcggcagtagtgctcatctaatcaagtctcctatctgggttagtttggttgcactgtgaggaagcgggactggttggcctatgtgggacacagctagtctgatagtaataaaagagttttcttattggtctacacactctgatgtggactaataatagtctagtatctcgttaggtcatatgctgatgagattgggacaattgatacatatattcacaataaatattttttgttgggtcgtgtgctaattagggtggaccaataaagatacacacatctacaactagttattataaagtacggagaaatcatgtacttattgtcacgccccgaactagccctgagcggaactagcccgtgacgctccaatttaacctgttaaccgataccagtcccaggaaacagtgctggtatcacaggaagacagtatatcacagcaacagaggtctctttattacagagtaggagtacagtcatgttgggctgcggacagatcccgagctcgcaactgcattacaaaagggaaagcggaagccaagacttggaccaatcatcacaggcgcgacttgggaactaggccgaaaccctaaaactcatcatagccgacttgctcctagaagaactcctcgtcggcgggggccacattatcttcttcagcaactgggggggggattatttatatagagcaagggtgagtacaggagtactcagcaagccatgggaattaagtgtttaatgcaggcttcaaaggaaaggctgttgtttttgcaattgattttatttaaactcctttttgaaacaactaagtgagtgcttctcaaacgacacggatgggacagtgcgtctcgtccggtcggagtatgtgcaatgtatcagtctttgaattgatcagggttggcacccggccaacagctttcaaacggccacccgagcctggctgatcccatcaaccgcagattttttcaaacatcgaacccattccacagcagcaatttcacaaagcagtagtcaaacaaaactacgctaggaatcacctcacatccgcccatgaccgtgggcacggctgttcaaacagtttaataacctctgcatagggggtacactttacccacacgacattactaacccagatcttccagcccgtgcagaacggccacgtctagagaccttaaggctttcatgacaaggcatttcgaaagccgacacaggttcaccatatgccaacgagaggggtcccagaccaacaacagattaggtcccagaccatactgtgccaggaaacccgggggttctccccggcaccaccccgttgaatccacatgtctcttggcatcatggcacccccgattagctagttactcagccaggggtgtcccattccacccatgtggtcgcacttgtcttatgttcggatgaaattccaaggaaacagtccttaagtgcaagagcgggaaaccgtactcccggtacgttccccggtccgcgattttggaaattcatttagttcgcaagcaccgacccaggtgtcgggttttccaagtcttttgtaaaacccaagttttacccatcgttggatattttaaattttgagggggggtgttccgatgcgcgtacccgaaggcccatgcatcgaagcacaatagttggcaagggaggtttaagtgttcaataattcacggagggtaattgcagcaattaggattgggggccagcaggctatctcacaagccgcggccaaattacttgtgtagatcctattcatgcaatatttgcggaaaagaaatacttagatttaaattataggtgcaagatgatcaaaggtgtcttgccttgctcgagaccttgagcttgatcctcgaaatcctcgcactgcgggtcttcgggctccgaaactacacgcgagacgggacaactcaacaaacggtgaaaataaagccctattatggacctctaagcgtgccattagatagatctcgagatttgaggaattttagaagttgaacggagtcaaacggacttacggttgggaagatattgaatttctaagattattggatttttgatctaaaggaaaaaggatttatttaaaacctttttgagaaaagaaaagaaaagaaagagggaggggaattagacttccgtcgggcagctagggcgcggcccgagagaaaggggcggctcggccgagcttaatgggccggccggcccgagaaggcggcccaaggcgcgcgcgcggccggtgaggaaagaaggagccggtgggccgggtccatctcgcgtggtcccgagtgggacccgcttgtcggcggctcggctcaccgtgagcgaggtgcacgcggggcgtgctagggtttgggaaggggaggcgcggcgcacgcgcggttcacggaggacgcggtgcgcggcaggcccacgcgcagcctcacagctcaccgtggaccatgcgcacggggagggtggaatggagggagcggctgaccgggtcggccgatttggtcgtgccgaggtggcaccgacatggcgcctacatggctgccacgcgggccggctggaggaagacgaaggcgccggccgcgaatggacggcgggcggtggcggtttctccgggacgccgtgcgacgacgaggggcgacggggtgtacaccggaatgacgagggagaacgagagggagcaagccaacggcttggattcgccggagggagttcgtcggtggcggattgcggcggcggccaccggcggcgagagaagaggggaacgatggcgagacgactagggttcgattcctccggactagagcatctacacgacctcgggattgcattccttgcgccggattaggaggaaacgcaccgagggtggccggcgacgagaggcgctaccgagctcgggcggcgacgacggcgagcacacagtgggcggcggcaaggcttggggcggcgccagctagctatggggaggttacacaagcttctatcgaaaactaaggggaagagggggaacgaggagggagcacggggagatgcactaccgtgcgggacggggcacagtgacgatgggccgacggcacggtagtgatctctccggcatcgggccagggaagcggaggaagacgatgcgcccgaagtccccttcacgcgtccttcgcacgcaccagctctcccggtgcttggcgatgaacggcggaggcgagacagagggatggcaatggcgtggaggtggcgagcgaaacgggaggaggaatcgatgggagggcaccttggttaaataggaggcgatgtcggtttgggaaccgaccaagggcggtcaagggagcgagctagcgctcggcggttgcggccaaaacggcgacaggggggtgacgccggcggaagagaaaagggaaaatgaggagagaaaggggggcttgccccttgccactttgggaaaaggaggagggagagagggcgacgcggcagagggaggaggagctcggcctccatcccttgaagctagcgcgcgaaggtggcggggccgggtcgatgacgacggcgatgacggcggaccggtttggagcggagcggcgacacgggcggcagatgcggggcaggcgcggcaggtgctgacagcggcggcgactggccggtcggccaacacggcgtgcgcgcgcgggaagcaacggggcgacgcgacgatttgggcggcgttggcgggaagcggcagcgagggcggagggcgctcggctcggcgcggctcacgagcacgcgcacgcggcgcacgggcagagcgagggagagagggagagagggagggagggagagagagatgggccgagaggaaatcgacccaccaaacctgagggaggcaaaatagacttttgcggaggaaatgaattgggaagaaaaaaaattgagattagggtttggatttgacgatggatcggggattcgagatccggaatggcacggagactgactgcaagcgaagaaacaattttcgcaattagggtttttagaatttaaattttcccgctaggcgccacgacggaacgggcgctacacttatcatccatgaaaccccatgatacttggtactacatagtaccttatatgttatgaacctccaaggtaacagacctggtattacatatgtatcatatgtggtatctaggtatcagacttatacttagacccagtatctaggtatcagattttgtagatatcgtgggtatcatatatgatatctgggtaccagatttgataattagacttggtacctaggtactagattttgtaaatattgtaggtaacatatatggtacctggcatgatacttgatacctagggtatcatatatggtgcctgggtatcatacttgatacttagacatgatacctaggtatcagattttatagatactgtgggtatcatatacctgggtatgatacttgatacctaaggtatcatatatggtacccgggtatcatacttgatacctagacctgatacctaagtatcagattttatagatactgtgggtatcatatataccttggtatcagacatgatacctatatatattagatatggtacttaaaacaagataattaagaaaaagatgaacataaaacaagataattaagaaaaaagatgaacataaatctagataattggccatggctctttccagcaggcccagctagtatgtgagcacctcttatgcatgtcctacaactaatagaagaagaagtcacgtccacactcagcaggacagtgcgacaagctagttcatcacgtgggagcctatccatatctcgcatatgaggtaggcatcaacgacataacgattcgctcacattaatcgtcccgtgacaacgggataccgttttatagcttttctcctctcaaaatcgtaaatcattaagaactataaaagaattagaacttgatatgcaaaaaatatattagcagatttgatgtgggaaaacttttgaatagttataaatatatagtttgaaaaaaaagtaattataaaacatgtgtattagagacatgtcggtatgcaaataaaactttaagaagaagaaaatagaacttgtacgtgttttgcagcacagaattaagagagctattgatcgatccagcagagcgtaggccatatcaatgagactcccatgaatatgcagaagctgcctacgaagaagctaggatagttgctaagctaggtagcttcctgttgatccgtatttctccctccatccttaaaaaaaaataaaccctgagttttcatgtacaacgtttgaccgttcgtcttatttgaaaaagttatgaaaaaaaatttaaaaaagcaagtcacgcataaaatattaattatgttttatcatctaacaacaataaaaatactaattataaaaaattctatataagacagacagtcaaacgttaaacacggaaatttagggtttgtttttttttttgaacggagggagtacaatactatatatactgtacttatatggttagctttagcaagctaaaatcctgtgtatgttacatctgtacatgtgctctaggtgcactttggaaaattcgtacatatatacacggtttaattatccggacagactttagcttggtggtacatgtcctgcatgctgttctgtacttctggtagggattaacctgctccgcctatattaaaaaagcaatttttatatatgaattttaacttagcgtatgtctagatttatatataaaagttacattttcgagatagagggattaaccacctaaataaacatgatattttaactctaatacattggcttcaatacaatgcaacataactttttattcatttgctctcaatatgctactctacttaatttcgttcttctcctcttgtgacttagcacatttgggctagctagctattcgcatgtaatgccacgatctagtgtactctttctttttctctctttcttttctctaaactcgcctatacacatttctccccccaacttcatggatcaaacaacacgttaacttcgaatatctaacatttagatttaccatcatcgtcagatttgtaacatccagtcaacttaattaattacccctgcgtgcatcacagcttttaattaattgggagagagaattggagtaaatgtatatggctgcttttcctctgttcggccataagaaaagctctaggaattgtggtaaatggcaaaggcttgtgcatgcaggggttgataattaaaggggcaaaagctgctgttgcagcgatcacaatccgaaatgccatactagtatgttgagtcccataggacgcccttcataaagagaggggtctttagatccacgggtgtaaagtttcggtgtgtcacatcaggtattatataaagtgtcgcatagggtgttcgggcactaacaaaaaaataattacagaatacgtcagtaaaccacatgatgaatttattaagactaattaatccatcattagcaaatgtttattgtagcatcacattatcaaatcatggagcaattaggcttaaaagattcgtcttgcaaattagtcgcaaactgtgtaattagttattttttagcttatatttaatacttcatgtagatgttcaaacgttcgatatcacagggtgaaaaattttggggtgagatctaaacagggccagagacactaactctcaggtagagggccaacgactataccatatcagaatattagggtctattttagagagcttaagaatctgagaagcagctggttggtagacagcttctgagaatctcaaaaagctgggttttccaaacttttagttcattttctggattctacaactacagctttttagaatctgaaccaaaaattggattgtttgcgggagtttctggttatgagagaagctgcagcagctagaagctccccaaacagacccttaagcttgttgccttatcaatcatggttaatatttaaatttaaaacttaattttagagttgattttgaggtcaaagtagtttatttctcaagctgttagagctattatacagctggagctatgaaactctgagttctaaactacaacctaaacagaactttctcatttttagttagtttggaggaaaaacaaaagatttggactcctaagaattaattcttatgaggcatactcagtttgtaggaatgtaaatataggtaaaccggaaattttccttcctacaagttgaaaaataattaaaacataaaaaaatcatccacttaaacctcttgaaaaattcatatggattaaagtgtgcatacactcatattttctctttttatatttctataaattaaaattcctccaaaccgaaatatcatggtgtgacataggatgtgcactttacctaaataaacacaggatgtgcacatgtactcctaaaagtattaatagttggccatgttttcttgtttcaagaccctggaaacatccaattaatcatgtacaatcaaatcatacgctagtttcacatggcggcacggggacaaaatctttttttcaaacagtccctatgtctatatatataattgccttgtcgtggcagctcccgcgtgcgtgcatctattacttgttttcggacatctcatacttctcattttcttaagtgatcccccctactcctaattactaggagtactagtactcgcatggaaatgaatgcaaataacaggacaacaccagtttccacttcccagtagatgcatgttactcagggtccaccctccatgcttagatggaagtttagacagattacaataccatctgtcaactaccacaaatgggttttctttctcttttgggactagtacaatttgttaattactgttccttaggctatgaaaatatgaaaaaaaaatgaaaatgtaactttgatcgctaatttctattacagtatatatattgcagaacttgagaacattatagtattatgaaagtatttctcaggacagcctacaacgacttttatccaaactaaacattcaaaatgataatgttcaaaagtttgaaagttccctttgagatgtgtactctaaacgattggttttcgtgaccagagtaaaatctagttgtttacatcttttagcattgtctgaataacaagagatcagattattcttaaagtggggatccgattgttttcaaggcaacatgaagttctctcaatcattagtccattactacataagggtaaagtcatactaataaaggaacttttaagtctaaaataaatgagtatgcagatggcgggacaggttttgaagtcaagtccctacgtgcctactaaccaacaccatgaatccgaacctcagaacctgaactgaactgggacagttcgcgttcgccctacagtgataacaataccatcatttgggcctgctaaatgtaaggggctctgatggtgatggggccggccgggctgaatttatggacaagtacagaagatgtggggctctggactctgggtaattaggcaagtttacactagggctgttcacccgggaattttcattttaaaccttttaaatttttaaattttaaaaataaatccttttaaaactggcctgggtacccttcctctcatctccggcgttctcgtcgcccgagtttgtgtcacgcaccgggtagattcagaaaatttcccagatactccctccatccttaaaaaaaagacaatctagaagggaatgtgaccactcctagtgcaacgaatctggacagagcaaaggttacatctcctcctaggttgcctgtaatatctcgcacaagaatgtccatctcactgagacatgtttctttctccattcttgaagaccagaggaggtgtgatcctacacactacacaacgataggccggaaaggcaaaaaagattgaggcggccggctccttacgcgacggcgatgcgaggggtgccgcgcgcggccagtgatccgttaattccagaaagcactcaggtgtcaatgtgccatgccacgcacatggtggggagaatgaggggatcatcaaccgatagcccccaccaagccgcctcgtgattcgtgctaaggagcatgcacacccccaggctcctactactactagtagtgctgctgttgtttccatgctttgaacttgttgctatgctattgtgtagtaattgtggactagggtagccagatgcgtcagtgcgtgcacgttgccacttccccaattcactatagctcctccagagttggagctcggaggcaggggcagatctagcgaggggcggcgagggctcgagcctcctttactggcgataggattatggaagtcttcactaattctttttaccatatacattcgaaggggactatagatatgtctagtttgttcagacccttctgttatttcttaatacgccactgctcggaggtaggactgtgcagtgactactaactacaacacatgattaaattgaaagcagaacagctcactctcagttctgatcacctagaggaaaaggggatgagagtagaaggcacaagggcaaaatttgcacacggtctacatgtgtatatatatatatatatatatatatatatatatatatgtgtgtgtgtgtgtgtatatgtagtgtatggtgccgcgctaggcttgccatatatatacatcaaaggaactcatcaaaagttttagaattccgaagtgctaagaaactgaaggtaaattcagaatagtagtagcattgcttagttagtctactgaagatagcaacgatcaaaggcattaagcagtttctccctgaatactggtaattagaaattactggtgttagctcgaacctggagtgagccttttacagttctgatcttgcgcattcttcatcttctgctggccttccagtacctgcagtaagtaagaatgtacatcaagcttaattatggccctagctttatcttgatttttaaactaaaggatggaacggagaatcaagaagccgagaattacctcaccttcttgacttccttggcctcccaaccggtttcttcgcctgggttggagccaagtctggctcctggccaaccgctatcggttcgccttgatgtgatggaccactccttgatcgggttctgctgtcaatgtattggcgacgatatacattagcaggtgaacttctcctagtttgagtgctcctttgcaggctagctcctgtgcaattcctaggactgttttcaagcggcacgcctgttgatgaactgaatagatggaaggacacaattacttacgtattgcaataaattcttttatcatgaaaatataaaatgtatatagtagtatatcatctgttcattgtggacagtttacattgcttgatagaagaaatgcatttcagattgttcataactagtaaggcattataggctgaccattggttatggagcatgtatacacattgcagaatttagatattaagaaaaacaattcatgccatattattgcaatgttgtattaaagtcataaaacaaacaaaatgaaccataaataccagatatcatgagtttataacaggaaaacaacattggcccatttgaagatacatggctgccatggacattacctgggcgcagcctccttgtcctcttgaaacataagttttgaaacagaacaagggtcattgcagatggtgcctgctgcagaaaaactaagagtatcagacgagttaatagtagaaacctaaggtttatactcacagaatcagaaactttaaactaaatgcagaaacgtactgttacggtttttgcgtgaaaggactactatttcaggatcaaaaggaacaatatcatccaaaggttccaccttaataggaaaggtatttgtcaggtcctgtgacaaaatttggagttactttcagtaacagggcaccacagccgaatttgacaaattccaaagagcgacacccagtaaactagtgttgtatagtccaagtacccgatcagagtatggatagagcatggtaggacaacggttatcccggttggcttcactagtggctgaagcaaaggtccgtgcagttacagcaggacgcttaccacggagagctgatatgtcattatcagtgtcatcatatgaaacaatgttggaaaatattaggttgtccgtcccgagaagggggatatctttgaacagcttctttgtatcttctggtatccccctgaatgcattagggtacttggtggttgcctcttcaaatgaagctatatctatcacaaaataaaggcacagaaatagttgatgaccaacatatatcccactagaataggctttacggttttgaaatgtaattgcaacaattacaacatattttacctgaatgactcttaagaataccatcctgcctatttgaaatgttcaaatcatttagctttggtctgacacttcgggagtgagactcatcgaggttatgtccagtgcaagaattacttcttttcagagcctgcagttgttcaacaaaactgcaagttaggctcctataaattgaactgtgtgaacctggttaggcattctctttggttgatttattcaggcttgcagttctgcagttttgatcttcattatttatagttttgtttgctcctactataatgattcaatagcagatgatattccacttcaagaagaaaagttagaacgtttgcatcattccagggtcaaacaaaaaaatgcaagatttgaacaaataaaatgagatacctgctctgagatagactaagtattgcccacgaaaaacttttaggcatgctgttagccaataaagaaacatcacttggtctagaaaatgaatggtattaaaatgacccaagaaggttagtagctcagaattatcaaacccatggcctatactatgaagaattttgtagtgatgggagaaaaatcagaagaaattaataacatgaataaaacctcagaaaatatggtgtactttggcagtttacatcatcagaagtagtcataaaaaactgagcacagtctaatggtattgaaaaggcgaatataaggtgcaatgtaaatacatgtcatgaaattctgtgatcttgagtaccaacatatttagtgtaaagtatatttccacaaggttcagagagttggggactcacatgctgactctcttcaagccatccgttctcaacaatgttgttgtcaagctgttggctacaatcatgaacatttgaactcgcagagcaagtgtttggacgaaatgaagagtatggaacatgatcttgctgttggctagtttgccaagcaattggaagaacaatagaaggttcaaccacatcagggtctgagtccacaacccgctcgtgaattatctttatcagtatatcacattccgatctggcacgtaattgaagaattgaagtcaaacttagcagtcaatatgttcagaaattgcctctgtgataaatagtcataataagaacgaatttccctatcaaacttatgtctttttttctatatcatctcaaggagataataacagaaaggccacgctcttgaaatttggtctgatagatatattagtaattgccggccacagatacatttagcttatgaaagtactaaaatttttcaccggaaggaagtactgaaattcaatgaaaataaactcatatgattaagctaatacagatccaatagtgaaaagattggttgtacaactaaaaaactacagcagaagaaaacaaagatataaggtatgataccttgagtacgtttcttgcaaaagcatctgcagtatagcatccttgggatctatctctgagacaagtgctaaggatcccacaccactgtcttttagagtaatctcctttccgctctatgatcatgaaaaggacattcttgatcaatctcttcatcactcctaaactaagatttacagtccacttgaactacagagatgtacaaagatggaaatacctggttgaactgattgttagaagcaaagtgcgcagtattatctgttcatttaagaagatatagatcaggcaaaaagggagcaaactttgatgtgttttcatcatcgagaaatgtgaagcacaaaacagagtaatggggttaatctaatcatctgttgctacaaagtatcgcatcaaaaggattcaatagttgcatgtatggcgttcttagataatgtaggagtagaatgcatgtgcttttagaaaagctacaggaaaaagaaaaactaagtatgtttcaatgctttgtcctaccagagattaactgaaacttcaggtggcagagagaggagcatcgacaaggtcaaattccagtctcaattttcaagcattgtacaatgggattcagcccaacaccccacaccattttccccctactgttcaaaccaatgaccagatcactggcaatcatacagaaaacacaaggccacctacacttctctagttttaaaattaacaggttcagtacaatatccgtgaggaaaaaatatttctccaagttctctccaaattggcaaatgaaaccactactaaaacctagagaatccgatcatattattatacctctaactccgtgttcgtgtgatgctgcactcggtttgtgcaaaaattaactacaggattaggtagcgccaaattcactcgaatatttcgcaggctaaccaaccacacggacgcgccaccatctccagcgacggacggcaacggctcacgccgaacacccgcgagggcaaacagcatcaaccacggcgcaaaacaacgcagcgcactcggattctagaactccgctcgagggaaggatcgcgtaccgccactgccgcggtggccgcgcggaggcggcggagactgggacgacgactcctgcgaggaggaagcggagccgccggtgccggagtcgggggagtccgggccgagcacggcggcgaggaggcggccggcgccgcataccaggccggagaaccaccctccgggccgctccgctggcggcggcggtgacggtggatcatcgcctgcggcggcggttgccatggatggggaagtggagaattggagggaaggggattgagaggaattttttttggttttggaatttgtgggcagttgcgctcagttactgcgaatattaaaatgaagtgatttttcgaaaaaaaaaatcccggatttttcgccacggtgaattttcagctttttttctgttttatttgctcgcttcgtgaacagcaaattccagaggcttattgaaagcccgtttgaaaagctttagagcatcaccaagagaatcccaatatttcattctcaaaactattctcaaaactatttttataggaattctaaacaaaatttgatgtgctaaaatattgatccctccaagagattgtctgaaattgacttcctaaaactaaaaggtgggccctctacaaaaccactaactgaaatttatttccgtctctccctatgtgagatcactctcgcgaactcctaatcgcggcctcgacaacagcacatcaatagcagcaccagctgcaaaatttaggaaaaacagtagagaacaatagcacgagaaccagcaagcagcaacagataccttaatcttcagcaagtgcaacaaaggtaatctgtaaaaagaatcacaagtgactgaccgattgaaactccttggtaaataaaaaacatggcacaagtttgagcaatggtgcaagagcagagattgggatcattcacttgcatcgctgaatgaatcaccaacggtaaactgcttcgacggatgaactcatcttcatgagagaccaatcccagcaaaaggaatgagcaactccggccgagtcatgatgatgggagccgatgcaggcgggctaatttgcgtcgtatcgaggcggtggctcaaatggaggcagcgatggtggttgggggatagacgaggaagttcaccggctgcagtgcagatggggccgctgccgctgccaaagcacaagctgccaacaccggaaaagctttggggagcggcgtatgatttctagccggccgcggcccgcgggtgagatggggctgcctgcaggacaccacgatgaggcgacgaatgacctcgcggcgaaccccaggtgagaaaatttcatgtggcgcgggaattcgctcgggagagggagattgggagctagcgcctctccccacttgtggagaacgaagaatccgggcttgggaattccaaccagtgggagcttggctagggattctgttggactgggtttttgaacgaaaatccccaaatttcaggattgagaaaataactacaacttcttaaatcaaaacttctcccaaacaattcaaattttttttagattctgcaaagttatagttatcagttatggaactcaaaagcgaactacgaagtactccctccttccaaactacgaagtactccctccttccatgaatttgaatttttttagattctgcaaagttatatagattctgcaaagttatagttatcagttatagaactcaaaagcgaactacgaagtactccctccttccatgaactaacgtcataataggaggagggagtattagttgttgaattcagaaagcaaattaaaaattaaaaattggtttttccagccgtttctcggaatctaaatctcctaaacaccctgagtcagtcacgtttcaaactcgttcaaagcggaaaagtaatacaacgcttatgtatttcatatttgagcaagtcgagaacagattgttttgctttgatccatggaagttgtcgtaagtttgaaacgaaacgtagaattcaaattgcctttgatgttatcgaaccatgaaacacaaaactgatagcttatctaatttggctaatcatgacaggcaaatggtattttcttacgaaatatgatctcacacattccgagcaacgacagtttcaacgcataacattaccatatcatggcatagttaaagatccaggtcaatctgcatcagttgtacatgacacttaattgttcatgtcagcagcatattacaataatcaatctggacatggcccgggctatctcattccgcatcctctatctcggtatcctctggaacgcctcggagatacaaaacgttgttgcacctgtacagttcacaaatgaaacaaataagaattatacatcagacaattgaatatgttttgtgggcaaccacaatgttgaacaaaagcaggtaacaagcaattaatataggcttataaccaggtaagaagcattgtgggtagagacaataactactaccgggccattgtgctactgccggtaacaagagaataaagaacaatattttctgtagatatgggaatctttttgtacgagcatggctataggagatagttttacaatgattctttttaaggtggaccccaccttaatttgcagaataggcatagcacattgtgagctttgtaataactgttaccacctgaaccccaggcccacgttattatccactttggtagtatacattgcggttgctctttaacgatttagtcagcaaaagacttcccaagttataagcgctgctacttgttatacttctgcatttgagtaaattccatatactctgaactctatcattctatctctccacattttaccatactatcattctatctcttaatattaccagtcagactgaaaacagggtaatagcatgcaagtaaccaacagatcacctatgagtacataagtaccagcggtaagccaataactacagatgaatctggtccaggactgaagggcgatatatagagttaccttatcagtatctcacccaagtttccagagaaatgcccatcaatatactcctctgtattagccagctgaaagcagtagacaattaggtaaattgcagcaaaagaagatgacacgtcgatccatattggtaaatgaacgaatttaactgatacaaaatacaaaataatacctgcagattcatataagagtcgacagaaacaagatatcctgaaaggggggtacaaaaagagtatcgtcagcataatcgataataaggcacagtctgaaaactaaattacaacaagaggacccattttaacacatgatttccattgaagttccattgtaaaaccaatgaaagtggatgttcttgataagtgccatgaagtaattgtccatggaagcaagaaatttcatgtaaaaactggacaaatttcaatgttcctgaaacctcagagatttcattctgaaatttcaatcactagcctaagcatatcagtgaataaaatgtgacgggtaaaagtatagattacctttgtattccataccccacttaagtttgacaatgacaggcttccctgtcaggttgttcaagaaaggcttcgggttaactggcacagtctgcatttagaaacaatccattaatagtatataaaagagtatagacaagatgtatatggaggcaccacttggaactgaataccatgaataatcatcatgaagaaaatcagaagaaaacaaatactagtcaggtcagtacaatgtctgtaacaaatcaagtttgttttgcaattatctgcagcaatagaacaccaaactgatgtgttgaagccctaattagcgcaagacgctgggtgctactccctactcagccgacagaccagcagctacataccgtaactgattacgcaggcctaacaagagacaggcagaagccaatccaggacagaccggctaggggcaacgcatgacatttagaccactgggtcattgtctttgttttccccactcaaagagggatacaatagttcctcaatgctcttctgaagctccaattcaagtaaagcatagtccacatagagaaccttgatgtgaacagctgagttgtcaagtttcaaatattttttacaagattaagctgaagatgccctttcctcttcagcccatactgatgtaccagtcagaatagtgagcaaggaatgggaacacttcttgttcttgcatcttgagcagcatggcagattcaagtgtgtgcttcccattcaaactcttcttttactctgaaatattgaatttcattttatcacaatccatggatttttctgatgttcaattcgatttttggcagttgtgctagtgatatgcgtaaaggaatcacagtttctgatctgaacatctcagaaaattaatggagttgtactccctccgtactcataaaggaagtcgtttaggacaatgtttaagtcaaactttgggaatataaatcatgaataactctcaagttgttgagtttgaaaatataaaaattatatgtatagatttgtcttgaaaaatactttcgtaaaagtatacatatatcacttttcaataaatatttttatagaaacaagaagtcaaagttgtgttttggagaccgtgtcgctgtcttaaatgacttcctttacgagtatggagggagtatgtatctttgttaaatttctggattgaaatttctattttctggttttaattcaatctggcacgctttctgtttctgttctgaattattcagctatcaatctgtcaatttctattatcaacttgtcagtctgaatttctgtgtgatgcttagtgtgcactttgcatgcgctgcagcctgaactagtgcacagtcctgcagaacctaatggggccagccagttccactgcaagagggacgggccaatttttctccctggtttccaagtggttcccatctaaattggggcagagggtataggtgacgggttggcccatcccgtcccgttttcggactgatctaccatgacttgaggataactagggaggttcgtgtgccgcataaaaaaagaaaatcagagcacatcttccaaccaaacaaacagctctacatccatcgttctttcaacctgaaagctaagcaagggtccaaacttacactcctgcgccataaaagataaccataactcaaaccacatcttcgaaacaagcagctctaggggtttcaaaaagaaaaagaagaagaagaagaagaagaagaagaagaagaaacaagcagctctacaaccccaaaacgaacttttgggggattttctaaatacttcaatttttccctcaccacaattcgacatgaaacctatcccaaatcacacatccgacctatctatcctggaggtcatagacctagaacagttaagccctccaatctatatccacctactccgaatcgagcacacgaagctacggctacgagactaccacaacagttggcaccaaatcacgcgacaaaaaaaaacattcgaagcgtaaacagatccactacacgagataaacaatttcgcggagtaatatcgagggagaaagagagagagagagagatgagggcaataccgccattgaaggggggtagccgccgccgccgccggtgccggtgctggtcggggatgcgtaggggggaaggcgacgaggcggcctagctagggttttgaggtggggaactccgataccaccgcctgaactaaaagtcgctcgatgggccacagcccatttatcggtttgagcggttcgaataaatccatttatgtccttcgtctttccgtcgagttttactcatgtcactgctctcttcgttccatattactccctccgtatttctctcttcgttccatattactccctccatattttaatgtataacaccgttaattttttgataaagtttaaccattcgttttgttcaaaatttttgtgcaaatatgaaaatatttataaagaacatttgatgataaatcaagtcacaataaaataaataataattacataatttttttaataaaacgaatggtcaaactttagaaaaaatcaacggtaccatacattaaaatatgaaggtagtataatttaaacatgtgatagtggtaggtagatagtcaaaatacgactatctttaaacgggagtatatcttacggcagtatgtcggagagccgtttgcattgccataggacctaatttaacttggttttataagttgaggtccagatttttggtattacggttaagatatattaaacttgacaaaaatatgagggacgtcaagtggaattatttctaagcggtttaaatttggggtcgtgcactctttccttttaaggaccatatttaaaaatgttatgtatataaataatccaaattttctctttttattaacatagtacatatgcagacgtttatataaacatgcgtacacacttacttgcttatcattgaaataataattagccatgaatgtgagtcctatgtaaagtctatgactctaaaacaagcgggcatgttccaccaccagaaacctaaccagtcgagttacgctcgcttcgtaattcaaatttgtttttatttaccataatttatataatgtgttgtcctgttgcagttaaatatagtgtaaacacaatgtaaagaagaaaaatgcagtcccttgtttatttttatttgcaaaataccgttatctataacaagaggggcaaattgatttttaccatttcattcaaagtttgaccttaagcattgactacatgaacctgaaaaaaatattcccgatactaaattctcaatgcacccacatatatcaatagtttacagaagcacttttcaatatttgtttggttctaacacttcttacgtcaaggttggttgcccaaaaaagaagtcataatgtgtaaacacacatgtttatataataatcaattagtttgttggttctaagacgtcctaactcctactcctagctggtcagggttggttgtcctgaagaaaaaagaagcgcacatatatgtaaataattgcatatacatgtacaataataaccgttaagtatatagatatacatgtgttcacaaaatcacagactcacaggcatgtgtttggctagccgtctgaatcaactccatgaaattcggatagccaacgttttgcatcagtactaacttctgccgaactcgtaaacaaaacctaaggccattagccagtaattgttggtgacagaaaacattagccccaaatactgttaaacttctttaaataagaattgttaaatttcataatgaggctttccacgacttgatgtttagctacatttatcacccagttcaattaaattaataaaaccgcaactgtgtagtcacgtagatgacgatttgcagacagagatggcgatgcatgatttcagagctggtcggatgagcaactgaagtgacatagaagtagcagctaacatatatatactccatctatccaaccaatctcgtactagattataacacatcttattactatgaatttagatatccaaattcatcgttttactatgtaacacatcctactatgagattaatttattttatgagattaatttatctttatgtatgctagttctgaagacaatatgtagttaacatgcctaatatgttttggttgcgcactttgttaactagcccccattttttaaaaaaaaagaaaaagaagaagaaaaagctatatatctagagaattttgtatatactatgtgaaataatattatagagctttttgaaacaagggattgtttcatactcattcctttaaattttctatgaaataaaccagtctaagcaattttggggggaaataagcatgagatttcacctcatggtttttcctctttcacgtgttttttctgcgttctaatcgaacgatggttttgtaatttccctatgttgcaaaattcacgaaagttatgttgtgaaattccgtaaaaatccaatgagtatgatagtctatttatacgtttttcttattctaatgtgttttctcagtcctgcgttttaaagggttcttagcccgtgcgaagatggaaacagggaaaaaggttatgtcatatatactccctttatcccattgtaaatgcaaccataaattttcatgtctaattttgatcatccgttttatttaatttttttatgattagtatttttaatgttattagattataaaatatgaatattattttatgtgtgacttatgttttttattatttttttaaaatttttttaaataagacatacgattaaatttggatacggaaacatatggctgcgtttaaaacgagacagatggagtatttgggtaggggattgcatcgaacctcaaaattgactagctagtctattatatttacttgatgaacctagtaggtgtgtaattaagaagatcataggataccggaggttatttatggcgacatgcttgtgatccaccttgatatatatcgttgttaaacaataatgaacaaatgcaattaatggttcagatcgatgaaagtgcttaattaggcttatacgtactaactaaaaagaaggacacgaacagcgttattcatctctgtgttacatatccaaccattttatacttgttagtagtggaggcttacgagtacggatgaacatgaaccggacggataatccatcagaacatatatacacatgtgacaacgttttttcttctcctagaaaagtcaagcatttactccccagctaatcctatgattaagtagtaatacaactccaacgtgttaggtgattcgtttttatttttatttttttggcgcgagtgttaggtgacttgttcgtgcgaatgagacatgcattgcatatacacatgtttttgtttgtttaatttgctccagggactccaggctagccgatcgaagccacttctggtgtctagattagctagtgcctaaaagctggagaacctaatttcagcatcgatcgtctccgccggctaacaaagattccttgtctcatgttgcaatagctagctcacgtaggacatgcaaaaacttaatttacagtatgctttgaaagtataattgcatgaaaacctattagtataaacggctaccggcctgtcattcggcattttttttaagctatagtcgtcatttttatgaccgttggatatgtgttaagattcgtgctggttattggatgcatgataaaattcgtgttagacggccggtaaaaaagatcagcacatgtggtgagttacatttgatatatttttaagggattttcagtcagtcccatgatgtataaaacataccttaatcttaaaaaaaaaattggactaacatatttttgatattgacgaaaacatccgttcaacatatgactatcaacggatatatcatttatatatataactgacaaaacaaaaaacaattagccgtaaatataagtacatgtgttaacttgaatccatatgaactgatcacaccacatcagttgagctacgcttattttgtgtctttcaaaacacatcgtacatttgggctgtgtacatccattatggatgtagaggccggattttaatctattttctaaagaaaaaaacacacatcgtacacacgttccaatcggacactgccaaacgtcttcttcacacactcaagtcatcttatctcctcccggcttccatttttctctacacagaaggttaggtatatctagctaattatcagtactatatatacacacacccaaatccaaaattccaagtgcttaccttagcttagatgcgaccgagcgaccgaccgggtgtagccgcgccgcaacggagttaacattccacccggccgcggtgtaccgtgcaccggtgtacgtacgtggccgccgtgatctacagactacgcgacggtgggccccacccccaacaaccgcggctcgcgcgcgccctctcgttcgcgcgcgccgccacacggatgcctttttttcctctccttttttttctttttgcttggaccataccgaccgagcgagtggacactggccggccgacccgatccgtcctccgccactatacgtgctactgctacctttctgccttttctaccgtgctactggcgcggtgtgactgacgtcacggtgacgtcagccggtaggttcgtttctccgtcgccggggcgtggtaggtgaggccgggccggttggacgtcggagcgggtctccggtccggtccggtctagcccgtggaagcaaacaattgaagaagaattccttttgactctcttttaattaaactattatctctgattgttgttttgatcattcttttttcttttttaccccttccatagatgctacactgcataagtccaagcttagtgaggtgtggtgaccatcgctaagctgatcggaaccgtatttttttttttttggggttggtggtgttgttagattataatccgatttaggctatgttcgctccagcgtgttccgaaaaacagaacgatccattagcatataattaattaagtattagctaattattttttaaacatgatcaatatgatttttttaatcaactttcgtacaaaaacttcttaaaaaaacgcaccgtttagccgtttaaaaagcgtgcgcgcggaaaacattgaagatgagttgagatacctagggtaagaacacggccttagtattggatgtttccttcccttatatagtttcttacgtagtgtccgtttcctgtccgtttcgtaaatattttttttatatctaccaatggtagtgtccgttttgtaaatattttttttataattaccaatggtctttgagaaactctaatatatttcacaaaagatatacctatgtacaaattttctctgaatcgtttctcgttagttttatactccctctaattcatattataagtcgtttgactattttcctgattaaattttattagatttgatcaagtttacagaaatatttagcaacatctaaaatatcacattattatttttattaaatctcacataatatgtttattttgtcttgaaagtactattattttttctataaacaacttataaaaggaaacagagggagtagtaactgtttttgttgttatcgtcaaacttaaatttatttggtattaacacatgcaatgagggaaaaatgtcttattctaaattgggaaaaaaacaattatagccaaaagcttgaggataaagacactccctcatacacgatgtgtcataggtaaacaacaaatatatgaaaccgtcaattctttaggataaaaaatcatactcttgtaaaccaattctaaaaattcagcttgccacatatacacacaaaatgacatacaaaaccaaaatgtcacatcacatatatagaaaacaaatacctaaaaacttggatattccaaccacaccaaacttcttcgccaacagcttccatattttagacatgacatatatgccgtgcaaacgaaaaagatttactctacagcaggcaaggagaaaaggggagatacacgagataaaagtcagtggcctgagagagtgaaaggctgaaactcgagcacaacccaacactgccagcagaaaaaactgaaaaaaccagaaaagccaatggtcaccaaccccaacaaaaaagcgagcgaccaatgcgatgggggttccgtaaaatcccatccccttcccaccctacccaaacacccgctggtataatggggttggtaaacgacgttgacgtggcacccctgccccagtcaacgaaccccccctccctctcaccaacccaatgctcctctcgcttacaggtgggtcccacacgtcatcctctccgggccccgctcaccaactccccccaactcccttctccctcccgctcccgccagtatttaacccctcccaccttccattcctcccctctccaggagacctcgccgccgatcgatcaatcgccgccgccgtctcctcgtgtaaccctagcttagtggattagtttaagtgtttgccggagattatggggtcggtggcggcggaggaggtggtggtgttccggtcgaagctgccggacatcgagatcgacaacagcatgacgctgcaggagtactgcttcgcgaggatggcggaggtcggggcgcggccgtgcctgatcgacgggcagaccggggagtcgtacacgtacgcggaggtggagtccgcgtcgcggcgcgccgcggcggggctccggcggatgggggtgggcaagggcgacgtggtgatgagcctcctccgcaactgccccgagttcgccttctccttcctcggcgcggccaggctgggcgccgccaccacgacggcgaacccgttctacacgccgcacgaggtccaccgccaggcggaggccgcgggcgccagggtgatcgtcaccgaggcgtgcgccgtcgagaaggtgcgggagttcgccgcggagaggggcgtccccgtggtcaccgtggacggcgcgttcgacggctgcgtggagttccgcgaggtgctcgccgcggaggagctcgacgccgacgccgacgtccaccccgacgacgtcgtcgccctccctactcctccggcaccaccggcctccccaagggcgtcatgctcacccaccgcagcctcatcaccagcgtcgcccagca

SEQ ID NO: 65490 - DNA, 1249 bp, Oryza sativa
acttttcgaccaacgtttgaccattcgttttatttaaaatttttatcatgcttaaagaacatttgatgataaatcaagtcacattaaaataaatgataattacataaattttttaaataagacgaatgatcaaacgttggtcgaaaagttaacggtgtcatatattaaaatatggagggagtattatatatcttggaggcttaagaacggtcatatataccaccacccatgcgggggagctaattgtactcgatccatcggctaattgataagaaaacaaaatcaggtaattaactaagtgtaaaacaaaataatacctagctatacactcagctgaacccaggccacaaaggcaggcagaagttctccctggaatgcatatgtctctcctcctgtatatatcgatcgtgtcctcccttcgtcttatattacccttcgtctcataatataagaaattttgagtttttatttacactttttatcactcgtttaattcaaaaaattttaaaataattatttattttttttgacttgatttattatccaaagtactttaagcataacttttcgttttttatatttgtataaattttttttgataagacgagtgctaaaacggtgtaagcaaaaacttaaaatccggaacggagggagtacgttctagctaattaagctactctcactatcacacatcacggaagaataatccatatatccctctgaaaaaaactggctgcaggatcgatcgattagaggacaaaaaggccagccacctcggtctgggtgctcacgcttttcccgatcgatcagtactacgtgaattgaatgtgcattacctagctatactgcgtacagtactttctctgttgcccagtgtgcacactactatactgtttggacacacgcacacactgatcagacagtgtggccatggctagctgcataaacctctacttgagcaatactacctgtgtactcctcagataacgtttaggaatcttccaactaactttacaaggtggtgggctagatgatctggattcaaagtctcaccctttctaattatttgatattaaatcattccttaatattcgtgtcttttacttgtgtgctgctcgctccgtcctataaaataaaataaattttagaaaaaaatatcctaaaatataagggattttagaattccaagacaatattatattcttcaccggcctatcaaccttattcatcacctactaaacttttctac

SEQ ID NO: 65491 - DNA, 6563 bp, Oryza sativa
tttcttgctcgtctcatcggctactttcataatatcgtcttaaaccaatctattaaaccccatagacagtattacaaccgattgggcgtgtttagggtttattattccttgatatatccagcacatagcatatttggtctaactccatcggctgagactatcaactatacactatcggctaatcaactatcgaacgactaattctgcttatattctttcttgctgattgtaggatcaaatcagttgggacgcccttgacacactcgtggctagcagtggacctgcattgaagttaagcagatctcccaggccatcgtgttttcacatcaacaaccacctaggagtgcttactcatgcccccaaggtttggagaggtacaggttgatctgcagagtcatagggtgcgagaacttctcaattcttgtggatgacatcaaactagtgctggaagccgagaagaacactacttggctaaagttcaaggagagcttcggctatcctgcagccgacgagggcaggctcaagcgggcggctttcaagaatataggcaattattggaaaatcattaagtccaggctggtcgccgagtacgtcctcaacccggctactccgaagccatatgggctcttcccattcatcacgccaagagtgtgggagcagttctacgagaagaagtcgacacctaaatcccgggccaaaagcgaggcttatcaggaactctaggctaggaacttgcactcccaccggcttggcactgcaggatacgccaggaaggaacaacaatggtaggaggaggatgaaacggtaggggaatcaaacacgccgccggtgtttggcgatatcccacacccatgagcaaggaactgggcaagggcaaagggtcacaagaacgacgatgggacaatttcgtcgccaaatccccaagatcaacaagtgtacgaaaatatagtaagtgtctcatctcaatatgttggcatagtttccatcgtacttttgatttaacacaaactcaattgtactgcagaaggagttggttgcctcgcaagaagcctcgtaagaggcttgctcttaaagacacgaggacgtatatttaggcatatacgtgcttgcaaccacactactagctcagaatcaaatcctccactttactcaccttgcttcttgacgtagtctctgctactaccttatatatatcttagcctaagtctgaatatgtatgcgaaggtcacagagcataacatattattgcaatatgcatgaatatggaagaaattgggtccaagttgtgcggtagaggatgcgacctcctactttacgacatgaaaatacttttgagaatggaaggcattgggagttattaacggagattacatgttcatgtcagtaactatgactggtttgaattcgtgacaatttatattgtgcgatgacatcaatcgtgatgaagttcaactgatactctttttggcttttttactgcagagatgtccaatcagtgcagcttttacatgctggtggtgtgttggtcaggctgaccgtaaatggggccgttgccatgcggccggatcaccatttatctccagaccttctgggaggacattttttcgtgtccaacacaagatcaaaatccattgatcaaaacaagctagtgaagctaatttcgagatcaattcactttcgtagaatcaaacgactaatttttacgataatctgacctgcccaaataaattacctactggccaaaatatgccacaaacactggttctccgcagcaaggcaacaatcttctcagcgaaatgaccccgatgggcagcattgtttggattaacaagccgctcgaccacagtacaaacgctgcgaggcagccagagaaggagatgagagttcattgttaccaggcccatatttaggggagaactcagatggaagaccacacaagccccattttttgttccttttcaattcaagccaatatgcgtttcaatatgcctaagagaatgttcttgcttcatttctttcgaatgaactctttttcttccactggtatggttgcaacacacttgttttccatagctttaataagcattcaataatattcatgccttataaaagaattgttacccatagagatgatgactgaatgtgcattcttgacaatgcaggttccattttttttgcttgctacgaaaattaaatcggtgtatatggacacaattctttgtgtgtacctgtttctcgtcgagtacaggtccggctctaggcctaggtcggttgtgtgatcgtctcaagcctgcagcagatgggagcccatcaccacgcaaaaccccatgcccaggccttagccctcaggctgaatagactccaagcgaacatcccagaatggaagctgcgtaggtggccactttaagaaggaaatgtggcaacagcacaccccacaaacccgttggttcgtcttcgatctaacgatctggctccttgtgcccgcggctagcgctttctctctgctcgacagcttcctgaccacgattgcaccatgcgacgagctgataagtcgagagtgaggggagtctagacaatggatttggacggaagctggtttgtgtgacgagatctaacagccatccagtcaccggcgtacttctgtactgtcactgctgtcatcattgctttaaccttgtgttgagggttggcgtcatatagtggtcaggtacagtatccaacacggtaccaaaaggggtgactgcagcaacagcattttgttctggcgtgacgaagacgttgtggttatcatggcgcgtctggatgatgttgttgtgaaccgagcgcccttgactagctagatcacgttggtaatcgtgatttaagtgttcttcggcttcttttcacgtaggtgttcttcctgcacctcccttcatatgaggcttctccgtcttcaatcgtagccataaagatctcacgaggtagagaaaagtcatctgaacaatccaggatatttggtgctccccatgctgcaacaagcatagtcatctgaccactcggagccacatatctcctccatgatgctgtgggagtccacaagtgggccaatcaaaactcgctacccctcccagggcccgtgctggaacggtgtgtgtgaaaatgtgaattaccagtgcaacaacggtgtgtgtaaaaatgttataaagcacataatcagtattcggcaaacccacattatcgccacaaacaacaatcttattcgtgaaacagtcgacggtacaagcaaacctgataagtgtttccatggtggaagccgctgtcaagggctaccatcctgcacggcgcatggcggcggtggcctcctacgcgaggagacaaatggcagcggcagtgcacggtgtggcgcggctgctatgcggtgtggaggcacacagtgctggtggcttcctcgggtggacgcagccacctctgcgtggaggcggatggcagcagcgatgggaccaggtggcggtggcggtgcccccacacgcatcgagctagacgcaggtgcgaagctagagttactcattggggtcagtagaccacgacgattttttgcgaatatcttgtaccagcactaatttaccggctatgactccagttaaggaaactactagaccccggtggtccaatgccatttttctgttcaagctcaattagcaactaaacaatactagtaagtagtaattagaaaattagctatcgcatataatacgacagcccgatatacatatgagatttgagcccagaaggaaagcaactcacacaagtccacaaattgccttgttgcgctgctatgtattcctgctttactccaaaagacattattttattatattatggtcccgttcttttctctagcaagagttggatgaagattaagattttcgtggtacgcttttcaaactgtgtaaacagtgcgtttcatacaaaaaaaactttctatatgaaagttgctctaaaatatcatattaatctatttttcaagtttgtaataattaaaactcaatcaatcatatgttaataccaccttgttttgcgtaaaaatcttaatctttatttttatcttcaggagaaaagaacaccacctatatggtcgatagttttgttttcggattatcttaagattattataagctatagtcaattaaagattattataagctatagtcaattagtggtgaccccggtgactatttttctggcttcgccccctggctagacggtggccaaatcacggcttagaggagggctgagggcctgaggcggcggatgggaggtgccaccaagaatcaggctcgagatcgatgcgacgaacaatcttcccattttccacgcgtgaaaccgactgaatgtagaactaaacggctgggcggctccacccgcgtgaaatcgattttcgctatcggccgactacccgtcagcacaaatgaattattttcaatggcttttggtcgttggcgggatagccagccgccagcgaaaacccatcttagccgccaacaaaaacacggttttttagccccactaaattttttacgttcggtcgtgcatttttaaatccaacattagttttcatgtttccactgtacacgtgatttgcattatatattttcccgtgaatcaatacatctaaagcaactactaaaccgatttttacgtgccatgtgaaaaacaggtgttgtacataggtccctgaattaattccactcgagaactccatgggagggttctcatataaagtgataccaagacaaccatgtgaaagaaatagagaatcgtgtcaggattatcaccccacgaaatcgatgtattgttagaggagaggctgatatattggttgtgcgaccgggataagtaaatcgtccgtcggagactggataggagggtgttccccaagcagttgttactattttcgagttcctgggagttcataccatgttctcaggaataatacacaaatgtcccaataggaatctcgtttgttgtatagtgatgacgtatatgttagacatggaaggcatcatgaattctaggtggccacatttccagagatctagttgataatttccaaagtaggattaatgatcgacaaggtagtcaaaagtgaccatgctatctagctcagtgatataatcaacgtgattttagaaacatttttttagtagatcatattattcacagaagttgggggtttatctcatctcgcatttttttaaagctcttctatgtttatttctaaactttttggctgtgtacctacgggtagatgccggagatgtaatccatttctattattaaaaaaaaaatctagctcagtgagcttgaggcacttcactgggcggctagatggatgaaatgaagctgcaaagaaatatcttggcgcgatatagcaaatgagcaaaaaattgtttttcttgttaaaaaaaattgtatgcgggaatttagttaatagtatttagtaacaccatgcatcatgcttgaagtctttatatatgcaatttgatttggttgccgaagtagtattggctgcacctagcataagacaatatgatagtatcgaccggcatgtagtaaaataaaatactatgcccaagtttttttaaaattcaagatgcaaatctggtgctctctctgttttttaaacctggggtgatcttatttgacaaagggattaagaatgataaagttttttcgcgtgtgaataacagcacaactggaataaccgcgggttcaatatgcagtaccatttctatattcagtaaaagaaaatcatagtgtgccgtgtgcgcatatatatacatctcgttgattctctttccaaaagcggagctcaaaagctcaagcccagtttcccatctcatatatatagtttatgttttactccagtacaagaacaacattggtgctcctcagacaaaattatcatctctgctgagagtaatttcgttgtgagttttggggaagtcatatcatggcctgaatcgaatttgcatatatgaatatcgggggcggagatatatgctattgctaggcatggaaggtatttggaattttggtcctctagggtttatttacctgagcatctctgcttcgactccctggtgcttctggtctcttggcagctgtgggaggtatgaaactatagggttttcgaccccttcccgctgcttggagtttgtgtctagccgtcgtagtttttttaaggttcaactttttattttgcttttcctcacttcccctggcataagtgttgtgtagctataactcttttcttctaatatattggcaatgcaatccttttacgcggtcacggaaaaaaatagaattttggattgtgaacattttagcacaagacatcacaattttgaaagttggaacgatgcttatatcaaccgtggtgaagcttgtggcaaagaaaaaccacaagacacattttccggccggttgaccaatcacgccaactgggcggaggtagtatatgttaggggggtgcccaggaatccggtcaagaaaatttttttagctatacctcatctatttca

SEQ ID NO: 65492 - DNA, 15272 bp, Oryza sativa
ggagaaagttggtagtctggagaaaaagttacgaatttatgtgtgtaggaaagtttttgatgtgatgcgatgtaatggaaagttgaaaatagggggaaactaagcacggcctcagcaaccaggacaacttttgccaaggtcaaaggaaaaggaacgaaaggtgctagacgaagcctcctcgtagaaacaagtggcaagtgaagtctatgaatgctaattatgcttttaagtctaagaattcttgtaattgagttgatgaggccccaattttctcactgaacgttctagtgaacgatgtaattatgtttccagattaataaagcgcgccaaatggcttcccttaaaaaaaaaaacattgatgtaggtagaagaccagtttagaggcatctgctcggtttagggcagaactgtaatctaccgtctatcatgtttatctatagaaggcatataccatcaccagaaaaagctctctctggtatttattcgttacgccgatcctacaccaggccatcttgttacaactgctgggctttgtttcaacagtgtgtaacgaccagtaatcctgcacgagctagcacagtttccatcaagacattagacatactttctcttccaaggcgctgtaggcttgggaggaatcatgaacgatcgctggacatgctcaaccgaaggtgctacagagacatcaccaagaacgaagtacccattatgcagcttaatcttcatcacgacatggagagctgtgcagctacctcctttaggaaatcttccatcttctcgcctagcatgaccctcccttgttctctcttgccgtaagtgaggtactgatcagggatgaactagatccgttacaaaacgttgctcagctagagaacttatcttcgttccgccatatatatcactcggctgcacggggtgacggaaatatatatgtaactcgtttatctttttgaaaaaagaaacaaaaagtaccataaactggtatgaaagtcattatatcgtcagatggccgtacttcctatccatataatatgtagtcgtaatcactaattcctaatacgaaaaagtacgaattaccaccccgaactatcacggtcgattaaattagcccattgaaccacaaaaccagacatctttcacctcaaactatacaaactagacaattaacccccctcagcactgttctgagcaattttttagttgagcatgcacatgtacggcgccaacgtggcgatccaatcagcaaagaaaatgaaaaagctccatggacccacctgtcatccctctctctctccctctctctctcgcgcgcgcgcttgggcaaccgatagtggaggaggagctcggccggcttgcggtggaggcggaggcgaagagagctcgggcaacaggtggaggggtgcgtcgaggagggcgctgctgcagctccctactaacggcgataagagggcctctacagaccgcgaggagagaaggatgagaggggggagaggagttcgtttggccggcggtggagcgagccgcttcccccaaatccagccgccgccgtcctctaatcccctttggccatccgcgagaagctcgggcagaggtgggtagagctcgcccggacggccggcagcggaggtcctctcgctcctctccttccttcttctctgcttctctccttcttcaatctccctcccactcctcttctcactcgcgccaaagccaaggatggcaatgctccttcgcctccgccattggcgcccgagcgatctccgccttccccaccggtgcccgagcgacctttgcctcccccgccgggggaggccgaggaggagctcagctcggcagggaaggagactcacgaggagatgctggggcgtccctcgtcatcatcgtcattgtctgaggccgcggcttctccggtggggttatctcggggtggtaggtgaggagaaggaggagggggatggtgggagaaggggcggcatcgtcggcgaccacggcgagtagtggttgtagttgcgtccgtggtggagagaggtggaggggacagatcagacagtgggccccacccatttttataaaagaattgcttactggattgccacacgtatgtcaagcaggaccaaaaccacctcatattgagtcggcgggcttttttgtcctgtttacataattgagggtgaaggaagtctggttttatggttcaggggataattcgatggaccgtgatagttctgtggagtaattcgtactttttcatttctaataatttgttttggccaaaccggagaggtactgtcacgcccggaaattcactagtaatttccgaacttgtttgtgcataaaatcctcgtctaggaatcagccgaggtacacaaactgacaatttaatatacagattcatcaaattaactaaaacgataaatacttacttaagaggcacttagtcctcaccatgaagaaaactgcagcggaaaataaaatctagcgaagctccggctccactcccacaggcagctcaactggggtataagccaaacgtcttctccttcgcaacttgtcttcaactgaggttgattgattattgcaaggtgagcatatgacatactcagcaagccacacagcaaatatgcaagtgcacaaggataccaaaggatggcgtagtataggctcatttgcgaaagcagcatttagcaaagagtttagagtagtaaaacagtagagtaattaatcagaaattttaatcaacactgaacagcatacccatgctgtacaggcccaaccatcctgaacaaccatacccggctgtacagatctaactccaaaccaggagctaagcaaattattaccagttataacatcaatacttattgtgagaggtgtgggactaatcacgaaaaacattgctcaactcgcccataaccgcgggcacggctattcgaatagttttactctggccagaggtgtaccactgtacccacaagacacagcctcaacatcatgtctacgatgcgtcgcgatactagaaagtacccgaatagaggctgtgacaataccctctgcataacacaactcaccacagtgcatcattcctggatcataatcaccccctcaaaaaccagaggcatggactccccagcgacccccgtgggcttatctcggccacttctcagtctggtgctccgcaatgaatcatgctatacaaaaggtaaagccgttgcccacgctggcttgtggttggcacgattaatgtttcacaatagtagctcgcgaaccggtccttaattgtcatgagcacgactctcaaaaccatgtgctcacaacccaccattatcaagttttagttggcaagtaattaaccaatcactactgaccatcgtgagctaccattaaatataaccataaatgatagtgaaacattagttatcccaattgtgtgctaatgtttctaagcatggctaagcaatcatatctaatatctagctgaaccaatatataaagctcaactagtcaagttataatctcccaaggtaacaaggaataaagtaatcaagaacaaaagggccatatcaaagaataggttaattccacccaatggcattcgaaaataaatgcacagttgaaataaatagagaatttaaatataggatcaacatgttcaaaggattgtgtttaggatctgtgtgacttgccttgcaataatcggtcttcaattaatcttcttgaacacttccggcgcactcgcaaaccttcgcaacgacggaaacgacaagctaacacgcaaaacgaagaaaaagactaataaaaaccaaataaacaatacataaaaagtaaacaaacatgtagatcataattttagatgaattatgagacttgaacggcctcattctgacttcaaatgaatttattatgaattttacaagattaaatctaattaaagcccatttaaaaagaattaaataaatttaattcaatttatggacaattttaatatgtagatctttattttatataacttttgcaacttgaaccacattaaactgagttcaaatgaattagttatgaatttttaaagattaaatcggattaaaacacttatattgattttaattgaattatgacgcaataatgaattaattttgaaaaggaaaagaaggattattgcgtcagcggctagggtttgcggtggaccgggtgcacggcagcggttcacggaaacgaacggccgagatcaactctatccaaaacggacggccgagatcgatcggtccacgaccggctcacgggagagggcgacgatgacgtcagcgatgacgtcaccaccggcggcggcggctcggcggctcgggctcgcatgctcgccggcgaacgacggcacggcgacgcgaacggagagcaccaggacgtagaggacgacgcggcgaactcaccggtgaccaaaggaacggcggaaaagcaacggacgacgccggcgacgaggatgaagcggcggcggagatcgggtcgacggcggcgacggtgctccggcggtcttcggcggcggtgaagcggtggacgaggacggcgacgacttggcgaccacgatgacgacctccccgagcgacggcgacggctggagcgacggcggcgcacggctggagcggcggcgacgacggcggcacgagacggcacggcgctagggctctacggacgacgagaggcgaaggcgagggtggcgacgggtagaggagagctcgggggtccttttaaaggggctcggaggcggcggcaaaggcccacggcgaccggcggcgagaaggaaaggttgggctcgaagagaggaaagccgatccgattcgaactcgaatcaaactcattccaaaccgatttagccgaagtttccaaaggagaaaaggtagaggagatcccgaagattgtttcccctctattgatttcaccggagaaggaaagacgcggctgaatttggaaggagaaggcggcggcggccgaaggaggacgacgaacctaacaagcggggcccacctgtcagcggctgagagagagaggagagcggcggctcggcggactgggccggctgggccgagggaaagagagagagaagggttttgggccggactgtggagtaattcgtactttttcatttctaataatttgttttggccaaaccggagaggtacactatgccatgattttgtaaattcaatttgatcgtagacattaccagcttaagaattggagtggctaacggatatgcagttacaaaagcacaaaataggtcttaacttattttttagtacttccacgtggttctctgtcagtatatatagtacgtactgtactatcagtattatcactagtaacaacagtgctctaaccaattatttatcagttctacttgcgtaaaaaatattgttccaatgattaaggtggtaatgtaaatatatctgctccatcgaatgagaaaggatgaaattgcgctcgagattgattctactgcatgtacataacacagtgaaattggtgattttttcagtgtaagccatatatgcaaagtttttgcaaggggtcaggttgcatatgtatggacttacgagttgtgatggaacaatttgacaagataaatttatcctaaacttatccattcactacttcagtatctaaacttatcctcgttagcttgcaattacatagacttcgactaccttgataggttactgtattgaaagcaattcaataaattgcttgagaatcatatcatcaggtcttgagagttggaatcctatatatggagactagcagggtagcatttaaaaatcctctagtggtttttgaaatgcagtgggtagaaatctggggtattttttctgtacgatctgcaaattaaaactggcgttatataccattaatttttcaccaaataaatacacttgtcagtgctaccaactcaaaaaaaattgatgtattgctggagaaggacaagatgggtcatgctactacatgagggtgttcgccgcacatatgttttctttccgagctttccaaaaacggaaaattggaatcatgccattgtaataattttacaaaatttgagatatgccattctgacccacatatcattgactcatgtgggtcctatatgtcattgagataccgatggcatatctcaaactttgcaaaattataatggcatggttctaaattacccatctgaaaatcacatgccatgttctgaatccaatttgcccatgagctttctgaagctcgtttgggcggtgtatgtgtggttaggtcgttaggcacagaaggcatcatgatttctagatggtcatatactgtggccggtagttcaaatttgaaagcaaaacgcaaaatggagcgacaagatagtgagttcgtgagtttctggtgctgcattgctgtttttggaggtttattgggagtgtagtgtgcctctgccccccgtcccgctgatcggagttgcgtttagccaccgtagtagtttttcttttcctacctatagttgttttttgttttgccttttctttgtcacccggcataggcatgtttggctaattgcgttaggtaagaaaaactcttctaccttctaatatattgacatgcaatcattttgcgtgttcgaaaaaaattgtttctggtgttgcagtactgcaatggactgaaggaaacaccgattttttattaaaaactaggaaggtagcccgcgcattcgcgcaggcatgtatcgtgtgctgcatttgaaaacggattatatttatcagatagcctctgccatgttttggaagtacatttcctcagcaaatatttttcgttgacatcacgttgataatttctctatgctatatactatatagtatttaattaatctgtataagcaattatctatcatcttcatcatcatctaaaaaggagttagacctagtttgtttagaaaacatgtttattaaattaaaagcaaggtgtttttttcttttttttttgttgaatgctttgggccctgatggtaaaaacataagacagctaaattcattgttccttttcccctaccatacgattttcatgcagctcctagtcaccgtgttgagatgtggtcattgcacctatggaggttgtcttgtgattcatcgtacttgtgatcactttttttgtcaagcttagttactcctattttcatttcttgttatatcgtaaaatctaaatggactccaaagttaatcattaaagtatatatgtacaacaaaaatatatttgcagacaattaatgttcatatatagggatgattcaccttttgaatgatctatgcacaaagaaaataaacggaattacccgaaatgcttagaaggccagaacaacacacttgaacatataacaatgatatactaattaaaagtgcattaagcaccatctaaagtcaattagatggtaacatagtttagagcagatacacgaaagatcatttagcttgcttggattattttagcacatttttaaaaaaaatcatgaagtaatcagatattctctaactaaagccattggattttcgatgcattggtgctttggacttcatattttagttagtcctatttgcttagatagtgtatatctaatttagctatgcatgtttgacaaacaacatatgatgatgcaacctgtattggattatttcgtaattcttttacagcaattcaaatgacatgtaaaagggcagggatgttcttccttaataaaaaatgtttcatagttcactttgaaatttttgtttggataactattgatttaatttagctatacatgtttgcagaatgatgtatagtgatgtaatatgtgcagcaaatttgttttgatggtatgcaaagcgcgcgggatgaatgtggctgaatgtcatattttgtacataggaaaatataaggatacggatcttaaattcctagtttaattataaacagagcaacaattatattagaaatcaggcgtagattaaaaattatggttgttttaatatattaattatctctcttttagcttactcatacccaaaaatagggatgggattagcagtggtcttcacgcatgtgaagggggcgaggaggtagatgcgatttgtttttataacttctccaaataatgtaacttaaaaccaatgataacaggtttaattttttctcaaaatttctaagattatttatgattttcaggacaagacatgtggcggcgtaagattttttgtaaattaaatttaatggttgaaaataatggtccatgaatttaattgaaatattttataattttaaaatgtgacatatggtgacttaagtgtgctctaaaggtgtttaattggtttttattacgtagactgatttaatatgaataatacatgttttcattctattataatttttcattttcattcagtttccatgcaaaggagtattttaatttttatatagtaaaatacaactataatggatattgaattattcaattaattttaaataaaacaatagttaaaataaatgaaaaaaaataaaatataattttagaaattataagccatttagctttttttttaatattaggttgttagataaaaaatataaggcgagagattagaggaagtatatgtatagcaggacgagagatagagattttttttctgagacatattccaacggatcctagtctttagttatctatttttaaaatatagatataattttagatctattagaaaatgtgttgggtgttgtatttactaatataagctaaatgttgccaatcatatggtttaaaaatctaattgtatcgtgtgaccaataggtagttgctagcagcatatgacccaaagaaatacatttattttaaatgtagttaatgtaggtattgaattctaaattttattgtaaataatctcatgctgtgcatagataaaaaaaattgctatttagatggtatagttgttgaaaataatttattacaaaatatgtttttcaatattaattaagaaaatgcttgaaaataggagggcatgtcgccctcatgtattagggtgagggcaaggatatatgatacataactacgtacatatacctaacgtaatgtaatggatggcagcggtggggtgtgggcctttctttttcttttttttttaagtaagtcctatggtagaaaatatgggtccactgtatattagtgaaagtcgatggctagatgttttgttttttctataatttgctagagtgagacatggtgagatgagagcatttgtagaatgccatatttttaacggtttaagagtgtttctaggatgtttaatagacttttagtatattatagattatcaaacaactaactattatatatcagccccatacgtcgtgatgtatttaggaccacaatataacttttataatttaattaaagtacaacggaatcacaaattggatatataatttaaaaataatttagaagatagttcgaggaacattgattggatattttatattattattatagatcttagtttaactatatatatttatatttgtgttgtagtttttttagaaaacagatcatcgatttttatgatgtattattttattatcttttctatgtacgtgcgtactgtttttttcttttctttccagtgaacagtacgtaaactatttgttttgtttttgtgtaggtaagtacgcacgggagaaggacgtggtttgcatcgtatcaacttgtacgtacatggcaacaatagtagtgcttaaatcatacaaagagaaagttattattttttaataatagatctaatccaatggtgtaaaatggcggatccaccaatttaagtgaaaatcgacggtgagatttgataatgccatgtggcggtctaggagcgtttgtaggacaccacgtggcggcttatgagcgtttgtagtgttaaatagaccatagaatttatatactaaataaaaatgactatcatattcaaacagaaatcactttgtctcaattttatgtaaactcgcctatcaccatcctccgcaagatttttttttcttttattatacatctaattcacctatgtatgtttatgggtaatatacgaaggaataatttatattgttgaaattatttgtgctaattgttaatgctatttacatgagaacgacataattaaaaatgatattatatggggtagggtatgcgtatatgtattcatggagtgagtatgtacacgtttatatgagcgcctatgattacctttacaatattttaaaaaatctttcaaaaaaattggtgggatggcgtgaagtggcgccatagcggcgttgattctttgataacatcgccaggagtggttgctatatacatatataatttgaagaaaaccttaaggctataaagagagaaacagaaaactaccaagatgggacagatcgtatgcactcttctctttttcttcttttcgatatctcttgtgtgcatacgtacatagggatagattagctgatttttagaagcaagggattagaatatatctaatctaatggttgaaaatggattcatcggtttaagtgtaaattgatgaccagatgttttgcctttttttcttatatttagcatcacatagcatcttaggctgtgttcggcagtgactgttcccatcctctcctcctcgttttccacgcgtactcttttcaaactactaaacggtgcgtttttttacaaaaagtttatatacgaaagtcgcttaaaaatcatattaatctatttttagaaaaaaaatagctaatacttaattaatcatgcactaaatactgctccgttttgcgtgccaggtagtgagggttgggaaccctcactcccgaacgcagccttaggagtatttgtaggagtgtaggaatgctattactcatactcacaatctattgtagtcaactattatttgatgtggcttggtggcactctctatttatctatcatttgttcatacatgcccttagcctgagtttggaactgagagttcccagctctcctcactcatttccgcacacacgtttctcaaatggctaaatagcgtgatttttgcaaaaaaaaattctataggaaagttgctttaaaaaattatattgatatatttttcaagtttttttaggataatacttaattaatcatgcgctaataaactgctccattttccgtgccagcgggaaacattcccaactctaacgaatgaaaagcagcattagtattgtcctttatcctctgtgcttcatgacaaacgtgttcattggatgtcagctaattattagacgcaatgtgcatggataccatgtaagcaatatgacttggcaattggtggatagtggtttgtatatagaacttagggataaattagtggggacattattgaaaaattatatattgtatgctacatattagttttagtacatacgtaatatatttatagttaagttctaaaacacttatctgattggctactcactttgttattgtgactacgtttaccgaattgctaaatggtgtgtatttgaaaaatattttctatacaattttttttcaaaatcaaataaattcacttttgagtttataatatttaatacttaattaatattgcgctaataacctacatcgattcgtgtgccctggacatgctcaaccaatgagctagatggaacgaaggctaagtaggagataaagaacatcaatatggtgtcaaaagaatatatttattctttaattttctaataatatatgaatagagaaaacacaaaatacatgaaaagtgaaaagtacatttatgataaatttagaagtgtcattttgatatatgtgtattttttattgttggagttatttttttcgaaaatataagtcgtatctaatttaactattatataatctacatttttcaattcatttatgtttttcatggatttttcgatgacatgtgtctaattagaatacaactcgaaataacatattccctctatccaaaaatataataatttttcactatgaatcgggactaatacttgttcagaattatagttaaaagttagaatgtagtacatgaaatagcatagtacatgtgtattattattcattatggttttactatatttttattgttttgttgttatttggttgtcacgcaaatgtcaaaagtatgtatatctttaaagttagaagagtattttcttatatgtggatttaatggtttcaccggttaaatgttatggatctacagatttaaatgcaaattaatagttaattgttttctttataatattttttttaaaaaattaaaatattagatagaatataggaaggtgagagagaggattattggacgatggaggaagtgtgcgtgctcatgtgcgtgcacggggtgttcggagggattagtatgcttttgaactaatctaaataggaaaaaaaaagatgtgcaaacgggagtacataagtacgtacatacgtttgtttttcttttttggcaggaatactatgcacatacttaattggtagtttctgatagatattttccggaatacttacgtgtattttttagtagatgtcgatgtatatagatctaattaaaattggtataaaatatcaggtccaccaatttaaatgaaaatcgacggcaagtatagatctaatctaacagtataaaataacgggtctactaatttaaatgaaaatcgacggtgagaatagactgtgccacgtggtggactaagagcgtttaaagatagaacgtttaaagagtattgattggatactttatttttatattaattttcgtaaatttatagagtagtatattttatttttaaattgtagaaaatcctaatttatgtaccatcgttttttttaatgcactacgtacctatgtttactttttttttattacgcagcttcttttcctgttgtacgtaattacggaatactttttgattggatacgtatacggagtttttgtttggtttcccggcccacagtaaacatgagaaaagtattagtttctttaagaaaataatacatccaatctaatggtctaaaatatcgggtccaccaatttaagtgaaaatcaacggtgagattaaacaatgctatgtggcggtctaggagcgtttttaggagcgccacgtggcggcttaggagcgtttgtaggaagtttaatggacttttagtatataatagaaagaatagaatagatagaagatagatagatagatagatataatagatagatagatagatagatagatagatagaagatagatagatagatagatagaagatagataatagatagatagatagatagatagatagatagatagatagatagataaccgatcccttcataggagttcagttatagtaatatttacttgcaggatactattctcattgctgcagtactgcattggtctcaaactctcaatggacagaaggaagctcagattttttttattaaaaaaatcgatcccttcatgggagtttagtaataatatttacttgcaggatatatactattctccttgtttgcacttcaaattattttgcacagtctttagactagcatcgaatatgcaaaattaatggagtaaagacctccataatttcaacaagtgactagaaaggcattacaaattcacgacgactacttaaaattttgttgttctctaaagttcagactaagtgcaaaactaaaggtctggttttgtatctgatggcgctacgaatcaagtgcattcacaatataccaaccagtaatactggtgatataaggtttggttttggttttggatgcagttggtgatgtaccgcaaaagcccagagtttcgataaaatattactactgaagaatacatatgctttcctgctctcagtgacaaaatgagatgcacataggcagatcatgagctacactgtcagatcacgagatcaccgaacatatcctcgttaggtagcgatacgtagatctgactaccttgataagttgttggactggaaacaattgaaaaaatcgcttgagaataatatatactccctctgtattgtaatgtatgacgccgttgactttttaaccaacgtttaaccactcgtcttattcaaaatttttatataaatataaaaatacttaagtcatgcttaaagaacatttaatgataaatctagtcacaataaaataaattataattacataaatttttttaataagacgaaaggttaaacgtttgttaaaaagtcaacggcgttatacattaaaatatggagggagtaataggttgagagtagggaaactttcagttggtggaaaactagtggaaaaattttttgggtgcgaatcagtacataaaacggacgacacgaacatgaatttcagtgaggaatcccatgtgaggattttcagaaaataaatatacacttatatggcaatgtgaggaacggtcttgtcagtactaccgtcttataaagttttgctggacgaggatcaggcaaacatgttttgctggacgaggatcaggctcatgctacatatgttccccatacatatgttctctttgggagttttctgaaaatcataccacgttctaagttcaattttcacatcccaaattgcatgtcatgcagagatataagtgtgttaggcatggaaggcatcaggatttctatattctcatatactccggctcatagttcataaatttgaaagcagaagaaaaagtggagagagcagtcattgagcttgtgagcttctggtactgtggtactctctccgattcaggttataaaatattttgactttggtcaaggtcatactgctccaagtatgaccaagtttattgaaaaatagtaatattttcgatccaacataaatttgtttttgaccaagtttatttacgatgacgaggcgccaccgccgactccacgtgcacgcatgtaatgtcccgattttcgttcggtattaaaaatcattaaataatgcatttccagaaattatattaaattttaaataaatttaatcaagtgaattattgagggaattaaaaattttctttaaaaatcattggctggaaatattttgtaatattcgctgtgccctaatatactctccggatttttccacaatttttcggagctcaagaagtaattataataatacaaagggcttgtttggtacaactccaactcctaaatttagctctaggagttaggtctggagtggagttgtgga

SEQ ID NO: 65493 - DNA, 1950 bp, Oryza sativa
gaggccgccgcctacttctccacttcctgccccacttttgtccaaaaggtcggcgtcggtttgaacccctcatgctgaacatcaccaccccacgtcgtcggccgattccgtctcacccgacctcgattccacactcttgcgcccatgaaaagcatcccccgaccatgctctctcgtttcccctccccgcccggctttcccccgcactctcccgttctccccacgcgagcacaagcgtcgtcgctcgccatcgacctctggacgcacgccaccgccgctagggtcaccgccaagccacgccaccgccaccattgtctccgccacgccgagccacacctcggcatccgctccacctctccccgtatccctgccggaaccacctccgcaccgagcacccgagccacctccaccatcgccacctccagccacgccgcgccgcctctcatgtccacatcgcgctgcgtcgtcgccttccccagcaccgcagccaccgtgcgcagcccgtccacccctccctcctcgcgaaccatcgcgggagaccgcttccctccgtccaaggtgagctctgccgatccttgccgcttccgggcgccatttccctcggtgccgggcctcctcctcgctccctaaaccccctgtctccttccccaggttcttccggccgctgtccgccagttcccgctcgcggaatgccgccatattgccgttgccgcgcctccccgaggagcctgccgccgctttcccatcgtcttctcgccgttgcgcgagcacggtgagcacccctccctctccctctatctccccttcgttggctgcctcgtgcgcgccgccgccacaggtggccattcagccaggctgctcgccgtcgtcccgcgccgccagtggccgcgtgccgccgccgtaccatggctcgcctgggccagtgtcacattctgatttttgtttcagggtttataaattatttaataaattaataatagaatttatattaagtgttctttaatttgcaagtgaagtaaaatgtgggaaataaaatttcctaaatataaagcatggatggatttaatttttattaaattctccatgattaagtcaactctctgaaattttctcggatttttcagagctcaattcctaaatgatacaaagaacagttcagtaattatttgatcattaatgatctaattataattgttaagtgcttttcttgtttaaaatccttaaattataaattgttgtttaaaaggaataattagaaataattttaaaagcttaaaagagaagatctaattttaatttgctaaatctcaatataaaattgggctagataaaattttgttaaatactttgcttaattctataattcctagatttttctgggatttatttgagctaaggaagtatttttaataaatggaattgcatttaagaaataatttaaattgaaaaatgtttttaaaagtctgttttggctttgggccgaaagccggcccaaaacctctctctttctctctcttctccccggcccaagccggcccgcagccgagccgccgctctcttctctctctctcagtcgctgacaggtggggcccgtctgtcggtttcgtcgtcctccacgcgccgccgccgccgcccgaaaccctagccgagcgccgccgccgtctccttccaaaattcggtcgatcctttccttctccggccgtatcgtttgatgggaaatgatcttctcgatcacctcttccttttctcttttggaatcatcgtctttttcggtttggaaatccgtggattcgaagtcgaatcggatcggcttttctctctccgagcccgacctttgcctttttcccttttccggggttttccccggggcggtcgccgtggccttcgccgccgctctagcccctttaaaagacccccgagctctcctctattccgtcgccacctttgcctt

SEQ ID NO: 65494 - DNA, 980 bp, Oryza sativa
caacggctttaccttttgtatagcatggttcattggagagcaccagactgagaagtggcggagataagctcacgggggtcgctggggagtccatgcctcttgtttttgagggggtgattatgatctaggaatggtgcactgtggtgagttgtgttatgtagagggtattgtcacagcctctattcgggtactttccagtatcgcgacgtatggtagacatgatgttgaggctgtgtcttgtgggtacagtggtacacctctgatcagagtaaaactattcgaatagccgtgcccgcggttatgggcgagttgagcaatgtttttcgtgattagtcccacacctctcacaataattatggatgttatacctggtaataatttgcttagctcctggtttggagttagatctgttcagccgggtatggttgttcagaatggttgggcctgtgcagcatgggtgtgctgttcagtgttgattaaaattcctgattaattactccactgttttacttctcttaaatgttttgctaaatgctgcttttgcaaatgagccaatattatgccatcctttggtatccttgtgcacttgcatatttgctgtgtggcttgctgagtatgtcatatgctcaccttgcaataatcaatcaatctcagttgaataaaaaggatctcgaaggagaagacgtttggcttataccccagttgagctgcctgtgggagtggagccggagcttcgctagattttattttccgctgcagttttcttcttggtgaggactaagtgcctcttaagtaagtatttatcattttagttaatttgatgaatctgtatattaaattgtcagtttgtgtacctcggctgattcctggacgaggattttatgcacaaataagttcggaaattactagtgaatttccgggcgtgacagtacctctccggtttggccaaaacaaattattagaaatgaaaaagtacgaat

SEQ ID NO: 65495 - DNA, 15931 bp, Oryza sativa
  unsure (1)..(15931): unsure at all n locations
gctaccgcctccaccgtcctcctccgatgctgcctacccgcatccgcctcgtcttcttcctcctcagatgcttttctgcccttttccttcttcaccagttcaccaccaccctctgcattgagatcaaggaatgaccacggatatccacttgttcaggtaaaaaatctccctgttataccagatccatgatttgtttggtctgaaatgagtgaatgtatgcatgtatgtatggattgtttcatgtgttaaattataagtgaatgaatggacaaaataaacaaggagaaaatagcgaacgagagattatctacctgcttggctgtgacagttagatcctatgcattgtcagtctgtcacttttcttcctagtagtaccatgatacacttattattatcgtcctgctcacaaaaaattgcagagttcatcatcagggatagataattagaggctttggatatatagcattgcaatgtcaatgttgcatatgcagcagtgtgcaaaccaactttttttatgtggaggaatcttgtctctgagcctgtttggtcagttatattgttgagctagacatgtgtgagaaacagtatatgttgagcctgtttggtcaaatatttattttaagtgacattataatctatttccaagtttgaactatttggctctatggtgcagtttagtcgtccactaccgattttgctgcaatcaacctagatatcatccaaggtgtacgttgctgagcatctaccgaacagaagtcccgaacaacaaatgtacaaccgttagtatcctcctgcttgccatgagtactgtgctaaaaggctgaaatgttatatcctcatgttatatttttcttgtgcaatgttttttatctttttcccatgggcacactggtgagtacttgtacttcacgcacaaaaaacaccactgaaacaaactaattttaagtggcctctgaaatttgattgtcaatatcagctttggataggagatggatggaccttcctaggcacaatttaacctgacaatgaaattgaatatgtagaccaatgtcctgatttaggtggcggcacaaacattactattgatccaacatatgtttctcctgttagatcaggtataaatggaataattgttaatgcaaatgaaaagagaaagccatttcaccctcttctcagacgcaatcttttacttttctgttgttttacagaattgctagatttttgttagaactgctattagaaaaattgagtcacttggtgaggaagtggaaaagttgactgaattacttgctaattctcgagatggacaacaagtcaatgtaaatcccttagtcatgtcaacttcttcaacaacttaaatgaggtaaataatgcgatgaatacagttctattctagatgatcagtgcctgtttccgtttcattacttttggccaacaatttgtattggttgaacaggagagtacaaatggctagctttttgttagagctactgatgctatcctggacatgaagagttgcatgttgaaggtggtcgcttgttggttgaattatttcatctacacatcggtggaccatcatcatacaagagtcttgggaatttttgctaattaaatagacttgttttgtatgaatgctaagaaaatgtactcgtatatatgtacactgaagcaagtgtttgcacactctgctgtgttggatataactacttttgatcttgtggaatcttaaagtcagtatgtttttttgatgcaacttaaagtcagtatgttaaacctgagttgttgaatgcacattgaaagcctatggggtattgaattgctgaatgtgtgttgaatgcctatggagtttgtactgattttgtgggctgatttggtaccgatctgaatttgtgtatattggacccattcgtactgatttggtccatgattgaaacaaccaagtgccagtaaaactactaactgtcaggctatatgccagggatgctctaagcatcaagggcagttaattgccacggatacaactatctgccgggaatactctagtgattctagggcagttaattgccaggaaaaaattatctgccgggaattctcttttgctacaggactttatagggcagtttttaagtgccgggaatagttttcccggcagatgaattgccattcaatgcacttatctagggcagttgcaatgaagggaatactaggtcatggtgtagtgtttaggctgcctacctcgggaataaatagagagagaaaggatgtagcctcccggtatcatttttgagagagtggagtttagagaaaagttaggctttcgagtttagtcgagatttttgtgaggagtactgttgtcgcactttgtaagcaccgagagaagtaataaaattccaatctacttagggacatcttccatttgtgtttctccgggtttcggtggtcacaccagtgagtgcatgaattgcaccattgcagttagactggcggcggcgacagtaggaggaggagacgctagcagttggactgggtgatctataccgatcagactgacggcagaggcgcgatcagactagcagatcaactccgattagatcgaccaccatcgaattagagggtaacttttaattccactaaaagttacggttttcgggtaacacaaccattcaccccctggttggcttagttattgctattcgatcctacaaacagcacatcttcgatcgaaaggtgtaaaatgagagttttattgcccttgatatttgcactcattcaacaattttacagtaataactactaatatttgttggaccgaatagaaataaccaagcaaatcagtgaaggatgaagggtagattacgtctacaaaagttaaataacgaaactttgatgatcataatgctaatgatcgatgaaattattttcaaaaggaggagaaaagatacaaaatgtgcatatcttaagttgtggggacatttctttcttttcaaaagtgagacaaatttccttttgaaattttgagcacttgatgctttttaccacttctttgtttttatttttccaaacaccaaaacaacatttttgataagtttgctaatatgtttattaaggggaaattgtaaaatgaaagtatgtttgatcgataggcatgcgagataattacttttgatatttggatattatttggcaaagtggtttgtagatatgtgtgttttttcagatgatggacaggattttgttgactgtttggtccggtcatgatcaggccagcatgtgttgcgcagtcggactagctagcccgacggtctgacctagcggctctgtgtcagttttggtttcaagttgcttatttggatactcttgattaattcatgtttatgacttatagatggatactatatgtatgtaatactactgtatgctaattttgagtcaagttgcagagatatggtttcgttgtttattcatttgtaggtgagtctatgcgttgggacagcgttgctggtgatagatagggattcaacttggaagaagatgacaactggacgattagcatattatgcgggatgcttcggctaatgatcaatgcatatgattggtgaaaattccttatggcatatatacgatggagatattgtgtagatgcaaagtcaaatttggaaaaagtccaaattcgatatgattaaagtttgtcaagtttatttcttgtaagagattgtttcctaggggttgggacttcttgtgcaagttcgagttgtgtatttaggctgtctaccttgggtatatattgaaagagggaggatgaggtcttccggtatcgattgtgtgagacttgagtttatagaaaagttaaggttttgagtttagtcgaggttttcgagaggagtgctattgtggaactttctaaacacgaatagaggtaataaagtttcattatattttaataaatcatcgatttgtgtttgctcgagttcgacgatcacatcggtcagtgcacgacggtcagatcagtggcggcgacgacatgaggaggcaacgcgactcgatcagatcggttgcacagacgtggtcagaccggcaaaagacttgtggtgagaccgagcttcatcgatttgagaataacttttagtttcgctaaaaattttggtttttgggtacttcgaccattcatccccttggttagtttagtttctgctgcgcaatcctacactattagtagtcaccaatgattaaataagggaacgccaaacaagaatctcgtattatcatgttttaattatttcatatttagaaaaatgaatttaagtaacttgtttataaaaatttcgctcaaaatacatggtttagtagattaaaaggggaacgactctcggtcgggcgcccgatcgggagtggtaaaatcgagcactgacgtcattctatttacgtgcaaaattactttaaactgatttttctcttaaattacttatccaaatcataattcgattgcaccattaaattcgttgtaattaaatcttcaaaacaagaccacatatggatatattccgacgaaaaaaaatttagcttattattgaattatttttaaatgttgcacgatgttccaccaggtatgtcggaattgtttcactaagtagatcgaaaatgtttcactcatttaaatcgggtgttgtttcaccttatataaaaataatgtttcagcaaatagcgaaagaatgtttcagttcactgtaacattagatctatacatagtgaaacattgtgagtacactaggttttttagtgaaataaaaaaataaactaaatttccttaatagggggtttccaaaatatgtgggttttttttgttgcaatggaatgtttcgttcactgtaacattaaatctatacatagtgaaacattatgaccacactaagtgaaatatttttgctggaaaaaaaaaccaaatacccttaacagagtttctaaaatatgtattgtggttaatttgttgcatgtggggacaagcactgtgatgggtccagcggcatgcaggggcaggggcgggggagccgcccgatttttgctcccccgcctggccgaccgattcgtatcattatccgattaaaaggtgccctaacgaaacccaatgaaaaatctgtcttaccttaaaaaggaacgggaccttaaataggttattttttttaataaactcatccttaccacagttacttttagttttatagctttaggaacacagctcccagtttcttttctttctgaatcacacatatctaccactccagagcaactcgtttttagtggtaaataggatgcataattcataccagttaagaacacagcactattagaacacaacttattcatacacagaatagtagcacatacatatttttccatgatcatagccacagttcatactaagattttatctatttggcccatttcatggaaggttcagacctgcagagttcttcagaggaatatactgaagttcatgctcagaagaactgggcattcactcatccttgatgtcatcagagcgcagcgacgttggatacaagagcttctttccaccagcctcagccatcttcttgctcggcgcatcagcttggctaccaccatggcggtgcatgtacaggaggcggtagcagaactcgacgacctccggtgcgaataccctccacaggtacattgtgctgaaccatggtggcacggtgagacaacgcttcccttgccgaaccgcttgtaccatggcttttgcgcaattcttcgcgtactccacgggaaataaaccaatttgagcctgaaaatatatatatattgtaaaatatttcattccagctgaactaagggtgtgtttgaggagaaggggattggggagattggaaagatacgcaaaacgaggtgagccattagcacatgattaattgaatattaactattttaaacttcaaaaatggattaatatgattttttaaagcaactttcctatagaatttttttgtaaaaaacgcaccgtttagcagtttggtaagcgtgcgcacggaaaacgagatgcttttctctctcaatcccccagattgcccaggaacgaatgaagcctaagtttagatttctttgtatgcccccttatagtctagaactttgtatgaaaaaatgttcaaagcagtggtactgaagtctgaatcttatgttgtgatcaaggagcctagtgtgatttcagaaggacttgtgaaattgacaagtgggtgttcttacatctcgcatttcttgatcgacctccatttcaccatgatccttgagaaatttcccttttgacatctcagactcgatccacccaggtgttacaattgtgattccaacttggctaccaagctctgtccgcagcgtctcgtagaagtttatcagtgcagcattggcagcctaagcagaggagcaaaagacaaacatcagtctcaatactgtcacatatgcattttcactaagactgcaggacattaatttacattgtagaaggtcattcttggaacaggattccatccggttgccgacgcagtaacaacgattcttcctcggctccttttcagatgagggagagcttcaaaagttgactgaactgaaccccagaagttcacatcctgaaaatgaagtagttcataccagtggttaatttacggatcttgaataaactacacactgaactgataagaactcatcaagaattatgttgctcttacaaattgagagctgtagttagtaacatctggaatctcctgaaacgcgccaacacttgcgatgccagcgttgcacacaagatggtccactgaaaaacaagtgtaaagctcaatgaagtactgaaatgatacttttgctgaagaaatttactgaacaaatcagtgatattggagacttgcatcgcccgtagtgatcgattgcggtctgaacaaatcttttgcagtcttcaggattcgcaacgtcgcccggaagaatgatcacatcaggtgctccaagctcgaacgcttgatcggcaactttacgcaggctccattctcttcttgcaacaaggaccaatgatgcccggttcagagcatagttgtatgctaattgctgcaaaaatcatcacgtgacatacgcaaataaatcttcatctcggcatacagaaataaacagagaattacaacaacctaaagttgaactatgcacaaacatatggtggtactatatatccttcgaacttttacaaattgtacgcaacgcgcctaatttgggatcttcaaagtaacaacatgctcaaactattttactctgaaactgtcagacagttatcatagttttggaaaaaaataatagaacaaagatgcgatactacaaagcaggcacacgaacacaatggcaaaacatgaccaaacacacaaaaatcagagcaattaattcaaagaaaaacagtcagcctgcaaaaagctgatacacagagcagagcccgtggccgtcagtcgcctcacgtcgccgatgcaggagaaggggccggtgatgagcacgaccttgcgggcgaagtcntcngngaaaggtangagggaaagagtggacngtcttgaaaggtagtagggcgggtagaagagcagcagcctgtccaccatggccggcgtcgtcacccagttgagcacgccgttcaccaaatgcaccatcgtcgccttcttccttgcttccttccttgctcctctgcaacctcgaccgatcttctcttcgatcgttttcagcttcagacacgtatcagagcagagcagggtcgcaagaacacaagtttggcagagagagagcaaagatttgcattgccgctctagtattttgcatggataggaggttgctcggcttggggacacgtaggggtggtgcgtgctgagacgtggagggcagcgggagcgctttggttggcttgctccacgcatgaagccggcttaatttgtcctcatcctttgcatctgaggccctgtatagattccacctaaaatttttcgccatatcacatcgaacgtttaaatacctatataaaatattaaatatagatttaaaaaataactaattatataggtttagactaatttgcgagacgaatcttttaaagtctaattgctccatgattttaatgtgacacgctaaaactttacactatgatctaaacaccccctgaacttgtaaattacaacctccgtcccaaaatatagcaacctaggagggaatgtgacccttctaagttgatgtatgtggactgtcattccttcctaggttgctatattttgggacggagggagtaggcgtaagcgaagagagagaacgtatatgttggcagatctcacactcacggcttgtttggcaacttgagggaagaggattgggagtttacacgagggaattgacggtgagattaagatgggaatttgatttttcatcccagtctcttgtttggtagaggtgatagaaattgatagggagtttagttggagattagatcattaaagaaaacggatggctgagatttgtttacgcgaagtaaaggaggaattccctcccaattacctgcccctacccagatattgaaaaggagggagttcattcctcaattccccatcctcatcccaccaaaattcctatgtcccccatctaaacaaaacagttaatagccacatccctctagactctaaatccctcctaaaaactccgtccaacaaacagaccgtcagctcacttattactgactaccttcgccggttgggccctctgcacagggccggctcatctacctgggccgatttgctgtctcgaccggtcatgcaatgggtccaataacatttcagcgtacaaaatgtaaaagggtgagcttaatttctatatatttttagtcaaaagtgtttaaggattataagaagtatttttgaaaaaaaaaactcatgggccttaacccattatcatccctagccataccctgccccagcagtcgcatgggctgcttggcaggagggctgcttgctagtgcatatgcgctgtgacagcaagtagtgcagcccacatgaaaccattactgacgtgcacaactgcatcacgacagcgcgtcacccctgacactaagcatcacgtttgatttgagagttttttttcgatgcgtctctatcgtggtgaaacctttcaactccgattacagaactttcgattcaattctgcaactttgaatttagaaatctcaaaacatcaaaccaaaagttacaaaaaaaaaattggattcataatctaaaactttgtactcatgttctgaaattttcaattcgaattgtaaaactttgaatccaaaatataagacttttaactgatagactaaaactttctacgtatacactaaaaatttcaacttgaatcacacaactttcgattcaaaatctaaaactttctgctaagaattccgaaacttcataccaaaatccctaaacttccatatcatagtatccaaaaactttaactcaaaaattcaaaacttcccacacaaataggtacaagttttctagatttgaatttgtcaataagaagccgataactcaccgatgtctcactagggcggaggaagagcagcagttggagcagcattcgacagaggtggaggaaaagatgatcccaacctcgctgggttcttgtcgaaggagaaggaagaagcatcgtcagctagagaaacggataaaagtgagaggatgttaatgggccttatgggtctagtgttcgctactttgctaactagcacgtgtgcgcgaatttgcattccaagcctcggcgcacctcttcgactctcgcgtgcgtacaaatgtacaaatgctgagtttgtgaacacgaactatttggtgattagcaacttagccttgcatgagttcagttacgtacggctccaaattcccatgacatggcaaacgaaaacaaatgccatatcaatgtatctcgcacaataacttacttttcttactacggattgaagtctgattattttgacttatagcagttgcattgattttctttaatgaggttattaataaattacgttctttttttagataatggaaatggattacatcttctaacttctgtcataagacaaacaaccatacgtttaatagtaataaaaaggtaagataaaagtaaatcaaaatgagaaataaggtgatgggacaaatccccaactcccctaaaattacggtctactagcagaatttgatgtggataccatgcgttatctttaactactttaaatttaaaatcaaagccatcttcattcctcccttcaacaaaaaaaaaaaaccgctagctccatcaaaaaccacccatctttaattaaaaaaaacaactccaaaatagaaaaagaaatcctacccattataaatcggcataaaaagaaagtaagttatatttgcaataatatcaaaagatatggcaaattggcccactaagaacctatttgatatggctctagctctagctctttctcttctggagttagagctcaaccaacactactacagaaaccaacactactacagaaacataaatagatatataccggttgagaatcccacataaactggcaccatgcatgaggcacacatgaggaggaatcaaaggtgccggtttaagaaccgtcacctttgaggtttcactaatccgatgccttgcgccaagaactgaatcccagaaacaacagtatgagatttcaacaatataaaaaacatcccgaacaagccacaaccgaatcttaaaatcaaccatacccccaccccagggaagaaatcaagaactcaggaggggagaaggcacagtgccagtggtgtcggcgtgggaagctaatggagaggttgtgtagccatcgctcgcgaatgaggatgcccgccgccgttggatccacccaaaggagggcatccgccaccgctggatccgcacgcgagtcaatgctgccaagagagaatcagtcgagagggagggccagggaaggagaagggtcgagggcgcccgccgtcatcattggatccacgtgcgcgagccttcatcaccaccgtgtctgcacgcgtggaccctcagccgcgcgtcactaagggtcgagtccaccgtaaaaggaagtgcagctggcaggagtgctctcataaaatgaaccataaaggtggatgtgggtttaggctgttccacaactttactccagacccaactcttgaagttaaatttaggagttagaaccctaccgaacgggccctaagcttaatatgttggcccatcaaatatcataaggctaatgaaaatggttagaccaaaaccatgataaagtatatcagtaacatagccaacattgtcctctatgtctacgcaagagccacgtttttatcttgcctcccacccatcacgtgcacgaaatactagatttcaggtgaatcaccttcaacctagcaccccgctttggaggcagtcaagagagaggcaggataggcagcttcccaacgatgacggcgtcatttccagcgatggcaagctcctcctcttctctagtgacagtgacacatccagctccaatagagaacatacggattgaggcttggggtttagatcagggtaggaggtggtacttggtacaagagaagaaggaggtttttctggcacatagaggaatgaccattggtggcggtgtgaacgaggcagcgcagcattgtagctgtgggacgggaagctggcgatgggcaaggttaggggcaacaataatggttaaagatacagtggtggtggaagcagatggcacaagctgccagagatgaggaaggaccagcggggataggagcttgatgttgccggacttgaagaagaaaaatgttgtaggacggaggaagatagaggagtacaggcttatgtaggtgttgtgtgagtaatgggaggagggaagaatatataatgttgattactgtagcacataagtcttgagcaatctaagccatccaaacttccctgatctttcttatttttaattttaggaactaacaattagacagccccatcgcatgcacatgatcgaccactccatgtccctgaaaaacggcccaaaacccttgtccttcatcgggaaaacaatacaattgataacaatagtgcacatactataatgtatctgttgacataaaattctaccttctatctttcgaataatggaccgttagatatactttaagattcatgtagaaccctctttacctagggtaaaagcggttctgcatgaatcttaaagtatatctaacgttcctctcgcgcattccgcccttccgcccgcctcgacgtctaaccagaaggtgtcaacgaagccagcgagccccctaccccctggccggcccttgctcccctcccccctcatagacgcaccgccgtcttccctgtctctgacaacagggcaccaccactaaccacctcctcctaacagcccttctgctttgcccccgccgcctacaacagcccaccgccagcttccgatcctacagctttggcgttgtcgtcgccgtctctccgcccatccgattcgctgcccactgctgcgctgccaccttccatggccatccctctaaagctagagaactctcccgtcttctccctcccccaccccacccctcccatcctcaccttaattatcctgcgaccctaacccgtagggtcctctgctggagtctagggtctcgccggcgtcaaagaagaataggaggtcgctgaaattggagaaggcttggagcacgaatctcgaagttcatccagtggcccaaaatctgtaagattggaagatagattttctattgacaaaaggatagcaattccgtactacttccttcgtttctaaatatttaacaccgttgactttgtagcacatgtttgaccgttcgttttattaaaaacttttgtgaaatatgtacaactatatgtttacgtgtaaatatatttaacaataaatcaaatgataggaaaataattaataattacttaaattttttaatataagccgaacggtcaaacatatttaaaaatgtcaacggcgccaaatatttagaaacggagggagtataattgagcacacgcatgttaatttggtgttgcttgcgagttgcgacttccggtaatcccacgtttctcacaaaatcatggagatatcgaaggaacccaactggaaacaccaatctcgtacggcaggaacacaccgttaggcccatcacggaactcgctgaagtcctcgccgagcgcacggaccgccatcgtccgccggtccagcaagcagagcgtccccctgagccggagcaccacggcgccgctcgcctcgccggaccacacgaacacctcgtccgactccggcaccggcagcggcggggagcatggactccggtgcactcccgtcgtcgtcaagtcgacgaccctcgtgcacgacaccgacaagagacgcggggccgacctggcgctggcgccgcagccgccgccgaagttcatcgcccagatctccacctgcgtcctccggccgacgagcagcgccaacgacttcctgtcgccgccgccgcacgacgacggcggcaccagcaggagctgccccggcgagacgtctgcctcgcccgtgcacgacgatagcagccggagttcggtcggcaaccgcgtgatcgtcgccggagatgttgcactcccgatctcggtttcgccggagacgtcgacgcagaggatgaagtagtcgtagggcaactggcggcgctggtattggaggtcgaagacaagcgatgggtggccgccgaggaagtaggcgacgccgtcgacgacggcgggcgtgcggatcagcaaggcgcgcgggctgccgtactcgccgccgccggcgatctcgacagggatcgcggtggttgggccccacgagccagcgtccggggataaggcctccatctctacgtgaatccgccgccgctcgcgccccgtcccggtcaggtgaaggctcacggagagaagccggtacgggtggagctcggaggtgactccggcgtcgtcgccggtgagcaggaggtaggacccggacgaccacggcctcggcatgtcgatgcagcgcacgtagcccgtcatagggttgcacactttgccggaggagtcgccggtccggaggacgacgaagccaccgcgcgccgccacgggttcgatgcgccaatggatagaaccatacacgtggtcggagctggacacgaaggaccgtatctgatcggcgccaccgccgccgccgacgatggcatggccagccgcgacgaaacgtagcggctggtagtcggggtcgggggaggggcggcgagtctgaagaaaaaaaccgcggaggaggccagggacgaacccgtcggcgttgcgaaggcggaggttgcgggaaaagccggcggcgccgcagatgacgcggcggaggtgcctgcacgcggcggcgcagcggaggagcgtgatggggtcggagcgctcggcgatctccacgaccatgtcgagcggcagagccggcgatgacaacgaggacggcggctcctccatctcgatctgatgatctctgtctatcggcggatgcacgtaagatgaatagtactctatgatatgtagtaacgggccggtgtaactttattcatatcatatgtaacgctggctaaagaaaaaaaaacacagacatcagagaccgaatcaaataagaaaataagagctagatttaaatataccgtgatcggttgtaagaaactaagaattctatttggattgcccccgagccccaccagctgcaaataaaaaggtgaaaaggcgtcgagaagaggtgacgaaccagtagcaaaaccagacatcggcttcaattgcttcatctcaggtcagagaattaattttcgtaatttaatgtgattgtttataggctaaagcaatatggtcttgaattagaacttcaatattgtggtatcatagcttaactttagcctactcaattacttattcacatcatcctagtgattagaagcagtcggagccatcttgattcgacatgaacaattttgaattaaataagtttaatataatctagtttaatctaatctatttagattcttatctttactgcttagtgaagattttctcttgttcaagttcaatttaagttaataagattgagtttgagttcattatgcacttctatgtttagacttattttaagtttcaagttttacgtccaattaaccttcacttagcagtggaattaagaaattgaagggaaggaaataatgagatcaatcggtttcaattttgccgaaatccccaaattgaatagaaccctgagctgcaaaatccaaatcaaatccaaatctatatctatatttatatctatatctatatacctatatatatacctaattaaaaaatatgtaatgattccagtatttttttgtccgtcactttttttgcgtttttttcttttttttttggctattttcgccctttttttctttttttccattcctcctcatttttccgttttctttcctttgaatcaaaatctaagcgaatctataaaactcgggatacaaacattgacttttaaatagagattagattccataaattaaagcagaattgaaaggaaaaaaacattgagaaaaatgatggagtagtagtggagaatcgatttttcaatcaattggaggacggaacgcattaggcatgtgtttggttgggaggatatcccgggatgggatgggatcatcccatttttatggctgtttggttgagggactaggagggataggatggttccaaaagagaatattccttcaatattcgggacaaccccatccggaaaaaagtggcggaagaaacgatcccacctcgcacctgtgacttgcgacacgcgggcggt

SEQ ID NO: 65496 - DNA, 2278 bp, Oryza sativa
ggcgcgcgagcagtacacggcggcgctggacctcatcaccttcaattcgaagtgttcgtagccaccaactgcagatcggggttcccaatctccacggtaaaaagaccctaaaccttggatgaggatttcgttttcagatctgtgcatatctgtttttgttgaagaatgtgtgaaatccctttatcaattgcttgacagtagatgttgtccatgtgtttttttttgttgtattgtagatggacaagaggaccaagcttttagtttgtattgcagctacaaatttattgttgtcgatgatggccatgattattaggtctagaaaaagaaagaggtgttcaaggagagaaggtattagatatggcccaatggttgaaagggatagaaaaagaattgagtacctagaaacgaatatttggtggaacgatacaacttgtatcaacatgcttagacttagaagggcaagtttctttcgtttttgtaagctttttagggatcgtggtttacttgaagataccattcacatgtgtattgaggaacaagtggctatgtttttgcatacagtggggcataaccttagaaatagattagttcgtactaattttgataggtctggagaaacagttagccgttatttcaacaaagtccttcatgcaatcggtgagctacgagatgaactaatcaggcccccctcattggacactccaactaaaatagcaggaaaccctagatgggatccttactttaaggtctgagattcatccctatctaaatttatctttatgtgaacattgatatatggtccctaatttttaatgttgttgaacacaaaataggattgtattggagctattgatggcacacatattagagcctcggttcgtaagaatgtggagtcttcttttcgtggtaggaagtcccatgccactcaaaatgtaatggcagccgtagattttgatcttcggtttacttatgtcttggctggttgggaggggacagcacatgatgctgtagttttaagagatgctttggaacgtgaaaatggcctccgtgtcccacaaggtaatagattacaaggtaatagtttatcaaattatccatgacaaatgttgatatttaggaatgtgaccaacttgtcgatcatataataggcaaatactatctagttgatgctggatatggagccaaacaaggattcttgcctccttttcgtgctgttcggtaccatctaaatgaatgggggaataatccggtacaaaatgagaaggagttgttcaaccttagacactcatccctccgtgtgacggttgaacgtgcatttgggtcactaaagaggaggttcaaagtgcttgatgatgccactccattcttcccatttcgaactcaagtagatattgttgtagcttgttgtattattcataattgggtcgtaaatgacggaattgatgagcttatagctccgcctgattggtcaagtgaggacattgatgaatcgttaaccggccaagcaaatgaccatgcattgatggttcagttcaggcagggcttagctgatcagatgtgggctgaccgtaatagccatcatggaatgtaatatgtagctgggctacttgtatttctaccttatttacaatatttcattagtcaatgaacatttttatgtatttcatttgtatggacagcttgttgtagtccatttgctaaattgcatttgtatggataaatctattgttgtatgctgaattatggtttgatgaatgctgagttggttgacatattgttgaatggtcatttcattggttgatagttgaatgctgaatttttttgggttgatttattgctgaatggtgaatttctgggttaacatattgctgaatggacaatttctgtttactatattgctgaatggacaatttctgtttactatattggtgaatggtcaatttctgtttactatattgctgaatggacactttctaggtttacatattgctaaatggatattttctggttcatttgacagcaggtagaaaatggacaacaatagtggcaagggaggaagcacccatgcttcatggacctcagctatgtcatctttcatgctcaaacaccttgccaatcttgtggccggaggcacaaggacctcatctggcttcaaggcagtgcatctcaatgcatgtgctagggctgtgaatgaaaggtttaacagcactctcacgggtgagcaaattaagaatcatttgaagacatggcaaagaaagtttacaaagataaataggct

SEQ ID NO: 65497 - DNA, 758 bp, Oryza sativa
gtatcagagcttccttgaccctaggttatgccaaatggttacccatagaagccctctaaaaatgttggaaaaatagaactgttctcctccctttctcttttaattaaaccaaactaatagcacatgcacttcataatctgttttaatggttctcgttcaaaaatttattccagtgttattagtactgtacatctattactgtactaatggctcattttaccagcaaaagttttacaatattgttttatttaatcttgctgcaataaaataaatttaacatgttgattttataactttcttttatttcttttggaacctgatgttcaaaagtacaaaattcatttccaactgtttcaacttatcttgcaagcttggtttactttatttaattaccttttactttgatcttctaaactttattcaaattaatcccaaaacttgtgctattaattggataaatgtcttaactccctcttttcacttgtctttagatgccgcgctacaagcctgagtacttgtttggtgttgagggttttgtccaggagttgcgtacaatgtcctttgtcattggatttgggactgcccctttttatgcccagattcctcatgatcgtcatgaagagaagtgcgagtcaaagtcaccttgaacagtaatagtgaagatatcccctcagtgatgttcgaagctggaggaagaaactacatccatgcaagtcaggaggtggcaaggatcgccataggagagctccgcgatcgtt

SEQ ID NO: 65498 - DNA, 713 bp, Oryza sativa
tagccacatatctccttgtatagagatgatttcttacataaaaaatagtgtattcatctttttacctatcttcttgttaactcttttagcgctagtggcgaagctatgttatattggaggtgcacatgaacccccaaattcctaatttctcacttaaaaacactagaatgtacagtgttgtactgaaattttctagattctcaatggtagtgcattccccttgttttgatgctagcttcgcccctgtttagcgcttcaaaattttacatatgtgacagtgtatttaatactatggacactaactgaggtagggggttgggattgcccttattccaccttctcgatcttagtcttagacatgatgatgaattgggagagagatctagagagagaattttgatgttgattaatacgagtatgagcttgaatgatttcctcaagacacgatttgttgtctccacagatgcagatccagcagaagcagtggccgaccaaaggaaccgacgaccgctaggcagccgccatgggtttgccggtttgacggagtacagtagaggtgctgtgcaggtgttttcacaacatttttctactcatcacgtgttctttggtcctcccttcattctacaatgaatttctggaactcgaactttataccactatatagtgatttctatattgattcatatgattctcgttattttagtgattttaag

SEQ ID NO: 65499 - DNA, 6584 bp, Oryza sativa
tttggtttgaggagtaaactaccgaaagtaaaattcagtccctgtcttcgagaacactgcagccagacaaggcaacagatggagccaccacctcatacaaatcgatcaaattaatgttcagttatttgcagaacagaacaagaaagaaatgaaaaaactctttctcctggaccacagaaaagtatacgtactgagcttctgaactgtccaagatcaccactattcagagaaagtgtttggacatagagaaaagtacatagtactacagtacagcaccgtgcaaagtcattgtgacatgtggactggtcgttctctgccttgtaaaattcaggcttctgcaggcagcatgatgcaaaatgcaacaaagttcagagaattccatggcatatgcagagcagacaagtctagtggactggagtacagtgagtctactgatgttcatcagagctgcatgccaaagtatccatgtctgcttgcagctgatgttaacttgttaatgcaagtggctgtggttgtcgaatcagatgcccattggatcaatccaaacgacagtgttgagtcattctagctagcatgaaatgttactattattttatcacactaaattgtcatgctctacataattaaggagagacacaacatgtcaacatacaggtctccatcacagttcatcagcatcatctctaaactattttacgagattaattctacttatttttttgtttgcaatggtccgtttgtcatcgtctgaactgcattctaacttctaagtgcatcatgataaggctgcaacaatatctttcactctttactctatcttttctgaaagtaatgccacggatgctttgtctctgatccacatggacgtcatcgatcacaaacagcactgcgatttaattaagcaattaaaccatcttgtagaggtttttcgtctggaatctgatcgagcgagctcatcgatggcgtcagggacgaaaatggccgcctatagcctggtcgtctcgtccatggcggcaaaacaagcaacgtttgccttcagaaatcttcagcagaagaaactgatcgccacttgtctgcttcgacttcatcagtttgcatcgatcgacttctctgcaaaaaagtttgattaatctaaccatcattaatctgtactatggacgcaaggttttttttacaactaatctaaacagagaacggaagaagagaatcttgaactgttcttttttttcagacagtgatctatctctgcacgaatactgactgaccgtgctcctctttacacgacaacgtaactttgttttctcaagaacaaaaacagcagagctttcaacggcaagttcttccgtgtctgatcatgtgtatatcctggaagaagagattttcttggctggagctggaaaaaaaactgcaccgggcgagacgatcgatcgatcgatgcttcggttcgctctgaaaatttggtcgatatcacgatttgtctgcacttgaacaagatccatatctggcatcatcatcagttgcatcgacttgtccgcgaaagttttttattattaatctctatcatcattttctgcaattctctgctagaagagaaggaagagcaaacgttgattagacaattgaactgctgtttaatttcccgagttcagactctgatctctgctagaatgagaagcgatttgattccgttttgcacatatatgtatgatgaaatcgatccagcagtggtggatggagttagttaacttgtcgacgatcgatgtaatttgcctgatgttgtctcgcatcagacagcgtccgttgcccgcaggcgtaaatataaattataaaagtactaaattgatactgcttctctttctcgattttagaactttgaacgacgaattcttggtttcatcatgtatgatgatgtgtatcctggaaaacctgcttcgattcgattcggtctgaaaattcaatggtacgttaccgtacaatggaagcttccaacagggaagaatattagatcagtcagagagaaaaggagatgaaatgcgtaaatagctctggtgaagtcaaggattgcgcgagttcttttagcacttctcattgtttgatccctacttgataatccgtagaaaaacaaactaaagcaactaaaataatttataagtagaagttttatatacttgtatcctttagtaacttataaaagcttatgttaaaaaataataaactactaatgaaactttaaaatcaaatctaaaattaacttttgaaatttaaattctgattacgtctgataagccaacaagcaaatgatgcggctgttaatactttttttcgttattaatgttttgttagcaacatgatggcaaatcttataataaaagcatgggcattaccaactatttagcattaaactaaactatcacatttactatttaaactaccgataaattagtagggcacattttgacgtcaatctacaatgtcccttaatttaaaacagagagagcactaggttttcggtaccccgcaacacacacgaatgagtttggaaaagaaaaagaaaaaaacatggaccatctaggcctatccaaacaaccaaactgaactggccgttcatgcaaaacgggccacaaatcttctgcacctcagcaatgggccaaaatacaacccaccaagcggaggctggggaggcggtggaaggagagagaagagggaaagagagagaggggatgacacatggggtcactattattgtttaaagtattttctgctaactcagcataaaccattttcaagttgaggatggagttatacttggttgtgtggttgagggacgaaattgctaacgggcggacgatcgccatccgtgcgcccacgtgatcgagtcatctttttttttacctttttatgttagaaattgctccttaactgtttttattttcctttttttttactattaccgattttcatggagccaagttagcgcttttttttccttttcttcttcctaaggagacgtgtgtacgtgcatatcatttctttttgcgaatatctatgtgggactttttaaaatttattttttaaattcgtttgaattcatctatagaaagtttatagatctaaagtttatacctataaagtttctatattaaaagtttacgtgtataaattttctacaaaaatttgtatgtatagggtttagacacagttagtttatatgtcaaaagtaaacgtacgtaggaagtaacatgttagggcccagtggcccacaactacatcctaattacactaggatttagatcatcccaaattactgaaaaatatgtgaagcaatggttagaataccaacaaaccagttgtatgtaagacagaaaaaaggcaaaaccaacgaaccagttttttttctcgtttcgatctcccgtcctccacacacgcaagttaggcatacaagtgggtccttccccgatcgctcgccgcaggcgccagcgatcaatcgcgtaatagggggacccgttgagggatgcggttcgattaaggggcaagataatgagagaggtaaaatagacttactccaatgagaaaaaaaacatagatccatccagccctacccactcttcattcgaaatgggcccagccgacttcacccatgaaatgggcctcgatacggcccaccaaacacgtttcccttttcttttctttctttatttcttcttctcgtctcttctcgccgccgccgccgcaatgctccgcgccgctcgcccccgccgagccggcgcgctcctcctcgccgccgcggccgccgcctcctcctcaggagcgctcgcgtacgaccgccgcggcggcgacggcgacggcgacggtgacggtgaagccttctccaccaccaccaccgcagtccgcatctcggcgtcctcgccgctccgccgcgcgctgtcctccgcggcctcggggatcctcccggggggcagtgcacacctcctcccgtcgccgctccctctcggtgaaggtacttcggtttccttccgttttctctttcagactagctcctgccatttttcggcgtcgtcgttcgtcggggtgacgtgtacggttctcgcaacggtggattgattcattgtttttttttcctactgtgattgctcgacgtagatgcgtgatctgctttcctgggcgagttcaatgtattttgccaactatgtatgaacatagtgtgatattgagctataaatttgtggccgccttgtcatatgcatacattctagcgtgtggtgtgtagctacggtgttgtgcatcaatgtgctggagttattctagtttaaccaccattgtgatttccggaaatggtggttcgatgtggaaatgaacaatgcttctgaatttttagtaggtgggtgagagatcctgtgcgtgggagtttttctttgtttatctgtgcagttgctttcttgatgggtagttaatttaaattcagtcattcctaaaataaaaaagttaaattgagcgtgtgcccccactatgttatattatatgtactctattgtgctgtgtaccaaaaggactggttgaggaccaatctgatggcatgttgtgtgtggagatgagaacatagtatgttatcccattacattgcagaatctgcgtatatctgaccatgtaagtatgtgctagatttcagctgttaacagttagctttgactttcgcttgttctgtagaaggtatgaaattgcctctacactgtataaatgccttttatgagtatttgagctgaacagcttctgtgattgtcaataaaatgttatgagaatattcacgatgtgtaacttaacaacatattcactatataagagaagcactcaagagaatttatttatttatttatttttgctgaaaacaatagtagccaccatatcttcttgattaatctctcgtatttttttccttgaagatcttaatgtgtacagtttacgtgcagggttttccttcctaaatttcttcacatctgcatcaaattggagtgcagggtttcccacccaaaattccttcgcatctgcgtcagttccacccactaatttgagcaaccagagctctgatggaaactcagatgattcaaaatgttgcccaggatgtattaaccgaaatacaatcgccaaggctgcagctgcagttggtcctgctgttgtcaacatttcttctacacaaggtaaaaactgtctaaaggagggtgtgaaaacttacagtcagcacattagctatacataataaacttttgtttgtctttttgtagaaactcatggatgggttctagagaagagcattggatctggaaccataatagacccagatgggacaatattgacatgtgcccatgttgttctagattttcaaagcacaaaaccaatcttgaggggaaaggttgttaacatgtcactaactttcgtagttttctgttcatctcaagctgtacacttcttcattatgtttcctgcacttattcatataaatctgtgatttttgctcagtcctgaatataatttactcacgggggaagtataccagtattttataggataaatccatgctgtgccaatagttttcatcaatatctgaaatatgccaaagaaaatgtgagggtaacatgcagttgtcttacgttggtgagacattagtggcacacataggcatttgatgaaactcaatgccatgatatggataaccccttatatcatattgttcttttcttcttcttcttcttttccggggttagtgtttttttccctaatatgggaaaataatcttggacatcagaaatacacttatctgatatactccaagctttagaattcaggcttttatgtactaacttatttccttatattagtacagatgcaacaaattacaattggcttgtattggaatttactgtttggttttgtatttcaaataccactttgcgcttggacaaactgagtgttataggcctttaatgttcttttgaagaaagagaatgacgtagaataatttttttctctgtactagtggtaaaatcctaaattttagtatggtcaaattattatagctgtgcttatgatagctatgaagtgtggggccaaattattgtccatgttagaatggataattcagtgcctaatggtccggatcatctaagtacttgttttcttaaaaattattatacaatagttgtgcttatgaattatgataaatacttttatactgtttcttacttagtactatttgataattcttgcatgattttggttgatataggttatttttgcaatgtgtttgtataaatcctgattcttttcttacaaaggttgaaattgtaataggttagtgtgactttgcaagatggtcgtgagtttgaaggcactgttctcaatgctgatcgtcactctgacattgctgttgtgaagattaaatcgaagacccctttaccatctgcaaatcttggatcatcatctaaacttcgaccaggtgattgggttgttgctttgggctgcccactttctcttcaaacacagttacagctggtattgtaaggttaacacctccctaagtgcagacctaatct

SEQ ID NO: 65500 - DNA, 1110 bp, Oryza sativa
atttggccacctttccggccagagccaactcggcctgctgtttgttgccccagaggaggacaacatggagacgatcgtcgcgcatgatgcgcttgtaatcacgtggaactcgtcgccagacaccgcagatcttgcccgtggcattctgatagacactgagagtgcccgccaaggtggtctccagttgatgctcctccaggattacacccgcatcatcaacgaattgaatggcacgcggacgaccgattcgcgatgaggtgtagaaggagtagtatagattcttcttgtggaacaggaaacgggcggtggccaccacattctgcggattgtaggtggtgtacatggacttcatttcctcacccttgaggaaatagaaggtgcggcccgttagcaacgcagcgtaatctataaatagggatcaaatgaaaggtggagataatccaggtgttagataaatacaatagttctcttgttaattaaatgtaggagctggtgaatgggattacaatttcccgcaggatttggcggattctattgggatctgggtgggtgtccggtacttttgtacttacgtttcatgttgcgctcttcctcttcattgggcacgggcacatccaaggctacatccgtatctgaaagatggagggaatacaaatagagaataagatgatgctgggcgataaggtacgaccttaaatggaatttagatagcaacaaatgcttcaaagcaaccgaaccgccgccagccattcaccatccatccagccagccatccagccagccatccagccagccaaccaactatccatccacaatttgtggacacaattccggcattcaaccaaaattccagttgaatgggtgaatggtgaatggctgaatggacgaatgccaggggatcatcatgaatggcaatgcaactatcaggtagagatcccacctccgaactaagaccttccatttccacctctcgcttccacccaggtggcattcattaatcgtgcataaattgagggcaggtagaaggtagagtttctcgaacgggaagtctaacctacatctaactagggaagtgctttgtatttgaggatgtgcggactctggggttct

SEQ ID NO: 65501 - DNA, 17729 bp, Oryza sativa
cattaatgagaagttttctggatcaatgtagcgttgttagatgagttgggtagttcttttggtattatgtgttgccggtgggcccatgatcatgtatgactttgtactgccaatatgtttaaggccgagaattcttaggtgcaagacttaaatttgctattatgtgtaagaccttaatttgctattatgtgcacgacttgaaacttcttattatgtttggcttggactctatgtatgggttgaaatgggatcagatgtgagctaattatgtgtgattgttttttgaggggttgattatggaactgctagtattgttcattattgggtagcttgtcattattctgtagcttgtccaatatgctgaaatgaagttgctggagcttattttcaaaaatagtgatatggagggtattttaattttttatatagtgtggtcatcatgtagaaatattattttgtagtttgtagactatgagaggtaacctcaccaactaatgtgtggaggtaattgtatccaagcatcccatgttcatccctccatccaaacaaaagataggatcattccaacccatcatatccctcaaaccaaactaaaaacagggttcgttctatcccttcaaccaaacaaaaaaacagaaccatcccattccaaaaaacagggatggaaccaacccatcccatcccatccccaaaccaaacacatgctaggaggctgatctaacgtgacggccaaaaaagaaaaaaggatagaaaaaggaccaacgaaaaaaaagggtttgaagggtttgaaggcagtcagctagctatacgagttgagcctatagctccccttgtgggctatgtcaaagagaggtaggtcaagcacagaaataacgtactaggctgggatcgaaaatgaagaataaatgagtttttctattcgatctcctaaatttggttgagggtttttatacacttgatctactatttccctttttatcaaaatctgagcaaattggtaaaactcggaatataaacagtgacttttaaatagatattagatcccataaattaaagcggaaaaatgaaaagaaaaatcatgggaaaaatgatagagtagtagtggggaatcgattttttaatgaggagggaacgcattagaggcagatcaaatgtgatgggaaaaaaatacggagagaaaaaagactgaccaaaaaaaggaacaatgacaacaaaaaaagacactcttccggtgtttgaagattgaagacgtcaatcaactagctatgcgagttgagcctatatctccccttgtgggctatgtgaaagaaagctaggtcaagtaaaagagataaggcactgggctgggttttgacccaaaaccaaggagtataatgaagtgtataatgtatagcgatccaaataggaataagttcaccggtggtccctcaacataatagcgagattttttaagatccctcaaccacaaaaccagaaatgttcgctactaaactcattcaaaccgttcactggaggtcccttggcagtatttttgccctgttttgctgacgtggcatcctagttagcaaaaaaaataaaaaaattaagtggggcccacatgtcagcttcacatatctttttttctccttctcttcacttttcttcttctcctcttcacttttctcttcaccggcggagcggcggtgggcgagcgcggcagtggagcggcggctagtggtgggcgagcacgacgacgggcagagcggacggcgaacgagcacggagccacagcccacaggtcacgagaggttcggatgccggcggcgccggccagcgacgcaagagaaggggaggttgttgtcgacggcgggaggtggccggaggaggaggtattgctatgttatccattgttgaagacagcagtgggctatgctagttgggcctacaactttacctgtgggctagatcaaagagagacaggccaagcaaagagaggtagcgggctggcctaggactgaaatggaacgaataaatgagcttttggtccaaaacaaatagtataatgcatacgatccaaaaacgtttttacccgttgcaacgcacgggcattttctctagtccaaatcaaattaagaaaactaagctcgagttcagattcttaccggatttgaagccctaattctaccgggaaaccccactgctaggaagcgacaccaccgcacctttacctccacaaaggtcgcgttggtcaccctgtgcgcgcgccgtcttggagttcctccaccgtcccatgcgtgcgagttggcttggcaccccctcccccgcccccaccccccgccgacgaagcccggccgctctcggtgcccgtcaccgcttgcacgcccgcttcgtcggaccgccgacgctgtggcttggcttggcgccgcccttaggtgtgcctctcagccggtgaagccggagccgctcgctgccgcgtgcctattccttgacggagttattactcttttatggccttacccttaaatattactctttatcgtcattgtaattctaaaatatcgatcctaatagtcattagtattatgttttatagtttgtagatatcccatcagccgtcgacataatgcttctttatggcccactcactgcacccctctattgtcatttgccacccctttgcttgctctatcacgccgccattttctttcgtgattaaagttcaattaataaattatttctagaaattttattaaaatttcaagcaatttatgaagtgaatcaatgtgggaaatagaatttcctttaaaaatcatggttacgaatttttttttcaaaattttccacgccctacagaacaccacaaacatcatttcaggaattaacttgattaaacttattttgttttcgtaaaaggaagtagactcaccacatactctcaccgtcccaaaataaacgtaacaatgagttttcatgcccaactttgttcatcttgtttcgtccatcttatttaaaattttttatgattagtatttttactgttattagattataaaatatgaataatactttatccgtaacaaaagattaaagttgggcacatgaaacaaatggttgcgcttattttgggcgcttatgtactagcaccaaccaacggtacaggtgcgcagatggtgacttcaagttcccccacgaaactaatcatggagaaatcgagggaacccaactggacaaaccgacctcatacggcagcaacacatggcgacgcccagagcgaaactcgacgaactcctcgccgagcgcgcggaccacaatggcgcgccgccgccggtccagcaggcagaccgtccccccgagccggagcaccacggcgccgctcgcgtcgccggaccacaggagcgccacctccgactccgacaccggcggcgagcagggactccggggtactcccatcaagtcgacgaccttggtgcacgccatccggagcaaggccatcccgtggcaggtcagcttcatcgtccatatctccacctgggtgcttcggccgacgagcagcgccaacgacgacgacctcctgtcgccgccgcgccacgacgacggcgccagcaggagctgccccggcgtgacggttgcctcgccggtgcacgacggggcacggagttcggtggtgggcaacggcatgatcgtcgccgccgctgttgttcccccggtctcgccgtcgcggcggcggatggagacgtcgacggcgaggacgaagtaggtgtaggacggcggcggcgagtgctggtatggtgggtcgaagctcacccgggacatccggcgttggagttggtatgtccggtcgtctctcccggacatctcgccgaggaagtaggcgacgccggcgacgacgacgggcgggcggaccagcacggggcgcgggccgaggcagccggtattgacgacggcgagcgtggtggctgggccccacgtgccagtgtccgtggtcaacgcctgcatctccacgcgtgtcctcgcgaaaaggcgcacggcgaggagcctgaacgggtggagctcggagtcgtcggaggtcactccgacgtcgacgccatcgccgccgtcgtcggcggtgagcactaggtaggacgacccctcacccttgcttgtcttcctcggcatgtcgatggcccgcacgtagcccgtcatagggttgcacaccttcccggaaaactcgccggtccggaggacgacgaagccgccgcgcgccgccacgggttcgatgcgccgacaaggattattctcgtcggagtccgacacgaaggacggtatctgacagttgtctccgctggcgatgtgatcgtggcggccggcggcgacgaagcggaggggctcgtagttgtagccgtggtcatgggggctggggcagcgaggctggaagaagaagccatggaggaggcccgggacgaagccgtccgcgttgcggaggcggaggtcgcggcggaagccctcgccggagatgacgcggcggaggtgcttgcatgcggcggcgcatcggagtagcgtgatggggtcggagcgctccgcgatctccacgacgatgtcgagcggcagagccggcgacgacgacgaggacggcggctcctccatatcgatctgatctatctcggctgatgagtccgacgttaattaccaataaggttttggtcgtacctcgtaactactaagtccaataccgaaactatcgacaaaagcgaaataaaacggatcgaaaaataacctgtgcgctacaagatgtatgaatgtatgtgggacgcgactccggctctagcgcacacgcccgatgggaggaggttaaaaaatggtgtacgatttacgtacaaaattactttaaactgatttttctcttaaattacttatccaaatcataacccgattgcaccattaaattcgtttgcaattaaatcatcaaaacaagaccacatatggatatattccgacgaaaaaaatttagcctattattaaattatttttaaatgttgcatgatgtttcaccaggtatatcggaattgtttcactaagtagatcgaaaatgttttactcgtttaaatcggatgttgttttaccttatataaaaataatgtttctgtaaatagcaaaagaatgtttcagtttactgcaacatttggttcatacatagtgaaacattataagtacactaggtgaaacattttttggtggaacagagaaaatgaaacgaattcccttaatagaaggtatccaaaatatgtgggttttttattgcaatggaatatttcagttcactgcaacattagaactatacatagtgaaacattgcgagtacactgggtgaaatatttttggtggaacaaaaaataaaccaaattaccttaatagagagtttccaaaatgtgggtgatttgttgcaaaagaatattttaattcactgtaatattagatctatatatagtgaaacattataattacactaggtaaaacatcttttgtgtaacatggggagggacaagtgggtgggtccagtggaggtgcgcacatgcactaccagggaatggaagtctaccgtgtgcctaaacaactcggtaacagggctaaaactcacggtaaggtcgttcctgtgagcaaactctcgggaaggtgtactcggcagcctttcacctttaccgtgtcactcttcccgtgagaaactgcttgcgaacttaggatgtgctgaaagcttaccgtgtgaaaacaccctgccggtaactttccagttaacgacacgtcatgcatggaacggagtgaaacggggtggttggaactcacgggaagaaatccataaaacacaggaacatgaaacaccttaccgagagtttttagtgacccgggaaggttgaaatttttcccgtgagatttagcacatggtgacatttgagatgaatacacggtaagattatgtagctcattgtacagggtttcacacattcacgattgtactgcactgatacagtaggcaagcaactaacatgtatgcatatacatatcatccaaacatgacagacaagcatcacatatggaaccacacaaatgtcaggtgaacattaactgtatattatcccagtatgaatttttgaatacaatgatacaagaacacaatataaatggctgtctgaagtggctataatgcaatagtaacaaggtgagtctgagttcttacaacctctcccagggaggcaatagagaaatgttagaggctagtgagtaaccaactccaaatttgtgtattgacagcaccaatcaactgcaatcctttgcaatgatccaattgtatgcctgaaattttacgaaagtaagatgactgccaaatattattacagcacgcaactagtttatgaaaggttaattcttgtgcatagttgacaaaggaaatattcatttggggaggcacaggatataaaaaattggcattatagtctccatcaaaaaaatgaaccatgtaccttagaaatactcgtcaaataagatatccctactagtgggaacctcatcatcttcagcagatgaggaagtgcaataagattcatcatcctcgtcatcatcatcttcatcttgaatagatgatccattgagaagcttcaagtccttgtcattgcaaatatcttcagtatccctgctaatggcaacttgctcaggatcattgttgagttcttgaccaagatcaattacaaaactgccggacagaccatcttcttggaaatagtggacaacattgctattaggaacaaaattgtaatcttgatcattgggtacttgtagtctaccaattggctgcaccttatacacaacccaccaattagtgaggtcttgcacagatttacatgggtacggcatgtaatacacctgtgtcgcttgatgagacaaaacaaatggttcgaattttggaaggattgacgcatgagcaacctcaaccagaccatatcttggtgtatacctcactttgcttgggtcaaaccaatggcaattgaagagcacaagtgtgagaggttttctgccatcaaagctaatttctactatttctttgatgtaaccataatactcagttgtgtcactattttctccctgtcctatagtcaccaaaccactatttattgtagttgcatttggcctctcatgttcatatttgtgtattcggaatcgatacccattcacatcatacatattatatagcaagactcgagtgtggcatcctttagctacttgcctcaaatcatcactcatagtttcatctaacatactctagcagtgaaatgaaaggaaataatgtgtcaataaattgtggcataatgttctattatggcaatattgaaggttatgttatagaaaaacataagtattattaggttattgacacaaatgcaattaagaggcgttaaactgcaaactaatgaaaacagaaagaaaatggaagaaggcactattaattattgaggtcttgaatttcaaaactgaagttatcaagttattaattggctaggttctttttgttagtagaaattggcaaggattttattctttccagatttccgacctaacagatgatcaattgagaagtgtctccatattaatgacatgtacatacatgttcagtactattttcataatgcttgtaaaaaaattaactcagattgtagtatgaaaaagccatatgcatactaggaacttgcactaatccaaatgtgctttactattgtaggaccaaatttatagcactgatataagaagtcaccaaatttagagttttagcagtaatactttattggtttgatggggattacctaggttagttgcaggaacattcatgaaagaacttaatgttcaacagttaggaaagtatgtatacacatgcaagatattacatcgaagtaagctagctagatttcctaatctgatctgaaaggatatgcattgctacgcgtataatataagtaaagtctgggctaaagaaattacttgttgatagaaccaagatacgaaattaggacgatctctcccagcaccattccgtaagatattctcttgttgttgccttgttgggacacctcgtctagtccattcctcatctatgaatttcctgcaagataaaaatgcacacactgatttaaagtaaaattatatgcagctatgaactagaagtaactcatatcaatttcatagttaatacccaatgtagtcatccacttcagtaaggtttgtaagcacatacaacatggcagcattccactcttcacgagttaggtgtcgagggactccacgactagtagaatccccctaatagagaatagacttagggaacaatcagtagactgagtagcaacattgtatcgaggaacaggattgtgaattgtctgcacttgatcaggaaagtatatggatgtgaagtttgagatttcatctagtatgtaaacctctgctatggaagcttcaacacgtgctcggtttctaaccttgctcttaagatacttttggcctctttcaacggggtaattccatctaaattgcacaggtccacccatgctagcttcatatggtaagtgaatcattaagtgttgcattggattaaaaaatccaggtggaaagatcttttctaatttgcaaaccaaaacaattacttgagactgcatgtttgccatctctataggatcaaactgttttgcgcaaagtttgcgataaaagaagctcacctctgctagcacttcccacacatgagttggcaagtatccacggaacatgactggaaagatacgttccatcattatgtggtaatcatggctttttaacccattgatccgcatggttttcaaattcactcctctccttaggttcgacccatagccatcagggaatttcaatgtttgaaaccattctaatacttccttcttctgagctctattcaagcaaaagtcagctcttggctttacccactgactagatgcatgtttttggatgaggttcaattcaggtctattacaaagtgctgcttgatcaaggcgagccttgatattgtccttcgtttggtctggaatgtcaaagcaagtattgaaaattgcctcagcgacattcttctcattgtgcatgacatcgatgttatgaggaagtactagtttgtgaaagtacgggagtctccacaaactagatatatgtgtccaatggtgatccttgccatagcctacaaacttatctccattagcagcagggacaaggttatctaaccgggcacggatctcttgacctgagagacgaagaggtggttcattgctaactgtagtgtttgatagaaaagaatttgaatcacttctaaaactatgatcaattgggaggaactggcgatgacaatcaaagaatgagtactttccaccaaacttcaacctttttccttggagtgcctccatacatgttgggcatggcatctttccatgcacacaccaaccggaaaatataccatatgctggaaggtcatggatagaataaagaaaggagactcgcatgatgaaattcgtcttggtggcacgatcatatgtcaacacaccttgctgccaagcatgtataagttcatcaactaagggttccatgaatacactaatgtgtttgccaggataatttggcccaggaattatcaaggtaaggaacatgttgtgctgccgcatgcaaacaccaggtggaaggtttagaggaatgacaaacataggccagcaagtgtacgaagaaaaacccataccaaatggacagaacccatctgttgctattgctattctaacattgcgggcttccattgaaaagcctgtgaagtctctatcaaatttcttccaagcctcaccatcagctgggtgtacaatcttgtcaggatggtaccgatgaccattcttgtgccatgtcatttgcttggcctgcgattcagacatgtatagccgctgaattcttgggatgaatggaagataacgaagtaccttcctggcaacagttaattgtttcttgtgaccattactgtcttcaacctccacatacctactctctccacacttatcacagtgcatcttctgcgcattctctttcctaaagagcatgcaatttttaaggcatgcatctatcttctcatatggcatgttcaatgcactaagaactttctttgcctcatacaagtttgctggtagtttgtgcccttgtgggaggagagcacatatcacatttaaaagtgcatcaaatccagcaattgatatagcatactgagacttgacagctagtagtcgtgtgatagcatcaagttgtgatacctgtgtgtgttcgtggagaggttgagttgctgcagacagcatttgaaagaaagcttgcgctgtaggctccggatcttcctcctcaactgagacataagcatcatggacatcatctatcatctcatccatccgatcaatctctgccaccctatcttcatcttcagtgctttggcatatatcgctttcacgtgcaggatatgtatcaccatgatacacccacacagtatatgctggcctgaaaccaaatttgcaaaggtgtttcatcatcatatctcttgtttgaggacgtgtgttgttgcagtagttacaaggacacaacacaccagcacgtcctgtctccctgttgaatgccttgtcaagaaattctgtagtcttcgatatccactcagcagtaacttcgccacactttcgacggcccttgtacatccaactgcgatcagtttccattgtacctagttatgacaaagtgatagaataaattgatgttaggaaatgtccttctattcatgaaaggttcaagaataataaaggcctagtttagtttgtatgattaagaaataaaatatcaaccattagttcggatcatcaatcacccaaactttcacatggcataacaacctagttctgcaatcccttagtacaaccgcaacctgactagtaaattctagaactggtcactaataaaaaagatgatgaaacatgaaggccgaatgaggattccaggagcaagacaacaacacctgagacgaatcagtcctagggagggttgctggacgagcagccaatcctcttccgtgcgtggcgactggtggcgtcggcacggcggtgcacgtgcgggctggggtctcgtactcgaccgacaccagatggatgggcgcggggcgacgtcgtgggtttggatggggtgcgcggtggcggcggcctggactggctgcggcgcggtgatgtggccttgacgggacgcggcgcagcggcggcggcctggactggacgcggcgcggcggcggcggccttggacggcggcgcgatgtggtgggttgattgggatgagaggaggacagagagattggggattttggtgacttggccacacccaccagatttttggcgaccttgccgcgcgcctgcgagaattttgccgcgatttatttctgacatgtggaccacgagcgttactgtattgttttctaaccaaaacacacgataagattaggaatgcaaactaccctgttcgtccttttttctcaacaaatctgcaaactgaactatttacgtgtggattgcaaactgaaattttgtactaaatttcgtttggtcccaatacaatgtgaaatagctaaaaaaaaatactcactacgttttatattactcgacttgacttttttgttggtcaatttttttaaactagcaaaatgaacatgctttcatctaaattccatgattttcgcttccactcatattctaaagattgatgccgcgtgcccgctcgtcctctgcctacttggccttaaccaaggaagaagaagaggaacggacgtagtcgagcatgcgaacgtcgccattgtttcatgtcaaaaatgcctcgccgtcggccgccgacagccgactgccctccgcgcgcagtagccaccggcggcggaggtggtggagcagtcagtgaacaacatacggttcctcgccgtggacgcaagctatgccctcgccgcgcaccccgtctccctcgccgcggcatcccgtctccctcgccgtggcatcccgtccacctcgctgacgcccgtcccgtcctcgccttcaccacccggcgcaccgcaagtaccacgtcacgcaggacgacccgtgtgacgatgagaaaaatatgaggtgattaaaaaaagtagataagttttaaataagattataaaaaacatagcaacatttttttttacttaaaaccaacatattatcaaacaaatttgtttttgtagatgtagctaaatttttctacaaacttattcaacacctaaaaaattttgactacaaaatagtcaaagcgagatataatacgaatcggagggagtgcgtgttattaaaattagttaacaattcctttgattctgttatgatttgtagaatttttgaactaaattttgattgatccttgcattaagtgcctttgctaaacaaaaactatttcctttttaacttcgttaagaattaaactttggtttgctgtatataataagaatttatttcttcaattaatttaatcaaatttattcaaatttataattttgattaaaagtgttgttcagatgtctatctcagaatttatttgcgttcatttcaagaaaaaactttcgtttatctttaatttttcaacaagctatccaaatattcaaacctgtttttcttaggaaatgtttagctttatatcttaaaatgtttttaaacaatgaacatttctaactttcaactaaaaaagatatcagcttgttgtcatgctattgagattgggactcctatttaaaaaaatttcaaatggcattaatttgaaagcattcataatatataaacatcttttagtgataatttggttgacaatgaacaaaagacaatagtaccggaaagcactaaccgagcctagtttgttactaatttgtgcgacccttccataagttgccagatattcactccaaaatatgaaataatatcagtcatcagttttgttgaacgcgtgagttatatctggacagtggccactgccacaccacataagttccaagttgataagttccactgtatgccaacatttccaatcaaaagtaccaaacttccggttcacaaactccagagcacagcaacatctatgaccaaaagtacctaaggcaacatgcacaccgaaatagctactagagtccgaatatggactcaggttcatgcaagcccttaggaaagtaaacgtatataactaagaacaaaagactaaaggcaacagccacaaccaacagctactcaggttcatggccatgaccatctaggtcagtttaattacaaaacacatccacatgttccaggcatgtagaactagtccattctttccagcagtagcaaagtcataattatcttcagattgcgctcgctgcgtcaagctgaaccatctaaattgcaccagaaacaatagcagcccctccatggtcagcacagaatgggtttccattcagagccgaagatacagacaaagcctgttttatgttacaaacaaaatggttaatattagtcctcataagttatatggggaacaattacttcatgcacagctagactaccatgtatcaaatacttactgggttagtcaacatgacaggcaagggaggaggacctgaggctgaaggtaagtcaatgttcagcttaagttgtatagcctgcaatccatttcacatgtacactagttagtgcgaccatcacagaattcaagccctcaaataatgaaaacactactagatggatcctataaccacttactcttaaagcaacttcaaagaacgatgatttttgttcaaacgctatcttttccaactccctttccttgcgctctagctccctctcctttctatcttgctccttctctcgtgccctctcttcacactcacgctccttctcctgctcccactcctgccgctccctctccttctcacgctccctttcttcacgctctcgttctcttgcctcgcgctcctcttgtagttgccgctcaaggtcttcaatttggtttgtgttgtcaggatttgtccgcagtctcctgcgaggacgtggatcgttaagtgaactgtcaccaaagattgctgatgagtcaatgtgcccatcaccgatcatgaatcgaccatgtttctttccaccaccagccatgtgcacagccattggatcaatgggagaattgcgccaatcacttcctgctccatgcagctgaacataagcttcattataggcctcctacagtcagatcaaatggtgtattagtactcatgcacaaatgataaactaccactaaatattcagcacttacaagcttcccagttgcatgtgtgttacatctgaatcgtccatcctctccatattccccccttccttctgtgtaggcctccatttgagacactacccgctttttcttcttctccaaaaacagaacatgggtaccatatatattataccatgatctgctacatgtttcaacatagatgcacataccaaatttttttggaaacgactcaagttagcactgccttggcggtgagatggccatgtcattttctccctccgtatcctatgagcatgtgagctagcctgccattcaggattacaccacttcaatcgtatcaactcccgccacgcattttttgcctttaggaaccaccatggttctacctataggagaagcacagatttattaattactaatctgatcagtagatcacaacaaattatcaatgaacaaccatagcacctgtaggtactcttcctctgttagatatgtcctgcaagcaatatcccgagaagtttctacctttaaaatcttcctttggtaattgagcacggccaggatacgagtttcataaatcaggtccgaaaaaaggtgcttgatacaattgcggacaacctttctagcatcttgttccgttctctctgcccacctgaagtaaagctgcaactacagaaagttagcctgcttgacattgaaaagtgtggtattaagatactttagtattgtacagcacaaattggccataaactatgaaaactgaagacacaataaaatgcatagtgtacttcatatttggagaaggtaatgctctaaaacaaacccagaaatcttcctcaacacgatggagacggcttggcaagcgattcagtatagcgctttctggatcgtccggtgcaatcctgtaatgtttccaactccatgctggctcatctcttcctttaaaattgacaatgccagggaaaaaatgcttaataatcacggtcaggatgccagtggggaccctaatgttgcccccaaaatcattagcctgccattgcctgtgcaaatcaatgaacaaacagatcaagccttcatatttcaactaatgaaacataccaaaattagcctatttacctatctccttttggagtcagcacaggtttgtcctcatctcgggtaggtcgtggtggcatccgtgtgggaccacgaaaaaacatttcctcatctgtttcttcgccagccaatatctcatccaaattagaagaattatcaggttgttgggaacctgaggaccttgttctacatctcggcaagatagcagcgctgacagcctgatctgaaggattggaatcctccctgcagcccaagctcaatcgccgcatattgctacaaaattaagatatgcagtattatattaaacaggtcaaaaactacatagtagcaacatggtataataatgcctattataaaatgtcgatacaaagatgtagtacaccatagcattgcagatcatcacacaacatggtgctgtcattccaacccgattcaaccattcaacatcgatctaaacaagtagggccgtggcaaacactcatactaaccattatgttttctgaaaagagggcaagttttgcctaaccaatatgtatccatcaacaagtacacaaatatgaaaacacattattctgacagtgcaagaactctcacccacatcattttgtagtctaatattgtttttatttacaaagcacaacaacttattcatatggtacttgtggtattacaagaaattaaaatgagatacagttcctagaaatcatacaccgaactatttctagttcttgggagaaaatggatgggttttctagaaccaagacccaactttacatacgattcaagaaaaaactcaacatatacataccaccagctggatggaagatgaggtgtgctcaagctggacaacgaaggggagcctagcagatggacgtggacatgcagggagcacgtacggccaggaatgcacagcgttgctcggcggccgtgcggcggactgacgctggggcgcacagctatcctgccatgtgcgaagaagagaggggaaaaatcagaaaggggaaaagtggcgaggagaatgaggcggcagggggtggggaagtgaggggatcgattaaaagggctagggttttgttgttctctattttgggctgacatgtgggccttcggctgtaactcgcacgggattctcctgttactcgcgcggcaacgaaaatcaggcgcgccagccagccgcgccaacggaaatcttggcgcgccatccgcctgcgccaacggcgatcccgcgcgccagaccaaatattccgcgcgcttaacggcagaaactatgggtcccacacttaccgtgtttctcgattcgtcccacggcatttttagccgcttcccgagtttttccttgtacacacacggtatgctttaaacgttaccgtgttccatataacactctcggtaaccaactgaggtacacggtagtctcccactctctggtagtggtggggggaggggagcgatcgattttcctacctcccctagtcgaccgatcctaattgttcctcatgaatgtgatttgtgtgattatgtgtggatttgttgaatttgtacgcatgaatttgtgatctgttgatttttgagattctgaaattaattgtaataggaatttgagatcatgaaatttagtaattgtattttttagataattgtagtatctaatctcaagtatcactatcaatttatagaaatttacaatttttagccctaaaatgggcattagtacgattcttgaataggttgctagcctaatattaatgtccgataaaacaatagctgtgatatgatagggtttctgaactgctagtgttaatggttttttttggtagtgttgcacgggccatcgatgcatatgtgtgcatccgcttctatcatggtgtctcctacgtcactaacagcgtctttttgttattcctcctctgccaacccgttattatctctaccccaatcctgaaccctaatatacaatacgtgctgccactatcgccgccttcacttgagaagactcatgctttctagagtgatgacttatgaaatcaattaaaaaaatattttttttcatcggtttcacaggaatatactcgctcctccgtttcgaaatgtttgacaccgttgactttttagcagatgtttgaccgttcgtcttattcaaaaacttttgtgaaatatataaaattatatgcctacataaagatatatttaacaatgaatcaaatgatatgaaaagaattaataattacttaattttttaaataaaacgaacggttaaacatgtgctaagaagtcaatggcgtcaaacattgtgcacgccatccggagcaaggccatcccac

SEQ ID NO: 65502 - DNA, 7316 bp, Oryza sativa
agttggtatgtctggtcgtctctcccggacatctcgccgagaaagtagcgacccccggcgatgacgacgggtggcgggaccagcacggggtgcgggtgaaggtagtgatcggcatcgacgacggggagcgtggtgactgggccccacgtgccagtgtccggggttaactcctgcacctccacgcgcgtcctcgcaaaaaggcgcacggcgaggagcctgaaccggtggagctcggattcgtcggaggtcactccgacgtcgacgccgtcaccgccgtcgtcggcggtgatcagtaggtaggacgacccctcacccttcgccgtcttcctcggcatgtcgatgggccgcgtgtagcccgtcataggattgcacaccttcccggagaacttgccggtcctgaggacgacgaagccgccgcgcgccgccacgggttcgatgcgccgagaacgtttattcttgtggacgcggttggagtcggatacgaaggacggtatctgataggtgtctccgccgccgccgctgccgccgctggcgatgtcctccgccgccgaaagctgatcatggcggccggcggcgacgaagcggagcgggtcgtagttgtagccgtggtaatgggggctggggcagcgaggctggaagaagaagccatggaggaggcccgggacgaagccgtccgcgttgcggaggcggaggtcgcggcggaagccctcgccggagatgacgcggcggaggtgcttgcatgcggcggcgcagcggaggagcgtgatggggtcggagcgctccgcgatctccacgacgatgtccagcggcagagccggcgacgacaacgaggacggcggctcctccatctcgatctgatctctatcggctgatgactctgacgcacctcatgcacgtagctaggaagtccaaagcccaaacgagaaaccgaaactaattaaaaggttaattgaggcacttgggcgcccatttttttctgagataaatcaggtgcccacataatcatatgtcatcatgcttgcatatgccagcaaaaattcctaagcaaactttaaaactattttttcttaaattatttatccaaattatgatccgatggcaccattaatccatcgcaataaaatctttaaaacaagacaacacttggatataatccgataaaaaaatatttagcttattattaaattatttttaaatattacacattgttctaccaagtagatcgaaacttttcactaagtagatcgaaaaatgttcaattgtttaaaggctaaaacacaaccaaatcacctcatgaaacattttgctacaacatatgaaacaatagcttctcaaaaaatcgagcgttgtttcaccttataaaaaaataatattttaagcaaatagcgaaagaacgtttcaattcactgcaacatttgatctatatatagtgaaacattatgagtacgcttgctgaaacattattggtggaacaaaaattaaaacggattccttaatagagcgtttccaaaatatatgggtaatttgttacaaaagaatatttcaattcactacaacatttcatccatacatagtgaaacattataattacactagctaaaacattgttggtgaaacagaaaatgaaacggatttacttaatatgggggtttccgtaatatgtgggagatttgttgcaacggggtgcaagtggtgggagcgcgtgggaggcaggtggaggcgcacgtgggggagagggcgctgttttcttcgcggaggcgcgcgcgggggagggcgcccgatttttttccgccggatagggtacctgatccccagcattttcggctatgataagttgtttttctaggtttcctgtaacaggggacccgcataactttgagacccgcaccgttcaaccatcgggtggaaataatgccccgtttgtagcttcgtaggggtgagccctgtccccaatggggaaactaccacccttaggtctaagaaggtgctttagatatgtttttcttttgcctaattacaattattttaggccatgccatataataaatacagtaatagacttatataattattgttcttctagatcgtaagtatacaactagttgtattttattatactataaaacagataaaaattagaaacgttaatttattgttttagaaaaaataatgggctatatctcttcgttaatttgaagttaatttgaaaagttcagttttaaagatttttatattccgataaatatccgttactgtattcgctccgatttattttagcgctgttagatatgtttttcttttgcctaattagaattattttaggccatgtcatgctaattagagttatagatcaactaatataattcttgctcttctggattgtaaactatacaactagttgtattattactaaaactaataaaaaatagaaatgttgatttgttgttttagaaaaaataatgggctatatctttttgttgatttcaaaagttaagttttcggggtttttatattctgataaatatcttttgatatttgctccgatttgtgttagcttcgtttgcaggtttccgatttcgattctgaaagaaaatgataacagtataggtggttttcattagttttcgagctattttcattctacaaaccaaaccaaccgagcgaacacacgcaccatcgcgaactcgcatcatatgctctgcaatgatggtagatatttgtataaaatcggtgaaaataactgtatatatttatacattttgttccaaaattttttatgcagatgtagatatcgaaggaacccaactggacaaacccatttcgtatggcagcaacatatggcgactcctgtagcgaaactcggggaactcctcgtcgatcgtgcggatcgccatggtcgctcggtccagctggcacaccgtgccgccgagccggagcaccacggcgccgctcgcctcgccggaccaatgcagctccacctccgactccgacaggtcgcacggcctccggcgaaccgccgccgtgtccaccacctccgtcgcgcgcgcccacgccgacggcgccgcgagcatgtccagcgtgtggatctccaccctggtggtccggcagacgagcagcgccaccgacctcctgtcgcgcgacggcgtcagcaggagctgcttcgacgtgacgaccgccgccgccgcctcgctgctggtgcagcgcgagcacgacggcggcttcagcccctccggcgccgggatgatcgtcgcggccttcgtcgtcccgtttctaccgtcgccgccgccgtggtcggagacgtcgacgcggaggatgaagtagtgagacggcgggtgcgggcgctggcggtcgaaggagtgggacacgacgaggaagtaggcggcgccattgacgacgacgggatgccggccgagtagctcggcgcccgggtgttggtggatgtcgccgccgacgccatggacgggaatcttggtggtggggccccatctgccagtgaccggggttaacgcctgcatcttcagtcgaagccgccgcccctggttcgtcggctggcagagctgcacggcgaggagcctgaaccggtggagctcggagtcgtcgtcggagctcggtccgagtccgacgccatcgtcggcggtgagcagcaggtatgacgtcaccaaatccttcctcggcagagggatggggagcacgtagcccgtcatggggttgcacacttcgccggaggacctgccagtccgagcgacgacgaagccgccgcgcgcctccacgggttcgaacccgagggccagcgactcaacggcgtcgtcgcccgccgggagctggccatggtggtcgccggcgccggcgccgtcggcgaaaaagcggaccggctcttggaggaaaccgtgggctccgtggagaggctggtagtagaagccccggaggaggaccgggacgaagccgccggcgttgcgaaggcggagctcgcggcggaggccctcgccagagatggcacggcggagctgcctgcacgcggcggcgcagcggaggagcgtgatcgggtcggagcgctcggcgatctccacgatgacgtcaatcggaagacctcgtgacgacagcgacgacgatgacgacgatgacggcggcttcatctctgatgtcatcgtcttcatctctgatttctctcgacggaagagaaattaaacgtgagataaataatgccaaacacaatgggactttgttacgtcttagtaagtcaaaactagtactaggactgtaggagtccaagacccaaacgggaaaactgaaataaacgtatcagaaaagaataagtgggaagtagatttttgtggaaaagcctacaggtcggatgttcgatcctttggggaaaaatcagatgctgaactgacgtcagcacccgatttacgtgtaaaactactttaaactgatttttctcttaaattacttatctaattaatgatccaattacaccattaaattcgttgtaattaaaatttcaaaataagaccacacatggatatattccgatgaaaaaaaagcttattattgaattatttttaaatgttgcatgatgtttcaccaggtatatcggaattgtttcactaagtagatcaaaaatatttcactcgtttaaatcgggtgttgtttcaacttatatgaaaacaatgtttcagcaaatagcgaaagaatgtttcagttcactgcaacattagatttatacatagtgaaacattataagtacattaagtcaaacattttttggtgaaaaaaaagaaacgaattcccttaataggaggtttccaaaatatgtgggttttttgttgcaatgaaatatttcagttcactgcaacattaaatctatatatagtgaaatattgtgagtatactaggtgaaacatttttggtggaacaaaaaataaaccaaattcccttaatagagggtttctaaaatatatgggtgatttgttgcaacggcgcgttccataatatcaaaatccactgcaacatttgatccgtacatagtgaaacatcataagtatactagttgaaacattgtaaaactactggttgaaacatcaaaagagaccatatgcaatattaaaaaaaataataaaaaatctagaatatttttgtcgaaatataatcatgtgtggtcttgttgtaaagatttaattgtaatgaatttagtgatgcaatcagatcgtagattagataaatagtttatgagaaaaaaatcttttgaagaaataagagatggttgcatgtgagaaaaaattctttgcatgcagacgtacactggcaggcacaaaagcagcgctcgatttttctccacccctgccggtcgcccgggtgtgagcattttcggatttttgtgtgtgccaggacatcctttattttgtgtaaggcatttaaaatgtcatctactccctccgtcccataaaaaccaatctaatactgaatatgatatctcctgatataacgaatctagatatgcctctgttcagattcgttatactagaatatatcacatctagtcttagattcgtttttttatggagggagtatataatatatctttccacaaacatgtaagttaaaattcgacttatacaattttataacaaaataaatttaaccgtgaattacgtctttgattcataatcaaattagttattttttcacttatataagttgaatttaaacatgtatgtttatggagtgacatatcacgtaataatatggtacttttttttccaaattttcttggatgattttcaagcgacatgtaaaagtgagaggatattcttaaggaataaatagagtgtccccagtctttgctacataattcgcacggcttgtaatttgaaacgaaatctaattttatgtttgagaaaataattctgcctttttctcatgccgatcgccgttgttcattgtggcctcgaacaccttaaactcatcccggtgactattaatacctctacgtagttttcatgcagactccccagagctcgtgattctggaactaccataattattccgtagtgatactctgatagagctaagcaagtcacactaatcttgaggaaaaaaaattgagagaatcccttatacgccaatcaaatttgactagttcccttatatgccacttaaaattagcttctctcttttatgtcactggtttaagtttttccacctttttataccactcccagcactataacgtttgttaactgttagtccaatgttagtttttttttctaaatgaccattatgccctctcaactaaaaaatgtgtaaacttaaaaaaatcataactagcttattttaaatcctttttgaatgaacataattttgtcggaaccaatgaaaaatgctctttgtattaaaaatattgttggaaagctgcatgtttcgtgcttatattgaaaattcatttgtgatggtgatggctaaaattgcacgtgatgcaaaaaaaaatcaattttcatatgtcgtatgcattagctatattagtactaaaatgctatatatatacatagactaacttctctatcaaataaaaaaaactcattggttgtataccaaatctcaagggcaaatgcatctttttgctatgaagttaagggtcaactggcggaggattgacggcaatgacatagaagggaggacaaacttgaaccggtgtgatagaagggaagggctaatttgaagtggcatataagggaatcagttaatttggagtggcatataagggattctctctaattattaatttaatgaaactaatttggtaatgtaaatattactcccgccattccaaattgatctacatatttcataggtacaccaagaccaagaaaagctaatagctctctcacactatatttactctagcaacaaactcaatgcatgtaccatctccactatttcctagccaatagcaaatcaagatattgcatgtgggttataaatacttgtgtgcatggatgcatgcatcaatgtccatttactccaatgcacaaataacgaataaaattaatgaatgaacacaaatatgtagatcatttaggaataacctcaaaaaaaaaactatacgtaaatcaatttggaatagagggagtactatatttgtctataaacttagtcaaacttaaagcagtttgactttgactaaagttaaaatatcttataacctgaaacggagggagtatttacactactacgaaacctcttatagaggactcgataccgataagcattttctcacctccacattttgaaaaattatagaaccatcggctttgagcact

SEQ ID NO: 65503 - DNA, 539 bp, Oryza sativa
ttgaaaaggtgtcaatgaaaaagttatggcagggaaatcatcagaagcatcaatgcattcttctaaggttgtccatttagtgaatgagatcatcaaagggttcgtaactggcctatatgttcagtttgcatatctgacagagaaggagtcaaagtagtaaaccttcccttcctgtagaagagtcctaagcttaatcatggcaggtggatagatttgaacatggatgctattgccctgcatattgtgtatataaagcaccttgttagtaccatatttgtatgtaagtattaataaagaagaaatgagtgttaattagactataaccttttcatccagcaagacaagatcagtgtggaagatttttgtttcatcattcagatcatggtagtcccattgcctagatactcttgccttgaactgtttattagtgtccccatacataaggtctgaaataagcacgtataccattggaagcctgtaattaaatattgaagatatttagttttacgtatatataaagcatcaatgtaatgaactaa

SEQ ID NO: 65504 - DNA, 29123 bp, Oryza sativa
cacttcccacaatccatatcctttccgcacccccaccccctctaaagaaccttccaaactcccaccgcccccaaaccattagtccataggtgtaggtgaaggtagagaacgtggtcaccgtggctgtgccggtgcagctgccacaggccaggctcactgactttggcgccgagctcgacgacaagtagtgaccgcatgcaatgaggatgctggtggtggcggcagaggaggagtgatggtggcaaggttgaggagcactggtggtagcgccgccctcgtcgatctgtgccactgcttcatcttccatagccacaagctcgtagtatatatatccaacatccacctccattgcctcgacccgctcctctaccatcactaccaacttgccccacactacattccttgccctgtttattttcattttctgttgcaattttgatcgattccatgaatgtgttcttggatgggggatgatggggatcataggggtggttattgggtgtggatcaggagatgctcgacgcatcggctcgaatgcatggagctttttttattgatggaactggttataagtgccggttatagggtaagaaccgccacctgtcatcttcataggtgccggtgtttgaatcggaacatatgcggagggcatagctaccccaaatttgttttggttgggaaactagcacctatgaaggcatgactagttccaaaccgacacctatgaagattcctgcaagtaatgttagttcaaattgttaaactggagtaggctaataagtatgtctggaccatcacacgcttgcatcgtccaaagaaaagtgttcaaatatatatgaaagagtctttggtgagattctataatctttgcgcaaaattgccctgatgctatgtcatgcaagaaaatcgatatctatgaggttttgcaatcaactgacgacatacttttgataggttccggccagggttcaatgcatcggaaagtggaaaattttcagggtttagttaaattacgaaatttcaaacaaaaattaatgttgaacaagaaacttgcagaaattcgaccaaggagagtgggctagcatcgagtccatctaaagccgggccaggaggttgaaactaagcataatgcgaggaccacgcgacttgtgtccactcatcgatcggaaatctgcggagcggccgccgtccactccagcttaaagccttctgccctaatccagtcttgcaagcagattaaagcctctattgtctcactggtcaacctgcttctataatcacttatgaccctctcagcagtggagaatgcactttctcaagctacagtagaagcaggggctgctaacaagtcacgcgctatgcttgtgagttggttgccttgcctttatggtgttttgctaattttcctattagcacagtctgaaactatcttaaaagttttcaactacacatgcatggtctgttgatttacgatagttggcatgtgactaggtgagattttctttgtgtatcctgagcaacgcgcgtgaaatgtctaggttgacatgctgcatgcatgcatggcattgacattttaatttattacaattactaggttgtagcccgtgggtttcctgtcatcatgacttctcttcttttttaaattgtttttctgatggtaaggcacgcaaagcgcatcttattatctcttttttatattgtttgcctgatggtagggcgcataaagcgctccttatacctagtgtgcttgaaagatggacaaatttttgggtggcaattttttgctctgatttcctgttagcaaatggtaagaatggtcacttgaaccatagtgtcaagctcatctacttagtgatgttgctgccacattgtgccactggtgatataaagtttggaagtttgaaaatgttcttttgatgcatttttggttcctgcctggcatttgcactccatgttgtcgtggaactgctgctgtatgcctgtactttgtagaaatgaagcatgtttaaatggcgtccataactttacaccacactttacggtcctgcatacaaatctgtatgtttaaatgctatatgcctatagtccgtagaaatgaagcatgcataggaagttactcgtatactttagtgtctaaattttagtgctatactcctatacattctagttcactttcttgtaccactttacttgctctcatatttttggataattgtttaatcaaatactattagtctagcgtcagttgcttgtttgcttggccaatgaaatgaggtgggttggggatgggaacattgggttttgttagtgcaatatattatggggacatcagattggtctacaaagtagacctatcattcaaaaactaatatcgtatatgtggattgtttcttgttgtttctctagcgcataaaaaaataatctaacatatggtactgtactatcaggttgctgggctcaaacatatgcgaacttcgatggaggagtggccaaaatgctttggtggctgctccagcattgtcacgtgcttttgaacaggttttaattatgttgtatgagatatgctcaaaaaaaatgttgtatgagatgtgaaggttggaatgtgtttttactgatctgtaactattttgttgctgatgatgagagaatgtaaattaatgatctgtaattaattttgctaaaattatggacgaaatatttgtattttgctaaatttagcagcagctgaattttacttgggctaaatctagtagtagcccaatttgaactgggttgaatgatgactaaaaggccgaaaaaataccccacaaaaaaacaaatcggcccaaaacaaaaaaaatctagctggtcataaatgggcataaatgggccgaaagctcctggaaacccgaattgggccacaaaactcgtgggctaaatcctacgtggcattgatgacacatcaacatccaccttggcgtacccatggcacatatgtggcgatttgaatccgtgacggaaaaaaagtcctatgtggcagctaatctgtgatggaaaaatgtctacgtggcagctattcatgaaggttatttttcgtcataggaaatgggcttggctagactaactagatctcgggctccatcgtgacggtttaaaaccgtcatcgattctgttaatctgtgatggttttcgacgaaccgtcacgcaggtcaatccatgacgctcaatccatgatgatttctgaaaccatcacagatgttgtttggtgatggtttttcagcgatccgtgacagaaattttccatcacggattaacaggattcttgttgtgatattagaatgtcctccagtattgcaagatatcaaaatcagtagtagcagggacattcttcctccaagtacatatcaagatgactagctttgcttcttagcttcaaagcaacatgctgtccccagtcagcccatgggttgtcgtcgatgttatcatcgtcaacttgaaactccacattctcacttgtttgatcattatgagcacttttgttcatatatatgtgaactatattcagcaaacaactctcttattttggtgtgcacaactgttagatacccgggggcaatattctcctagctttcgctgctcatatgcactaatgcagtcccccttgatggtagttttagaaataagttaaagcacgaattcaagctagcaacaaagctcttaaaacctagggtattccacaaagttataggacagctcatgcacaacaatcaatttaacaagttcttttctacataattcttgatcaaattgccaatccttaagagcagcagcatgtgaatgagtagatgacctgatcgagtacttccaccatttgacccaatctagctttaccatcacaactatccaaatgtctgtggcaattgctcctatcaactgttggaattaatgaatgggccttagcccactcgaagattaattctttggaaaatcacaaaagcccacctcatgggatggcatgcatgtggagtttagtaccaccttgcttattctaggagagggggacctccttaaaagggaggatgtcctcctagtcacttgaagcatgtgtggtggagagaagaggggaaacacacgcgctcgctcgcctcgcctcgccggggaggcggcgcgcgtgcacgacgtacgcgtcgaatggtccgaaaaattggctcctcacccttgcgcagatgcagcttccttttgcagttttgttttgctgcaaattcggattcgtttttgttttggaaacgttccgaaaaatccggtgtgtgcaaacggcgtggagtccggataaggtacgcgcgacttatccggttcggttacgcgcagtagagatcgtgcgggcgccccgatcaagcgacccttctctatataaaccgacctgccgtcttcacgcaacacaagcgaaatcaatctagggtttgcctcctactctgtactgcgccgtcgctcgtagactactccatcccgctcgccggcgtgcaccgtcgatcgggagagcaggtctccggaacctctgccttcgacttcctgcaccgggagaaggaggcaataaggtttttgggaagcgcttcgcgcgactgctccctgtttgttcgcgacggctcgccttcctcttcgctcgcgtgtttcgtgccttcgtagacacctgcgaaaagtttcgaccaagcagccgatctttccgtcacctcggtacgtgttcaatatgttacgcatatttgatctgttcatgttatactgtgtagtttacatgtatagatctaatgatgcgttcatgctagttttcatctgtaatgtcatgatttatttatgggatagattaaatcattatatgtctataatctcaacattccaaaaaccttattataggcactgtgattttactatggctggttttgccgatgcactgaggccggataaattcaccggtgtgcattttaagagatggcagatcagggtcactctgtggctgacagctatgaaatgcttctgggtgagtactggcaaacctgaaggagttcttactgctgaacagcagaagcaattcgaggaagccactactctctttgtgggatgcattcttagcgttcttggcgatcgtctggtcgaggtgtatatgcatatgaccgacgctaaggagttgtgggatgcactgaatactaaattcggtgctactgatgctagcaatgatctgtatatcatggagcagtttcatgactacaagatggctgacaaccgttctgtagtcgaacaggctcatgagatacaaacgatggctaaggaactcgaactccttaagtgtgtcttacccgacaaatttgtggccgggtgcattattgcaaaactacctccatcttggagaagtttcggtactgcactcaaacacaagagacaggaatactccgttgaggggttgattgcgtctcttgatgttgaggagaaagctcgggaaaaagatgccgcgtctaagggcgatggtgggcagtccagtgccaatgttgtgcacaaggcccagaacaagagcaaggggaaatacaaagctcagcagaccaccaacttcaagaagcagaagaagaacaacaacaatcctaatcaggatgagaggacttgctttgtgtgtggccaagttggtcatctggctagaaagtgtccacagcgcaaggggatgaaggcacctgcagggcagacttctaagtctgctaaagtgaccattggcaacactggagatggaagcgggtatggtaatttacctactgttttttcagttaatcaatctactaattggtgggttgatactggggccaatgtatatgtttgtgctgacatctcattgttttcttcttatcaggtcgcacggggttccaccgtcctaatggggaatgggtcacatgcttctgttcatggtgttggcacggtagatctgaagtttacttcgggaaagatcgtgcagctgaagaacgtgcagcatgtcccttctatcgacaggaatcttgttagtggctcccgtctgactagagacggatttaagttggtttttgagtctaataaagtagtcgtgtctaaacatggatattttattggtaaaggttatgagtgcggaggcctgttccgcttttccctttctgatttctgcaataagtctgtgaaccatatttgtggcagtgtggatgatgaggctaatgtttggcattcacgtttatgtcatattaattttggcttgatgtctcggctttccagcatgtgtttaattcctaatttttccattgtcaaaggttctaagtgccatagttgtgtgcaatcgaagcaacctcgcaagcctcacaaggctgccgaggagagaaacttggcaccactagaactcctacattcagatctttgtgaaatgaatggggtgttgacgaagggtggaaaacgatatttcatgacattgattgatgatgctactagattttgctatgtgtacttgttgaaaacgaaagacgaggctctagactattttaaaatttataaggcagaagttgaaaatcaacttgacagaaagataaaaaggcttaggtctgatcgtggtggagagtttttctcgaacgagtttgacttattctgtgaggaacatggcatcatacatgagaggacgcctccctattctcccgagtctaatgggattgctgaaaggaagaaccgcacactgactgacttggtgaatgccatgttggacaccgcgggactgcctaaggcatggtggggggaggcattgttgacctcaaatcatgtgttaaacagagttcctaacagaaataaggacaaaacaccatatgagatatggattggtagaaaaccatcactttcttatttgcgcacatgggggtgcttggcgaaagtcaatgtaccaataacgaagaagcgcaaacttggacctaagactgtggactgtgtttttctgggatatgctcatcataacattgcctatagatttttaatagttaaatccgaggtaccggacatgcatgttggtacaattatggagtctcgtgatgctaccttctttgagagctttttcccaatgaaggatacacatagtggttcgaaccaaccctttgaaataattcccagttcatcacaccaccagaacaaactgaacatacacatgaacttgtctctgaggaggatgtcagtgaagctcctcgaaggagtaagagacaaaggacggctaagtcttttggtgatgatttcactgtgtacctcgtggatgacactcctaagtcaatttcagaagcatatgcatctcctgatgcagactactggaaggaggttgtccatagtgaaatggattccattatcgctaacgggacttgggaggtgacagagcgaccctatgggtgtaaacctgtggggtgcaagtgggtgttcaagaagaagcttaggcctgacggtactattgaaaagtacaaggctcggcttgttgctaagggctatactcagaaagaaggcgaagatttatttgacacttactcacctgttgctagattgaccacaattcgtgtgctactttccctagcagcctcacatggtcttctcgttcatcaaatggacgttaagacagcttttcttaatggagagctggatgaggagatctatatgtatcaacctgatgggtttgtagttgaaggtcaagaaggcaaagtgtgcaaattgttgaagtctttgtatggtctgaaacaagctcctaagcaatggcatgagaaatttgacaaaacattgacatctgcaggctttgcagtcaatgaggcagataaatgtgtgtactatcgccatggtgggggtgagggagttattttgtgcttgtatgttgacgacatactgatatttgggacaaatcttgaggtgataaatgaggttaaatcattcttgtctcaaaattttgatatgaaggatttgggagtagctgatgttatcttaaacattaagctaattagaggtgagaatgggattacactcttgcagtcccattatgtggagaagatcttgaatcgtttggctacattgatagtaagccttctccaacaccttatgatcctagcttgttgcttcgcaagaacaagagaattgctaggaatcaactggaatactcccaaatcattggctcgttgatgtacctggctagtgcaactaggcctgatatttcctttgctgtgagcaagttgagccgatttacctctaatccgggagatgatcactggcgtgcgtttgagcgagtaatgcgctatctgaaaggtactatggaattggggcttcactatactgggtatcctgcggtactggagggttatagtgattctaactggatctctgatgtggatgagatcaaagccactagtggatatgttttcacactgggtggtggtgctgtttcatggaggtcttgcaaacagaccattttgacgaggtcaaccatggaagcagagctaacggcactggatactgctactgttgaggcagaatggctgcgtgatctattaatggatctgcctgttgttgaaaaaccggtgccgactatccttatgaactgtgacaatcaaacggtaattgtcaaagtgaatagttctaaggataatatgaaatcgtctagacatgtgaaaagacgattgaagtctgtcaggaaattaagaaactccggagttataacgttggattacatccaaacagcgagaaacctggcagatcccttcacgaagggactatcacgaaatgtgatagacaatgcatcgaaggagatgggtttgagacccatgtgagttatactatggtggtaacccagtctatgtgatcggagatcccgtgaattagatcctgggaagaacaaaccattaataaactagaggagagtaccaatatatataccctctccaagtgaagatgcatatactctcgtgagctgcaaggcaggttggctatgccttaatgagttttgttggctttaattagcgaagatgttgtcctgcagagcattcttgaaagaactcacctttgtgagcttgactgttggtcgcagtctatgaagattttgggtgaatcttctaggaagcttactaaagacctaggagtatgacttatacgctccacccgaggggtagtctacagacggtctagtaccagataagactttgagtgaaacttgcttgcacaagacttgcaattcaaggcgtagtccattgttcaagttgtgagtaagtgtagcttggagttctaggtggatgttcaaccttaattggtctccatcgaaccgctggtatataaacagtatattggaaaaggcaaatcttagtgggattttgagatttggtgagggattgttggaattaatgaatgggccttagcccactcgaagattaattctttggaaaatcacaaaagcccacctcatgggatggcatgcatgtggagtttagtaccaccttgcttattctaggagagggggacctccttaaaagggaggatgtcctcctagtcacttgaagcatgtgtggtggagagaagaggggaaacacacgcgcgcgctcgctcgcctcgcctcgcctcgccgggccgggccgggccgggccgggcaggcggcgcgcgtgcacgacgtacgcgtcgaatggtccgaaaaattggctcctcacccttgcgtagatgcagcttccttttgcagttttgttttgctgcaaattcagattcgtttttgttttggaaacgttccgaaaaatccggtgcgtgcaaacggcgtggagtccggataagttacgcgcgacttatccggttcggttacgcgcagtagagatcgtgcgggcgccccgatcaagcgactcttctctatataaaccgacctgccgtcttcacgcaacacaagcgaaatcaatctagggtttgcctcctactctgtactgcgccgtcgctcgtagactactccatcccgctcgccggcgtgcaccgtcgatcgggagagcaggtctccggaacctctgccttcgacgtcctgcaccgggagaaggcggcaataaggtttttgggaagcgcttcgcgcgactgctccctgtttgttcgcgacggctcgccttcctcttcgctcgcgtgtttcgtgccttcgtagacacctgcgaaaagtttcgaccaagcagccgatctttccgtcacctcggtacgtgttcaatatgttgcgcatatttgatctgttcatgttatactgtgtagtttacatgtatagatctaatgatgcgttcatgctagttttcatctgtaatgtcatgatttatttatgggatagattaaatcattatatgtctataatctcaacatcaacatccctatcagctttaaataatttgttgcattgaatacacttagctgcaagcaccaatatgccatcatatatgggttcaaagtctttccaaatctccgaagtaagttttctctttatagatctacgagatggacctatatattgccataaaatgaaattgacatggaatttcctaggaaaagattagggtcatgtcataggacaaaatcaaattgacactgatgtatggggcttttaactatttgccactcttacgaatggaccttaacgatttgccactaggcccacatgtcatagacacatgagggcccacgtgtcattgacagagcgtggcaaatcgttaattgctatgtcacaagagtggcaaatagttaaatttccccaaatgtatttgcacttaccatatccctgagaaatgttgtttgctcagatggagactttggcaatgttgtcgatgtggatcttgttactcgtgctagctactgattggatgacatcaacatggaggaggctaccaggccatcggacgtctgataaaaaacgaaatatcggacgcctctcatagcccttagtagcagcgcacctagcactatatttaaagcgcaagagcatgcagccacatgtgctagcctatgtatgcagcatgtacggctactagtactgtattataatgtacacatatatttttattctttgaactcttttctcttaaaatatatatttgatctgtgatttgattacatcattggatttgttataataaaatctttataacaagatctcagatggctatatttcgatataaaaaaactactgaaacatcgtgaaatgcttattgcaacaacaggtagtaccatatgtgacatttcaaaaacccattgcaacaaaaaaaaaactttaaagtgcaacatagtccaattctaattgaaacatttgtttctcattgagtcaaacactgaattttaacgattgaaacatatatatttttttcgtcataatataatcatgcaagatctcattgtaaagatttaataacaacaaatacaccacagtaatcggatcatgaatcgcataattagtttggaagaaaaatggttttaaagatcatgtctcaatttgcatgttcctatatacttgcatgcaagttgtgcatgcatacggctgaggaaaagtaactgggaaagagaaatcaggaaaaacaccaggaaaggtgaatcaactttagactagtatagaggaagctggcgtccgatgtttgtcttcccgtcggacgcgcgacacgaagcattttcccatcaacatccgtatcccaggggaaccgacaataggaataattggggactttagttgctttgctggtggggaattctgtccctgcaacacacgatgcttctgttgagttgccgaagatattccactaccgtcttgagcctccatgcataattcctacggagtaaaatagaaaacatcaaaatattttacaataatcctacttactttttttaacggtataagacaacaataaaatagctatccctgaaagtaactgtctcaatatccaatcaatttgcatcagtttttctatagagatattaatatactagtactagtttcatagagacttttttgtaactattaatttcagaagttcatttgcatatgaagagtatcgaaatgacaactattacataatttcagacctataatgtagcatgtgcggcggtgacgggaggtcgcactagaacgggattgtttatctgtgacgggctgaaagcatcatcactatcgggtaaggccccccatcacgatggttgttggcgctgctcgtcggccagagcacccaggtggacatctggacgatgaacctcctccacaggacggccttgcgccgaatggcgtgcaccaaggtcatcgacttgacgggagtaccccggagtccctgcacgccgccggtgtcagagttggagatggcgcgttcctgtggtccggcgatgcgagcagcggcgtggtgctccggctcgggtggacggtctgcttgctttgctggaccggcgtcggcgcgccattgtggtctgcgcgctcggcgaggcgttcagcgagtttcgctctgggcgccgccatgtgttgccgccatatgaggtgggtttgtccagttgggttccctcgatttctccatgatttcattcgtcggctggggaacgtgaagtcgcaacacaatttcgccacccgcagttttgcaccccaccatgcatcatgcatggatctatgggagtgaattataaactctcctaaaaatattctctccgtttcacaatgcaagtcattctagcatttcaatgtatatcaatataaatgtgtgaaatgctacaatgacttacattgtgaaacggagaaagtaaataaataacaataaataaatttaaaaaaaataaacaagatatattgatacatgataaatcactacaatacaaatttaacttctctaaattatatgatatatccatgtattaatccattcttcacatattacaaactgttaaatggcatatttcatgtaaaaactttgcatatagaagatgatttaaaatatcaaataaatatatttttggttttataataataatagctcaattaattatacgctaattcctttttcgttttgtatatgctgactttgtttccagcttaatttatttcaaattcctcctaaggagtttggactaggccgccaaactaaagatattttctgtttaaatgttatactgtctcgtcttcacctcttcaccggacagttcagatcaggttgacgacgattgtatcctacggaaaatttataactagttcaaatcaacttcaaattatgtgaaacttatttctaaaattttgtaaattccagctctatctgttggaatagaaatacaaatgttaacaagtatattttatacacaatatgcaaaataagccaaattggttaataaatggccaatgctaaaaatagcctttcatagctaagttttaatcctattaacaatactattgaatctaaaatgtgataatccatgctttaaccctaaaaacatgacacataaatgatctttaaagattaaatcatggaagaagcacatttgtgtaaaaaaaaagattccttaatcaattgtaaaactaaatgtcacgcctgaaaaatacctttccgaaatgccattttccttttttcgtggctggtggaagagaatgaaagtctagctagaatatatccttctgcagagaggggtcggccattgcactgtgcaagtgtagaatgcaattcaagtctacagatcacgtctggtttgcactataggcctcatcaattgggttattgaaaggcttatgctgatatatttatgccggtaattaatcaaggaaaagtgagcgatatcttaaaattttcacatggcattgtactacgataatggctctgctcatatgtattgttttttaatttagttcaaagttagctatatgatcatataaccgatgccaaaaaaatggtcctaaaattttgtggggtgccagcttacatatcaggttcacacaaaaagggaaacacccgccatctcaagcagccaactagctagctagtagtacttcttactactcggagctcaaagatttcttaaccaccatatcaattgaaggagccaaaacgaaaccttaggttacaggttccaaaaaggcctaaagccaccaacagagcaaactatataaaccatctcattttgtttcattgcctccatctgcattagcatcgaaatcaccctaaagataacaatcggagaagcggataagatcaaatacaacgaataaaagcttgcttgtagcattcaccaaacaaactatataatgttttacaaattttactattatcagcttttgggtttggtccagaacaagcttgcccagatttatgttctcattagttgtctatagattgattttatacatatgttctatggtaagaggtgtggaaagcagggtattaatcaatcaacaccaataatctgattagtgaagattaattcaagtagcattcttttggtgggagatactaatttaacactataacagttaagttagacagggaattgaagacactataactgtgaaactggaaataatctgagttggaacttgaaacacttgacagtggaactggactaactcacccatggcagcagagaagaggatgggactattctgaataggtggacgaagactggcctagtgaaaggagccataaatgttctcagtgtggtattgaagactaatatgcacaaatagcctttcgttcacgacacagtcctcacagcttctgaccgccagcacgtcgagctaacattcatgatgccttccatgcctaaatagctactttcccattgttttgtggcttatggaagatgataaaaatctagttagaaaatgtgcttttgaagcgagaggttggtcactgccagtgttgcactacgcaagtgtagaatgcaagtctatatatcacttccatcttacactgtaggtctcatcaagtgggttggtgaaaggcatgtgtgctcatatatttatgctggtgatcaaggaaatgtgagtatcttcagctttgcatatgacattgtactataaaatccgtccacatttataattgggttttcatagtcgtacaagaggataaccgcaaggtactataaattcataaattctagtaacaatatgtgatacttcttgatatcttttgtggtgttaaagtaagcggcgtcacaaaactaggacattgccacgcacataccctaactttacatatcctagctaaaacctcatcctcacttcagcccagaatgatttttttctttgttttggctctgcattgtcttttaagttgaaagtttgttgtgagattgcccaaacgtaagtaatgtttaaaaaaaaggtcatgctattttgtgggataaaaagataaagaggggaaaatatacggtggaaactacgtatgtatacatgtagtggaaacctggaaactattgttggataaaaaaatagactctgagatttgtccacgtcatcacgagtaaaaactttactcgcagatttactcatgagttaaaattttaccatggtgacgtggacgaatctcgaacatccatttccattttttgatccaatggtaatttccaagttttcactacatatagggtttgcactacatatttttccgataaagagatgccatctcaagctgccaactattcctactactaggagctcggaaggaggctgttctagagcatctgtacaaatacaccacacaaatatagccacatgacattggaaaatgatatgttcaaccaggatctccatgtaactatcaaaactcagagagcacccaattccttttcttttaaaattatgtagttcattgaattctgtttttaatgggtaatcataaaaaatgtttcattttcagtgaagaaggggcgtaccatatctctagcatagaagttgtagtcctgttagcgagtctgtccacttcaatatggtaatgtgccattttgaaaaatataacataaatcatatatatgtaaacaagaaaacgatgcaatcttaaattgtcatggaaatttagataaaaaaaaagacaaatggtactggcacggcatgatgaatcatgctgaacacttatctttttttcatctcgatatgtaggacgaatttaatatttaacttattttatatgtaatacatccattaattttgatggaatttttgaaatattgctacttaacatcgctaagggatactcctgaagaaaacccacgcacaataactgatttctctctgcattctctgaacccattgcgggtgccatcggcctaataactgatcatgctagatttgaagcacggcagcaaccaaacagagcctcttcacctcttgcttcgggtaatcaaggtttcaatgaattagttcactatcacacctttggcaattcagttgttgagctcttgtgtcgtcattgttggaatctgcggtctatgtgtctcgtcatgtcggtggcgttccgaacacgtcctacatgtcacatgaggaaaaaatcttctagattcttttctgtgcaacttccctaaagcccaacacgctcagtatcaaaatctggtgatctctctgagtttcacagaacagatgacacattgacactgagtgttgggcatctaaaattccagatgccctccatgtctagagtatactaccatctacaacacttgcacttggagaaggaatttatattcaatcacatcataccatatggttgcagaaaaaagaaaactgctatagaaacccatgcatgcattcatatggcaaacaccctgtgagtctaagatggacaatgtgtgctttataaagcaacagtgtttttgttgcctccagtaaattgtcaattatatgagatggctggttaaccctggcatgagcatttgtattcttggatatttgttaatcagctaggaaaaaagttaatcctgacatagcattgctgatcgagcatcgccaatcaaagtaatttcaaccattatttatgaaatctactagtaaaaaaatattttgccactggtagttgaggtagcagtacaaatatatatgagccattgaattagaaactatgaagagtcttgattgattctacaaaacacctcatataacatgttatatttccacaatatggtatcagtacttcaaaatttccgttgcagctattatagtaccacacccttaaacaagtattccgtcttaatcacttaattcttctatcaaattccaacagagcagcattactgagaaaacatagtcaaattaaaagcatctggtggagaatatctaaacatgggatgtgtaatctgagatgaacttggaaaaagtacgaattactcccctgaactatcacggtcggccaattaccccctaaacccgaaaaccagacatcgtttaccttgaaccttcaatatcaaacaaattaccccctcgacataatccagagcggttttgtcctacgtggcaatccagtcagcattttttttatggtggggcccacctatcatataaactctatcacctgtctctctcccccctctttcttaggccattgggcgcaggtcgagcggtgcgccgcgcgggggcgggtggtgagcacggtggcgggtcgacgagctcggccggctctagtggcagcagcgggggtggtgagggcggcgggacttggagcgaggcaacggcggcgggacgtggaacaacgcgtgttcgctacaatttcatcgctccatccatccatccatgccgcgtgtgtgctggatctgctggttgttggatctgctgctcctgcgacccgtggccgcgtgtgtgctgtcctctcgctggttctgacgaccttttcttcctcgatgccgctgtagatggccggcggtgagcaggaggaatcatcactggtgttcttatctccgaggaattttgattctctgtgtggagattatggatatcccatatctacacggcgatgatgtttgggctgaatataggataccgaatatagatagaatatcttatttgtatttcgagtttgtttctcaacttgtacatcaaggaaataccttgagacttagtcggttacgactgtattttatctgtatctgcctattccgttagggatatagattatcttttgtaacacggactccttcccatatataaggggggtccgggtgcctctaggggcggatgttgattttctcccaatcatccaatcaataatacactcggcggattcatccccggacaggagtagggtattacttcttgaataagaaggcctgaacctgtataaatcctttgtctccaaacccatacacttttccagcttgatagccacccccttttattattgccgaaatctagtttcgacagttggcgcgccaggttggggttgcgtcaagcttttcgccgatcagtgcaatgggttccgtctccggcatcgacgacctcgtcttccctcccgggcagacgtttcggttcggcagcctcgacttcgtcaccaacaacttcggcaagatctctctccttgactcggagtcgaaccagtcgggagagaaccggatctcagtcccgtttggattcccaaacgcggctgaaagttgcttcaagaccatctcaatcgagtcggcttcaaaccactcggctgagatcgcatcttctccaacgtcaccagatcaagatgatggggcttacccaccgatcctgatgaagctccccgacgatttggcggccgtctccatcacgacagcgtctccttcccgtaggcctaggcggaagtcggcttcaacaccgatttcgcctagcttcagggaagtcggcgtcatcctccaacctctcggcacggtttcgaccgatcagctggatggctacaacagctctcccaccgtcgactcgcgccccaccgacatcgtggagtatgacgaatttagctctcgctacaacgacctggatctcgacgacttcgacggaagcctagatgacaactacacccctctctacttcggcgtcttcatggccggtaacgagacggaagagcaacgccaagcccgggaaaccgaagcacgtcgcgagactgagcgtcgccgactggaggaggagcatcaagcacaagaacaagaacggctacggcgtgagcagcaggagcgtgaacggaccgcgaaggaggctgaggatcgacggcagcgagctctggaagcagggcgccgagcgcgtgatctcattggccaacaagatgttgaagggacacctgttttccgcacccctcaacagaatgcggttgccgcgatcaccctcctcgacaccctcctcagggagaacgagctcaatcaatctgaccacgtcgtcaacatcttgaaccagacgaagaccatgattgcggcttcggtcccagttaactccgaaagcgtccacacgccgactggcagccgagtcccccacttccgatctcatgactaccgtcatccaagcctcagcattaccggcgcaggatccaatcgcaggagcaggggccacgacgagcggtctgttcactcacctcccgatcatcatagggagcgccgagtggaacggcctcgctcaccacctcgtcgccgccccgtcgatcttcgcgacaccatcatacagcgccgagcagctcgaggttatcatcattcgccggactgccacgacgacgaccttgacggagtagcagccttcaccgacgacctgcgtcgagtggattggccagccggcttcaagccgactggaatagagaagtacgacggtaccactaacccagaatcgtggcttaccgtctacggtctcgcaatccgcgcagcaggaggagatagcaaggccatggcgaactatttaccagtggctttagcggattccgcccgatcttggctccatggattgccccgtggtacaattggatcttgggctgaattacgcgaccacttcatcgccaacttccaaggcaccttcgagcgtcccggcacacaatacgacctctacaacgttattcagaagtccggagaatcccttcgagattacatccggcgattttctgaacaacgtaacaagatctccgacatcactgacgacgttatcatcgccgcattcaccaaggggattagccccgaagaattggtcggcaagttcgggcgtaagcctcccaggacagtcaagctcatgtttgaaaaagccaacgagtacgccaaagctgaagacgccgtcaccgcatcaaagcagtcgggtcctaattggaagccaaaaaaggatacgccggcttcgggaggaggtggaagtaacaatcataaggaccgcaagcgtaagcctgcggaacttgttgcaaccgccagtcactcttctcgacagcgttcgcgcgtcaacacgttcgacaagatcatgaactcccaatgcccacaccatcctaactccaaccatgtggccaaagattgtttcgtttacaagcaattcgcggatcaatacaccaagactacacggaagaactccgacgaagaacaaagcacgtcgaggaagaaggacgacggcgacgccccggcaggatttcaagtccaccgcaaggagctcaaccatattttcggcggccccctggcttatgagtctaaaaggaagcaaaagttgaccgaacgggagatcaatgctgttcagcccgacacgccccaatatcttcgatggtcagagatcgcaatcaagtttgaccgctcggatcatcctgaccgagtggtccacccggggcggtaccccctagtactagacccagtggtccgtaatgtcaagcttcgcagaaccctcatcgacggtggcagtgcactcaatatcctcttcgccaagaccttggatgatatgcagatccctcgctccgagctaaaaccaagcaatgcgccttttcacggagtaattccaggattgtccgcaactccactcggccagatcaccctcccggtcacttttggcactcgggaaaactttcgcacagagaatatcagctttgaagtcgctgatttcgagacagcataccatgccatactcgggcgcccggcgttagctaagttcatggccgtcccgcactacacttacatgatgatgaagatgcctggtccccgaggagtcctatccctacggagcgacatcaagcaagccgtcacatgtgacaaggagagttgcgacatggcccaaacccgcgagatggcgtctgcccgagaggatatccgactggctgcagccacggcgagcgaaggagaagtgcccgctaccaagacttcaaaaagcggagaaagcgaagccaagactaagaagattcccctagatccctctgatcctactaaaactgctgtaataggcgccgagttagattgtaaataggaaagcgcgctcatcacctttcttcagaacaataaagatatctttgcgtggaaaccatctgatatgcccggtattcctagagaggtgattgagcactccttacatgtcaaagaagatgccaaacctatcaaacaacgactccgccgatttgcacaagacaggaaagacgcgatcaaggaggaattaaccaagctgttagcagcaggcttcatcaaagaagtccttcatcccgactggctggcaaacccggttctagttcggaagaaaacagggcaatggcgcatgtgcgttgattatactgacctcaacaaatcctgccctaaagatccttttgggttgcctcgcattgaccaggtagtcgactcgaccgccggctgtgagcttctcagttttttggattgctactcggggtatcatcagatccgactgaaggaatccgactgcttgaagacttcattcatcacgccctttggagcttattgctatgtcaccatgccgttcggactaaaaaatgcaggagcaacttatcaacgtatgatccagaggtgcttctcaacacagatcggccgcaacgttgaagcttatgtggatgatgtagttgtcaagaccaagcaaaaggacgatttgatctcggatctagaagaaactttcgcgagcatccgcgctttcaggatgaaattaaaccctgataagtgcaccttcggagtaccgtcagggaagctgcttgaatttatggtgtctcataggggcatccaagccaacccggagaaagttactgctatcctcaacatgaaaccgccaagtacccagaaagatgttcagaagttgactgggtgcatggcggcgctcagccgatttgtttcaagacttggcgagcgggggatgcccttctttaagctactgaagaaaacagatgatttccagtggggacccgaagcacagaaggccttcgaagatttcaagaaactcctcaccgagccaccggtcttagcctcaccacacccgcaggagccgttgttgctatatgtagcagccacctcccaggttgtgagcacagtcttggtcgttgagcgcgaggaagaaggccatgtccagaaagtccagcgaccgatttattttgtcagcgaggtcctagccgactccaaaacgaggtaccctcaggttcagaagctgttatatggtattctaattactaccaggaagctatctcactactttcaaggtcactcggtaacggtggtcacatcatttccactcggtgatgtactgcacaaccgcgaagcaaacggacggattgctaagtgggctttggagttgatgtctttggacatatcattcaagccccgaatttcaatcaagtcccaagcgttagctgattttgtcgccgaatggaccgagtgccagcaggatacccccgcggagaagatggagcactggaccatgcattttgacgggtcaaaaagactttcgggcactggagcaggagtggttttaatttccccaactggagaaagattaagctatgtgctttggatacatttttcggcatcccacaacgttgccgagtatgaggccctccttcatggactgcggattgcaatttccctagggataaagcgtctaatagtccgaggcgattcacagctggttgtcaaccaggttatgaaagagtggtcctgcctcgacgacaatatgatggcatatcgacaagaggtacgcaaattggaagacaagttcgatggactcgagctcagtcacgttcttcgacacaataatgaagccgccgacagacttgccaactttggatccaagcgcgaagtggctccctctgatgttttcgtcgaacacctttatatgccgacagtacctcacaaagatactactcaatttgcgggcactcatgatgtagctatgattgaagccgactggcgagagcccctcatacgatttttgacttctcaagaactcccctaagacaaagatgaggccgagcggatttcaaggcgaagcaaactttatgttatgcatgaagctgagttatacaagagaagcccttcaggaattctgcagcgctgcgtatctttagaggaagggagacaattgctgaaagacatacattctgggatatgcggaaaccatgctgctgcacgcaccattgtcggcaaagcttaccggcagggttttttctggcctactgcagtgtccgacgccgacaaaatcgtgcgcacatgtgaaggttgccaatttttcgccagacaaattcatctaccagctcaagagttgcagaccatcccgctgtcttggccgtttgcggtttgggggctcgacatggttggcccgtttaaaaaggcagccggcggttacacgcatctctttgtggccattgataaattttccaagtggattgaagctaaacctgttgtcacaatcacagcaaataatgctcgagacttcttcatcaacattgtgcatagatttggagtgcccaatcggatcatcactgataatggcacacaattcactggcggagtttttaaagacttttgtgaggactttggaattaagatttgttatgcctcagtggcacaccccatgagcaatggacaggtggagcgcgccaatggcatgatacttcaagggattaaagcgcgtgtttttgaccggctaaaaccctatgccggcaaatgggtgcaacagctgccatcagtactttggtctttgcgtactacacccagtcgggccacaggccagtcaccttttttccttgtctatggggcagaagcaatgttgccgagtgaagttgaattcgagtctttgcgttttcgaaattttcgtgaagaacgctacgaagaggaccgaatggatgacttacaccgattggaagaagtccgcgaagcggctttgattcagtcagctagatacttacaagggttgcggcgttatcataatcgcaatgttcgatcccgtgcctttttagtcggcgacctggttttgcggaaaattcaaactacacgagatcggcacaagttatctcctctatgggaagggccatttatcatctctgaagtcacccggccaggttcctatcgactcaagcgcgaagacggtactctcgtcgacaactcttggaacattgaacatcttcgtcgtttctacgcttaagcttatcattgtattttcctatcttgactgtcaacatcaagttttcttcttgacgttgtcagtcgggggctattatcataataatggagtgtgattttttatcaattcaatttgcttacttggtctatcattgccttgtttggttttcctacttagtctgcgaggactgaaaggttttaatagcttctttgggttttaggctcaacaaagcttaacaaaaacttctaagaaatcaaagactaggctagaattatcacgcacagcataaatacaccagtattgtacaaattgagcctccatgtattacattcatactcagtcagaatcagttctttcatcatcagagttattactactcggctgaaagttagtattgtggaattgatctacaacgtcgcttgcaattttgtcagccgcattttgagcactgctgataagatcaagagcagcctcttcacttgtcccgtctgcaaagccatcaatggtgtcaacttcaattcttgggtacaaggatttggtcatcgctaatgccatgctagctcccatacttccagctttcttgatgttcttgaaatacacatccggagcagctctcagcttgtcaaagatttcggttgcgtcgagtgcactcggaccactgttattcaggaacatagcttggacaagtggggtagcgacattagcaacttcatctcttgctccttcaagcctcttgatcttaccaaccaggacgtcaaattgagcttgggatttgattttgcgatctacaaaacacatttatgatgagaatctgctgcgttataaagagagaagttcagattgtcagctggcagtaccttcaacttccttcaaggcagagtccctctgtgcagccagttctaccttgtctcttttcaaggcttcaatttgcttttccatttgagccatcttggcggcttgcactgtttgaaatccaaatggttgaggatacagttgcgacagcatagatcaatgcgacaggtctagaggttaccttttgacgaaccactcagctcgaagtttgaatcctggagctgagcaattcgctcccttaattccttctccgtctttttggcgagctccttggcctcgtgtaactggtccctaacagcttcaagagttcccaaatgaggaaccagtctttctaaagttgcggtcttggcctcattgcgaagatggattctctgcataatggtttgtgatttagttctgctaaaaagaaaacaaagtcaccaaaggcagtcgcccggaagacttacatttacaatacgagtggcttctccaagcgccttcttcagctggcatacttcctcatcttctttttgacgatttatgacgataccggcagcttgtgagttctcgtcccaccatttgattaagataggaggacgagagtcgtcggccgcctttatgcgaaggatttcttcttcgtcatcgcctggtggtcctgatgtgtttccaagacgttagacggataaactgaagttatttaaatcggcatcacttgagaagataatttacctgaagatgttcctagctgggcgtgaggtgatccttgttctttatttggagacccaattatcgagtcgttaccagcctctggcccttgagaagttgtcgtctgcgcttcaacttcggggatctcttgatcgggacccacatccgactggtttccagtcgggggctcttgggttgttgcagtttcagttgcttccgactggtttccagtcggtggctggtcactcggatcggccttgtcatccgaagcatgggcgccagtcggctggctttcggcagtcggctggctttcggcagtcggctggctttcggcagtcggttggttttcggcagtctgctcaacgtctttggataaatttggctctgtcacagccggatcaggatcttttccagttggatctatgtcggatggtttcctgcaaagtgtcctttcgatattcagcgtaatttctatgagagaagcatgtcaaagggagatggtaccgagaggtttgtacctggaagatgttctaatctttggcatttgacggccagccagttttttcttgggcatggtacgctttgggagtttattaggcgagcccttgtccccagatttatcgtcgtcgccttcatcgttgtcgagcaccagttttctcttccgagaacctgtctgtccagtcggattggaggtttgaggttgcggatctggtctgatttttgaacctccacctccctgaacggtgtgctgacgaggcgaccggcattgagtgattgcgggatcagatttcatcaacgcatattcctaaatgagatgcctccacggttaattaattcaacatgaaaacaagataatgttttggtcatagattgaagatttcagaggcatacctgcggaggcggattgaatgcattatatggcacaactggcagctgatgtgagtagctgacgacaatagcatttgagaaaattttatacattctctccttcatgattttaaagtccagagagtctggttcttcacgattgggatcatgcttgccgtcgaactcgaatgctgtacgggatctttctttaattggtgccaatcggcatttgatgaaatgccgagtaatctgctctccttgcaagccttgttctttgagttttagcatgcggtccatcaattccaaggcttgagcagcttcatctccgatcggaagagagttccaagtatcttggtacactggaggaagacaagagtactcgggaagagcaggctcaggattctgaacataaaaccagttcacatgccaccctttgtttgaggtcttgaagggcatagagaaatacttctggctcagagttcccctcaactgaaatcctgcccctccgactacacatgccttatttttgtttggttggggcttgagaaaaaagattcggcggaacagagcgaagtggggtttaattcccaagaaggcttcacaaacatggatgaaattggcgatatggattatggaatttgggtttaggtgatgcaagctgattccatagaagtttaatatcccgcggaaaaattttgaggtcggaagagcgaagccgccatagaagaaatgagagaagaccacaatctcgtgtgtatcgggggtcggaaaaatctcaccgcacgctggccgccacccgatgatctccttggcagggagaacgccgtgcgccaccatctccttcaggttctcttccgttacgtcggacggcgcccattggccttcaaagctttctttctcctccgccatcgattttacccgaatgcgctgatttgattcgagggatggctagggagaggtgagggattgaggcggtggatcacgggaaggattttgatgcacttttcgaaggtggatttgagcggaatggtgaaccctagtttgccggcgcagttctctactgtagcagggagtggggaaaatggcgagagttccggcggggaagacgaagtgtcgcttggatctcgggatttcttgttaagggtatcggaggtgcaaatgggcttaggcctgaacagtacctcagcccaatacttttaacagcgtggcccattgtgttccttagggacttaggcattttttgctttggcaatttatgcgcacaatagtgttgcccaatgctgataaaatcctttttacgcggtcatataattctttggaattattgcaatgcaaattaaaaggtgcccgacagaaaagcgttatgctgtttttgtaagcttttttaggctacaaaagctgtttgggttaacttggaatgacttgtttttattatagtcattcccttggtatgttatatgcctgttttcattatggtaaatagtcatagcctaggctattagacttattcattcccataatttttataatacttggtgggtaatccttagagtttttattcggatgcctgtcaagtgtgttcattcgtgaaccttttagagtgttaaccactcggattctttttattatggataaaaggcagtcggctagaatgcctctttaggcgccgcgtatgcttttgtcatatgatgcgcgattgtgctaatattctgttctcaactatatgtttagtttgttaattaatcacatagttgggggctacacctaattaggtgcatctattcgatgcaccgtattctttattgtttcgccctttacagtcttcgtcttcgctactcggcaggccttggcatgaataatttgaagcactcggattactatctttgagaaggctataatggttgactgcaaaggtctcgggggctactgtggagattatggatatcccatatctacacggcgatgatgtttgggctgaatataggataccgaatatagatagaatatcttatttgtatttcgagtttgtttctcaacttgtacatcaaggaaataccttgagacttagtcggttacgactgtattttatctgtatctgcctattctgttagggatatagattatcttttgtaacacggactccttcccatatataaggggggtccgggtgcctctaggggcggatgttgattttctcccaatcatccaatcaataatacactcggcggattcatccccggacagg

SEQ ID NO: 65505 - DNA, 16865 bp, Oryza sativa
ggagcaacctagccacgcccactgtccgctcgctcaaccaccagagaaagaggatgatgtgattcaatatgacatgtgggccctatattttttaatttttttggctgattggatttccacgttggcgccacgtgtatgccacgtaggattaaaaccgctttggaagtgctcaggggggtgatttatccggtatgaatacttgaaggtgtaaaatgtccggtttcgtggttcggggggtaattcggctaaccgcgatagttcgggggtaattcgtactttttccgatgaactttaattgcgttggaacaacactgatgttaagtgctgttgctatgaaattcaactagcattaccatgccaagttgccaaccttccctttgatcaaagtaaaaccatgaataacctctgccattagtaattatatgataatcatcatcccaatgctcttgggtccgactctgaccagtccatattacactccaggaaatcctgtagatgaaagaagatgaaaggtgtaggatcgaatacctagaaccaaacctacaatagggttgtgaaaagtaggaataccaaaaaagggaaaacttttagcaaaactaaaagttaattaattaccatctaacttgacaatgttcctgacgaagttgggtctggccacagagctcacgccagtctgacagcaccttaaccatcattctaaccgatgtagatcggctggtctgatcgtccttcaagccgccatctcctagagccgccgccggtctaaccgccctagagccgctggtctaaccaccaggttgccccgagcaaaaccgagcaaaatcataaagcgcagaactcttcaaattaaatcaactttattgcttctaaatgaggaagctccgaacgccgctttcgagggataagacccacaccctgtgcaaggcaagcctctttgatcacattgcccctatatttgcaagatattttttattgaaaaatgcattgcttagtatacacgataaacatgtttaggccctcagattgtttatgcaaccgacagaccgacctagtagtcgcacttatattacataggttgatgtttccttacctttgatagctccacaaatatttgcgtcattattgttatacgactatcgaggtagttcgcttagccatgcttatgttgtattgtcgggtgggaaacctgggttattccaattatatgcttaaaaatctggtgcgttgtaccgacgtgttgtgaaataaaatgtgttgtgaaatggtgatgatgcaaggtcatatctttgtggtttggccatgtattgtcgataagcatcgtttgctttgggaaatccatccaaacacattacagtgcgaccacacgggtgtttatgggatacctctggctaaataattagttatcatataggggttggtgtgccaatggttgtggggtgccgaggatgaggagacgaagtttatttagccctattgggtgtctctttttattgcctctattgtggcacgcgatatcagtaggagacatcgtcggtatttcttgagtggatgatggctgaccttgcctgatactcggctaagagacttagcccaactagggggcatgcgattttcatgggttagctttggaaaggccttaccatgaacttccgttaccgataggtatcggtaaccggtgatagtttcatggggtaaagcatgtaacctctgcagagattaatgaattgttcgaacacccgtggcacggtcaagtgtcacaccccaatctgataccgccgtacaacggcacctgacaggagcgtgtcgtagggaaacggcgctcaggtcgggtttttcacaattcattttattttcaaacacaccgacaccacaggtcgggttttggaggcttcacaaacccatttcccaagttttcgacaagcaatggtgtatgtgggatatttggtatacgcgctcagagagcacgaataccgaggtaccacaagggtggagcgacaaggaatcagggatgtacgacctacggaaattagtgcgactactgggtaggtccgtcggtttggcacgcaaaccgaggccaagcaagttaagtgtgtgattctaataatgcaagttacaaacaaaataataatgatttttcaattataggagcaattgatcaaagggtgacttgccttgctcaaggtcttcacgaagcttcacgaatcttcgagaaaacctgcgatcgacgaaaatccgataaccgcaactatacgcaaacaatcgaaaacctaaacaaaagaccaaaagaaagatcctatttagactaattagtagtgccattaaatagatctcaattttacggaattactggaagtggaacggagtcaatcggatgagcggttgagaagatatgaattttggaagtttaattggagtttctggaataggagaaatggtttatgaaattttatagaaataatattctcaagaatattattgacagtcactgacgcgcgggaccaaaggaaatgatttgtggaattttggaataaggaattgatttatgggacaaaggaaaaaggatttattaaatccctggaaaaagaaaaggatagagggatgtatattagacttgttcggtggcattggtgcggcccaaaggctaacgcggctcggccgaaccaaatgggccggcgcgggcgcgaggagaaggcccatgagggcgcgcggggagagagggaggcccgtcggggtgggcgcggtccaccgcgcgggacccacatggcggtggttgggttcacggtggggagagcgcacgcgggtgcggcgctagggttcggggggggaaaggcggtccacgcgcggcgcgcgggtggacgcggtgtgcggtgggcccacgcgcagcgtgtcggctctccgtggaccgcgcgcgagggtgggggacggagggaggcggctgaccgaggtcagcttttgacccggtcgcgtcgaggtggcgccgacgtggcaaccacgtcggatggggaggcaaaggaggccgggcaggctgatccgacggctcacggggtgcggggggatccggcgaacggcggcgagccggaaggggcggctagcactggcggcaggaggaggagaaggggaactcattccacggctcgcatcaggaagaggacgcgcgacgacggccggcggcggcggccaatctcgccggcatgccgacgtggccgcgcgcgaggagagcgaagggtgcgcgggctcgggcttagccgaaccggtacggtgttgcgacgcgcacgcagtgacgcgggacccgatggtcaccggcggcgcacgcacggcggtgttatgcggcggcggaagcggcaagacggcgcggagacaaaggagaaggccgacggccttggggcagccagggggaggtcaaggggatccccgggggcgtggcggcgagaggaatcgacgcgagagaagccgacgatggcggattgcggcggcggcaatcaccggagagcaaaaaggggaaaacacgacgagacgacgagggtttgattcaaagggatgggagcatctccggggttcaaggaatccgttcccggcgtcggattggacggagcggcaccgaggttggctggcgacgagagacggcctccgggacagagcatggtggccggcgagctagcgcgcggtgcaagggcgacgagcggcgattcggcggcgagacctggggcagtgtccatgcgtgatcggggggctagccgagctaccacgcgagctagggagggagaggacgagcaagaagggagaacggagggtggcattaccaagccgagacgggcgcagtgacgagcggccgacggctcggaagcgagctctccggcctcgggccgaggaaggggaggaaggagggtgcccggagtcccgcgtcacgcgtcctcgcacgcaccggtctcccggtgctcggcggcggacggcgacggcgagagcagaggaagggcgacaatggcgcggtggagtaggagtgtgaagtgggagggattgagatgggatggggagcttggcttcggggttttataggcgcggggtgaggcgatgtcggtttgggggggggggagaaccgaccttggcggtcaagcgctcggctggcggcagcggcggtttcgtgggcgatgcgaaagcggcgacgacgtggatgctttgggcggcgaaggcggtggatcggacggccgaatccgaaccacgggagcgcaggctggcgcggtcaaggtggaagcggcgagctggcatggtcgcggtggtggcgtgggcgcgacagggcgcaaaggtggcgtcagcggcgccctgtgtccgctcccgcaccaggacaagggagagagcgaggcggccttgcccgcaagggaaaagcgaaaggaggaggaggaagggagccttgctccttccgtttttgggcggcgaggctggagaggcgcgtgggattggcgtcgccgcgttggcggcttgtggcatgcggaggcggggccatggtgacgcagcggatgacagcgaaaagggaggagggctggtttggcggcgagcgcggaccaaggcggtcgacgcggcaggggcgacggtggcgcggccacagcggtcggccatgagcggcgccgcgcgcgggagcatcggcgtggcgcggtcaaggtggggcacaggcgcggcaggacgttgtcggcgtcctctgcctccgcgcgcaagaagacaagggcgagaggagagaggccgggtttagaagggaaaggtgagggaggacggtggaaagggaagcctctcccttccgttttgggcggcgggcaggcgaggcgcgcgcgggaagggcggccggcgaattcaaacggcggcggcgggaatcggcgccgaggtgaggagttcgacgagagagagagaggaaaaagacgagagagcgagagaaacagagagagagcgaccgcacacgcgcaacgcacgtgcgagggggtggaggaggagcggctgagaggagatgggccgaagagaaaacggcccacaaaagtccgagggaggcaaaatagactttttcggaggagattgatctggagagaaatggagagatttagggtttggattcgacttcaaatttgatattcaaactcgagggtttagggatgaatcaagggagactcaaggaaatgattcgagatggggatttgaataattctggattcgtagaagtacttggcgaggattcaaggaagcatttgaatttcagaatttgatttcagagactcgaatcggaagaggaaatttgaggcgaaggattttgatttcgatgagagggaacaacgggatttgaattgagatcttggcacaacttagactcgcacacaaagaatgaaaattttcgcaattaggatttttgccgaattagtttttaacgcctcacgaaaagcggagcgttacatcaagggcgagtgtaaggtgtttctcatagcgtagatttgtatgacaaaggtttgtggaagagtggttatttgggaagggaaacgtttccagagtccgcctatgtggcagacggccaacctttgtggttagcaacgggtctatgtgacctggggtgtcgtctgacaccgaagtgttgttagagctgagaaggtgttgatgtgctaggatagctgggtgaactatgtgaaccatgtgttgttgtgaaagtgaaaagaaactaatagaggaaacaaaatagttattgcttgttaatctcgtgacaagttgttgcaaagcaacttgtcaaatgggtcgaggcgtgagcctcctcccgacaactaaaacttgactcagtaggagttttcgtgaaataaatcactttgccaaaaaggcagctttcgcaaataaaaccctatcctccttgtttaaaccgagcatgtcactctttttcctagcttgctgagtatgttaagtactcaccttgcccttatattaatctatagagtatgaagatgaagacgtcgaccacaccgctgaggagtgtctccaggagcaagccgagtatgaagacttctagatgtttcgtgcctagccccaagcctcccttgtggaataagatagtctcgcctaggttcttttcctagtgcttagttgcttagccgcttagtctctccacgttattcgcttctgcgccatcgcctttatggttttttgtattgttgtgttgctcatctatgggcctgtccatgatgtcaactttcgaaagtactactacccagtgatgtaataaagcagtttactctgatttcacatttattctatgtgtactagctagtatatcccgagactggtactatctcacaggtaaagcataacaccccgatgtatgttagctgtgtttatggctaacgaatgtcggggcgttacagtgcaacaacaacactcctatctgaaaattcgactaaacttgaagtgtaggccaaaccctaatttttctctcaactcttctcttacaaaatcgataccgagaggtctcaacccctcctcttctgtttataccctgagatggcaacccaaaagacacgaattctacttgaataatttgccctaatccaataggaaacctactcataaaagtaacaatcttatcctactacaattcaaagttcaatcttcctaaatttgaactccttccaaatttgattccgcttttcaaacgcacacaatctctcttatatgccatcaaatcttcataaccacgttcattgttctttagtcaaagcatcacgcatgatctcccgatcgtctggacatcaatttctcccaagtcaactctcgatccatcacctgcaacgctatcccgagatatcaagacacaagtaaacatgaatcaaacaaggaaccatctcgagcaaaagttcttcccaacttgattcaaaattagcacacaacagtattacacacacgtagaaatcaactagaagtcataaattgaagcaatcacgagtatccaaagaaacattctgaaatcaactccaaatagagtctagccagtcagaccatcggactggccgcttggacagaacacaacacgccgatctggccggcctacctatagcccgatctgaccagtcctagtaaaaaccacttcgccaattatccacctattatcaaaaccaatataaatcatatgccattgttttttgatgtaatcatatgccaattgttcataaaaaaaatatgtaaatcaaaaacattgatttcacaaaaggatctatacatattaattaagacttcaacttatggtcggattcaatgcagttagctaaaccttctgaatcttttcaaggtaacacacggtagctagctgattaatagagttggcttcaccgtgtagtttgcaaacatcttcaaaaggagaagagatatgtcttttcatccaaactcgaggctttttttttttggtcctgctagccacatatgctcatgtaaggtagcattacttaggtgtgagaggcatcaggattatatatatgcataccacgcataggatgggcatctacacccaaagctattttactcttcagcaactgcttgattcctggatgaacaaattcaccaagatcaagaagtgtctgcttgcaactgaagtgactgcagtttgctggaccatctggaaagctagtaatcctgcctgcgttccaaataagtttccagcagatccagttgaggtaattcataatatttgtcattggatctcatctatggcatctatctatctatctattatctatctatcttctatctatctatctattatatactaaaagtccattaaacttcctataaacgctcctacgccgccatgtggtgctcctacaaacactcataggttgccatgtggcattttataatctcaccgtcgattttcatttaaaatggtggacccgttattttaggccattagattagatctatttgcatcctcctaatatcccgtgcatatgtgtgaaaccgtttgtaccagaaaaaacttacgtacgtatctatggtagggacaacccatttaactgtttatttgaaaaaaacgctcgtacgtaccttaaaaaatattaaaaagatgctgttcatatggaaacaagtacgtacatatatgcacgaaattttaaatttaaacaaatgcgtacttatatgaaactatatttcttacaattaaatttaaattttaagactaatattaactaggtttttcttttaaaaaactacaaggggagaaatgtttaggatatgtatatgtacaccttttttttattaatttctgtgtaacaaattgcgtcaatgcaaatcaattaagggcagagcttgatagtacaaataaaacactatgattaaattaaaatacatttatttattcataaaagttttttagtctttttatagaaaaggtaaaaacaccttattttaatttacacttaatttattagacatatgctccaaacaaactaagtatacctctttttttaccctaaaaaatgtatacatccttttttttatgatgaggaagattatagacaattgtttatatggatgaattgaatattatataatataaatcttaagtagagcttagaaaaattatctaaacaatattgatgaagaaaatttatggagaaaacatactgctaaagcttggtgaatgttgctcaattgatattccacccttataaatttttcaaacacatcctagatgcatacccgcgcgaatgcgctattaaatttcctaaaatgttctcatgccactaagtggtaccctataaacactctcgagtcgccaagcggcactataataaataataaatcagagaaatcctaccaacgattttgttggacccattattttagaacattagatatattttattaaagaaacagattcggcacaaacgtaaaaaaacaaaattaaaagttttggcatgttatacgaattaatgaacgtatgtacggtacgtacttccctcccgttccttagtatattattttctctcttcacgagaaactaaaataaaaacatttttacaggcaaaaaaatcccacaaatagacttctaccaactagctaggtctagaagctctccctctctccctcgatctacatatgaacgcaataattctaagtcgctacgtggtctataaaattagaaaacgtactaaaaaatatttataaaaaacaaagcaaccagctatcgatttctatttaaattgatggatacattgttttagattgttagattttttaataaaaaaatcgcaaacctctctccctcccttccaccccgtgcggcattaaaatccattaaacattttataaatgcttataaaatcttagagattctggaaaacaaactaatccattaaacatccttaaattgttcctaagccacaaagtgacaccctacaaacaaacgctcctaggtcaccaaggaacactctaataaataaaaaaaaaatctgaacaacgattttcatttaaattagtgaatccattgttttggatggttaaatcgtttttttaaaagaacacacacatccagaacctcgccatcacataggaacgaacatgcatacttccctcccgtttctttcagttttatctatcttcatgataaaatgataatcaaaattatttttacatgaaaaaaaagcccacaaatagacctccacctactacttggtctagcagttctccctctatcacttaaacatcctacaaactgaaatttcttaccttttcatccttttcaaaacttattttacaaatagactcctcgaaaaacttattacaggaatgggcctattttttttgcgccagagaggctggcaccatcctccaccctagcgccagccaccctggcgctgtcaccgtgtcaccgtggcactagggcacacgtgagtgggctgacatggcaaagggaggcgccacgctggcgcctccgtcccacacaccacggtgctagcaaggctgccgcactccccctgggtgggccgcgcccttaacccgtgcgggccccacctcctttctcctcccccactcattttcgccaacttaggagcccgagcacgcagagaagcccttctcccctctctcccccccatctctactcatcaaatccactcaatctttttcacaagttttttttggaaatcgaagataaaggtatactcctccattccatccttttttttccgttttaatcggttgcatttgtagatcggagggtacccctagaaacccttttaactttaaatataattaaatttgaatcaaataaaaattgatctcattggatttatttttgggttataagctatccttctgggaagtcaaaatatcataaattttctcataggaaccacctccattctttcaacacaatatttttttataaattcaaaactgcacgatgtcaagtaattttactttagaatttatatgttgcaagggtaattataagaaaataatcagcattcaaagcatactaaataagtttatttttcgtttagtatatatacactaaacatttcaataaaaattcacccccacaaatttcacttacattatataaggtgcccgcgcatgtgcgcgggctatctttctagttgctgaagaagtagcaggaaaataaatgcagaaacaccgcgatgagggtaaattagtagggtaccccgttttcatgcaccgtgataggcatgaaacaccaataatgcacacaaataatttaaatgtgtaaattattagatgtgccaattggtacaaataagaatgtttccttatttcttctgctctacttaaaattcatgatggaaacttctctagtcccgttaatccaaatttaaatgtatatattattagatgtgcaaatttgttcaaataagattgtttcattattttttctgctctacttaaaattcatgatggaaacttcactagtcccgttaatccaaagtccaggtgccgagggatgaatgactattgcctctcagatgcgatacgcattgtagatcaattgccaatctagaaacactctggcagaaaatgtttaatcgattctccatgtccctacctcggagcatacattttaatttgaagagagtatgtacgagattatggtggaaatgggattttatatttgcagaaagaaaaatatgttctcaagatgcaaatatgacaaatggtatgtctactgcatgattgacagtacatgctgaaaggatgtctgtttttatcttgatatatgggattaattttatattgattttttcaaagtttataaaacttggtttatgtcttatgatcattccattgatttctttgatttttcttgaaacatcgatactctacttcgatataaggggattccatgctgttgtcaaaactacagtcctgtagaagcatatttacttcatttttctgttttacataacctgttacttgtctcaccgtctgactaactgatcaaggtggagttaaaacaatctggcaaacaaacaaatcatcagcagggagtcatggcgattatgaatcaactcacatacatcacattgtggtactccactcttcaattgatcgatggccattatattatcgatcggatactggctatgaggtcatgtcataacgttcggtatgaaggagagaaagtacttcaagttttccctgtgcagatttcgttccatcagaccatatggaatattttgatcccccatcagttcaacaagcaactaacgtcgcgatgtgtggccatctatcattatttccagatgccttccatgactagacagtgctacctatatacaacacgagaaagatggagagaggcatttgttttcagatcataccatgatttctgaagaactcttccatacaacccatccatctaagcaaacatccaccctttgagtctaagtgtctaagacgatgaagaatgttccttttcctatagcactgctactgttatatcctcatcggtaaaacatcacttatacgatggttggtaatcgtaacatcaaacatttgtacttggacaaaaatttgtcaggtaagaattttacatcgaattcctgaccaagaattgaagagatgaacatttgtacttgagcataaattcgtatgttcaaaacatggtacttctgttctgtactgcaaaagtgctgttgcagcagtcctagttgtaccacgcccttaagaaacactaattcctagtcaatcacttagttcctctatcaaattataccaccagaagtttgagaaagcactgtgtgtcagatgaaatcatttggtagctagaacaaagattcacatgagatatgtagttcggatagagtcatttggattgaaatcataattttccaaacagcggagttgtgggaaacactaaaaagtattggttgaaggggacaatagtgtgtttttctctgtgttcttactcccaggttcccaacacccttctctcgttctccacgcgcacgcttttcaaaatgctaaacggtgcattttttgcaagaaatttctatacgaaagttgctttaaaaatcaaattaatccatttttgaaaaaaaaattactgatacttaattaatcacgcgctaatgaaccgctccgttttccgtgcgtgatatatgggttcccaactagaactaacgaacacagtgtttggttctaggtactgttatgaactttacttgagttgaaataacatcatggctaaatggtacggactgtagtgagttttcaggacattcccaaaatttcggggatttcaaaacgatagttcagagaagccagtgaatataatttcagtttttcatccattagctaggcccaaagcagcaccgcaagtttttcgcattaatgcttgatcccacagctacgtactaagccttctccattgtcaagcacgatttgaaatcaataaattaaaccaacacttcatgacatcaacaatgatgataccttccatgcctaatgcaggtatatataccttcatatgacatgtgcaatatggacattcacaatatggtagagtttcctgagaactcaaaaacgaaacataggcgtacgtcaatgccttcttattctgggaaggacactacttccctactagcagaccgcacacctgttgttgagcaactagcaagctactaggtttcccattatataggtttatcaaaattataattaaaggatttaaagcaggatataccctggtaggaagaacaataactaaattcatacaaagggaatcttatcaccagaaaaatataactttggatatccgcttgtggaggcatcactgtgcccgcacaatcctctgaggttttcaattttgggatgaaaacagagcgatactgatggataatgcccttaccatattcggtttcatatgtggctaaaaatatgacaacaaatagcagatgtaagtctcgatccatcacgagctatactcccataacctcaagtaacacttgcacatgaaaaacaaagcaactctatatccaggtaaaaattttggaccaacttgattcatttcagcacacaatagtatcgcacgcggatagaaaaccatttagaagtcatctacatgaagcaatctagaaaatccatgaaaacaacccaaaaccgactccctcccggattctgccggtctaaccgtcgggttacccgatcagaccgcctgaacacctctggtctgactggcgctcactgtttagtccgaccggcctagtactaaccatattgttcaccgacagaaaaatactattcactgtattttcaacaaacactcaccttcactactggagaaaccatctttgtccggttggccaaaaaccacaatagttctggttgtaataaaaaccgggacgaaagatggtctttagtcccggttcacatgctgttaggggcagtcaggcccctccggtatctttagtcctggttggagtttccatccagcattaaagtttggacctttagtcccggtttgtgttatcaaccaggacataagacccagttggtaacataaaccgagactaaaattcgatgtaccatatataatccctaggacttatcctcccaaactcctcatctcctattcttactctctctttatctttttctttgccttatcctctccttcttcagatggagcttatcctctcctcatctttctttgctgcagatcgagcgagccagcggagggccgcggcggccagcgcccggcggtggcacgcggcgacggccggcggggccatcgcacgaggagggaagcaccggggagacggcagtgggcgggcgccagccgccgaggtggcgggcagcggtgctccctaggcggtggtggaaccataggcgtctaggcgggaggctggcgagttgtggcggacggccagcgcccgatctgtaaaatttgtgatgtggattttttttctgatctgtgcaatgtgtgtggccgatctgttcgacgcgaattcttttctgatctgtgcgatgtgtgatatgtggatgtatttggggatataaagaaaatacagcttgatgtatttcgggattttgtgaatgatttgtggtgttcgaatgatttgtggataattttatgaatgatttgtgttgctcgaaatcatgcaagcaggaaaaaaaagaaaaaaaatcattacttccagttggtaacttcaaccggaacttaatctttagtcctggttatttcaaccgagattaaagatgggcatgtttagtcccagattcgtagtcccggttgcataaccgagactacagggggttgcgaactgggattaaaaagggttaatttctctaccagtgctttgacaattgttcatcaccaagattaggcatcacatgattctacaataaatcttcctatggtttagaaccgtgatggtgaatgaactagcataatccgtatgaatatttaaaatatgaaaactattctataaaagggttctctagaaataagcttacttcctctaaccctatcaataaaagaagccagtgacctttttacttaaaatcttcaggtaagcttcaaaaaattatactatatagtatctcgggcacatgatacatgcgttcggtatcgtggtgccaaattaaggaccaactaatgcgtcctatgtgtttcgacaggacatgttggagatgaatcgccaatattcaatgcactgtagcagcaatatcaattcatttcgtcgcaatctagcttgtatcatatatttgaatgtattatatatctacagaaatatactttctctgtttcacaatgtaagtcattctagcattttccacattcatattgatgttaatgaatctggacatatatatctatctagatttattaacatcaatataaatgtggaaaatgatagaatgacttatatcgtgaaacggatggaggacattgtatggtgctcaggggagctgttatatataccaccttgggagattccagactacatcttgacgccgtgttctgaaaattcgaaagttaattaaatagcagatgtacgttcaccagaaaaattgaattttacattcaagacagatatcaagatacaaaacatttcaagtaattgtacatctacttcaattcaaattctctttacatcagcatccacaatgaatttgaaattgattttttttaatgtttacataactttgcgtgtaaaacatcgattggtttatgtgaaatttttgaaaaatgtcgccatccccgtgctcgaaaaatacacccaagcagacatccattggttccatctgcctaattcatcaaacaagagttgaagcatggcaattgttcaacaaaaccctctttcattcaggagataatatggcggagatgtaccatcgtggttaggcacacaatacctgagccgctgagccctgtgggtgtcattaccagttgctgcagctgtacaccttgctctgccactacggtaaagttatactcttcgaggcacaagggagccaaagtgcttagctttctcgtgtatctttccttccttcaaaccagatgttgtatatcactgtctcccaaggttcgcacacaagagttctcaccctccaggatgggcatactaaaattccacatgcctttcaaacctataatatacctctgtttatcacttgcaagatagagagtggaatttgaattcatattgtggcatacatataatttctgaagaactccatatgcaaaccatccttgtggcaagcaagcaccctgcaactgagagtctgtcgaatggctccccggtagcaacattgcatttatcgtccccagtgaagcctcacttatataagatgggaattctttcctgaacttttgtagttggccattaattttgttgttaggttcgcatatgctactgcgtccattacttcgaaaggtctgagaggcgtcaggcttgcatgcacgctgtgatcggaatggtcatgttcacccaactgtcatctatctatctatctatctattatctatctattattatatactaaaaatctatgaaacttcctacaaacgctcctacgctgccatgtggcactcctagaaatactcctagaccgccatgtgtcattctacaatcctaccgtcgattttcacttaaattggtagacccattattttagaccgttagattatatgcattgttttgtacttcctacatatactaagagaatcagattaccagaaattaagtacgaacgtacaaagatatacctatcggtactgttcgtttgaaaaaaaaaacaactaacgtacgtatacgatgaaaaaaagctatcaagaaaaaaaaaacattgagatattaccattcacgtgaataaaaaaggaacatgcacatgtatgc

SEQ ID NO: 65506 - DNA, 740 bp, Oryza sativa
agatttggcttgaaaaatactttcataaaaatatacatatataactttttaataaatatttttatagaaacaataagtcaaaattctgttgtgtccataacgactttctttacgagtacgaagggagtacaaataaatgaatcaataattataaagttgatataaaaaaattgacaagaaatttatacatggaaagttttttaaaaaatcacaccgtttattagcgcgggagtacctttgtgctgcttcttggaacttggaaggaaacttgagttccaccctttgggagttggggtccaaatgaatgaccttggacggctgaatttcggtggatagaagtcaatccggtccattcttgtggatggattccaaattcaagttcagagtaagaatgagcaggctttgtgtgaacactataaactatttttgcggctgttttgacccccccaaaaataaatccaaacagatcatattcattcatttcattcatcggccatgattcactcatgcagcagttgtgctgttgcttcgaggagcttgctctacttgcgttagcactgtacgggtgactgccgggtgggccccagttctgcggcggttaggtatgggcccaccgtcagtgtcatgtgtgtaccacgtcggggggtgcgtttaaatatggagggaatggacagcattgggggggctctcttggctgcttcaaagttcgaagcactgcacttgtggcgttgaaagttccc

SEQ ID NO: 65507 - DNA, 733 bp, Oryza sativa
accgcccaagggaaatttaatcatccagccctagtatcattgttctgaatctctctacacctgtaaagtgatcaaggaaattaagaaacacggtgcactgatgcatggttcatcaactaactctcagggaccagcgatgatgcagacgtaatatactccatcatgcatgtgatactagcaattctctcttccattcactctctcgtctagtacatttgagttaatcagtcagtttggaatcactttacaacgaagttaatcacagacaaattcaacatgcttaaggacggacaaagatgattatcaaagacattaaactactactctttgtcatctgaggatactgtagttttatactgcaattgcagcaacattatactattaacgagacctgttttgtcattgcgagatccactccaaaattttcaaatgctcgtggttttgcaaacaaattgtaaccgaagacagacatgggtgtcagagctgtcgccgttggaaggtgacatgatcgcagccgtccactccatcggccgctggctaaccaaccaaccccgtccgccgacatgctgctgtccgcctcctgccgacttgttcttgtcttcctcctatgctcttaactctgaattttgttaagagatagaaggacctgtagtaattatttatcaataaaattttatcaaatttgtcatatcaaacatctcgccacatatttcccacaatcagagccctttga

SEQ ID NO: 65508 - DNA, 614 bp, Oryza sativa
gattctttttttttttgaagacacatgacaaagattgctccttgattattcgacttgagtcgtaacatggctaatcagctactgtactagctagagatgtactcctcgatgcttgtccagtttcatctctagaattatattttaggggacaaagagaggatatgctcgtagattataatattattggtagaaagcaactgaagcattttatagtgattggctactctagtatagctagtagtaattgtatgtcttgtgtcgaagaaatgcgtggtcgctgttatggtgtgacatggatcgatcgatcgatcgatcggatcaacaccagcagctggcgattggcgagcatggcggcttcatgaccccggcgtttggatttatcaacaacacatggttaatttctaaagagatattgttcatttactcttaagctaaatctataagatgtagttaaaatttaaattttaaaactgatttgatggttttttaattatagttttatttcttttaataagtgttatagcttataatcgagtgcaggcgaagcgattgggctagcacggcattctcagagcgagtacaatagcatgatacttcctccgtttcaaaatgtt

SEQ ID NO: 65509 - DNA, 1630 bp, Oryza sativa
caaagttgcatgcgataattcacgacttcaacagcctgaagcataagaggtgaagagggttcaatcaactatttcatccaagatagatgagcgatgagcgcgatttatttccccaatcaaatgggatgaaagcggttatataattcaatcaatcaactatttaacgagggaatcatagtcacatccgcttatcgatctctccgcattaagctcgggtcacagcgacacatatccaaccagcacacagagaacacaaacatgcatagaagacagagcagattaaaaaggaagaggctcttcagatgcgttaacgtttactgaatttcatcgcaacagataaaaggaagcaacaatcttttgcaagttcatgatgttcttagccaaaattctacgacatcataaaagacagttgtgtctggaggattgtgtcccgtcgatccaatactaaaaaaacatgccttgcattagcgcaactgattactgatggcgttcatgacgatccaaatcagtccacaagggtgcccaagatgtcatgctctctgaagagaaggtacctggaattccagatgcaaagattattagagcaatggtaaaacataatttatatcatatactgacagcaacagtatcagcataactatcaggaacatacagaatattggatgaacaaaaatcatcataatagatcattttcccactcaacgttcaaccaatagctagcaacagcaagcattctaaatattgaactaccagaagaaagcagcctaaacgaggaagcacgtgtggttcccggttcttcagcaacaccaccaccaagtattcgatcaattcctaactgtagcactcacaagtacttcctctgtttcacaatgtaagtcttctagcatttcccacattgatgttaatgaatctagatagatatatgtctagattcattaacatcaatatgaatatgggaaatgctaaaatgacttatattgtgaaacggagagagtaattactacttcgtacatggtagccataaacaacggtgctatagcatgctgccgatagaggtcatgagagcctcattggttgcccatattcccttattagggaataaaagttaatttataggtaaaacttttatatatttgttcctagcaacttaaaaaccaatgctaaaaagaaattacgttgaaaatatcttaaaatcaacttcaaattcaagtttgaaaattcaaatatatgcttttgctttggcttattaggccaaccgatggggctcatacacattattgtactatgagagcactacaagatctatcatctatgatagtatgcaacgagtggtaattacattgccctagcaatatgccgaaaggtacattctcactaacaagtgaagcaatggagagatagttcacatactctttttcagcagcaagcttgacttcgagtccaccatattcaggcaggagaacagtgtctccttccttgagagcaacagggatcagcttgccatccttgtcacgttcgccagggccaacagccaccactttaccaaagttgagctggattcagcggaacattcagagttaaacaatcaacattagcaaggtgatgcaactagtgtaataaaacagtaaca

SEQ ID NO: 65510 - DNA, 722 bp, Oryza sativa
aaaaggtgggatttcctctttatatatttcactttgtttcacaaaactacctgctgagtataatatggaagtttcaaaaagattgtttaatatcatgtgtcggttatatgaataagtaaaccagtaaggaataaatcaaagatctccttggatgcgatttgtcataaaagtctgctgttatgcggttaagaactttggtaagagattttaaatatttggcaaaatgatcgtgagcatggctgtcctggatttttttttttttgaaaaatttgaggtgtccatcaattaaagctggtaaatataaatagtacatctgtaagctacatcctacatgcactgttttttgaggctgtatggtacatattttgttggttaagagggaatggcgctgttgagtgctcagtggcatctctccttgaaacaggccgatctgattgcgcactaatatgttattggttactgtctcaggttggagcaacaaaggcagagttgttctgcaagacatttgaagaagcccataagaaacttgtatggacttgactcccagccatcacttcaataaccaccaccacgcaaaactgccttgagatctcacgatattgttctctgtgccaggtttacaaagagctgaacctagatgctgctcaaagatttctgaatgcctatgagaaacgatcatgaattatagccagatattgttcaaagatctgcagacgccaaac

SEQ ID NO: 65511 - DNA, 2720 bp, Oryza sativa
catcggttttttacttaaacatcaacacattattttagatcatcaaatcaatcaatatttttctaaaaaaaagaaacatctcaacccttcctccatccccgttcacttgcagtgtgcagcattacttttcacagcttttatatctctatgataattaaaatttaaattatttttatgagcaaagaaaagaccacaaactaatctccacctattaggtctagccaactattatttttctaagtgaaaacaataacttaatgcccatattgactatattaactggtaacaaaaaattacattatgaacccacatccatattgaagcctcttctcaataaaggtaaaatttacaataggacatcccaaaaaaagtataattagctaagagacactgcaagaacgtatatctgctatgggacaccgcaaaaaactggtaattagctactagatacccgtggtattattttgttatatccaaaggaaaaggggagagaaacaatcacgaaagtatgattttgcccctttctgccatgtgcggctcgcatatcgctctaacgccgtggtagtcacgacatgggcggtggagggtatggcagcgtggcgtgccacgactccgagatcgacaacaatagcctgcgctctgtgacaccctactcgacatgaattaaaaggtggtccacgttgtgctcaccccaagcgtggtgtgtggcggagcataagcgccagcatagccctcacactgtagcggcaacaagtgtggaaatgacatggagccacaagcccaggtgcacgggccctccttgaccccctcccccctctctagagagccacctcaccaccggcgggtgctgttgctgcgtcgaagatgtttgcaaggcagacttagtaggtaagggaaaagttatacttttgttattgtctctctctgcatttcctttggatattataaaataatatcgtgagccaccagtagctaattaccaattttttcggtgtgccacaacagatacgcgttcttacggtgtctctcggccaattacatgttttttaatatcctatagcaaattttaccctaaagaaaagaaaatactaaaattgctcactaaaaatcaaaatatcacagctcaattttttataaaactagttgacccattatttatatcctgatagacatctaacgactttctatcaactttttctcagcttatatatagaagctatttacccatacattttgatattgatgcttttatcaataaatgatcacttcaggagataaataaataatcataaaatgatcatagcttctaaattatttatatgatctatgaagtcacgtggccagttgaacaacaaaccgattgtactgggcacgttggttgcaccaaggaatcttaagaatgaaacaaccatgatgtggcctcagctatatataagccaattacagatagaaattaaaagaccatatctatttttttggggtaaaacttcctacagtacatcgtgaatttgtgacatataggatagaacaatctagaaatatgcaattattacatgatattccagtttagtggtaattttctaagaaaatactacaacatctattttatttttttcttacttaattggagcgagataatttagaattgatgcctttaccccatggcaggttgtaggatcaacccacatatattttcattctgacttacagagatcaaagcatttcaaaagatgcttcataaagtggatttatccaaaaaaatggagattaaaagaaatgaaaataaaataaaatttatctaatttaaaatttgtttttgttgggtttataacccattctaaatagaaatattcaaacatttttgcaagactaataaaatgaatatatttaaaatttcaaacagaatctaacaaaaataattggacattcatagggaacacatctattgtttcgacacaaaattttctcatgtattagaaacaacacggtttaaagtaattttagttcaatttatatgtttcaagtaaccagcgttcaaagcacgtcgaattagtttaattttagtttatgataaagtgaaagaatatttttgatagaaaacaatccacacatggacattcgtaaaaaaattttacgcacatgcccgcgcatatgcgcgggataccttcctagttcagttttaaattattggagacggtttatcatttgcctgaaaaatattactcacaacatttctttatgtcgtttagctcatgacctttgaggatctgatttagttttacttcagggaattatcatcttgtttcgcccgttttcattaaaattgaaagggttatattttcactaggaattgggcgcgcatctcacttttgtcattcagtgcactaaaacaactgtattttttttcagtagtgatttaatcaaattccggggttttgcacatcagcagcactccccccaaaaataacatcaatagaaaacccaaaccaaaaccagtactcgctgtaaaattatgcacctcattgtaatttgaacaggggcagtgccatctcaaatacaaaactggagttttagttttgcgttttgtctcgaacatagaacatcactatcccaagaaatagtcgtgagttgctaatgcttgtcaagttccttcctggtagctagcttgaaaattatgcagactattacgcaataaaatttgtgcatataccatgcttgtc

SEQ ID NO: 65512 - DNA, 1308 bp, Oryza sativa
cacatatatctctgtatgacatatgcaatttcggatgggaaaattgaacttatattagaacgtggtatgattttgagaaagctcccaaagaaaacatatgtatggaaaacatatgtagcatgagcctgatcctcctccagcaaaacataaactttataagacggtagtactgacaagaccgttcctcacatggccatataagtgtatatttattttctgaaaatcctcacatgggattcctcactgaaattcatgtttgtgtcgcccgttttattaagggtgagactaatcacggtgaatctggtcgatcgcccataaccacgggcatggctattctaatagttttactctggccagaggtgcacaactgtacccacaagacacaacccaccgccatgtcacgcgcctagccggacacgtcaccatgctgagtgattgtgacaagacccttcatataaccccctctgaccaagcacaccacacctcaggtttcaccccccactcctcaacaggcagtgggcagtcccctctcgtgcctaggtgaatccggaagcgacaaaggccgtcgcagagcccatcccgctccatcacgcgcacccttgcctggatgcgtcagccagaggaaagctatacttcaagtcaggcagttacctattcccgcttgtggcaagcattgtatgtcttccagggtttcccacgaatcggtccaattgccctgggtgtgaccagcaaaaccatgcacccacagcctaccattcagtcacattttagttggataattatgaccaatgaaacatggccggatgtcccgagcacgcagctcgtctagatactaagaggtctaatactgtaattatcccatcaactaagttacccaaggttgacaaaggacagacatcaagtaaatatgacacaagcaagcagataggtaaactctaatcccatgtaattagcaaaacatgcatatttatttgcaaatgataaaacatttgtaaattaggatacaaatgctcaaggggaatgtgtgactttccttgcttcttcaaacaaatcttctggactcttttcctcgtgaccgcggacttccgaaatggcggaatctactcgctgacatgcaaaacgaggaaaaactcaaataaaaaccaagcaaacaatacataaaatgtaaacaaacatgtagagctcaattttagatgaattttgcaagttgagttgctcaatttggagttcgaatgaatttattatgaatgtaagaatttttgagcaacataaatgaatttctagaattattatcgaattattgtgcaa

SEQ ID NO: 65513 - DNA, 16556 bp, Oryza sativa
gacttctcttcatgcacaatttgacggctggcttggatagtggcctcaatgtccttacgttctcgccgttcagctatgcttaacttggctttctccaggttgaattggtgttgctcaaggtaaacggctggagtaaggatatcggctaactcatctaggattaaagcctgaatctcgggtagctgagccctgattgagccacagtcaaccactaagttgtctagcgatgatgcttctagccgatctaaaatgcttccttgagttttcttcacatcatcagataaaggagccaaggctttgcttgtggtatcttcttctccttcatcaagatagtctctgatgtcaaaagagaaaagatcggctaatacctgcagtgacaatttagaagcagattagaggttaaacgattatagccgatttgaatgcttcttatgataaaagaaacttactgggatagcaggagcagctggttgttcttcttcctcgatgtgatgacttcccgcagctaaaggggtatgatcacttgatgattgttgaacaggaggagaaggaggaggtgaaggctgaaaggaaacaagtgtcagatagaatcggctaaaaattaactaatgaaagttaaaactatcttactggtggagctggtttagatgttgttgcagccgatttcttcttcaccgcagtcttctttttctacaattataagacttggtaatgatcggctataagacaaaataatcacgaaagggattaaagagagacacttacccttgagaagtgaacaagagcagaagtgtcacgcccggaatttctatccaaaattccaaacgcttacatgtgtgtgaaccctcgtccaggaatcagccgaggcacacaataacaaattgataatacagtacaaatattactctaattaataagcgaataaaatgtcattacagaggtagatagttcctctcaatcaataaagttctaagcagcggaaattaaataaacggcgcagacggctccactccacaggcagcttgaccaaggctacacctaatcctccacaccatcagcctcattgtagaactcttcctctgatgaatgattgcaaggtgagtatatgacatactcagcaagccacgcagcaaatatgcaagtgcacaggataacaaaggatggcataatagggttccatttgcaaaagcagcatttagcaaacatttgagaatttaacaaaacagttaagtaataattaaacaatattaatccaacgctatacaacataccctgttgtataggcccaaccattctgaacaaccaccccggctgcacagttctatctccaaaccaggaatgtaccattccaaaccaggagctaatcaaattattaccagttatagcatctcttacaatgatgagaggtgtgagactaatcacgaaagacattgttagacccgcccataaccgcgggcacggctattcgaatagttttactctggccagaggtgtaccactgtacccacaagacacaaccccacatcatgtcaccatgtgcctcaataccaccacggtatctcggaaaggagttgtgacaatacccctcgcataacacaatccactgcagcgcaccttcctggatcataatcacccccttataaacaaggcatggactccccagcgacccccgtgggcttatctccgccacttctcagtctggtgccccgcaatgaaccatgctatacaaaagataaagccgttgcccatgctggcttgtggttggcacgataaatgtttcacaaccgaaactcgtgaaccggtccttaattgtcatgagcacgaccatcaaaaccatgtgctcacaacccaccattaccaggttttagttggcacattaattaattaactaatcacgattgaccatcgtgaactatcaataagccatcatgaaataatagtgagtcattagttatcccataagtgtactaaagtttctaagcagggctaagcaattatatctaatatctagttgaaccaatataaataaaactcaactagtcaaattaatataacccaaggtatcaaggaatatggtaatcaagtacgaaagggccataacaaagaataggtcaattccacccaatgacattcaaaaatagatgcaatagttgaatagaaacaatagctttaaataggatcaacatgctcaaagggttgtttgggatctgtgtgacttgccttgctggccttggaattcttcaaactcttcttctgcgaaaacggactctccggaaacgacggaatctaagcagaaaagagcaaaatcaccaaaacagcacataaacaagcatgaacagtacatgtggatatttttaatgtgtagatctcaattttagaaaaatttagagacttgaaccaactaaatcggagctaagatgaattagttatgaatttttaaagattaaatcggattaaaacacttaaatcggttaaaattgaattatgacgcaataatgaattatttttgaaaaggaaaaggggatttattgcgtcagcggctagggtttgggtggaccggcgcatgggcggcggttcacatgaacggacggccgagattgatccgatccaaatcggatggccgagatcgatcggtccacgaccggctcacgggagaggatcccgatgacgtcaacgatgacatcaccgacgacggcggcggctcggcgaagaagacggctcaggcggcggacactcgccggcgaacggcggcaccacggcaccaacggagggcaccagcacgtagaggacaacgcggcgaacacaccggtgaccaaaacggcggcggaaaaggaacggacgacgacggcgacgagaaggaagcggcggctaccttcgggttgtcgacggcgacgaagctccggcgggttccgacggctgcgaaggggcggacgaggacggcggcgacttggcgatgacgacggcggtcttcccgagcggcggcgacagctgaagcgacggcggagcacggctgaagcggcggcggcgacggcgaagctagggcacacggcgctagagctcttccggcgacgagaggtgaaggcgagggtggcggcgagaagagaagagcacggggatcctttaaaaggggctcggaggcggcggcgaaggcccacggcgacggcaacggcgaaggaaactcgcggcttggagagagggaaaaccgatccgaatcgaactcgtctccgacgctttccaaagcgatttaaccaaagattccaaaggagaaaaggtagaggagatcccggagatcatttcccctctaacaaatcgaccggagaaggaaaggaacggccggatttggaaaggaaacggcggcggcgcgaaactagggtttcgggcggcggcggccgaaggttgacgacgactgacaggtgggccccacctgtcagcgaccgaacgcgcgcgcgcggctgcggactgggccggctgggccgaggagagagagaacggttttgggccgactttcggcccaaagccaaaagaagactttttaaaacctttttcaatttaaattatttcttaaatgcaattccatttattaaaaatacttccttagctcaaataaatcccagaaaaatctaggaattatagaattaagcaaagtatttaatgaaattttatctggccccattttatattggaatttattaattaaaattagatcttcttctcaagactttttaaaattatttctaaaaattccatttaaacaacaatttatatattttgaattttcagggtgtgacaagaaggagttggaggggtttgcttaggcgaagccgatggtgttcttttagtatcacttaccttggctgcggcctgatcaacctcgtcttcaattacctcttcatccagagcttgttcgatggatggatctagggtaggcagatcatcagttggcttggttttctttgtcttcttcttcttaattggggatacgatgcttacagccgagatctggttttcctctttttgccggcatcggctgattctctgacgagcccttgaagaagagctaaggtcttgggggcatcatagccgataaccggaggagatagcccacctccgttaggaattaaacctggggcatattggatgtctttgccactgttgctttgatgaggaggggaagattctgttatctgcaaatcaaaaggacgattagttgagattaattggccaaacagctatttaactaaaattgagcaaagttgaagacttacttgacggacaacatctagaaagaggtctgtcatgtacattgaagctggttggtggaataaatgcagtttccattcaccctgccacctgtcaaagcttttgcttctgaatgttgccagttctatgttgttaatactgcccagagggggtccttgaaggctaagtagccgatccatcatcagggttgatgaaatccctcctcggcattggatcttgtcagcgaagaataagccgattgggagttggcccattccgagttgtctagctgagctcattggatgatagaattcataagaagcttggatgtttcttccttgatgaatgccaacaggaaggatgcatgggctgattgcagccgagaagatttccctggatgattggtatacttcatggttgatgtctttgaatctgaagtccactgggtgttcaagttgtgcagagtcttcataaaggaaccagactctagcatctttttgaaagctttcatagaagctacaaaaccaatccttgagcagttcagccgatagttttgctccggcatcagttggtgtagaagcgtattctccgtatgatgtgcatctccgatgagtacgctcttctccatcatcccctacaatcggctctagtcttgggaactcagcttctgatacggatggccgattgacaaccttcatgactatcaggtttaaccaggtttgtagcagccaccagggtccacctgctccaactactgagccgactgttatcttagccgatgcattgctcaacatctggtatagatagccgaggagaattttgcccaaggggaattgtctctttatttctagagcttcagccagaaattgccagttagttgtggggccgcaacttgatccacagaaaagaaatttttctagccacattaatagaaaggccacatgttctcgaggggtgaccgagccctggcccatgtatgctgctacatagcctgaccaacctcctatgcttttggttttgaagtcatattggttctttgtgttcaaactcatagggttggccgatgaggtgacatccagacctatgatcatactgatatctatgaaggttggagtcatcggcccttgattgaatagaaaggcgttagtagtgtttgaccagaagcaagaagcggctgccattaggggttcatctttggctgagtttgctatagtaaggtcaagtgtttggccgattccaatttcatcctagtgaaccttcttgctagctgatacacgtttgaaccatgtggtccagctcttttctggtggaactttctctagagatggccaagacttgaaagtattcttccagtgatctagatctgggttggttaatctaaaggggattctattggtttcaccaacaataaactcggtggggtcaggattgccgattgggccgagaaaatagtggttttcatgcgtcagactgggaattgcgacttggtgagaaagatgctacaaattcgaagcaaccaaaagaaggaaagcgatatgagataagagaagatcgatctgctgctaaagaaggggatttagccgatgagaacttacctcagcgtattcggccgatggtgcaccagatgggctggcagaagatgacattggtgcgggcggagatctcgtcggggaggaaatcgcctaggaatcgcctttgcgccagaggaatcgccgaagaagagagagagaaaacggaagtcacggcgtgagatttctcgggggtaagggttagtatttaaagtgctggaataatggtcaaaagcggcagagtgcgaaactcgctcggagtcggcatacggcaaatccggaacattatcgaatatcccggacttggggggcatgtgttaacaagcaaatttggtaacatctgtgttaggaaggaggatttaatcaaagcggagtcggaggcggagatcgagttcggaagcagagcaggaatcggctggaatcaagatcggctacggttaggatcggttgtatctgagtcgggctaaataagccgatatagccgattctgacaatacaacttgtacgcgacatcgggttcaagttaatgtatttcaagatgattgccacgcacggagagagtcttgggaaggcaattgtatctattaattaggatatcttatgtaaattccttatagataaatgtgggcaaaagtctgccgcaaagacttatagtatcttagagtttgttagagataatgatcatgtccggtatgggcatatcatgtaattctcgggtataaatagaccctgagccctatgtaattttaacacacacgttcaatacaatctcggcgcatcgccacccttttttgctttagttttgtttcgactagttgttgctttcgggttgagctgcatcgatttcgatcttcagcaagaggtaaaattcattatgatagattgcgttcttaggattagtacttccatctttatgatactctaatcttgtgtatgtaattcgtcgagttatcatatatcttacataatctctagcaatatcatcatgtaacctactgtcgtctaacatctgttgatagagggcagccgattaggttaaatctcgtcgttgatctagattatataagatatctaccattctatgaaacttctagcgacttgattgtctagatatcgttcttcttttcatacttaatgctgcttcagttgagtttgatctattaagtcgtgcttagaacatcgatctctagcctgccttctagttgccgattagaatagcatcggagtttcagccgatcgtatgtgatttaactatatttattctatatgtttcattgatatgttaaatctgcactttatatcaagatattgccgtatctaaatatattaagcctttgtttgatatattatacctactttaatatcctgatatagagttgtatcggagtattagccgatacatgctagatctatctgatcggctatgctataaacatatatagtcttgttattaacatatattttgatctaagtgatttatactttctcggcatgatgaccgatctatcccaatcacttgatttaagtatacgtcgatataaggagtatatattgttaatatctacagccaatcgagtagatttagttcttccttatttattcatgactgccgatcggtacacagatgacatcggcccaaagataaatgatatgtcatcggcatttagccgatcggctatcatttatagatttaaccacggtttctttgcttctatttcttgttgattacaggatcaaatcaactggcacgctaatacatccgaaggcgagctttcgacctgcactggagttaagcagatctcccaggccacgtgttttctgtcaacagatggtacacatatttattaattctaatttagtacttacttatttaagagaataaaaaccaaagagtttattagcagtaaaaactgttacaacgtaaggtcatgataacatatcaaatagatcacaaacattttttactgacggaatacctgagtggattgcaagctaggaacactgcatggattaattgtattccctccgtcccaaaataaatcaacttatagagtttaaactttgtcccaaaataaatcaacttctacctttttcatccaccctagtgctttggtttcgtcttcgacttctttggatgttggtgcttcttcatcgaagtcttctgttcttgctttatttaatgccatgtccgatgataaactcgaacagttcgaggaggaggatttggttttgttatctaacaaattttctcgagctatgaaaaatgttaggaacaggaaaagaggagaaccgaattgttgttttgagtgtggagcacttgatcatcttcgctcacattgtcctaagcttgggagaggcaagaaggaagatgatgggagagtcaaagaggatgacgtgaataagaagaagaacacaaaggagaagaagaaacattgcatgcagtggttaatccaagaaatcataaaagcttttgatgaatcggaagatgaagatgagagcaaaggtaagcaaattgttgatatagcttttattgctcgtaatgcaaattctgatgttgatgaatctgatgatgataatgaagaaaagcttagttatgatcaattagaatatgctgcctacaaatttgctaagaaacttcaaacatgttctattgtgcttgatgagaaggatcatactattgagattcttaatgctgaaattgctagattaaaatctttgattcctaatgatgataattgtcaatcttgtgaagttttattttctgaaattaatgctttgcaagatgtcaattctgttaattgcaagaaattggaatctgagattgaaaaatctaaaaaattggagtcttcttttgctcttggatttgctttacatgctcatgttgttgatgaattgattttgacaaagaatattttgaaaaaatacaaagttgctttttgtacaagttctttgttcaatgtttcatgtgcaaaaagggctaaataaaatgagggtgttttgatttctcaagattgttcaaagtgtgttttgaatgagttgaagttgaaagatgctttagagcgtgttaaacacatggaagagattgttaaacaagataaggtgttttcttgctcaacttgtagaaaacaaaaaggtcttttggatgcttgcaaaaattgtgctattcttactcaggaggtttcttatttgaaaagttctttgcaaagattttctgatggtaaaaagaacctcaacatgattcttgatcaatgcaaggttagcatacataatcgtggtttaggttttgattcttatgcttatcatactagacatcctcctactattttgggtgttgctaggagagatgaaattttgattgaaactgagcctaagaacactatgtttaaatctgctggcatcatgtcttctttgaatgcatcttcttcgaaatcaaatgttgtgaatgcaaaaacttctattgatgcaaaaccatcaatttcaaaaccatctacttcacaaactagtcgtgagaagtacacttgttcttttttggaaaagacggacatttggttggtttttgttttagacttgcccataaacagaaaaaagaaagagaaatagcttttgcaaaacgacgttggcaaaaatcgggttttaattcgaggatcacggttagaccgacactgaccagtcggtcagaccggctagcggtcagaccgcagttgaaccggcggtcagaccggttgccaggcccagtcagaccgcaggtacagaggcggtcagacctgtttcagggcaattttgcgcgtaattcaaatcggacttttgtgaagcgaaaaggtaatttttcaggtaagtctgattctgattttgtcagtgcttttgtatcacaccctaaaaatcccaaatatataaattgttgtttaattggaattattagaaaagattttaaaagcctagaagaaagggtctaattataaataataaattccaatataaaagtggaccagataaaattttattaaatactttgcttaattctataattcctagattttttttctaggacttatttgagctaaggaagtatttttaataaatggaattgcatttaatgaataatttaaattgaaaaaggtttttaaaatcctcttttggctttgggccgaaagtcggcccaaaaccttctctctctctccccggcccaagccggcccagtccgcccgcagccgccgcgtgcgagcgccctcggacgctgacaggtggggcctgcctgtcaggtcgtcgtctacctccggccgcccgccgcccgagccctagcgctgcgccgccgccatctccttccaaatccggccgcccctttccgtttccgatgaaattaatagaggggaaatgatccccgggatcccctctatcttttctcttatggaatcgtcggctattttcgtttggaaatccgtggattcgatctcgaatctgattcgtctctctccccgaaccctagaccttccttcgccgtcgtcgtcgccatgggcctccgacgccgcctcctagccgctataaattgacccccaagcccgccgctacccgccgccaccctcgccttcgcctctcgtcgcccgtagagccctagccccgtgcagcctagcatcgccgtcgccgccgtcgctctagccgtgcgccgccgttgcttcggtcgtcgccatcgctcggggaggtcaccatcgtggtcgccaagtcgtcgcagtcctcgtccgcccctccgccgtcgctgtcgaccgccggaacaccgtcgccgtcgtcaagccgaagagcgccgccgcttcttcctcgtcgccgacgtcatccggtcaccgtccgtcaccggttaggtcatcggtgagttcgccgcgtcgcccgcatcatttcggtgctctccgttcgcgccgccgcgccgtcgttcgccggcgggcatgtgtgcccgagtcgtcgccggtgatgacgtcaccgctgacgtcatcgtcgtcgttccccgtggcccggtcatggatcgatggatcttggccgtccgttttggatggatcaatctcggtcgtccaatcttgtgaaccgccgccgcgcacccggtccaccgtaaaccgacccgctgacgcaataaatccctttttcctttcaaaaataattcattattgcgtcataatttaattaaaatccatataagtgttttaatccgatttaatctttaaaaattcataactaattcatcttagctcagatttagttggttcaagtctctaaatttttctaaaattgagatctacatgttaaaaatatccacatgtactgttcatgcttgtttatgtgatgttttggtgattttgctcttttttctttagattccgacgtttccggagagtctgagtttgcaggagaagattttgaagagttccaaggccagcaaggcaagtcacacagatcccaaacaacccttttagcatgttgatcccgtttaaagctattgtttctattcaactattgcatttattttcgaatgtcattgggtggaattaacctattgtttgttatagcccttttgttcttgattactttattacttgataccttgggttattataacttgactagttgagctttatatattggttcagctagatattagatatgattgcttagccatgcttagaaacattagcacactattgggataacttattactcactattatttaatgatggcttaatgatagctcatgatggctaatcatgattggttaattaattaatttgccaactaaaacctgataatggtgggttgtgagcacatggttttgatggtcgtgctcatgacaattaaggaccggttcacgagtttcggttgtgaaacattaaccgtgccaaccacaagccagcgtgggcaacggctttaccttttgtatagcatggttcattgcggggcaccaaactgagaagtggcggagataagcccacgggggtcgctggggagtccatgccttgttttataagggggtgattatgatccaggaacagtgcgctgtggcggattgtgttgtgagaggggtactgtcacagatcctttccgaggtaccgtggtggtattgaggcgcatggtgacatgtcatggggctgtgtcatgtgggtacagtggtacatctctagccagagtaaaactattcaaatagccgtgcccgcggttattggcgggtctaacaatgtctttcgtgattagtctcacaattctcatcataataaaagatgctataaccagtaataatttgattagctcctggtttggaatagttaattcctggtttggagatagaactgtgcagccgggatggttgttcagaatggttgggcctatgcaacagggtatgttgtatagcgttggattaatattgtttaattattacttaactgttttattaaattctgaaatgtttattaaatgctgtttatgcaaatgaaaccctactatgctatcctttgttatcctgtgcacttgcatatttgatgcgtgacttgctgagtatgtcatatactctccttgcaatcattcatcagaggaggagttctacagtgatgctgatggtgtggaggattaggtgtagccctggtcaagctgcctgtggagtggagtcgtctgcgccgtttatttttttttctgctgcttagatctttattgatcgagaggaactatctacctctgtaatgacattttattcgcttattaattagagtaataattatactctattatcaatttgttattgtgtgcctcggctgattcctggacgagggttcacacacatgtaagcgtttggaattttggatagaaattccgggcgtgacattttgtacctactggttctactggtcgtgtgactcagtgttggattccaaaatttcttatttctaaccccaacatggaggcctcgacatcttctcgttcgtatatattttggcagcatactccccatgagcgttcaattttaagatgacgattgcttttcaaggtaacatcaatttacatttggattgacatatattttgttctactttcttaattattagcttttcatatgctagtgtttgaggtagtagtttttgttaatactagtggatacatatcaattcatgagaactttggtgatatcattggcaattggatgtctttttcaaaatctttgatttcttcttgatttttgtttggggagaattggaggttaatttgagggggagtttgtactttttcatgcattcatgtttatttttatgcattgtttctaaatctgaaaataaataaaaataagaaaaagaagagctttgttttatacctttaatatattcttgtgcatgctagcaaaataattgaggtatatttgttgctattttagcttgtatgcattttagtctttatatggggcttagatattgcttttaagtgagatgatgcatgacactaattcttttacttgaattaagaaaatatgcaatattgatgctagcatatggtttgatttataaatgcttatgtatatgctttgtaattgctcattgtgaaaagagaataaaaatgtgaaaaaaatgactaccgaatccttggaaacagtctttacgacaaggacgtattcgatgtgagcaaaaaaagggtgccgaatccctggaaacagtcttgacgacagggacgtacccggaataaaagaaacaaatatgagcaaaaaggctcaagaaaaagtaaaaaaattatcttgattgttttgtgctaaagctaatttgagaaagagtgataaatgcaataggtatatatgtatagtgtttatttttcaacctatgtgcttgtgaatatattgcattataaatcatttgaaatcatgaattcttattgttgatttgagcttaatcgtaatatttttgattcatgtttatactatgaagcatgcttgttaactagttgatgaatttatctaacttatattgcaaaacatgatcttgaattgcttttggtacatttcaaagctctcgaaaaaaattgagaaaatataaaaaataaaaaatggttattccaagtgcaatcatgacatcattgcatttgtactttattgttattttttctcttttacattcttgatgaaatcattgtcaaagggggagaaatatacaaaatgcatacttcttgaaagggggagaattgaactttgtttcgattttaaaaaatagtcgattttgtgctttgattgcaaattgatgggagaaattctttcttttaaaaagggggagagattttctttttcattttgtgatttttgtttttatttttcaaaaacacaaatttgcattttggagatattgccaatgtgttcatcaaggggaagattgtgaaatcattgtcatgattaatatttgtgatgaacaattggctgtgcaaaatgatttaatcaacgaattggtttgaaaagacgtgtggatgttggtgtgagtgcgtgtgactaatgtgggtcaggttgtaatatctgtgtccagaaacggttgttttgtctgattgtgtgcaggtgacttgaggtcagccttggtcaatggtgaggaccgggactatgctcaggaaggagcagaggtctagtgcggtcgggataccatgtgagaaggtgactagagttatgattcttggaggtcaacttcggtcaacggtagggatcgggactaaactcagggaggagttgaggtccaaacggtcatggataccaggtgacgaagttgaatacgagatggcacacggtggatggataccgtgtgggagagatcttcgcaacgggcttcacgaggtgtgcgtgcaagcgtcggtgttcacgaggaggaacgagagaagatagagatgttcatgtacggtggagtacatggttgctacagtactcgatgtactgtagcgtgtagtttgcatgtacgtgatgtacatgtgtgcaggtagcatgcatgtgtgcatggtgtatgcatgccgtgacttggactgggaggagcagcagcggctcggttggatggcaggccgagaccgagctggcgaaggatcggtacgaaggagtccgaccccgagcaggaaatggcaggcgcacgggttggttgctgctgtgtgttttggaaattttggattgagtcccattagaaataggagttctacacctactttaattatgggttttttttataaatagagagagagagcgtgaggtttccggtatcgcttttcagagcgtggagttgatagtttagttagggtttcgagattagtcgagatttttgtaaggagtgctgttgttgcactttgtaaacacagagagaagaaataaagttgtcatctactttgagagttattcgatttgtgtttcatcggattcggcggtctaaccggtgacataccgacggttcaaccggcgacaagacggcggttagactggcggcatacgagcaatccgaccggcggcgacaggactacgtcgagatttccatcgatttgagggtaacttttatttccgctaaaagtttttgggtttttcgttttccctaccattcaccccccttctggtaggtttggttgcttgtgttcgatcctacaagcatgacacaaaaagatgatgggcttctaatggcccatgccgttgatcattaaatcagcagatgtcattaaagatcaatggtaatgatggaataattttctaaataaatcgtcagatctttctagttaacgtgagagctttctcaaagttcagggtccaagaagaaagttgatgatgatctccccccttattgacgaatcaagtcatggagaaagaaatcgatgaagctgttgctaccatgagtgaagaagaacaagccgataaaaaacatgcagcaaccgatcaagatgaagctatcaacattgatgaagacagtgaatctgatgaccaacatccattgcctccacgcaagcgtagagtaactcgcaagaaaccacaccaattgcctcagcaagattttctgatctcatcaatttcaactttccaaccagaactgcttagccgataacaatttttatacttgtgagcaatcctctgataagcaatcctgaattcttcgatgagcgaatcaataatcatgccactttttgttatcttgaaaccgtaggaaaacgtgtccattagcttgaacccctctccctccccaagctatggactgggcatctcctcgaagaagtccaaggaacactgagcatattggaggcccttcgatcaggacccctctaaaggggaaaagactagccaaagcgcaacctctagagaggactgagaagaagggcacaaagctgtgcattgtagagtcggatgaagatgaatatccttcacctggtgcaaagcctgcccaagagccgagcgccgatgcagcccaagattcgaaaagaactcaaacggcacccagactgaacagggcaatcccaaagtttagggcctcatctaggtaatcaaaacaaaacttggcttcctgacctatcaaattgttcaaatgctggtgaatgatgtcaatgatgactactcgtgattaatccttattgaagatgtcatttacataggattctatccatgtgacaactttttgcaggaaaccacaaggcattgatccttctagcaagcctaaacctttctgggaaaactagttggaaaccactagggaatcgactgctgatgaagagccctcgactggttgccagtcaggttcgaccggcga

SEQ ID NO: 65514 - DNA, 15698 bp, Oryza sativa
tttggaacgagcgcgtcacgccgcatgtaacgcagtgcagcgcgctcgtttatccggtctgtgaccggtcacagaccggtcagattgcgggttaggtggcaacaggcgatctgacacacgcctcgccccatcccgttaggatgagagcctctaggcactcgtccctagccggagccagcgtgctagctcctggagatggcacgttggtcccggtcagatatataccaggcttcatcccaaccattgcaagaaagacattgtatgaagaagggcagacatgcagtttgctaagctgacgcgtggaggacaaaaatgactggtttgtcaccgatctgacactggtcatgtcatcggtagacaaccgcgttcccacgttgaacctgcttccggcggagtggaggtaggtatgggccgtcccatcagaaggtcattcggacagcagccattgcaagtctccgcccatttatgaagggatgacagggtgatccccgaggtcagacgagtgaggacgcgtggccacactaaaaaacaagcttccaagagaaggcgagccaagttttagtaaagataggatgggtccccacccaaaagaaaaagaggtagaagtggtgcatgtggtatccccttgagatataaaagtctcgtactccaccgccccctccacgccaaagtcctaagcggggggaggcgctcgagagggtcgaaagatccgcgacttcaccgaccgcgggcgatggagaagaacggcgagacggggagcgtcgcctcctcgtctacggcgatggcagcacgccccagggcgcgctccaggctgcaggcgcgctcctacgtcacccgcccgtcgtccccgatccggagtctccagcccagcgttggctggacgacgtggccaacttggtcatgacggcacggcagcgcctaggtgctggtgggcggtcctccgccactaagacctctggcgctgctaccaccggctccatgtcgtcaaggcggagggcgcggcgagcggcggccgttgctcgccattcggccgccactccctcgtcagcacctccgacccgggaagatcagcgtggggggccggatgcccaccgcggctccgaacgccggcgtaatggtcgacatgctccccatgtaacggagggcgcctcctcgtccggagtgtcacctcagcacggacgcggggatcagccctccgtgcccccggttggtggtgtcggctgtagagcctttgtggcgagccttcggaatgtccgttggcccccaaggttccggcccaccatcaccgaaaaatatgacgggagcgtcaaccccgccgagtttctccaggtctacacgaccgggatcgaggccgctgggggtgacgacagggtcatggcgaatttctttcccatggccctgaagggacaggcgcggggttggctaatgaatttgtcacccgcatcggtccactcttgggaagatttgtgccagcagttcaccatgaacttccaaggcacgtatccactcccaggtgaagaagcggacttgcacgcggtacagcgaagggatgatgagtcgcttcgctcgtacattcagcggttctgtcaagtccgcaacaccataccatgcatccctgcacacgcggtgatctacgcgttcagggggggcgtgcggcacaaccgcatgctcgaaaagatcgcctccaaggagccccagactaccgcggagctttttcagctcgtggaccgagtggctcgcaaggaggaggcctggacttggaacccctccggttccggagtggcagcttcggccgcccccggatccgctgctcggacagggcggcgtgacaggaggaagaagaagaggtcagtccattccgacgacgagggtcatgtcctcgccgtcgagggcgcttcgcgggcgacccgaaaggggaggcctgcgagcgacaaaaagaaggaggccggcgctcccagcagggagcgcccaaccggcaagtggtgcaccgtccacaacacctccctccacgacctcgtggactgccgcgcagccaaaagtttggctgagcggacgaggaagtgggaggaggagaggaggcaggagcgccgagaaggcaagtccccggcggttccctctggcaatcagcgaagtgaggccaagcagaaggcccccgccgaggacatcgatgacggcgatgatgacttaggtttccaggagcctggggccaccattgccactgtcgatgggggagcgtgtgctcacgtttctcgccagagcctcaaggccatgaagcgagagcttctggccacggcccctactcatgaggcgacgcgtcgggcgcggtggtcggagattgccctcacctttgaccagaccgaccacccaccgtgtgttgcccgggaaggacagatcgcgatggtggtttcccccaccgtttgcaacgtgaagttggggcgtgtcctcatagatggtggggcagccctcaacatcctttcccccgcagcctttgacgccatcaaggccccggggatggtgctccagccgtcccagccgattatcggtgtaacgccggggcacacttggccgttaggtcatatcgacttcccggtcaccttcggtggatccgccaacttccgcacggagcgggtgaacttcgatgtggcggacctcagtctgccctacaacgcggtcctagggaggcccgcgttggtgaagttcatggtggcggtccactacgcctacctccagatgaagatgccgggccccggtggccctatctctgtccatgacgacctcaaagtcgcgcttgcttgtatggagcagcgcgcggaccacctcgccgccgcgtccaagcccgagggtggtgacgagaggcttggcacctccgtccccgccgccccgaggcagcggatgatcacgtgcgacgaggtcccggtcaaggaggttgccctgggcgacggcccgtccaagaccacacggatcggtggtcttctggacggcaaataggaagacgcgctcgtctccttcctgcgggcaaacgctgacgtcttcgcatggagaccggcggatatgcccggggtccccagggaggtgattgagcaccgtctcgccgtgcgaccgggcgcaaggccagtccggcagaaagtgcggcggcaggccccggaacgtcaagccttcatccgtgaggaggtggcgagactactggaagccggatttatccgtgaggtcatccatccggagtggctggcgaacccggttgtcgttcccaaggcaaacggcaagcttcggatgtgcatcgactacaccgaccttaacaaggcatgtcctaaggacccttaccccctgcctcgcatagatcagattgtcgactccactgcggggtgcgaccttttgtgttttctagatgcatactctggttaccatcagattcgcatggctagggaggatgagaaaaaaactgcattcattacccccataggaacttattgttatacgacaatgcccttcgggttaaagaatgcaggtcctacttttcaacgtactactcgaatttctttgggtagccaaataggacgtaatgttgaggcttatgtcgatgacttggttgtgaagacacgcaaccaagaaactttactttcggatctggcggaaacttttgagagtctccgctccgcccgcataaaactgaaccccgataagtgcgtgttcggtgtacctgcgggcaagcttctcgggttcttggtctctgcccgaggcatcgaggccaaccccgagaagatacgagctatagagcggatgcgcccccccagcaagcttagggatgtgcaatgcgtcaccggttgcatggccgccctaagtcggttcatatcaaggctgggagagaaggcgctaccattatttaagctcctcaaacgctccgggccgtttacctggacggaggaagctgaacgtgccctcactcagttgaaggcgtatctcagctctcccccagttctggtcgccccggagccagatgaacccttgctactctacttagcggcgaccccgcaggtagttagtgcggcgttggttgtggagcgcgatgaggacaaccctcattccgcatatccccaccctgtgccaactcaacccgggagagagcagggaggagaggcccccgagccgaacggtggcccaaggcccccgacgaccggagttggccctctgcccgcttgtcaaacggtgccgggtgcccccaacccccaggatggcccgagggccactgtgggaaggccgcacctatcgccctctgaccccgaggttaaccctgtgccgacccgacccaggagagagcagggaggagaggcccccgagccaaacggtggcccaaggcccccgacgaccggagctggccctctgcccgcttgtccgacgacgccaggcctccccgacacccaggacggccccgaagccactgtgggaaggccgcgcctgtcgtcctccgaccccgaggtcatcggcacagaagacgagtgcaccccgcatggcctcttggacgaagagtgccccagggatgcggcccctggcgaagaggatcggccccgccgaaaggtgcagcggcccgtctactttgttagtgaggccctccgggacgccaagacccgataccctcaggcccagaaaatgctttacgctattctgatggcttcgaggaaactgcgtcattatttccaggcgcatcgggtcacggtggttacgtcttaccccctcggccaaatcctgcataatcgagagggtacaggacgggtggtgaaatgggcaatcgaactttctgagttcgatttgcactttgaaccacgccacgctatcaagagccaggccctcgccgactttgtggcagagtggaccccggctctcgaacccgtctcagaccccgaggccagctcgagcccctcgcagccgcctcacaccacccactgggtgatgcagttcgacggctccctgtctcttcagggcgctggtgcgggggtcacgttgacctcgccgagcggagacatcctcagatacctggtccgtctcgactttcgggcgaccaatattatggcagagtacgagggactccttgcgggactcagggtggcagctggactggggatccgccgcctcctggtgttaggcgactcccagctggtcgttaaccaggtctgtaaggagtaccggtgctctgacccgcagatggatgcttatgtacgccaagtgcggcgtatggagcgccatttcgacgggatagagcttcggcacgtgcccaaacgggataacacgattgccgacgaactctcacggctcgcttcctcacgagcccagaccccaccgggcgcctttgaagaaaggcttgcccagccgtcggcgcgacccgaccccctaggggagacggacgcgcctgaccggcccccgaggcccgtcggagtccaggcctcgggacccgaggggagcgttcccagctcccttagattgattgcttggatcgctgagatccaagcatacctcacagataagactctacccgaggaccgcgaagggagtgaacgcgtccaacgcatctccaaacgctacgtgctggtagaagggaccctctatcggcgcgcggctaatggaatcctcctgaagtgcattcctcgggaacaaggcgtcgagcttcttgccgatatccatgaaggcgaatgcggagcccacttcgcctcacgcaccttggttggcaaagcctttcgccagggtttctattggccgacagctctcaatgatgtggtcgacctggtccggcgatgcagagcgtgtcaattccacgccaagcaaatccatcagccggcccaggccctgcagatcataccactttcatggccatttgctgtctgggggctcgatatcctgggaccgtttaggcgggccccgggcgggtttgagtatctgtatgtcgcgatcgacaagttcactaagtggcccgaggcttatccggttatcaagatcgataaacactccgcacttaaattcatcaagggcatcacagcccggtttggggtgccgaaccgtattattacggataatggcacccaattcactagtgagcttttcggtgactactgcgaagacatgggcatcaagctctgcttcgcctcccccgcccaccccagaagcaatggccaagtggagcgcgccaatgcggaaatcctcagaggccttaaaaccaagaccttcaacatcctcaagaagcacggcgattcgtagatcgaggagttgccagctgtgctctgggcgaaccgaaccacaccaagccgagctaccggggaaacgcctttcttcctcgtctacggcgcggaggcggttctcccatccgagctcaccctgaggtcacctcgggccaccatgtactgcgaggctgatcaagatcagcttcgcagagatgacctcaactacttgcaagagcgaaggcggcgcgcggccctccgagccgcgcgctaccagcaaagcctgcggcgcttccatcagcgccacgtccgggcccgatcactctgcgtcgacgacctcgtcctatgccgcgtccaaacgcgtgctggattgagcaagctctcacccatgtgggagggtccgtatcgagtgatcggcgtcccccagccgggctccgttcggctggccactgtcacgaccggaaataacccaacgggcattccttacgtgcgtgcattaatccttgtcccaggaggcaaggtacaccaaaagttgatacaaatcagagtttaacaagccgaagcgtaaatagttaacttattacatgggcagcgaaggcccagcacacacaaagacaaacgaaaaacagcggaagactagggcgacgaccacaggcgcttgacggcaggcacgagctagacaccaaagccttcatcttcatggagctcctcttctgggcttgggaaaaattgagcaagactgagtacaaccaccgtactcaacaagacacacccacaaatgcagaataaatgcaagggagtacaagggaattataatataaagggttagggttgcagtaaacagcatttaaagacatttagttgctcaaagctattttgtaaacccgatcctagaactatacaatgttattaatcaaggtcgtgaacccacacgaacctgccttaacccaaggcctatgatgattcagaccgaactggcaacccgaccctgggtcccagctcgtcccaagccaacccaggccaaccattccacattttagttgttaagaaggttttaagaattaaaacactaacttgggtacattgctcggcttgcccataaccgagggctcggctattcgaatagattatactctgatcagaggtgtacatctttacccacaagacacatcttcctcacgtgtaaccacgtgccacataccaccacggtatacagacgaaagacgtgacatagtttccaacccatcctagccatagacaagagtaccgacccaatcccgcctacggccggaacccccgggacaggcaggcaagactgagcccccagcagcagggcaccaaccctctgccatgacatctcgactaccgggccgcagctcgtgtagccttcatttgccctggagaatgtccatcgatccccgacttcatccatctccaatccgtgtacttttgtttatgactagactgagccacaaactaagccttacccactagacatgtggaagtacggtagtgctttgcaacagaggcccgaagaccggtccttatatggccgaggtgctaccatcaaaaccatgcaccccgagcccagcctaaaaccatttttggggattttgaatagagggggaggtgtgaaaccaattccacaataaaccaacaattccagggtgtccaggtgatgagaatatcccaaagtctagagttgtaaaaccacctaatgttgtctaatttaattgcgaagcatctacctaaatttaaactagggataccacgagtagagtgtccactagttgaggttttgtttagtctagggtgaacaaggtaataataataacaataacaataataatatggtcataacaaaggtaaataggcatggctaaataaaacagtgataacgcgggaatttaaataaagcgataatgcaataatttaaatcaacataattttacaaactgggattcaatatgctcaaggatgatgtgacttgccttgctcgctttcccaaccgacggcttcgacttccacgaagagcggatcttccgaagctgcagcgtctacacgaccaacggaaaagaaaaggcttttactctaataaactccacataacagcagaaacaaagcacaaaaatgggttcttgacttcttaaggaaaaattagagacttgaacggtccaattccgagttcaaatggccaagttatggccatttgaagtttatatgctctttaaatggatatttgcgaatttcttcatttaaattttaattaaaaaacgggtttattgcgtcagccgagggagagggcgcgtggaccgggtccacgggagtggggcccacgcgtcagcctctcggtccacggtggaccgggagcacgcggctggcggcggccggcgccgtgggtcccacgcgtcagccgcacccgcgggcgcgggcggctgatggccgggcccacttggcagccgcgagggcgcgcccgaaggcggcctcgccggcacggccgacgggaggcggcacgcccgcgccccgatggtcaccgccggcgaccaccggcgcggtggagcggcgcccgagagagcggagaggagaaggaagcgaaagggcggtcttcggctcaccccgggtcgacggcgacgacgggaacggcggccgaagcggaggaaggcggcggcgcggctcgggacgacgaggacgacggcgctccggcggtcggcgagcgaaatggaggagcggccgaggtcgacggggacgcggcgaagccgaaggaggtgacgccgagacgggaggatgtccggagcgacgacggcggcgaaccgaagctcggcggcgacggcggagagaagatgcgacggcgcgagcgcgattccgacggggagagcgagtggcgaacggcggaaacggaggagagaggcacggggaacgtttatatagggttgggagtgagggaaggcggccggaggagatggaaaccggcgcggaggatccggccgccattgattgcgccggcgaggtttgcgggattgaatccggacgaatccgagggagagagagaggggaaagagagggaaacgggagagggaatcgcggggaataattcccccctcattatggcgcgcggggacggcgggatgcggcggattcggcggcggcggcggcgctagggcacgggcgagcggcgggagcggcgggaggaaggcgatgacaggtgggccctacccgtcagcgagggcggcgggcgggcccgcctgtcagcggcgcgcgcgcgggggaggccgatgggccgcgggggagaggagagagagggagggagagttgggccgagccggcccaagagaggaaggggggaaaagaagacttcttttagggtttttcttttttataaaccttttcaactttgtttatttcttttcaattattatttgtgctctgaaaattccactaaaatttatttacgcattttaggcttttaggaaatatacaaaaatcctccaagccttatttgacttttaaatttgcacattttaattgttggaggctttcacatgaattttaattattctcggcacaatttcgaggatgtattttagagtcgttttgggacgtgacaaacctaccccccttaaacggaatctcgaccccgagattcggaagaactggcgaagagatctggatgggctgccttcagctcgtcttcacgctcccaagtagcttcttcctcggcgtggttgctccactggaccttgcaaaaacggattacccggttcctggtcctgcgctccatggtgtccaggattttcactggcctctccacgtaggtcaaatcttcgcgaacttcaatttgctctgagtcggcctgctcggatggcactcgaaggcatttcttgagttgcgacacatggaacacatcatgcacgttgcccaaggaggcgggcagctccaactggtaagcgacttctccgcgtcgagcaaggatacggaaaggacccacataccgaggtgcgagcttccctttcgtctgaaacctgtgtacacctcgcaatggcgtgacccgaaggtatacaaaatcatccactgcgaattccaggtcacggcgacggttatctgcataacttttctgccgggactgtgccacctttagattatcccgaatgattctgactttagcttcagcttctctcaggatatcagtcccgaacacttggctttctcctacttgatcccacaagagtggtgtccggcacttgcgcccatacaacgcttcataaggtgccatttgtatgctggcttgatagctgttattgtaagagaactcagcataggggagactcttatcccaggtcttcccgaaatctaggacacatgcgcggagcatatcttctaggatctggttcagacgctcggtctgtccatctgtctgcgggtgataggcggtgctgaagtttaatcgagtacccagctcttcttggagcttcttccaaaagtgagaggtgaattggcttcccctatcagatacgattttcttgggaacgccatggagactcacgatcctagcgaagtagagttcggctagcttgttccctccataggtggtcttcacaggaataaaacgagctaccttggttaatcgatccacaactacccatatagaatcatatccgccttgggttttgggagtccggtgatgaaatccatcccaatttcatcccatttccattcgggtacttggagaggttggagaagtccggccggtcgttggtgctctgccttgacacgctggcacacgtcacacagggccacaaactctgcaatttcccgcttcatgctaacccaccagtatttctccttcaagtctaagtacatctttgtactgcccgggtgaatggaataaggactttcgtgagcttcctgaagtatcagctgtttaagttctctgttatctggaacgcatacccgctttccgttccatagggttccgtgttcatcctctgtgaaaccagcggctttaccctgtttcatattcttgaggagtccatgcatgtccggatcattcttctgagcctcgcggatttgatcgagcaaggtggacttggcttccaacgcggccaaaaatccacgaccaactatgtttaggttcagggcttccatctgttggttaagttcgggtggaatgccacggacgttaagagtgttgcaatggctctttcgacttagagcgtcggcaaccacgttggccttaccaggatgatagtgaattcccacatcatagtccttgatgagttctaaccatctcctttgccgaaggttcagatccgactgggtgaagatgtatttcaaactcttatggtcggtatagatttcacagcgattcccaatgagatagtgccgccagatttttagagcatgaactactgcggctaactccaagtcatgtgtagggtagttgccttcatgaggtcgtaagaaactgcggacttgagtaactgtcttgggttgcttccaatcggtgacggcggtcactgtttcgggatccacagcaactcctttagcagatatcacgtgccctaagaatttgacttcggacaaccagaactcacacttgctaagcttggcatacaattgatgttcccgcaactttcccaacaccagacggagatggtgttgatggtcttcctctgattgtgagtatatcagaatgtcatcaatgaaaaccacaacaaacttatccaagtattccatgaatactttgttcatcaagttcatgaagaaggcaggcgcattggtcaaaccgaacgacatcaccgtgaattcatacagcccgtatcgcgtggtgaatgcggtcttcggaatatcttcttcacgaatacgtaattggtgatatccggaacgaagatcaatcttggagaatacagtggcacctttaagttgatcgaatagatcatcgatccggggaagagggtacttgttttttatggtgacttcattgagagctctgtagtcgacgcacatcctcttcgtcttgtctttcttctctacaaaaatcacaggagcaccccatggggaaatactcggacgtatataccccttttctttcaattcttccaactgtttctttacttcggctagttcatttgctgccatacggtagggtcgcttgtgcagaggagtggttcctggagcaagatctattcggaactcaatctctcgcttgggcggcataccaggtagttcttccggaaacacttctccgaactccctgacgatggggatttctgacagtcctatctgatgaagttctgaacttctgacagaggttgggggtgcaaagaaaacaaccggttgtgccggtcctcggtacagagtgacagtgcgtctcgcgcaatccactactccttggaattgtgccaaccaattcatcccaagaatcacatccaagttcttggtgtctaacagaatcagatccgagggaaaaggaatcccctgaatttctatagggacggcagggctataatactttgctgtcataacccctccaggggtggtgatgagcagagggtttctaagcctttctacccccaactgatttctccccacgaatggcacagatataaacgagtgggaagctccagagtcgaacaaaattgtagcagggatggaatgaacgaggaacgtaccaacgatgacgtctggagttgtcagcacgtcctcggccgtcacgtgattcacacgaccccgaatgacgtccttaccaccgttgttggggcggggaggcgcttggccttgctgacgccttggcttcgggcatttatccgcaaagggcccgggctcgaagcagttgaagcacagacgctgcggaccttgagcatccctgcggccttgaacaggctgcacagttggcgtaggaggacggggcgcacgagtcccttgctgattctgctgctgctgcagctgtgggacgcgcaccacgaattgaggtcgaggcgcggggcgaggttgctgctgctgttgttgttgctgctgcgaggaggatccccctggatagggattggtgtagcggaccctttggttagcaccctgctgattgcggaaattcgccaagcgacgcttgtgcgactccagttccttgtgcttggcttccaagcggatgctcttgtccaccagtcgttggaagtccggatagtccccagagactagacggacggacagctcggggtccattcctgccaagaacttttcttgcttctcctcatcttcccgcacatcctccggagcgtaacgggccaggttattgaactcatgcaaatactccatcacggagcggttgccttgcttcaactctcggaattcccttttcttaagggccacgactccagcgggcacatgggttcttcggaaagcggcggtgaagcgagcccaagtaatcggctgtccctctggctgcgtagcctggaagtggtcccaccagagagatgcgggcccctgcagctgatgggcggcgaagacgactttctcctcatcgctgcactgcaccgtgtctagctttttccccacggcatgcaaccaatccaacgcatccacggggttgttggaactggagaaggtaggtgggcggatgcggaggaactcggcgagtttagagtgttgtgggggtggtggtggagcattctgttgtggcgggttttggaggtggtggaggaaagcattcatcatgttggcttgctgggcgaggatttgggtgagaatggcgttggtgtctggtggtggtggtggaggcggaggaggaggtggaggtgggttgccctggtggttgtggttgctgccttcaggttggttgccatcaccggtaacagcatttctcctagtcgtcaccatctgaaaaccccacacagaacccgcaaacagagagagagctaacaattaaaactaaccacccacgactaccataattcttgaatttattactgctattaaattggttcattaatgttcaagttgcttaggcgaataaaataaggcaggctccgacacagttatgccacacaccggcataaccatgccccacacgactcaacaagaagacaaacgagaaagaacacacgcgcaagcctactaactgctcgtctactgctgcgacgggccagggcggaaggtgagcaacagcgcaccctccgtgctaccaacgccggaggcttccccctcctggggaaccacgggcgcaggctcggcacgaggggtctcgacgaagcaagtccacgccagggactgacgaacaagctcgggcctggaggtgctcttgcgggcggtgatcttctggctgcggcagacgcggcgacgcttggggcggcagatctctccctgggcgatcttgagctggtgcagctgcgcctccactgcgtcgaggtccttcttgagctgcaggttctcctgacgcagctccaggatcttcagattgttctcgaccatcccgcgacgtaccatctggtggaagtcgatacgagccgcgtcgtacgcctccaccatgcgcgccaggtgcacgatggtagcgtcatcctccgagctagcatcccggaaggtggcgtagtcgcgggctcctccgcgacgagggtggtagcggtagggcgagtgctgcaactcgtccgggtagcgctggtgaagagtgccgatggcgaggagagcggcgctctggcaagcggcggggaaggagtctccacccgcggtgactgtcagcgaagtccgctcgggagagccagagaggatcacggcggtgacctcccaaccagcgtggggctccgcgtcctcaccctcctgctccgggagcggcctggcctggtagtccaccccatggggataccctaagaccacgcacatgccccgtagctccaagacgaagccagtcatgtccaaaccacgacgggtgacgctgccggccatctacaaacaaaaacaaaaaagaaaagcaacattttaaaggtcagattttgatggtaagtgaagcagcaagacagagagagactagacagttttcacaaataacaaaggatttttatttttgaaaatattgctaaggcttgggatctacggctcgtcctagggtcaagggtggctctgataccaacttgtcacgaccggaaataacccaacgggcattccttacgtgcgtgcattaatccttgtcctaggaggcaaggtacaccaaaagttgatacaaatcagagtttaacaagcggaagcgtaaatagttaacttattacatgggcagcgaaggcccagcacacacaaagacaaacgaaaaacagcggaagactagggcgacgaccacaggcgcttgacggcaggcacgagctaacaccaaagccttcatcttcatggagctcctcttctgggcttgggaaaaattgagcaagactgagtacaaccaccgtactcaacaagacacacccacaaatgcagaataaatgcaagggagtacaagggaattataatataaagggttagggttgc
